United States Patent 7,868,149 (PLANT GENOME SEQUENCE AND USES THEREOF) - sequence listing, part 67

SEQ ID NO: 36649 - DNA, 46999 bp, Oryza sativa
  unsure (1)..(46999): unsure at all n locations
tttagtcaaatatgtattgcaaaagtttgggctgcacatacacggttactaatttttactaatcagtaaaatctaataatattgatatgaattccatatttaacatccatcctaatgcagcaaatcatttaaagtataattttcaaggcaatcagacaaatatcctagtctaggtttgaattgtttgatcatgtcaaggtttttctactatcatactatatacatgggatacatggcccaaaacttcataaacatgaatactatgattgcggtcattatccaactgttttttattggctatcctttctgatgtgtcaagcagtccaaaatatataattagaatactaaatagaatacaaatttaaccataactgaattcaaaagcacatatttaacccatgatgtttgtgctacaaataaaccttcttcgtacctcccacggacaacaggtgtttccaaccaattattcacatcttataatcatggccatatcacacttatctcaatacacaagaacccacagccagtttactggagtaaatagccacaaccctgcaagttactcggtctagtacgatccataatagggaggcatggttgtacggtattacatgagcgaacatcccaaccaaccgtccttaatcaactcagatggtgctacgtgcatccgaaataagttccataattagccagatcatgtatgataatttatgtttattaccattcccaatccaagcatgattcattcccattcacctatctcaatcaaccagctatttccgttaactgcataccattgtcttctctatgcatggctaagcatttattcaagtagtagtcccatagatattacccatctactgtttgacaaggtatacaagatcaataattgaaggcaagatgcaaatagcaataggataataaactctacccgacatatttgcaaatggcgatgcatatatagttttaaatcaaaacatgcttttgcaaattgggttcaacataaccaaaatttagccttgttcctgtgctatttattgaggctcttctggttactccttgagctcatcctgcacatcagaatttagcaagaaaccaagagacaaataagaaccaatagataaataggttacaaaactaggaaaacttctaccacggtaaagaaaatgttgtgagatgaagtggtacactgcacattgacaacattcctgactataggttacatttatgcttaacttcaaattttacttgtttgctcactgaaactgtcctcaattttcattcaatagtagagagagaatattggactaattgcattaatcatctaggacagtgtatatatagatagagtacagagatagaagataaggaaggactctaaacaaatcaatcctatctatgatatcatagtttttttaatatataccaatcgattgtttatctttacaggattttggtcttaacctcatgaaactaaaccatcagaaactaactatagagttttgttgatttcacaaatgcgcttcttcaaaaataccatttatgcccaaaagaaatattccgcaagcatacaaaaaaccattgtacctttcacttgggagtattgtatcgaatccacaaggatcctttggtctaggtttcatgttactacttctaattaaacaagctaactaaagtcataatactatgtttcttgcttcaagtacagtagcaccaccaaagaaagggaagagaaaggggtgctaatatgccaaaacacaccaacttaagtagagctaacgttgccgacttttttttttttgagaaacacagtacaaacgcaggcgctcacaacgtgcgcacactcacccctatgaacgcacacacgcacaccctacccctatgagcaccttcggaagactgggctggcatatcttgagattgacgaagtcaccacaggcgcctcgctgtcgacgggtacgttgcctaccactgaaagaataattagccgtaaatgcgagcacccgtatcaaatctaggatttaaacccgggtgggctggtccaccacaaggaacctaaccagttgagctatgctcactttgctaacgctgccgactttaaacaatggccggtctagtcaccacccaactgactacttcgtccaattctctatcatgtattcctagataaaaacgatgcccaagcacacatacttgtagaaataccactagaattagttgcaacagtgaacagaggaagcaagataaataaagtataaagactttatctaaaatagattaggagccaacaggctcttatagtggtaaataaaataatgaaataaataaaaaagtagagttgacatattaaccgaacaagaagattgaaatgactcttccgggtcacttcattttattttacgataagagtggtcacttcttatatagtggaaattggaacacacttaaattcttcctctcatgttttcttcgattgtcgcatttcctacttgccatccaatagactcttcacaaaattcatgcgactctaacacctatagaaatttacaatatgtaaaaaaaattgcattcttcttattcatgttttcaaaatcccgcatttccaaggaggtctaatgtgactgatattgatccctagctacattgcactcactttgtccaaaataaatcaactcataggttcacatgttttcattgcatagagaaaagatcaaagtatccttcattaaaacaaaaaagcactattgatggttggtggtaagtggttttcaaaagatttaacttctttagtcctaacgcttataagaaaagagaaatcaacttattttaggacaaaatttaaattctacaaatcaacttagtcactgtttggcatattccacgttagatttaaaacttgttagttaaactgtagtagtgaattttagatttcatttaaaatatgaacaaaacaattcatctaaattttataacataatcatagatccaatccaaatccatgggttcatggagatagaaatacccaactaaaaaaatcttatatctaaagctactcacaaatattacgcacatacatgtaagctttcaacagaatattagtgaaatcaaatatatgccctagttttcgtctattaaagtatgtgttagatgacatatttacagggtatgactgtgctggatatgactgtgctgttacatgtgcaggaatgtgttcgcgtctatcatgcaatgtaaaaaaaaaacatagccatatttggggatggtgaaaagtgtgcctacaactatcttcaaaacaacgatggttacattcactcgattcgcatgtgtgctcatctctgatgtacgtccagctgtcctgctccaaatttcgttgttactcctctcgttgcgctgcatgtcgatgaggagcgcttcgtcctcctccctcccgcgtcaaaaagagaaaaaaaaaaaaccttacaaaactcctcctccaccaccacctcctcctcctcccctcctccctcctccgccccacccggcgatcccccccacctcccaagacgtcttccccggcgtcctacctccgatcgcgatcgcgggcgcggtcgcggtcgtgctcggacgcggcgtccatgtcgtcgtcggcgtcggagcagccgcgcggggaccaggtgtggtcgtcgtcgtcgccgccgcggtcgtcgacgcctcccccgcagccgctcgtggggggcctgatcgagtcgctctcgttccggagctgcgggttcggccgcgccgccgtctccgcgttcgagaaggaggacctccgcgcccgcgccgcgctgccgcagcggctccgggccgcggtccacgcggcgctgcgtgccaaggacccctccgcgggggcgttcgcctacgtcgccggcaacgcggctgcccggggtgggcgaggaggcggcggcagcggcggcggccgcgaggtgtcggcggccaacccgtggttcgaggtcgcccacgacgacgcccccgagtcccccctcgtcgcgttcgtcaacccccgcagcggcggccgcctcggccccgtcctcaaaacccgcctccaggagctcatcggcgaagaccaggtcaacacctcctctctctctctctctctctctctctctctctctctctctctctcatatattttgttgcgtggcatgatgtgcgggtgaggcattttgtcgagcggttggagagcacgacgtgaggtgatgagatggtcggcgtcgggcgttacgtcgatctgctgtcgcggtgcggcggcgacgcgcgcgcggtcgcgcggatccaggcggcgctggtcacgtcggggtggctgcggcggagtgccgacctccacaacgcgctcatccgggcgctcgcggggtccgcgcgcccgcacctcgcgctcccgctctacgcgcacctcctccgcgcgggccaccaccccaccccgcacaccctcccctccctcctcaagtcgctcgcgctctcccccgccgtccccggcgcgcggggcctcgcgctcgccgtccacgcccacgccgtcaagctcggcctcgcggggttcctcctcgtgagcaacgcgctcatccgcgtccacgcgggcatcctcggccggctctccgacgccctcgtgctgcttcgcaccgcggcttccgtcgacgcctccacgttcaacacgctcatcacggcctacgcgagggccggccgggtcaccgacgcccgcgcgctgttcgacgaaatgcctgcgaggaatgctgtgtcgtggagcgccatggtgaatggctacgtgcaggctggggacgggagggaggcgctggggttgttcgcacggatgcaggccgatggtgtccgcccggatgacacggtccttgtcggtgtgctcgcggcatgcgcgcagcttggcgtgctggagcagggcaaatgggtacatggttacctcaaggcaaataacattaggatcaccgtgtttttgggcactgcattagttgacatgtatgccaaatgtggtgagatgcagctcgccatggaggtgttcaaggtgatgaaggaaaagaatgtgctggcttggaccactatgataaaaggcctggcaatgcatggtcgaggatcggaggcattggagttattctcccagatggagagattaggtgtgaagccagatgacattgccttcattggtgcattgtgcgcatgcacacacactgggttggttgacaaggggcgggagctttttgattctatggtgaggaagtatggtatcaaaccgaagatcgagcattatggatgcatggtggaccttctggcacgaaatggcttgctcaacgaagccagagagatggttgagaaaatgcccatgaaacctgatgccttgatctggggtgctttgatggctggctgtaggtttcataagaatgttgagttggctgagtatgttgtcaagcattggattgaactggagcctgataaaagtggcgcttatgtgcttctgggtaacatatatgctgcctctggtaggcatgcttctgcaagggaaattaggcacctaatgcgtgagaagggagttgataagacaccaggatgcagcactgtggagattaaaggagttattcaccaattcattgttggagatctgtcccatccttttatagaaaagattttgtctaaatgggatgagattgatagtaggataaggttggaggaaggttatgtgcctgataagaaggaagttctgcttgatattgaagaagaagagaaggaaaatgcactcagccgtcatagtgagaagatggcaattgcatttgctttgattaacacaagtgatgatatgcccattcggatagtcaagaacctcagagtttgccatgattgccatcatgtcaccaaacttatatctaaagtatatggtagagaaattattgttagagatcgaacacgattccatttgttcaaagatggcagttgttcgtgcaaggactattggtagtaattaacagatctgtagaataacatcagtacttgattcatgaagtagttcagtcaccaaatgaaaaaaaaaaatctctttcatcttgaagtatacatcaggggtcatgaatgaagaatgtcaaggtgattaaggaataaaactccctgctagttctaatctgcatatgtagtcaggctgccactaagctaatttccatggatattattgttcatctttggtattgaggtgattgttccagaacaataatataattctgcactggtagcatgccaaatccaattgtgaaccaagcatactgcattttttaaatctatcatgatgtatgaatctggtacattagtctagatatgctattgttccattgttatcacgcttatacaaaatagcactacaaacaaaatatgggttgatatcgaatacgaaatgctagggaaacacatggttgaaccctatggaatagagtagaacagttaatttacttgtgttggcatgagaaatttggatacgatgcagggcacataagcataatgagtgcatggaatactttcatgtccaacagttttccaaccaaggaaaagtgtaatagttagtcgtagtcctcaacttacgcaaatgctggaaagattctgatgatccatagtcccatgcaaaacaaatgcattgctttagccttttctgatatgctctgaactttcactaaattagtttatctcatactagtctgaattggctttacttcatacacttttatttactgtcatttaacatccattcttgtaagcaaatataatcatttttagttaactacactaaaaacatatatgaaaatgcagaatggtaggatatcgcttaaactacaaattcatcactggccataaataaatattgaagtaggtaactgtaccggctaattgaccaaatcccactttattgatggttcagttccaactaaattgttgctctgcttcggttaaatgcccttgaattatttctgcaaaagaactaaaatgggtcaattggacacctcaacccaaatcacttgatttcctatagatacttgctctgttaaagaaagtttgagcacgccaaatcacttgctttcctattcttgttctgttaaataaagtttgagcatcatacaatatcttcaattattgggactgctgttcttgaaaaattaaaatgattaaggaataactgctttgttattaacaaccttttgtcagcaggtttttgatcttactgttgtgaagccttctgactttgtgcaatatgttttgggttgcttggaacaacttgctgacgctggtgatcacagtgcaaagtccattcgccataatctaagagtcatggtatgtatgcattttcgtagcttccatagctgtaaagaacacatcattattattctgtgtttttcctgagttgctgaatactaatcacatcatctcttatttttgtcattgttgtagtttcacaaaggtactaaattgtaaaaatgtttttatttttgttctttcgtatgatggaaaacctgtactagtcagcagaaccgttctcatattccaaaagtttcagaattctaaatacttacagtttgtaacctacctaggttgcaggaggtgatggtacagtaggttgggtgttgggatgtttaggagacctttatgttcagaacagggaaccaattcctccagttgctgttataccacttgggacaggaaatgatctttccaggagttttggctgggtaaaacgatctctttcttgcactctttccgtcttcctatgaagctacttactgcaagttttcatgacctcacagttattttcagggtgcttcatttcctttcggatggaaagcagctgctaaacgatctctgtacaaagctatttttggttcagtttcttgtttagacaggtgacttctttactttgttggccagttattttaatcttctgtgcattctggttgcagtttgatgatgatacatcagtatttttgttatgttaagaaaccttatttgagctggttaagtccgcataggtatcactttttcgcaataccatggtcccagcaatgtactcctctatttccaaatatatgtaattttagacactaacatgatcccaaacatacatcggaccattacctttttttctaattacgcgttagtacttgtttattcagcgtattgtcccaatatttctgcatttatgaccaagttcctccttcaacatgtaatactcacgtccccagtataaccacttccagttgctgattaattagttatttctgcagttggcatattgttgtttctatgccagaacgaggagatgaagaggaagaactggattttcctcactcccttaggaatcttggagagtgtaccttttatgatgtaattattttctactatcttatatattgaaatgttgtacaaatgcattggaagtctaccccgtgtacattttatatcgtactccctctggtcataaatatgacatgcacgataagatttggtaaaacttgtgaaactttgaccattaattttatgagaataagtttatgatattatgatagtatttttcaaggcaaatctatgatatcatattttggttttaaactaagcattatatatattatagatggtcaaattttaaaacttttaaccatatattttcctaaatgccaaatatttatgactagaggagcaattatttttatactatcttcttcaagtgttgtacaaatgcattctgcttgattaatacaagtctaccctgcaggacggcactgctgaaggggagttgcctgaaacagtttcttgctttgatggcgtattctataattacttcagcataggtacaatttttacatgataacttatagttgtgttcattattcaatagtgtgtttatagtgtattccaaagtcctagatatactcttggccacacataaataatttgtattgtcatattctacatttctaagcatctattatggtttcatatgatgcatctcatcaagggaaagtatcttcaagaccattgtgctttgtcacttatgctaataaccttgtaactaggtgttcgaaaaattctcctttggttattacattctcataaagtttttaatctacgatgtatgtttgtattgtttgttgtgatgttctttatgcttattttggttctataataaacaaaattaatgcacattgtagcactacaattggaataatgagatgaattatatctcagttatttgtcaccccttacattcattatcagtgtcagagaaagctaccatagaagttatctacggtgtggctttctttgttgttactatatgttgtcattttcaatatgcatattacatatgttctgaagggaccttgaggatgcaaattctgttgtaatgcaggtatggatgctcaagtggcgtatggatttcaccatctacgggatgaaaagccattccttgctagtggtcctttatctaataaggtatgcactcagggatgagatttccatcatttatggcaattcaaaagcttttcagcccaaactcatgatattgaattagcatgtgctcattatctgtctcctgttctttgtataatcataaagttgacccttgaatgggatcaagattgccgtctatagacgcaatgttaaatggtacaaattatttaaaagaaaagataaggggaggacagctgaagaacagtgggcccattatattaatgaattgttttcttttgggtatccagtgtattttctgctagctaaaagcaattcctgacaagaccagcttgtactgtgagtctgtgactgattaacaagaagaatgtccgtgcaggaggggcgtataggagactggcaagggacacaggggaataggagattggataactttttccttttctttaaactattgaataggagcatcgccctaaatgagaggccctaataaataaaattttaagtacaaagacaatgaaccataataaatataaatatatcatggatgatacattaaatggcttcaatcctaagcaaagggtttcaattgggatgtaattggaacgtggtgtgctgcttctgacttccacatgccggccgtaggtctggccgcacatgacattacctttttcaacacttatcgcaactcgcaagctattaattttgatctgatgtaagtaacataggcttccacatattctcactgtaaacatatatacatcaaatagggtttgatacatgggttgaagcacgttatttattgaatgatggttcttataagttctaattgtcagttgatcgggtacataattgacgtttgaactttgtcatgataagccttctgttctgttgatgaatatgataaataatatttcaacagtgaattttttgctaactaaattactgattggctgattttatgacagttaatttacgcagggtatacctgcaagcagggatggttttttacacaatgtgtcagcgaccctgaactgaggtgctgtatcccccctcgatttagtttaaggcatacttatgtttgactgatatctagaaatctggaaagtccatccatcatttgattattttagtgttttctgctctataccttttttggggaagaaatgatccgatgacaatgtgttttccttacaaagagcaaatatactcaagtttttcttttgaccaagtgccaatcatggttaattgattatgttgtatcaatttgtaatgttctaatgatatttatgaaaacttataactttctctaattgtatttacttttttttcattctgtccaaactcatcaaggttgtatttatacatagatatgaaatgtttcttttctgttatcgtcttccagatactgatttgcaaaactgagattagaatggcagagacaggaaaaaggctcttattttgattctcatttcatatatcaggggattgacgaacattattcgtttatcaataaagaagttggacagctctgagtgggagaacatccctgtaccatcaaggcaagttgaagtttttctttcctatttgttattgttatatgattttagttccagatctgaaattcagaaacaataatgatccttgcataagtcactgttctccagtttgaactctgcagaatactattataaacagattactttagtagttctgatactattatatatgggcacactaagtaatgaagtctcacggctgaactagaaattattcttggcacaagtatagaggatacagtttatattgagcagccatgttgtacttcagtgtcagggctattgttgcattaaaccttcacaattatgcaagtggaaggaatccatggggaaacttgaagcctgaatacttggaaaaggtgtgctgagtaaattgcttgtcatttttatgattgctttattggaaaagcacaatagcctgaacttcctcgcaaatactaaaaagcatgctatttttcttaactggaatatcatcaagagaacttctatcttttttatgtaaacagagaggatttgtcgaagctcaatcagacgatggtcttcttgaaatatttggattgaagcaagggtggcatgcatcccttgtgatggttgaactaatatctgcaaagcacatagctcaggtacttttgctccctgcacaagatctgaatagcagaaggtattttaatgcattactgttcaatttggagctcaaaggttaaaaatgtagtagtaaatttttcgctatgtcacctgtgaacaaacatcacattaggtaaaaaaaaaaaagaagtattacaacttagttcaacaggaaaaggcatcatcagtttagataaacagctactttgcaaattacaactccagatggcattcgacactgatatcctcaaaattatttaagcgacgctacctactgttttcaggcagcagcaatacgattggagatcaaaggtgggcaatggagggatgcatacatgcaaatggatggggagccatggaagcaaccattggaccacgagtactcgacgttcgtcgatatcaagaaggtcccttacccatctctaatcatcaatggtggggatcgttagtaacaacaggagagccagccccagatttctttgccctgacctttgctagagctgccaaggaaaaattttccaagctggattccaacttggaagccagacttaaccctgactattcttaactatctcactgtatatgaagttttgaggatatgatatttttgcaggggacgcagccatatacccctgtgctttgatccaagttctcaattaacactgcatgaagtaattgctacatgcatttttttttactaaatgtacagggaaaaaaaaaagaacatccggactttatgccacgtttttgttttccaagaaaatgagcactgttttggggtcacattgtgtagatatagctcaaggattgcatcacatcaactataggcgttgttcgagctttcaaccatcccttctatatcgcgagaaggataggggcacagggaagttgtcagttcaagtataagtgactcaatccatcaaacttaaattctaatttagtgcaaatttaatgcaaattttgtgaagtccgcagatttatccatagccaaagctatgtttaattccacgccaaaattagaagtttgactaaaattgaaagttaatggaccgctccgttttccgtgcgggaagatagattcccaactcccgtatccgaacacaccataaaggttagaccgtcctctttatataccgagaaatttggcactcgagcaccaacccatataacaatgccatacagtaatgcttccccgcactgtgtggttcctacaaaatttgtccaaacccaatgaaatttctgaagattttaatcaggcctgcgtattaaactcaatccaatttatcaaccaagcaaccgtattcatatccccagaaacaaagaattgatcatcactttcccattccattgggaacacttctcagcactaacattgttttcattggtttgtctgagctttgaatgaactgttacaagttgaagttgaagtgacgtagtacctccagcagccgcctcatggcaatgtaaacctgactatcttttacttcatacctctgaagagcagcttacctttcctctgcatccacgagcttctcttataccaaacgaatgccactcaagatcattcatcatctgctacagaaaaacaaaagggctttgcagctatttctattttattgtcaatatgttagctactctctgattggatactgagtactgaaagaattaagttaaaacagcaattgatagttgcatgcttcaacagcaattgatagttgcatgcttcgtgctgtgaacacaatgctccaggtttccttaaatgagtatgccatgccatgatgtctatcaactgtccttccctgatgaacatgccatgacatgattgtatgaatcacccccattatgccacagtatcaaacttctagtcccattatgccacagtatcaaacttctagtaagaaaactcagttatactattacagaatgtcctgtttgcaaagtgacaatgacatggacacatgagatgtagcaactaaacacaagaaaactacagaatactgcagaatatccatgacaagcggcaaatgcacatctacaagatgctcgaaatgtgcttctcaaactacatatagaaaataaaggattccacaccaccagcgatgataatggtaacaatgcaaagtctatcagatgatgatcatgtcccagaaactccacctaataaagatgatgatcatgtccaagaaactccatgtaaagaagatgatcatggccagaaattcaacctaatggagatggtgatgccacatgacagaaacaagcatttagaagaaaatatgcagatgataatttagtaggatgctaaagttcaagttacatcccctctcagtttgaaggagctccatttagagagcccccaattccaccaacagaatccttccttcggccatagggatttttcgaaaatgttcaagacgttaaggacttacaaaccatataaaattagcaaaggaaacataaatatctaatgttaatgtaagtgattattttatttcattgagcaaataaaggatattgaattcgcattccaccacgaccagagctaggaataacagcaccctgtagattatggtgtacagctgatgcagcattcacatcctaaaatttaacaaacagtgagatgcataagaatgtaggataaggttaagataaaattacaatattgtaagtacctacctcaaactcaatgaaacaaacagtgttcctgtcttggcgcaacaccttcatttgtttataaccaggttgcctgaaaggaaaatgaataataatcagttagaactgttgtatctactttctagaaccataccatgcaacaccactgcacacaatagacaacgatattggcgtcgattcttacacgctgaagaggctccgcaattcctcttcaataacagtttctccaagattaccaatgaaaagggtattacagggagggttatcctttgtattctgaaaaagagaaatcaaaatataccattaatactagatttcagaaaactgaacagtataaagcagtcaaaatattgaccccaaacaatgtattctgcatcagcaatgcagcaaccacctcttatttttaatagcattacaatttattaaccaaaatcatgacaagcattatgttcaatgaaaaacaccacaagcatctttgcaaacaagactttatgtactcacacatttgtgcacatattacctggttattttttagggaggaacttgagaagttatagaggataggtaaaggcaacagagtctagtttatttttatcaatgttcatagttcaattatattcaagtggatgaaaaaaaggaagaggttgtctttgaatgatgttattcaagtggtttcgtcacaggttgtaaagtgcaggggccatagatttagacttctctatataagcaaatatgaattcatcatattatatcttacataacagttaatacaaagaaatagagatgatgtgcacacaacggagctatccaatgacctgtgtcaaatttaatcaggaaataatatttaactttcctaagattaagctcaaaaccaaggtgagatatataacataactccgaagtacctgaacaggagcataggcagttggacctggtacgggagaaggtgaagtcattgccacaggaggcactgaataggcagcataatgattgtaaggtggaggtgccgcgatataactgaatgatacacaaaagaaaaaaaggattatagagctccatagctgtgcataattagttgaaagaaagagcaacaaattaagaaatttaccctggagttccccacatggaaacagctggtgggggtggatgatatgggggagcagcataaggagaatgagtataatctccaccagtccgcaagcgtttactttggtccatagcatttgcatcgtttcccacacctaacataagccttaattaattcagcgcataatggatatgcataacagtgtagtaaccatttcatggagtaaatggaaataaacaacagcccaatataaggagtacgtggaacattattgtcaccaggtttcttcatcaagttatagtaattttatcacaatcactaattctataatcattagttcatctttatttcatttgcatatttcctaaagcttatatgaaatgctacaataacattttcaaagattaaaatttggcaacagaaagctttggtaaaacaataatagccttgaatgtgcttatctcacaacacagaactaaatcctgtaaaagttttatgaagccatatgaaaaccaccaattcacctacacattggttaaatgtcctgacctgcataggtttaccaaacagtttaaaggaagacatcaaagctccaatagcaggccacctttcccatatcgaattattctaatattacacataagcttcagaaaatatgcaacaagaaatgaactgcatattcattgccattctctgccaagcttcataataaatgataaaaggtgaaagcttccatgatacaaagcagtatgcgcaaacatggctacatttatatggaccaattccatccaaccaaaaatttatcaggttgatctgcacaacatgacagcgaaagcgagcgcacatcgacaaaggggaacgcacctctcttgacgaagaggttcttcttggccatctcggtgtgcagcgccgtcttggtctccgcatcgaagatgagatcctgcagagagaaactcgtgtcacaccaccatccacccaaaccctataaccaaccccgccatggagaccccaaagagagagagaaaaaaccctagcacctgcagcgcggccttggcggcgatggcgtggtgcgcggaggagaagagcgcgaaccccatgggctggtcgcccttgaagttgatctgggaggcctcgaacccggggagccagcggagcaggttgtggagctcccgctccttgacgtcggtggggagccccgtgatgaagatggtgcggacctcgtcggggcgggcggcagccgccgcagcttcggagtcggcggcggcgggctgcggcgatggtgtcgggcgcgcatgggacgcccggcacggggggtgacgcaggaacgtcggcgaccggggcgggcgcgcccgccgccggcggccgttgctggtggaacgggtggatcgttccggccatcggggcggcggcggcggaggggaggggaggaggtggcgcgcgggcacaaaccctaaccctagagagagattgggttttgggggtttcggggagagagagagagagagagagagagagaggcagcagcgcacgcagatgagatgacgaggtgaggtgaggtgaggtgcgtcctccggcccagcctagcaaagcagctttcagctgatttcaggcccttttggatcgaataaagaacatgcaaaattttctaacttgtgaagtaaccatcataatatttttttcactttgtatgtattttttagacattcagtgcgagtacgtggagtattgtcccaaaatgacacgttaaaaaaattggagtccatgccaagagtcaggctcaaagtcacgtgatccatcacgcgagtagggcagcaagtcgtggacaccactcagcgtccgtgttgcaggggttgttctctagtcacgtcgtgtgagccgtatggtcgcgcagtgtcttcttagtaaagttgggtccatttagttttgcttaattgagtaatatgtgatgcttgggcttatatagcagctaggaaaactcgttggtgtgtcaagcattgttcctataagagtctccaaacatcacctaagataaaaccatctctaaagatactatgtgtccataatgcaagctacacttgttaggatccataaataatttgcatatcggcccctagaattcgaatatgttcaattttaatttgcaaacgtatttaaagttatctattccaatccataaaaaaaattacatattacccctcaccctcatccccttgtacccacacatcattttccccatttgtctctccctccatgctagtgcgccattgacagaattgtcgttccttcctccgctctccacaccgccgactggatcggcacttcttcgtccagtccttgagatcgagtgacaactatgtagctcctattcccaccatcgctcctatccccctacccgggtcctctccctcctatcctctttccctgcctagcgcccctcctctccttcatggctacacttcaagccagggggcagcgatggtctcgagcatggctgaggaccgcccggcgatggagatggtgtgggcgaaggggagagtaaggacaatggggacacaccggcatcgttgtcccaaaatgacacgttaaaaaaattcgagtccatgccgagagtcgggctcaaagtcacgtgatccatgacgcgagtagggcagcaagccgtgggacaccactcagcgtccgtattgccggggttgttctctcgtcacgtcgtgtgagccgtatggtcgcgcagtgttttcttagtaaagttgggtccatttgagtttgctttattgagttatatgtgatgcttgggcctatatagcagctaggaaaactcgttggtgtgtcaagcattgttcctataagagtctccaaacatcacctaagataaaaccatctctaaagatactatgtgtccataatgcaagctacacttgttaggatccataaataatttgcatatcggcccctagaattcgaatatgttcaattttaatttgcaaacgtatttaaagttatctattccaatccataaaaaaattacatattacccctcaccctcatccccttgtacccacacatcattttccccatttgtctctccctccatgctagtgcgccattgacagaatcgtcgttccttcctccgctctccacaccgccgactggatcggcacttcttcatccagtccttgagatcgagtgacaactatgtagctcctattcccaccatcgctcctatccccctacccgggtcctctccctcctatcctctttccctgcctagcgcccctcctctccttcatggctgcacttcaagccagggggcagcgatggtctcgagcatggctgaggaccgcccggtgatggaaatggtgtgggcgaaggggagagtaaggacaatagggacacaccggcttcgttgtccatggttacatatctggccggtgggcatggtagtgacacgttgagagacaaggggctcctcaccagtggtcttgagctcccctagtcgccatcggtcaagctctcctcctcgctagtggtcttgaacaccctcgttctaagcattggcaattgacctgcttggaatgacagcatcagtgctggatcttcttaggcgggtggactcggcaacctattttctcatggcgctagcatggttggtcctcagcgacggctaccccgatggcccacgaagccgacaacctcgacgatgaatggtttgggagggggccggcagcaatgcagggtggagcgacagcttctcccaactcgtctcctcactcaagtggtccctacgccagacgttttgcaaggcaacgcggttgtgcttcctgcatgacacaaggaacctcatgaagccatggccctcacctactgtctcctccatgcctgctagtgtgctaaatggctaggtgagaccacatgtcatgtaggaacattgtgaatggtcttggctttaagattttttactttggacttctttttctctctttgaccctttttcctcaacattggtttcaatccacatggtgatgagctaagaggagcgaggtcatggagtaaatcatgtcggactactaagccggacatcgaggaaaagggtaaaatggttgcaacatgaaactctagtatacaagagagagtacactgtaagaaaaataggtccaaagtgaaagtgcgtctaccccctccccaccaaatttgttgattaacgataacacaattagaaattcctaatgcaactatctaaatgcttgcaaggtcaaaggtgtccccattatttgattgagaaaagatggcaataaactatggtaattcttgaatcatctcattttcttgactctaggagaccatactaataagagggatgctacacaacaataattcagatgtactcttgtgttgagaatcaagtttttgacgcatcgaaaacttccaaaatctcactgaacgcgagtctctaattgtacttcattgaaaacaatcgcaatatccaatcgattggattgtctgaaatgtcaaagaactttgttctatatttgattgtatgtttttgatcgaaaacttgtaatgttcaatcaaaatgctcgacattctggaaactccaatgttgcaaggaactcaactctctggttggttcaacttttaccatcagaatatccgatgtaccagaatgcccaatatttcattgaactcaagtctctctcttaattaaaatcttgcattggaaagtccaatagtgacatcggaatatccgatccgatattctttatagacatctaggatttggacttagctagcagacatataatacatatcagaatattagaccttgaagtcgggatatccaagatgggaagaaaatacatcccccctcccctcccctcccctccccaacaaccagattttgggatcacctatttaaacactggccctatccttttcttggattagttattcaattcactcaaacctgcttttggttagagcttggttctaatgttctttggatcttgagcatgggcgtgctctcactcactctctcaaatctctcttggctttcgtgcttcgattatttgtgtgtggatttgggattgaagacctagttttgtgctattctcttagatcttcagcactaggtttgattccaaggatttgttactcttgaagattgaggactctggatggttaggcatcactccctacccaccgattcatgtttggctataaggagaagtctgtgaaggcaaaatctcaccctcgcaagaaaacagataccccgagtagagatggagtgcatttgtgcaaccttgcaatggaagggttggaaaagacccggctcattgtgagctcctcaatggagagtagaatcccctcaaggatttgaactttgggaaataatcgttgtggagaaatattatatgtctcccataaaactttgttaaatggaatattgtcttgaatttaatgggcaacaaaaatcatctcttgaaatgctattgttagaaatagttttggatggatgttgagatggattaggcatggtaatcatgtttgatctactcccaaaccatctcaactagctccgccacgatgagtttatttgaaataatgcaatatcagaaaaccacctattaacaaacaaccattattccctcttttattctctccttggtttcacaccttaaatcatgcatgtctagattactagtttattccatccatttgcttagtgagtaccacacattcgatgtatgtgttatgttcaatttctactattattaatatgacatctaaagttttaatgttttgacttcaaattctatttgttatgttgttagtgctatgcaaccatctcgttagttatcatcctattagaactgaaattatccaagaagtgggccttttgagtcttttttttttgcacttttttcgattcaattgtgcatgtcataatttggaaacaaatccctaaagttaattgcatataataattttggtacaatattaatgataatcaatatgttccctgattattactgccacacttcttgcatgaatgttcctttgttattctatccctctgcttcgcatgcaccacacatagggagagcatcatctacatccaacgccatcatctcttggtgtcttatacaaagagatgaaaatcaggtcttttggcagtacgtatttgctgacgacaacttcactgtcttcatttcaaatttaaactttacttcaaatatcgttagagcactcataggtatgcgattatagtggttctatttctagaattattaaaatgacatttatggttttagtgagactctgtttgttgtgttgattatgtcattaatgctatgcaaccactctgtttgttgtgttgattatgtcattaatgctatgcaaccatctcgttagttatcacctcattataattgaattaatccaagaagtatgcgtttttaaggtgtattttacacttttttggttcaattgtgtatgtgataatttggaaacaaatctctagagctaattgcatatggtaattttggtattgtattaatgataatcaacatgttcctcaaatgttactagcgactttctcccctcactatattaccccacttcttgagtctaggtttctagattattccatccctttgcttcatgcgcaccacacatagaaagatcatcatctccatccaatgccatcatctttgtgcgtccgacacaaaaagaggcaaatcaagtcttttagccatacatgtttgctcatcacatcttcattatctttgtctgcaacgtacaagctaagaccgtgtattctcgtcgacgtaaagctctacttcaaacatcgttagagcactccttggtatgtgattttagtggttcgatttctagcattattactatggcatttacagtttcagcgatttaacttcaaactatgtttgttgtgttgatcaacttgatgcttctatgcaacaatcttattcattatcaccttactagaattgaaattatccaacaagtaggccttttatgttttttacacttttcccagttctactgagtatttggtaatttggaaacaaatctctagagctaagtgcatattgaaattttagtactatattagttataatcaatatgtttcctaaatgtaactatcgtctttctcctctcgctatattatccacttcttgagtttgggtttttttggttattccatccatttccttagtgtgcaccacacataggaagaacatcatttgcatccaacaccatcatctctttgcgtcccatacaaagagaggcaaatcagggtttttagaagtagatgtttgctcgcaacatattcattgttcttcttcacgacctacgcgttgtgaccgttttctcctcgaactcgactctacttcacgtatcgtcagagcactcctaggtaagtgattttagtggtttgacttctagcattattactatgccatttgtggtttcagcgatttgacttcaaactttgtttgttgtgttgatcgtgttgttagtgctatgcaactgtcttggttagttatcaccttactagaatagaaattattcagggagcaggcctttttagttttgttttcaatttttggttcaattttatgtatgtgatgatttgaaaacaaatctctaaagctaactgcatatgataattttgatattgtattaattgtaatcaatctgttccccgaacattactagtgtatttctcctctcgctatattaacctacttcttaagtctgtgtttctaggttattcctccttagtgcgtgccacacatagggagatcattatctccatccaatgctatcatctttgtgcgttatacacagaaagaagtaaatcgggtcttttagccatacatatttgctcatgacatcttcattgtcttcattcgcaacctacgagccaaaaccatgtaccctcgttgatttaagctctacttcaaacatcgttagagcactccttggtatgtgattttagttattcgacttctagcattattaatatgccatttacggttttaggatttgatttcaaactctattggttgtgttgatcatgttgttagtgctatgcagccatatcattatttatcactttattagaatcgaaattatcctagaagaaggctttttttacacattttttcgattcaattgtgtatgtgataatttggaaacaaatctctagagtttattttatatggtaattttggtactatattaaagatagtcaatgttttccccaaatattatgaataaaattcgaatatatacttttatttttaacgttttgcttttatatacatgcatggaaaagaattgtgaaaatatacctctaccgcagaatggagatgcgggaccgaggcagtgccgctcgctcccgcgtagcgtctgcacggcaccgtcgctcccgcggaacgtccacgcggaaccgttgctcccgcacgcaatgcctagctcccgcgcgccacatacgcgcgaccggcgcggtccggtgcagcggggacgcgtgacaggcgcggtcccacgcgctaacgacgcgcgaccggcgcagcaaagcaagcagcccatgcagcgcatgcattcacgttgcatgcattcaacggcgcggcggttccgcgtttccaggctgtgggatcgatcggtcccgcactgctgttttgcgcgactgccggttccgcggaatggtggtgcgggaccgagacagttccgcatgacccctatgcagtagagctatatttttgcaaaatttcattgcattggtatataaacgcaaaataacgaagaaaaaaaatatattttcaattttttttttcgtttgtcctctctctagattagaccacttcttattacatccttcttcttagcgtgcacctcacgtagggagagcatcatctccatccaatgtcatcgtctctttgcatgttttataaagagaggtaaatcgggtattttagcaatacatgtttgcaagcgacaactccatcaattgtcttcatccacaacctatgcgctatggttgttttctcgtcgaactcaaactcttgtttaaacatcgtcagggcactcctagttaagtgcttttagtgattcgacttctagccttattaaaatgccatttgtgattttagtgatttgacttcaaactcggtttgttgtgttgattatgttgttaatgctacgcaaccatgtcattagttataatcttttgaattcaaattatctaagaagtaggcccttttagtcttttaacactttttgggttcaattgggtatctgataatctagaaacgaatctctagagcttttggcatatggtaattttggtattgtatttattataatcaatatgttctcaaatgctactagtgtctttctctcctcattagattaactcacttcttgtgtctaggtttctttggtactctgtccctctgcttagcgtgcaccacacttaggatgagcagcatatccatccaacaccattgcctctttgcgtcttttacaaatagaggcaaatagagtcttttaaaaacatgtgtttgctcatgacatcttcattgtttttgtccacgacctatgcactatgacaattttctcctcgaactcaaattctacttcaaacatcgtcagagcactccttggtaagtgattttagtggttcgacttctattattattaccgtggcatttacggttttagcgatttggcttcaaactatgtttactacgttgatcaccttgatacttctatgtaatagtctcatcctttatcaccttaccggaattgatattatccaagaagtaggcctttaaaggtttttttttacaccttttctagttcttagtgagtatttggtaatttggaaacaaatctctagagctaagtgcatatggaaattttagtgctattagttataattaacatgtttcctaaaatgtaactattgtctttccatctcttttcttagcgtgcaccacacatagagagaacatcatatgcatccaacatcatcttctccttacgtcccatagagaggcaaatcgaggttttttagaagtacatgtttactcgcaacatcttcattgttcttgttcgtgacctgcgcgctacatccattttttcctcgaactcaaactctacttcaaatatcggcaaaccactcctaagtgagtgattttagtggttcaacttctagcactattactatgccatttgcaattttagcgatttgacttcaatttagtgaattgacttcaaactttgtttgtagttttgatcatgttgttagtgttatgtaaccatcttgttagttatcaccttatcagaattgaaattatccaagaaataggcaattttagtgtttttttacacttttttcggttcaattgtgtatgtgctactttgggacaaatatccggagctaattgcatatggtaattttggtaatatattcattatgatcaatatgttccccaaatgttaatgcatttttctctcctcgctaacctactacttcttgagtctacgtttctatgttattccatccctccaattagcgtgcaccaaacatagagagatgatcatctcatccaatgctagtgtctttgcatcccataaaaagagaggcaaattgttttttttagaaatacatgtttgcttgtgacattttcattggtttcatctgtgacctacgcgctaagattgttaactcgtcgaactcaaactttacttcaaacatcgttagggcactcctaggtaagtgattttagtggttcggcttctagcatttttaatatgccatatgcagttttagtgatttgacttcaaattttgtttgttatgtgtatcatgttgttagtgctaggcaactatcttgttagttatcaccttattagagttgaaattattcgaaaagtaataatttttctagcaataacagttaagtggcaatgggatgagaaatggagagatgagagagatatgataaggaagaagaaaggatgggttgatgacatgtgtgcctgttgcttttctttttgctaggtttgtttggtcgccatatggtccgcacactttgtcatcaagatgaaaatgggcctgtgcggctgcccaggctgcacccggcacgaatagtgccgcactcactgtgcgcagccgcaattgtcggcctgccaaacgtgcccaatataagtctgcccctactttaattgggtaaagctaatgattttgaacttgaagggtaagtctggtaggggtcaagctcgagcacgaccaagcctgactagtatgctttttcctaggcctaagcctggcccaagtaaaacatcgacactgcctaatttcaaataggaaaaaaaaatctttgatgtgaaaagagatgaatgtgaaataagggttaggtagaactcacccaccggtgacaacatggttggactcctagtcagagacttcgtgatgggcgacggtgagaggtgattggcattgaaggaatatgctgcgcgtgtggccgtcgcatgcagactacactaagccaaagcggagtcgagggcgaggcatctgatttctgatcagctaatgtacgtgcaagaagttgaggcatcaatcaacggccttgtatgattccattgtctctgatgggttgagtaggcttctatcattaggggggtttccctgggattgaaggaatgacaatttttttttaaattccccttcccaatcatttctaaaactcctatgtttaccaaccaaacaaaacgcgtcatcatcattcctcaaactctcattccttcttaacaattctctccaatcaaacgcgccgtgagagtcaaaggcagggcagatcacggactatttgactctcattcatttttttcttaaaacaaactccttccgtgattacatgtagttgtttcaactggattttttggggggccgggttttgacgtcttctgaaattgaaaggagctgtgttcgtgattgcaatcacgggagatcgagttggacatttaattacatatcgttgttgtttgcagctaaccatcaacctcttcgatctgcctgtgctgcaagccacatcaccgtcgagttgactaaaaaccaaagatatttttgccatctggtattcccacaagtacatacacaaagcctctgattattttcattgtaacacaagttctcttgcattaatgaaatgtatctgctacattttgctctctttttaatttttttatggttttctacttaaagatgcatattatggacaaaatatgcacactgcatttatagaaacacactcaaaccccccccccccaccccccccaactcccaaataaaaaaaaaccttatatccacctaataataaaactaggaactagacacatactgatgaatattgcaaatcttgaagccaaacatctcaaccattttccttcacaaaataagtaaatgtgtgcaccacgcaaattaaaatatcatgtatatatccttcctctaacttcaaatacaagtcatgttatgtaaaacagtacaattaaggaaacgactcaaataattttatcgccctaatacattaaaaagtgacttatttatttatttatttatttgtaagagtgacaccatttatttggtaagaacaaaccaaagcaaaatgatgaaagattgaaggttctatttttttatgagaggttgtaaaactaattaacttaaattttggaaaataagacgtaaagtaggattaaaaattacatttataagcaaagaaaatactacacaattacacattaccacaaaacagaggacagtactaaatcctctatttctatttaaagagaaaatgaaaaataactggtcgatccgctctaaagaatttctctctacaatacaaaaatcatggctcttattacaactaatagtaatgctacacatacttaaaacttccttacaaacttataacaaaaatctcattatagaagattcaaccataatgtgacaaatccgtatttgtaaaaagtttataaaaaaaatagtacacgtatatcgtttccctactgctaattaaccctctataaatgcatgcctctcaccactctccctccattgccatttcccctactctctctctctctctcaactctcaagccaagaattgtcagggacacgtagccatgaggacgatggttgcggcgccgccgccgtcgccggcgatggctgtctcgccgtggcactcgccggtgccgtacctgttcggcgggctggccgccatgctggggctcatcacgctcgcgctcctcatcctcgcctgctcctactggaagctcaacagctacctcggcaccggccactcttcctccgccgccgccgccgccgccgccggagatggaggcgacggcgatggcggctcgaagtcgccggcgaccgcggtggccgcgtttccggtggtgtacggggacctcgtcgccgtcgtcatggcaggggagaggatgcccacgttcttggccgcgccgatcgtccgtcgaccgccgtccactgacacctcctcctccgccgttgccgaggtggcctcgccggagaacggatgcgacgcggcggagggaggcgcggccagccggccacctccgcagccggtggcggcgaggcaagccgtacagctagctcagctctgaacttccaactgtaaaaaggagaatttgtgggggccttttctgataatttttttgtctccttttttccaaatcgtactctttttttttcctattttcatctctactaggattgtaaataatatattggtgagaattcagatgaagaataatttagttggagatgaaaatatgataggaatgttgtagattctcgtcgagcaaatataattaatcttcgaacaaccagcataaaaaaaacacgacagcatgacactcccacacaaaccatgcatattctactattctaggatatgttatgcgcagtgctaattgagcattctaattatgcaacctctaattctatctataaaaccttcacgtaccttgaaaattattttcctcactatcgaaatatgagtcgcgtctaggttttttaaaaggacggttttacatgacttctatataaaaaattaaacgtattcaaaagttacaggcaaaataaatcatgcaactctcatatatatacacttatatgtttgcttaattacctttttcccccttttatgtgaactttagactggatttcatggaaaagatgtcctagcttcatgtccaaaggaaaaaccgggcgggaaagctggagtcggttgcttccggtgataaagttgcttatttggttggcaaaaggacacccttttgctttgtcacgtagacaactttgtctcatcaaattgaagaggaagccctcgtactatagatgttggggatgttcatataaatgttggattttgatcaaattttgttagaaagttgtttttctttttttttccttttggcaaatggacaccttttgctttgtcacgaagctaactctgtctcatcaaattaaataagatggctctaactcatatcaattctgaagcttggagatgttcatctaaatatcggattttgatcaaattttgttagtaatttgtatttccttttcttttcagatctgattaagtttgcagtaactagcacaggttcggttgctgacaattgagctgtttgtggctgattaacattgggccctgtaggcccagtactagttcttctcttgaatcaccagaaccacagaattcagatcgaatcctgccaaagtgatggtcgttgtaagctgtgatgcatgaataataaattaataatcaagtcattttttttaggtatacattgaccacaagtagctctctacaggttattaatgaaaactatgtatatatgtttgactatacattgagagaaaatgactgctacatggcaaatgcagaagaagaaagttatagagaagataaaaagaaaattaaagggaatatgtgtgtgtgagagagaattcaaggaggaaattaaaggggaccgacctagctacacgagtgggacaaatccgatggtacatgggactaactgtacctacacgtcgtcacatacatatgcgacactgagacgacattgcaaaatgagctgtctgtttaacacctggtttaagttcacaacctactcttctattggattacattactctccatggagtgattttgggactgctcgcttgtggctgccgcagccgcgtcctaccgatcagcgtctttaattaccttctctttcaacgtatggggaaatatatagataccctattttcattgtaagctagctagtgtattaagtagctcattcgtgcgactatagtcatcaatcatgttataaatggtgtgtaagaaaatatattaatgataatatgaaattaaatgattagttattcaaaacgtataaaacatctgaatttgttcgaaacttaattagttgatataaattaaattaattacatgtatatacacttgtatagatacacaactttgagtattcttaagattaggaatactcatgtttaattgtagagtttagagtaccatgtttacacagtttttactttgtaattaattatctgaatttaaagatgtatttgtaatataaatataggcaaatgaatgatttgtacattatacaatttactatattactaagtgcgaaaatagaatcacatatcctctctacatcaagctccatgcggtccacctgtaatcactttgtctccttatatacattatgttttgattaagtaagcggttatatctctatttgtaaataataatacctttttaccatctcaagcaagtagctcttctattgccagagaagggtcacaccctatgtttgttactactactttgagtttcatcctatggtcaaaattgattcttgcttttaatctgatggctaatattcattcgatgatgtggcacactctagttgtatgttgggtttactttcattagataacatttgacgtacaccttctattgtcgtaagtatcaccaaattttacattaccctttgatacttttaagaaccacaattctttttttttcccgcctaacccaatagcgcaccgccactattgaagaaacatcgatagttgtgaagataaattattggctctttcaacatcaaagatggctctcgagtacggttttgggaagataaatggttggggaatgcctgtttaagagaataatatccttctctctataatgctgttaggcataaacatgtaactatttcagaaattttacagaccagtcctctaagcttttcttggcgcagggaccttactagctctaagttagtggcgtggaatcaccttgtctcacgcatcgctatattatattatctcacgaccaagatgagtttaaatggaatctaaccactgatggcagattctcagttaaatctctttatcttgcgttggtgcagaccgatgttcccaatataaacaaaagaatctagaagatcaaagctccccctaaagattaatatcttcttatggtacttacgccgtggagtagtcttaacaaaagataatctgattaaaaggaattggagaggaaacaagtcttgttctttctacctcaaagatgaaactattaatcatttgttctttgattgtcgttttgccagcgcggtttagtctttaatccagattgcttcgaatattagtttacctaatagtacaactcatatgtttgggcattggataagaagacaaccacgcattttgagaactttggtcttattagaggcaactaccactatttgatcaatttggctttacagaaataatgtggtttttgaaaggaaaagcatatcttctcctttgcaggttatctttttgactacacattggctctgctcataggctatcctccagaagatcaatttgcggggtactatcattgcggcttgtcaacaattggagctagtgaccatggagttttctaccccggcacatgggtggcgctctaggctacggttagagagctcctgaagttctttttgttcatgctattttggatgatgagtttatcttttgtttctttcttgttggctgtgtgcactctttgggtgtagaagccagaggtgctctcagaataattgtatcacttgatgaaatttactaagattaataaagcttccattatctaaaaactattgaagaaacaattggcctcctctcaaacactatatttgaccatttaaatatgtgatgttgttaactttttaatatgatatttgatctttcatgttattttaaaattttgtgcaagtacagaaaaatataagtatgcttaaacaaaagtacttattgtgaaccttattgagaaggttaaaatatttatgaccgggaagaatacattatactgatcttatccacattgcatatgagtacgtgatcccttccctaatcaaggcgtcacacactcccaacaaacaccccaacagtaagtgtgtggaacatatataggccccccacaagatcgttgtgcaagtgcagctaatgatcatctccttctaagtgagagagaagctaagaaacctctctaaaaagagatggatgatgaatcacacacaatcacccccaataatcacctgatctgctgatcctactatgtgggagccaagtgtcccactgcaacagcagagtgtgattagatcaaaccagatgcactagctacatggatgcatatgtgtttgtgtgtttgtggatcttggccatgatggtaggctaagctagacctgtaccctgcactcatgtttcccctgacttcactgccaagagagactagcaacacacaggggatccctacactgcctttctttctttgcttccaccctaaacaagcctctgctatgtatgctaccttctcttggtctctaccaaccagcattactgtctcaaccaatggcagttccttcagtcactaactaattgtcatcctggttacaagattagtgtgaatctgaaacctaataattgaacttgtatgttttgttgtaaatggatattggatagcatgccttggttttagtgacagcatgtgtgtacttgcaagaaatgagttggttttggtccttggaaaagatcatcgatgatagaagataaatgtcttattggagtaattattattagttcaccgagctacaaatgggaattgattcttaatgttgagctgaaaattggagagaccaataaaccccaatggagggaagtggacactgacaaatatgctatggtgatttatagtcagtgaaaatcttattcaattgattcttacgaatgattgaggaattcaacaggaaactccagatgaattcagtaggaaacaattttattaccatggaaatcatccaattcctacattggtaatgcatgacctgattcactattaaggttgattaaaagctgttgatgtaactcgtctaacaactagatttaacggttcataaccgaaaaacggttgcttttctagaacatgttgattgcatcaaaccagtcaagattcttttcagtggacagcatcatatgctttactaccaaactaccaactcaaaattgacataatagaatgtacatgtttctgtactaatcactcgagataaaattaaggaccatgaattaaaagcaactctaattttgtgtgtactacatcacaggttgcactacttctaatggtccatgatttggctaaagcatcaattctacctgttttttcccattgtcatgtaggtaggtgcagcactggaaacacaaacatgtattgaaaactaaagaccaaagggcagcaaaattcagcatctaggccaaatttctttgtaaattccagatttagaagttgggaaaaaaaagtgaaaatccatatatcatcaatcttttgccacaacactaacatttttatggttaaatttcattgaatttgttaacatgtagatccctcaaaagttctttaaaaaaaaactctgcaagatcaaaccgggcaacagtcaagtacacctgaagggtaacaatactctgcaagatccaatcagaagcagccacatttcctaggttggcactactctacaactcccatgcaaactctacctatctctgtaccttcacgcatcttcagtcccaagcaaccccaatttttcctctcttttttttcttcttctttttggtaatgcatgccatggccattaccattctgctgctactgctcctctccttccatggtggtcgcccacatggcatagagctcacaagctcgatcagctaatggccatcactacctccaactaactaaccaccttttctctccactgcacagcaacttcatcagtcccatatctatcaaggctatcaccatgagtgtgcaaaatattcatccggccatgcctcccctacaaatacaatccctgtccttgtcgtggccgtcgacatcgccggagtcggagcgaaagaaagaacagtgctggcactaggccactagctaagtagctagctagctagctagtagcagtggtagctgaagaggaggagctagttgatcagctgagctgagctagaggtagaagaagaagatggacaccattgaggagtgcagtgtggacgatggacgccggctgatgctgctggggtcgaggatactggtcggcgtgcccaacaactcccggggatgctccgagctgctctcgtgggcgatccgcgtcgtcgcgaggcccaacgattcggttgtcgccgtccatgttcttggtacgcacttgaattaatctttctttcctgtgtttgactgtgtgtttgtgatttgagttgttcttctcctttctttttgtttgcattgattgattgtttgattgttaattgcttgattggtttgttggttatggttgtggtgattgatgttgtgggttgtggcaggagggagggggaggaagaacaggctgcagaaggcgaacgcgtttgtgatctacagctcggggagtttgtggagacttgtgaggctaaacaggtgagatttgattgaaatcaaagcgaatgcagtttggtttggatttattgagttgtatgcactgaccagttcaacccaaaagcctacactgataaggaaagacagacaattcactttatattctaacaggattgtgttctcttttttatttgttcatgcataggcggtcagtttctggtgaattattttttggtgcattggctatgcaaagatggtactagtgttctgttctttcttttctcggtttatattaatcttgaatacttttctttctgttggcatttcaaaaagaaaatcttttcttcttcttttatgttgatcttggattccttttctttttggcgaacacattgcagtgggaacttgaaagcaaagtctgtgatcattagtgttagtttggtgcccctctctgtcaggtttgtcatgtctcttgtcagctgttagtgttaggtgaagttgtgactacagtctagtacaggtcatgattagcactgtgctctgagtctatctcttctctctctctctgattttgttttttgaaaaacaatctagtttcaattttctctgtctctgatttttcttcatgtagttgtcaagtcttatcagttggaattttgggaagatgtactatcatttgaacttgtaggattacttttgagtgaagctgaaactaagggttacagttatactgaatactgaatttttggtcgtactaattatctgaatccctatcattttggtttaccttttatttatgctgtcaggtaaatttggaggccaaggtggtttgcagcccaagcatttggagagcacttacccaggaagctacattgactgatgcaaacttcctcattgttgggagatcaggaaatgcatatcgtaggtaatctcaggaagctgcttctttgttcagaaaatgaacttggattttcttttagttgatactctcattaacgtaatcatgtattatctagttagtattcatctcaaacgtaattatggatattctttatcttgatagaagtactgtacaaaatatttatccccactgttaattaggcctaaagcactaaatgctacaattgtcatcataacaggaatcattttgaggttgcaaactactgctacatgaatgctccaagaaactgttcagtgattgcagttggaagggatggtctaccacagagcgccgctcgattcaagtctcgatcatttgatggtaaaaatgatcatttttttctaactttcatcactagcaagtttcatttacaatgtactaattctgaacctgaaattacagacagtagtatcttctcaagctcaacatggagcaggagatttccaccacttcagaagctactcagatcaaactcagcgcgaaaaccggcacaatcaacgggtgaagccacagaggacaagagctcaccaagggcagttcttgatggtccagaggcaggggagcaacatgtcactgaagaatgctacagcacaacatctagcaatgaggtgagccggcgtggtcaaaatggcatctggaggaggctatctgacatgaagctctggcttccattcctgcggtccatcgacgatgaaaacgtgaaaggaggtgataattcttcgaattatactgaagatcagaagcctgcctggaggtgtttcagctaccaggagatttcagttgctaccaatgacttccatccaggtaaatatttccatcacttaactatgcatttttaattttagtcacctcgaaaatttctatttcagacatgaattctgttaaaaaaaaggttgtgtttggttttataaaagttagtctgaatttgagaaaaatacaaatgcagaagcaagtttagtactaagatttgcaattcatttgatggtttttcatagataacatggctgggagaggaggctatgcagaagtatacaagggtatcctatctgatggacaatgtgtagctgtgaagagattggcacaaggtaagccaactgaacagaaggaaaaagagttcctgacagaattgggaatccagggacatgtctgccacccaaacacagcataccttcttggctgctgtgttgagaatggactctatttagtattcgagttctgcgaaaacgggacacttgcatcggcactgcacggtattgaatttgatacagtagtaattttcaagtatgcgttgaaatttttgttggtaaacatgtaacagtaggagatgaacttttgcagggaagagtgccaaaatccttgagtggcctttgaggtacaagattgcggtaggtgtcgcgaggggcttgcagtatctgcacatgttctgtaggcaccggatcatccatcgcgacatcaaagcctccaatgtgctacttggtgatgattttgagcctcaggtagccccccattttcatgctgaaaaaatggttttggccatgcgctttgcacaacaatggaatcaaattggatcaaacatgttaagatttaataagaactgtggcatctgtaacagatatcagacttcggactggcaaagtggcttcccaagcagtggactcatcactctgtcatacctatagagggcacatttgggtgagcacagtgctaatgtctgaagacgtactataaaaaatacaaaaacatgtgtcaattaagtactatgaagataaaattgcattatgtcaactgaatctttcccttaaatgaattcaatgatttgagcaggtatttagcaccagagtacttcatgcatggcattgtcgatgagaagaccgacattttcgcattcggagttttgctgctagagattgtcactggaaggaggcctattgactgctccaagctgagccttcttcagtgggtgagtactgagtaccactgcaacaatgcaagtagtgtaacaattactagcacctaacaaagcatatatagaactcattttcttctactgctccaggcaaagccacttcttgaagctggacaagtgactgaacttgcagacccgaatctcggcggcgattatgacaaggatcagctgaagaggatggtcgcagtcgcgtcacgctgcattatgcgaccggcgatgtggcggccctccatggctgaggtagaacagttcatcaatccagtggttgagcagatcaaactattacaacttctgaaacaaaaatgttacctatgagcatatgacaaaatgttccccctactgtgcattgtcaaatttcaggtgctgcatttcctgtcaactgatgagtgcctgaaggagccggagaagtggaacattccggaagacgaggtcgacgacatggatgattgcactatgttttctgaatctttgtctccatgaagacaggctctgatattatttggtctttggcatggctgttcttcatggtgatgtcaagtgctaccttttatgtttcttctcttggttttggaatgttaggtgcttggtatgtaatcatgcaatttagggagaagattttgaagatatggttcgaatttatctttttatggatgaacataaaaagatcacattttcctgtaaattattcatgagaaaatttggtgctgttgagccaagcatatatcatgtgcactaataaacagctcatttgtaagtatgtctccaaacaggcgctgacaagtagatccacttttcgccaaaatattcatgcacattttaggaggaatgaataattttgtatgtagtaaaatcgtacagcaaaaaataaataaatggtgacaatcttcagaaccatacacacgtaggactgaaatagtttcatcgtaaaggatgtaatgtgagaccattataaccaggtcagaaacaacatgaatgtgtacaaattatggaataaatggtaaatgtgtcacattatgcccagggttgtctctgggcatagctaaaaacagaatgaacattctgtaaattggagaatgggatttatgcaggcaaagttgtgcaagaactgcaaatacacaggtttgaagttgcatccgaaaagagtgctgctccacatcagagatatacatatttcacttcagcaataccgacttatctataaatcctccaaaaaacatttttgaattggaaatataaataaatcaggaaaaatcctataaatgttataaccatggttctacgtcctctactatgtggcatcaaaccataaataaacaagggtcaaatttatatgaattctggcacttcaaaacaatcagataactaaaaagagagagaaaattattcttttatattttattgcaattggaacgaagtggagcattccaccagagaaccgaataactgaatattcccaacaaggattcctgataaggaaaacattccaccggcccaaaacagataactcctgcatgcgtcatgccatcaccacccaaaaacctaaacaaaccaccatgatcaggcaccaccctcaatgctcaaaacccattgattaaaagaaagctgcagtcatcatgctattattaataagaaatgacataggatttgttatcttagcaatgataattgcaccatgaaaactacaggtgaacaactatatacaagctacctttgcaatacattaatccgctataattcgatgaaggagatgaggatctaccattggaaagtagaacgggatcgccgaattctgccatgaatgttgactgcaactatgacactttttttttttagataatgggaatttataaaaccacaataactatgacgcataacataattctgcaactacgacttgtaagatagcatcaataattcatcatttcattagcaaacagtataaaatgaccgcagaaactaaattgacctctaattcattcatggaaatggaattttacccaatgaaaacctacatcatcagttaaaaacgactacggatcatcaccgtcgaatttggattgcgagttatgtgatgacacacaattgtttgtgctagtacaactcataagagaaaaatcacattggattttttttattatttcagcactgaaccatagaaattaactacatgagttatcttacaaaagtcacaatgcattaataataatccccctaattttaaccgatggaatttggaattccacccaccgaaaacccgcatcagcagttaaaaatagtgatgcgggtttccaccacggaatcagaaagcgacggcgaagaagacgacgacatgaacaccatgcgccaccattagcatgacggcgagattatgacatgttgcccttttcttaatgtttgtcttaagacgggcaaacgccattgccgttgccgcgttggcgcccattgggagaggggtttctggaactttctagaaggttggcacgacgccgtaggccgcggtggcagcggtggtgctgtccatgtagaaccctacgccgtcggcgcggccgtcgtcggagaaggagagccagaacttggcctccttcgtggcggcggcgccggcgccgccggcgccgctgactccggcggcggccgtgctgtcgtcgtccgatgacgaggaggcggcggcggtggtggcgcgcttgacgaagcggcccttgatcctcggccgcgcctcggcgtaggccttgcgtgaggcgtagcggatggtcttctggaacttgcggttcttgcgcttctcccggtagcgcctcaccctctcctccctcgccgccgccgccgcggcgaccgcgccggccgccgaggtcgggacgacgacggagtcggccggtgaccacggcgtcaacgcggcgagctggcctgggtgcaagccccagcgncggcgcggcggcgccgtcgaacgacgacgcgaggccgccgccgccgcaggacatgatgtcgacgtcggagagcaggtcaaagaggctcctttcggcgccgccgcngccgccgccgccggcgctgtcgttggtgaagctcgacgagctgtcgttggggctcccctgcccctgcccctgcaccgccgcccccgccgccgcggcggcagcccatgacgaggcggcgtcgtcgtcgggcgcgaacaggtggtcgtacaccccggagctcgccgccgccatggcgaccgcgagcggcacgcggtcgtggcgcgacgccagcgggttggccgcgtgcaccgcggcgtcgcacggcacgcagagcgccgccgcgtccgccgcgcagtacaccgtcgccgcgccgccgcacaccccgcacgccgcgccgccgcagctggccgggctcgcgctgccgtcgcttgccatcatctcctcaacaagatcttgcttgcttagttagcttggctaattaatggcttaatcttaagctaattttaagcttgagcttgagatcaagtggcttaagctaagctaaattgtgtgtgtttgtgagtgggagtgagggtgctgagctgtataaatagggggaagaagagacgccaagagaggttaaggggaaggtggagttggtgaagtgcctaagaggacacgtggagcgctaatggccaagagaaacttggcatgagagagaggaggccaagtgtgatttcaggagaaaatggtaggtgtactatggtaggtacccttgtttctcggcctaaccaaactgtgcatatgtctcgttgtctcgatattacgcgatacaagtagattctgtaacaggacgattaagattatttcggtcctgtaccatatcacatcgatttttctctaatcgggacgcttttgactttttagtttcaaataaaattcatgtaaatattgtaactaatcttgcaaaatgtgtaaatatatgttgtctttatggttcgattaagatactttaaatataattggcatgtataaaaactaacaaaatcataggtgaggtaaataggatacttactaagatcgatgaaaattaatatgaactcaagaggattgttcaccattttttttctagaaataaccattgtaggagtatcttgtatcttggttgctaagtaggttggaaggaagcatagaacaacatgtgattttttttaaaaaaaagggatttatgcagcaaccaattacaaaggaaaataatgtgttaaccagacttggcattcaggactgtttgtataaggagtttgcctgatggacccataactacaaatctaccaattagtaacttactattattttcagctctatagtttacttttacaattatccataatataagtttatatgaagaaaatcaaaatagaacatcattaagtaattttcaaccaggctacgtagagaatagcccgcacatcaacctcttacctatcactcagtcatcgctacatctatgtgaaaatcacttggctacgccgagaacagcgcatccaccgctgtcctacgtcacaatcaccccgttaactgtgtgcaattcctagtggacctacgatttttccactaatcaaaaccgggtgattaagcttaagtgatcaaaggtggagagatgagggtagagagagctgtcacactttggtctgtgccgacgtagggcccacaccacaccagagagcgcaggaaatgatccctggcagatgacgtggcgtgtgcaatcatccaggatgttatattgtggtggggcccaccggaatttcaacgcgcatatataatactgcgctccgattggttgcagcatgcttggcttggcttggtcgtcttgatcaatcagctgttgacggtggggaaaactcggtttgattttcaattttgtttaatttggctatctctttgcgaaagggcctatagcctggtgattacaagagcctcagtagcacctgaggtcctgggttcgactccccttgggagcgaattttccaggatttaacggcgttgtgcttttagtggtaggcgacgtacccgtcgacagcgaagcgcctgtagtgacttcatcaatctctccaggatttgtcggcccagttttcaaagatgctcttataggggtagggtttgcgtgcatgtgttcacaggggtgagtgcacgtgcattgtgagtgtctgcgtgcgtacatgtgttcacaggggtgagtgcgcgtgcgttgtgagtgtctgcgtcataattctcaaaaaaatttggctatctctttctatctgcactgtttaatcctgccgtacaagctagaaaaacttgaaatctggtttctatctgcactgtttaatcctgccgtacaagtggtggtggtgatggtgtagtaataactcttttccttcccaagggaaaaagaaattggttttgtggttaggggaaaatggattttcttctaagaataatttagataagtactactgcaaattaaagacgtattgaagctcatgaaccctctagaacgtatgaatttggcataattaatttgtacatgaagtagatgacacccgcgcggaaaattgtatatatggataaaaatcaactatatttgattaagggcatgttcactttgatgaaaaaaaaaattactaaaatttggtattgctaaaattttggcaacttaccaaaaatttggcaagattttttatatagggcttgtttggtttggagccaatttttgccctaccaaaatcttgatagtaccaaaacattggcaaattttggcactaccaaatttggtagtattcaatttgaactatggtgggtaaaatttggtagcaaaccaaacatccacttgctactattgaagttgccaaaattttggtagggtagtaaattggtatcaaaccaaataagcccatagttaccaaaacttggcagcaaactaaatatagccacttttttgacaactttactaaaatttggtaaggttgaaaaagacattaaagtgaacagggcctaaatagctagagtatgatagccaagaataaacagaaactgtaccggttatcactattggtgttgagttttttttttggtgatgtggccttatacatgggttaataatttatttataggagtaaattcttaatgtgttgtaactaggattagttcaattcctactggaaattggaagattgcttttgagtgttgtataagaggcacggatctttattttgagatatactcaagcttactgactcctttggacctaccgaatttttgcagggtttcagtataaataatagttcaattccagcatttagatgaatccacatgttctaaatgaggctcaaggctccatttggaatgcataaatgagatttgtaagaaataatttagttttgtaggaatatatacaaataaggacagcttgaatggagcctaattattataatttaatcgccaatctcttgcaacggattctctcttaaagtgaaatcgaaaatagtggtggagccaacggcgccatcgagtctaagcaactaatagtgttttctagtggccaatcaatattttcatatgttgatggctatctacaatggagatgccagcgtagggctcagaatggcacccgaccaacccgctgtgtctgattgaaaaagatataacaaaacaatatggcataagaccacttgttattgtccacgatacatgaaagaatctctttttaacgtgccaaaaatactttatgggcatgataaacaattccataaaatccaaattactcattttgtcacaaaatataactgcagcgagtaatatatattatagcctaaatatgtacagtcaaaattctataatattgccactatatagtgcaagtcgttcatagattctatacagaactggagacaagatcacaagatttgccatgcatgataaaggcattgatgtcaaaacggattaacattgtaatatttggtaattttccttataagcataacgttagagaataccaaacctgtacattacaaactatgtcgatcgcttacaatgactactaagaaaacatagatactactaagtatctttcagtgaaaataaaataattaaggatatacttccacgagcgagcacatgttaattttttactctccctattgtagtataaattaattccccattaaccacgtacgttaacactggaggtaactaaaggtaccacttaacttttgccattatcatacatacaaacaaatcagctgcattaccatccggataaactttttttttacaccaaaacaaaccgagagcaattgttcttggtttggtccagctagctagctagtggacgacgactactacaaaaggtagtatgaaactttttcttcttgccaaaaaataaaacgaaagagagcaaaaaaaaaattactgctctactttagctaagcctgtagcttaatcatggcttagctagatcgcactgatctctgatctgatgttgctccacactgcactccatcattgcgtatattttttgcggccatcgttatctcctctctcctccatcgtgctgcgaaaaggcggccactcgaaagtcaacggggtcgcacgcgttgacattttcgtcgagcgcggaaacaaaagccggctcgagcgcacgcacgcacgcccgccccgcccgcctcctttcccgcttcgcgagcgcgcgacacgtgtccttctggaacattcggccagagatcattcatagtacagcaactgatagcggtaaaaattgatagaagtattatttgtagttaatctaataatctaaatttacaatagttttatataaatatatacaataccatatgcaactgatacacatacattattttaaagctcgtgctataggtctacaggtgactatatatatgtataccatttttcttatcttttacttcctccgtttctaaatatttgacgccgttaaattttttaaatatatttgaccattcgtcttattaaaaaattattaattctttttctatcatttaattcattgttaaatatacttatatgtatacatatggttttatatatttcacaaaagttttttaataaaacgaacggtcaaacatgtgctaaaaagtcaacggtgtaaaatatttagaaactaagggagtactatcttttttctttgcttgtagatggcttatagccttctaccccctatgtttcataatataagttatttgaaatttttttcttagtcaaacttttttaagttttaccaagtttatagaaaaaatataataatattttcaacacaaaacaaacatattatcaaatatattcaatgttagatttaatgaaacgaatttaatatttaggtgttgctaaatttttctatgaatttgatcaaacttaacataatttgactagaaaaaaagtcaaatgacttataatatgaaacaaagggaatagcattatactctctctatccttcactaagttaatctagtactacatatgatatatcttagtaatacgaatttgaataagagtctattcagattcataatattaggatgtgtcataatactagagtaatttattttgagaagaagtgaatacttggtagagcaaggataatagtaagttataaactaactacaaacttacgtggaggagagaggtaataa

SEQ ID NO: 36650 - DNA, 1758 bp, Oryza sativa
aatttagcaacatctattattatatatgttagctttaaaatagactaatacttcctctattttatattataagttgtttgattttttttcctagtaaaacttctttaagttaaccaaatttatagaaaaatatactattattttcaacacgaaacaaatatattatcaactatattcaatattgttaggtttaatgaaactaattttatattttagatgttgttaattttttctataaacttaatcaaacttaacaaagtttaacttaaaaaaatattgaacaacttataatatgaaacggaaggaatagctcacagtgaactctatactactccctccatttcacaatgtaagactttcaagcattacccatattcatatagatgttaataaatttagatagatatatattatatctatattcatattcatattcattaatatatatatatatataaatgtgggtaatgctagaaaatcttatattataaaacgtaagaagtactaaacttgctcttagagcaagtttaatagtatagcccactactagctctaattcacctatagccaaactaatagccaattcatacaatagttaattactatactattaatatatggtcccacatgtcatacacacattgcgttttggagtccacgctgcagctggctatagatctgtagcccgctgctcttctctttcattttttatctcattaaaatatgtttatagttggctaatagtctgttattgtacctgctcttagtgggctagtgggaatacgggggactaaagctaattaatcaataagctgcgggcgtcgctgcctcgccggtagctatagttggctccggcctaggggcctagctagtgccacgtcggactgcttgatgctgacgtgggcggcggttgcttgcgtgtacatacaattctttttatttactaagcatataaaaaaccggaggagtattatttttggttttctgttttctctgcgtacgctgcatctggtcgtgtttgtatctgctgttgttgttgtttggttaacagaacaaaccgtccacgagtggatttatttatttatttttgctctgtgtatttggttgactgaaaatgaccggtgttctttgcaaaccaatatataaatccatccgtgttagttaaggtgtaagtgctggattggtccagagatgcattttaataatcatggtgctataaacgagaaaatgtctcacgaagcatcttacgcatattgtcgatctatgtggttttctgatgtactagtataatagaatttaaattagtttagatcgtagcataatccagagctaactaagcggtttgcaactgttaatggattcacattgtttgattcgacggctcaaggctacccattgccgtcatcttcgtacggattcaaatcatcgactttaccctttaaatgcagtggaaaccaataataaaaatgagttttaagagggtggcttgtagtgattattataaccgttggaaatataagcacaatctatttgatgtaatttatattatgtaaagacatttaacatatggacatatcaaatatgcgaaacattttggctacgtgtattggcagtcagtggcggacccagcgttaaaatttagctatggcggactaacgtgccatatcgaacatcattgtaatttcaacaaataaactaaaatttgtttatacataaatcacactatatttacactcattaggtagaaaatatagcact

SEQ ID NO: 36651 - DNA, 7478 bp, Oryza sativa
ttttttttcgttgttgcttcctgttgtgccttttggttagagcattggacggtccgtccaatcaacagtatgcttaagaaaaagaatgcagtaatctagtgggtattttactagaggttgcacttatacgggttaatattttgttattagacaattcattcatttttagagacacaaggcaattatactatagcccttacatccaagtaatcaaacaaatagagtttcaaccaaaccaaatagtcaattaatcatctaaatggctaaatgttcagatgtgttacttagtttggctgtggcatagctacggcagctgccataccatgccacaagagagggtccgccaccgtcgacagtcctgacgaactggataagttgtgtgtaggtcgttcacatgtcgacaatcctgaagaacgggatacgtcgcacgtagaccgttcacacatatgtcacgcacgtgcaccattctaggggagtcaagcgaggtgcgaggcgagtgcatgtttttctctagttctctctaccacacatgtctaaattagctaaaagagatcactctctcttctcttttgagaatgtatctcttttagaataagtaaggtaataataaaggtgggtttctgtgattttttataaagttaattcttaacacatttattaatttcaacaataactcaagttaggtattttatggtattatagatctcttatttttcacgaataagcgatccgatggggccaatagacttgtagagtgacaatcaaatcctctccatatgcacatgcgcacgtgagattctcacgattagagtttacatatagtgattttcttttcaatgagatttttttcttttccataattgtaaggcgttgtgcctatgccaaggctaaaatatcacacacgttttttggttgcccaacaagattttcttccggaaccgtgtgcgttgaccttgaaattagctgctcgatcagtcacatcatcatcgatcgatctagtcctaaatttcactgtgcggctcacaaaaaagacgaacaaaaagatctcactagctttagctagcgtgtaatttaggcatgtgtggcagcagcaagtggaatgggtgacagtgtcaagtgggggggggggggggaggggtcttctttctttaaaaaagagatctcccacatgaaagcgggggattgatccttggactgcgataaatctcgccagaccgcaatatgatatatcttatgctctctttaggctgttcgaaatcatacaggagaccgttgatataaacaatttcttataacagtctatatttcgatcatcgatattatggtaaccgagtgggtaccaacttgaacaattcttgttattttttatttttataataaatagccgttttatcaagtagttcctaaatgtggagtgtctcggaaagatgataatgaactgagagactatccacgcatatataaaccttacttatacatacattctctacaatattttcttaaattttcgttgagggagagattaattactttgggatgaaactgtcacttaacttaaaaaggtctaacaacgtaaacagagaaaatgtaaagcaaatgatgtattcagtcaaagctaaaacctgttttaaaagttggatggttttcaagctttccttaaaacttaaggttctgaaataatttttttccccttgcagataagtgcgtgcaaatcaagctcaactcatcatcaacgggttaccttttccggcacggtcggctgctcatccaagcactagaaggtttcttcaattaggagtcgcccaggttttctgttcatttggacttatcatcttatcctcttttttttttcttctcatggttccagaaccttcaagccacgtagcctccaaacaaacaggacgactgctatctttcggcttgatgcacaatcacattctgagacactttccattgtcttctagtagcacttggtagaagctgctctcttgtgggccatcacaccaatagatattttttcttgagctagtgattcttgtcaagctggtgttccatccaattcaattgattattaattagctcatgactagtgtgcatttgggaaaagttgacagccagttgataaccaatcagttcaattcctggcatgctaatccttcccaagaaaattgactaatgcccgactagtgcagttgcaattataagcatcttaaaacacaaaaggcgatcgacagtgaaatgtaagataacaaaatacgtggagtacttatgggcggatccaacatgggcgctgggactcgagttctccctatcgtgttggatccccatgaagaaggtgaggagaaacggaaaagatgaggaagatgggggactgaaaaaaggatgaagaggatgagtacccccttcatataggatcgatcctgaatccactcccctatacttgtgaacatcacttgcagattatttatcggattagttacttcatgctatgaaaaatgtattttcttcttgaaaaagcattcttctactgcactgcaaaaactgttgtcttaagctatttattaaacttatttatgaaaatattaatttatctctataatcaagtagataatcaatagcaacaatctaattaataatccaaatcaaacatgtcttagtatgcatctgccaagtagtctagtgctaagttgcttgagtgaaggcttcttgttattcttgacatctcggcatgtcttagccggtctcggaaatgttcatggtgatctctcgagaaaattgtgagatgcaattttgtgaaggttttgggttatcttctggagtagagaagaactaccgctaaagggcgctcacagatttcatggccatgagaggaagtaaaactctcacttatagtgctccaaattagagtactagtggagattgcccaattttcgatatcttgggaaaaagtctcagcatcttgtttgcttttcctatctcaatctctttacctctcgcattttactttcatagattgaattagaattgagtaaaacttcaactcagttgcaaattttgggtcacaatggttgtcaaacataggaacttagggtagatataatcttctgttattgagttctaatttggccttgtacttagaaaatcctattcaccccgatcctatacacagatagattttttttcctacagatattttttccgcaactagtgattcttgtcaagccagtgttccatccaattcaattggttattaactcatgactagtgcgtttgcaaaagttgacagtcagttgataaccaatcaatccaattccctgcatgctaatccttccaaaaaaaattgactagtgtagttgcaagttgcaactacaagtatcttaaaacacaaaagatgatcgatggtgaaatgtagtgaaataagtggaatacttgtgaagaaacttgtgcagattatacagaaacacttctgatgtagtggagttatggctgtcctggtacctataattacataaacgcagaaacatttttcataggaattcagcctgatttacttaacgactttaatatcttttaaagttgttaaaatcgtgatcctaaatcgaaaggtataagtaagatcacaatcataaaatcgtgtacgtaaaaatcataaattctacctacatggtaaaatcatagaatcaaacaccttaattagaatcgtaaaattatataacagaatcgatatattttaacaaccttaatctccttcgtgcaattgaaaaaacaaatctccttctttgggcaaatgtgattactgactcaagtattatatggacacttggccttgcctatatctaacggaatcggaactgttcgccgcaaacgcgatgaattgtcggcacaacacgtgtctgatgtttaaggggatattgtagcaaccgtgacatttctatggaacaggatgtcgccgtaaacaaattaattaattaatcctcctaattccatgtccaagttgttaaggctgtgtttagttcacaccaaaattgaaagtttagttgaaattagaacgatatgatgaaaaagttagaagtttacgtgtgtaggaaaattttgatatgataaaaaagttagaagtttaaagaaaaagtctataactaaacacggactaggcgacagtgactattcgcgacgacggttgaacagtcgttgcaagaaaaaacaaacggcctgccctggtcctggtgttcagcacaagttatcagatgacgtccctgctgacgtcaattcgcagctggctttgtgctgggccaggtctatctagctccttttgtttaccagcagcaaagtcgctacatcaattattactagacgctatattaattagtggtatgactaataagccgtcgaaaaataaacaaaacgataaaagtaattcgtagataaatattaatctgtatattattgttgttttaagagtcaatgctagaaaataagccacggtgagaaaaagaatcccaaaatcaaatgcaaatatcatgatgttttggacttatggtagtgttttcttaagagaaatatacatataatatcaaaggaagattttaaaaacatataactcaaaagtaaggttttaagatgtgcttatccaagagtagagacgtatcatactttactactttaccatccgtacccttgtgcttatgatgttattgagttattgtggtaactttctgcgaattatgatttcatagttgtattacatgtcatcagaattgctaccaattgaacagtgatcataaagatgtatagatgaggtcaagagtagatttaatttagttacagagggtcaagaatcaagatcacttctttcattcatttcaatataacattattaagaaatgactagtggataatgttcccaagcattcgtatcaccagagtaaaagaatatgtagaaaacgacatgaaactcggcgacaaggtggaaattaggcgtgttcaatcatcggaaaaaaatgtcacaatagaagggatttacgggtaaagccaccagtgaccaagagtcctgacagtttgctcgtcattttctacaaatctattcttgatctcaatatggaggtacatctaaagtcgtatccgaaaactttaacaagcactttacagataatcgatggtataaaacttctggagttaaaacaaagagaatgggggttctcacgcagacttgtgaggaaaagggagcagtgtccctgttctttaccatcaagcaatgatccatggaacagaggctcctaaattagctgcttttggatttcagtgcattactgagcctgcagcaagaatcaaaccaggcttttgtaagttaattccatcagatattcccatatgcattcatcagggaggaattgcagaataatgtgttgtaaaacagaactggaaaaaatgtaacatgggagttcagtctaatcatattcacaggaaaacaaaccgtccagtactcacgtcactacaagaaacaggatagtacaggattttaccagcataaacattttagccattatttcatttgttccgtagagaaaagaaaatttcatgtgacttaccagtccaaaccttcaaaaaggccctctccttttatggcagatgttttgaaaatcgcccattgacggctcttaatcttgtggagttctaatgattccgttatggcagcatcatcaagtgcacctggaagatcctgcattcattgtaggcatgacagcacatgagacatcatattgggcgtctacattgttgccatagaataaagcatctccaacttatttgtatagaaaatgcaagcaacaaagaatgacaattgacaaaaagacattcacatttgaaacctaatgtccaagtaacataatggaaaatcataataaataggctacgtttgtttggtacagagagcgatatattttattaaccaaaaaaaatgcttaaatagtgcaagttcagaacagctagaagtaacttttgtttaaggacttaagatgccatgggctgtcaaaatccaagtgaaccacatgcagaaaaatgtagcaccggagtacgtttgaaaccaatttaagcacacaaaattaacaacagtgtatgagacccagaatggtttggttttacctgtttattcgcatatacaaggacaactgcaccttttagctcatcctcctgccagttgaaggcaagcagccaataagcaaatgcacctaaatgaaatcaattcatgtgtactgctatagccttaaaatcattaggatattggatttatgtctacacaagcgtaacaccatgctaacgaaatgctgctaatatttctaaccataaaaagaatgaaaatagcaaactagatagggatcctggcctcctgtggtgcataaacactgttagtgttcatgaacaaacgagcatgagatattgatttatcaaatttataacagaccagttgttgggatcaaaattaaactgcaaaaggaggcatagcctgtgaatcacaaagcgcctgaaatcccctgacaagtaagcaatccgttaaatcctgacaaaaatacatggattttttattaccaattaatgattttaaagaatgagcaagcagcatgcttcactaaacttgcagtcataatcaccctttgagaaatatgtgcaaaatcccatttgtttcttccatgtaatggttacatatgacacagtaaatatatataccgagtccctcaagcacaggtggcccatacctcaaggatagcatgaaactcttcttttgccgttacaagcctatctgtatcacttgaatcgacaacataaatgatagcctgggtatttggaaagtagcatctccagtatggcctaaaaaggtgaatatgttaatggcgtagagaaacgtgtcatgcctagtctttaaaaggaaggaagtcaaataatctaagagaatccatgcctaacaaaggaaacatacttgaatacaaaagagtaacagaaaggaatcagaagtagcaagacataagtgaaggttgactataaagtttaaatattcttgtgaatcctgaactaaacacgtaagtataaggtaaacaattacaatttcatttcaatgaatggtcgcattacgctcatttggacacctatgtactccactgtgcagatctatatatgtttgttatgggaaaggtcaagtgctgtagtatatggaatatcataagcgatagtatttagaaagctgtcttagccccggggtaaatgtgtagcccccatttcttgtggtaagcatctatgtcccttctctatacatatccggctgaagaacaggatgaccaagtaaattttatatatatccagttgcctgcctctcaaacgcaaaaactccatggagaataattagatatttgaagcccaaggaaaaaaacaaactagccatatttacaccccataaaaggaattttacaaaaggttggattattttttac

SEQ ID NO: 36652 - DNA, 17496 bp, Oryza sativa
attcttgcagatttcaattaaatgacatggaaaatggaatgcaatgtgtagctccccagtgttccggtgattacaaggtattgctacagtaaatcgtacatgtaatgttacacgatggtggcaattaaaaaaatatgtttctttactaaccacaggagacaactagctttgaaatggtgcaatcaaacgctaagcaaatgaatccatatttcgaaaaccaggccacacttttccgagattggaatattagtcaaagctatatgagtttcggagatcgaaatactagtcaaagctatgtgagttccatagttatcaatgtgctataagctctaagctctaacggtttgggggtacagtagaatggctattgtttttaatacaaactttatttagcagtgataaaaaaatactcatggttttacttgcccaccatacaagactcttgttatttcgcaaatgaacatgctgactaaagtctgatttgagcacgttctcctcattgttttccactattttttttatttcttcatttctacttccgcaggaattctacatcattattgttgctgtgcaagaatccaagtgttagtgtattactgcatatgaacttccccttaggattgtgaaatgctagtgaaccaaatacttcttatactaaggcttggcgatcagtgccaaagcagatgagaggatagtattttaagaataaccacatcagccttcaaacataggaaaaaacaggtcactgaattgcttaagatgctcagaatggtcatttttgaactctttgcagacaagccatgaaagccattaggcaacaactcatttacttcaacaccacatagaataaacagaaccccattttgattcaattcaggaactcagcatacaagtaaaaaaggtcacgttatactaaaattccctcaaaacctaggacagaatcagaattgtaatggtcaaaccctagtcagctaggtctcaaccattggtccactcaatcataaattgtagtacccacaattggcctcatggatattgtcgtaaattgtacttataaattgtctcgcggaaaaatctaaaccagtcctcgtgaatcagagacttgggggcacactcaccgagatcccagacttggaacttgatgttgttgtactgcaccgtctccacgttgaacccaatcgctgcagcaacgcaacaacaacaagcacacacgtcaccaaacccgcggagcaaaccgaatggaagaaaaaaaatgagggaatcgggagcggggaacccacttgggatcgtggagacgacctcccccatctgcagccgatctgcgaggaaaaaaaaacacaagcacccagatcagatccgaggtggagacggcgagattacattcgatggagtcggggggcgaggtgggcttacataggatggtggtcttgccggcattgtcgaggccgaggacgaggatgcgggcctcgcggttgccgaagaccgacgagaagagccgcgtgaagacgatgcccatggcggcggcggcgcggaggtcacccccgcgcgcgcggcggaaggcggggggctgggctagggtttcggcggcggcggcggtggagatctgagacggggaggagaggaggggggagatctgggagtgagctggcgcgcgcgagtacccaagacgacgaagacgactcaccgaatggggaaggtggatggatggattttttgtttggaggggaaaaggggagaagcggtttggtttggtttggtggatttaggagagattccaattgcaaaggtttttaggtgggtttgtatggtttttctatttcctaagaaaaagattgcagctacaaaaggtttttatgtggggtttgtatggtttttttattgggattatctaaaactactgtaagatttttttatgaaaaactttcaaatctaactataatataattgtaatgtaattccactacaactatgtatataaatattaaaataatatatataactttatatctaacttatatagagattacagtacagtacattgtaactatattgtagttacactataactatactataactacatttgaaagttttttgcaaaaataacttgtgacggttttttaacaattccatcctctattttacctaagaaaaagacatggtttctctgggttggttttaagttcaggttagttgaagatcaaaatgtaaatggaaaattttaggatatggaataaatactccatccattgtagaatactagtaatcatgcatatactaggcacattttctttcatgctcactgaattgagaaacgttgcaaggacacgtttatactcgcttaattcaggtagtatatgccaagcaagttaaaacagaaatctggattttacaagtatatgtctttcaaatccaaattcaaatagtttctattcatcattgtataatattcaggttccgtttggcacagctctagctcctaactccaacttccctagagctggagttgtgccacacggtacaaattcttcatttttttagcggagtttgcagagttactccccaaaattgtactacggggtagaactgggtttttctacttcacagctccatttcgtccctaatgacccactaccctttaattttttcatgtatttatgcgatatgccactgaactaccccttcacaccccctctcctccctttctctctcatccacatcttcctcccttgacggcggcggcaggcgtcggtgggggcgggtggcgtggcgcatgagagcagcaaggccacaagcgatggcagcggcggcaagaggcgcgtgggtggcggcgcagggtcagcatcggcaaggcgacacgcgtgcggtggcacgtgggtggagcggcgactacggcaggacaatgccaacaagggacgtggtgacacaatctagccaaacactttcatacccacctcagctcatataggaaccagttctcactgaagttgaaggttagagttgagagttggagtttggaaccctaccaaacgaggcaagaggaattttgttacaataattgattcaccaaaaaaccatgctttttttgttggccaacaacatggtggggtacccagcaggtataagtaaaatggcatgtaattatgttgagattgagcagaggaacaatcagtgtacatagataaaatacaaactttagatgatttacaaatagtcaataaaaggaaaatgatagggaaatgtgcttcaacaatatggcatcctccatttgagtcatttgccttgactaatgtcatccttcaaacctgtggtcagtcgtatcgccatgctaattaggtttgcctcctattgaaaagaaggaaaactatagtacatgcctaacaactcaaaggggcaaatacgtcttttttactttatagttaacggtcaacacacaatcaataggcggagtcaatagacgggagtggcatgagagggtgcacaaatttggaccgatggcatgtaggggaagaaccgattttcactggcatataaaggatcagacaattcttagtggcatataagggattatctctacatgttaatatccaaccatatcccaaaacctccatctatttgttggtcatgccttaccatcaaggcactatactgttagctgaatttatcagctttgaactttttgcgtttattagccaatttcaaatttctttttttctttttctaatgacatttcgtatattcgtcagtctgatattcaatgctacttgatttgcgatgcatgtatgcagcagttagtaatgtcctgatgaagctcgacgcctattcaagaaacctaatgttaatttccatgttcctgtgcggcaactgcaatggactaaacatgataaagcggtacacctacagatcggaccttgcttacttgccattaaaccacatccatccatcgtgaatgtatccaattgattctggccgttttccagagacttattttgctcctgctaaaagaaaatggtttaagtgaacatcgggtgaccaatgtatgagtatttttttggttgtaatgttcagttcaaccattattttctagtttttttctcaaacatacaggaggagagctgtgtattttctttatagtaaagagagaagagaataaaactcttctcatgttttgatttttgttgtgtaggccatacagatgatcaaatctagcatgtgcatctttaatggagtgcttgtgcagatattttacttgtcgaaattgatcctattgtactaacttttgacctcattgtcgaaattgatcctatttactaacttttgacctcatgtgaccagaatgaccgttgacaaaatgtcatctcacccaccatgcttatatagttatatttatggtttagccttatctgtagtcatcaaatattcaaatatatagtcagtatataaatagatgcatgccaagtaacatttggtctagtgctgtaatatgtgttattgaaataacaagtttatggccttctacggcatgttttccccgtcaagactgataatgtatttcatgttaaatcatatatgttgaactgcactatagtttaatactttgttttctatatcagtgcttaagctcacgattcctattgtcatacaaatgcagaaagcctcggagaaagatacagagacagcttcgaaaaaggaaactaagaaataagtctaaaggtgtcatgtgcattttaacggtttgccaacagtaattccattagcattagaacttgtattccttctcttttcctaatcttctacccaacaaattaaaatcaaacatacttatatttcaattaaaaagaggcactaaattagtttcattacatctaacattgaatatattttgatagttttttgtgttaaaaatattattatatttttctatgaatctagtcaaacgtaaagaagtttgacttaaaatcaatatgacttataatataaaatataccctctttgtccccacaaataaattaaaccttaggttgccaattggaattaaggaagaagataatgagccaaaatgtctctaattaatagaaaagttacattggtggtgaataggtagttgaggggtattgatggaataaaattttttgatttgcggaccgatggtagaaaagttacattggtggtgaataggtagttgaggggtattgatggaataaaattttttgatttgcggaccgatggtagataagaaggtaactgttgatttattttaggacaaattcaaattaagttgatttatttttggacggatggagtagtagtaattttgtagttattgattatgttggttttttaacgtagtttatcttacaacatttgcttttgaatcactaaggatatgtctataaaagttttacttataaattaattttaatcagtaataaacggttcggaaaatgaaggtaattttcggggatcattagtattttgacacatttgtaacccaaattaataagatctaaccctttttcactatcaaactaatatgttattttttttgtttcttaccatcaatattctattatatatgtaaaagttaaattatttaatggatatcacaaaaagctcaatacttaactatctaatgaataaaggaatttttttaattgtgtgctagttattgtctctcattgtagctcatcgtggtacttagtatggcttgccctaagtgacgcaccacaatccatttataagactatttttagagttgttctttttgccaaatggcatataatctaaccgatgcaaccaaatatcttcttgtgtgcataaaaaagatataacaaataacataattaggtatatggaattcctgagtcaacaaatagattgtttgaaagtgcatctagaccccctagctaaattttggctaattaatgacaaatgaataatgtaataatgtctttaatgagtgatacggaggcattaagtcctttgaagtggaaaagtgagccaaaacaacactcaaagcaaatgagttgaagcgaaagttaattgggcaaagtttggaagatagaagatcaatttgccccaaagttataatggattggacaatcatgtgcggtataggaaaattcgggtctaacatggaccggacaatctaggtggagtcggaaaaatctagtgaagatgatcacgagaaactaagtgaactagattgtttgggaactttcggataatcatggtcgaacagtccgatgcggtaccggactatctaacacgctctggacgtggctagatgattgttcatcagatgttgaagaagcagtggagtagacaatatggtactataccggagtgtttgggagaagcaatgttgaacaatcctacagctatcggatcgtccacctctttatggcccaatggcttgtagttcaatgaatgttggaaaagcataaagtgttggacaatctggatcctatacaaattttggcagactctatcaacggtaataaacaactagttgaaggagttggggctataaatgggtggtgctatggactcatttagagacttttggacccctcttcacccttagaaagccaaacaagtgtccaaacggctaggagtcaacctcgagacaccgatttgttcgtggtgtgctgagggagtatgtgaaggtcagatctcacctctaaaagggaagagatacccttagtggaaggagtgtatttgtgcaatctcacaaggatagggttggaaaagacccgacggagagtagaatcccctcaaggatttgaactttaggaacacattatctcataagaatcccgatgatatctctctcactcatctagttttgctatttggtgttgctaatagtttagttgctatttgtgcaattctttccctaattatgccgaacccctttttgcttgacttgctagtttgcttgtaaatatgagtttttctaaaatatccaaaaatattttagaaatatctgaaaatactaggaagtatccaaaacgttcagcttccgcattttcttaaaagttttagatgcctgttcaccccctctgtaacatcaaggtcgtttcctcaggacacaaaactagagtattctcttcgagccagcatcaatttcagactacgacaattttcttgctaaccatttgcaatattccctactaagaaaaatattccccatcaccttcactggtcactgtttctatcacaagaaaaagaacaagaaaagaaaaaaaaacacaagaatatactactaaaacaagtctagggaggtccaacaaccaagtccaaaccgatcaaacatccgacgaaaaaacacacgaaaatccaaaattaacaatagaaaaaatcctcctccttaaacccccttaaaccctagctcccgccgctccgcacagtaagctcacttctcctcctcctcccccatccatggcggccgcccgcgccaccctcccgctcccgcgtgtccccgccccctcgccgaggccccagctcaggcccttcccctccctccccgctcgccgcggcgcggtggcatgcggcgccggctcggcggcggcgggggtcgcggcgtcgctgcggctcggggacgtgatcgaggcgcagcagttcgaccgggacgcgctgacggagatcttcgaggtggcgcgggagatggaggccctggagcgcgggtcctcctcccgcggcgccgggaggagccgcgtcctcgaggggtacctcatggccacgctcttctatgagccgtccacgcgcacgcgcctctccttcgaggccgccatgcggcggctcggcggggaggtgctcaccaccgagaacgcccgcgagttctcctccgccgccaagggcgagaccctggaaggtgagttcctgggttcagtgcgttgagtgatgtagtgactgaacctttggttggagcggcaaatttcgaagtattgggatgaaattggagtggttttgtgagttgtcgatagtgaacaggtgaggaaatgctcattctgtgccttctgggtacatgttggttttgcattgtcggaattggtagatcttgatttgtctctcgttgtgcaaatggccgcgaaacggagttgaaaattatgggagagtttgaaatggttttggatcaactgtggtatggagtgatgtggattagtcaagtttatttggagcggagtgggatgacatggagtgtcaactagaaatttggtattgtttggaacagttttagtcttgtcgtattataggatgtcatggaaacaaatgctaggaataactagttgtacagtgaactctttggatagtttcggcgtgctcgatgacatttcagttggatatttttgcttgaatctgcgagatagaaaatttcaagggtagttcttgactttcattgtggagcgaacatgagttttctgtcatttgcgctaagggcatcaaagaatggtgagatatctaggataggttgattcatgggatgttggtgttcatcacatttttttttgttttagaatcacggtggtatcttcaatgccttggagttgtgatgtcgaatgccaaaagaaattatcttgaaatgtgttgttgggattaatgatactagttcaagtaccagggcgctggtattgctgccagttggctactatgtttgtatagttgcatcagtagttattccttcgaggaagatagggaggatctaaggacatcagtttgcatcatttgtggtaaaccacgaatagtacaaatataaaaggtttacccataaattatttttgttgtcctaaatgttttgattgtgatgttgggtggcatacttgcatttaggacctatatattcaattaatatgttatattagtattgtgtgggaatataaattcccggaataatctcactatttaatctggatctgacagttgactggtgcttacctcacaaaacagatctaaaactaacattttcaagtaaaaataaatccctctgaatcaaaatatataagtttcttttagccttctcaacatttttaaaatgttactgtagaattacaaggaacttttgtttctttttctttgtatgtttcccttgctaaatgaatgtactcgtgaacaaatattcattctctcctatgtgggtataaatgaaggaccgcaaatcatttgtctattttgtttatttttatgcatgtctgatatgacttattttttggaccagaggatgtaggttgttaaccatgtgtatccatgctgcagataccataaggactgttgagggttattctgatattattgttctgagacattttgaaagtggggctgcaaggagagcagccgccactgcagacattccagttattaatgcaggcgatgggccagggcaacatccaactcaggtaattgttctgcccctgactccttttgaactctcttgtttttaccaataaacagtgtcatcatgcttggattcctggaaaaggacagttttaggcaggtgattgctgttttcttaaggagctaaaaatgcattttaacgaatgatgttctgaccagactctggatggatcattcaatagaaattgcagttttgttgccaatgtacggtgttgatcagaatcacatattaccggctgataaaatagactgtatagtgatgtggatgcagatttcattttattattaagctttctctggagcatttatagttaattcatgacactgaatactccatagtaacaacacctgtaaaattatcagtgctcctcttggggatatacaacatttttgttgtattgctagtgaataggatgaaatgaatgggtgtcagtgaatcagtgtttctagctagtctggtattcctttaggcaagtaagaatgttgcagctttataaacacattttcagcttaatacttgtggcagctttataggtttgtccactgtatctctttatctctgccatcatgttgataactaaaatcagtttggaatctagtttctgttcttacatcctgaatcctgatgcagtatgatttatgtactattttatttgtaattgataattttgttcttttgttcaggctttattggatgtctattcaatagagagagaaattggcacactagatggaataaaacttggtttggttggagaccttgctaatggaagaactgttcgttctctagcctatttgattgccaaataccaaaacattaagatatactttgtatctccagatgttgtaaaaatgaaggtattactcgtcctatcaaatgttaactgcattccgctcttttgatgtctgttatggcccagatagaacagattggatgatgatttttttcttctgtcccataggatgacatcaaggaatacttaacttctcaaggtgttgagtgggaagaaagttcagatttgttggaggtggcatcaaaatgcgatgttatttatcaaacacgcattcaaaaagaaagattcggtgagaggatagatctttatgaagcagctcgtggtaagtacattgtggacaagaaggtcttagatgtgctgccaaaacatgctgttatcatgcatccccttccaaggcttgatgaggttagcaattatccttttaaataaaatcatctaacagtattcatttatcagtgttttacattcaatagtgtcccagatgagatattattggttatatttagcattagtaaaattgttttatattgccaaaaaaaggcaggatatagtttctgttacatttgcatatcataatatccaatatgagctttcaagtttcaaagccttaatagtaaatatgtctgtgaatggatgcaccaaagtgatatgtttttactagttacttagtagttgctgtgtcccaaatgatatggcttggtgcaggcagatgctgagcaccgcttttcatttagtatgtaagcgtgctgtttcagtcagctatgtgaaaagtcaattgtgaacttgggaaatgggaactccttaccaaaagtgtgtctagaataggtgagagttaacccaagtcaactgtcagctatgagaaaagtcatcaatgaaataacagaggatgtatttatctagaatagatgagaattgcccagggcatagcttgatgccttgatgaaacaattgttgtcatttacacatctgggaactagcactagcagtcagcatgctttcctaggccttatggcggcccaagatctaatcacattcaaaattttctgttttgcagatcacaatagatgttgacagtgatccgagagctgcatattttagacaggccaaaaacggcctctacatcagaatggcgttgctcaaacttctgcttgttggtcgctgacagctttcttagtgcgtggcgctgtggtgttgatgggggtcaaaaaatgtttgtcttaatcaatggctccaaatcaactgattagtattgtactaggcaccataagttagatccttgcaaggatttaaccatgtctagaactctagatgcataattttcgatgtaacaaaatattctgaaacagagatttgttgctctcatatgttcttgtgaatcattatcaccgaggactgcactaattttcctacagtgttgttgcaaggactgcagtgatttaccgagtagctctttctgccctcttttgttgaccaaggacaaagaactcaatgtaactggctggctatcagtaccagacgagctctggtattttccccatatcctgttttaaccctaggcgctgacacgttgattgtttttctcttgtcatgtgtaggtatatgatctattgatctatatgattggcacttgccaaggaatagcatggttgtcacctttcagagtatgacagattcctgactgaagcataatcccattggcatcgctttctgcaattccaagtttccatatcatgactgcaggtgaaaatgactatcatgacttccaggggtgacacattcagggtttgtgatgtatactggtaaattgtcatgagagagaggtgatggtgagcccacaccagcaatctcaaatggttggccagacagaagaaggtttcaaagcccttcatgtcagcaatatgacacaatgcataaccggccggctcacacatttcatgccttgggaccccggtacggcttcaagatgttgacctagaacctgctgcattctaaagcctctgagaagtgaattagttagcttgattaattggcttgaattcagcatcactctcactctcatgatgtgtagtgttggcatctccgaatcaaaaccatggtaatttgcagtcaattagggtccacagacagtgactggtccgatacatgacagtggaaatatacatggctgattggcaacattccctgaccatcttgttctaattagattaacattgtgtttaggctcaagagaagcttctttctcagtcatgagttgcgtcagagtttcatgattgtaacaccagggaatattgtcgcagaggccatgcatgaaagtgactattgtgaggatataaagtcctttttcttcttccagtgaaagccaccttgcatttttatctgagctcatcagtcctatctgatctttgacagaatggtgccaagattacatcatctcttggacctggtatatatattttttaccatacctttttatttatcccttgctacaaatttcttacaacaaactccttacagtttggttttaggtgtcactgatcaaagaacacaaaggctagacaatccctatttatattattattattattacctccctaattaacatccttatcaaacctcttcacaattttcagatgtcataaactgttgcataatcctggaagatggagctggtttcaggggtgaaatcccagcaagtcacaggtgactgctttccctgatcatagctccaccagtccacatccccctgcggcggcgcgccgccgtcgacgatcgcgccgccgccggcgtagagaagctcctggagctcggcctcgatggcgacgacgacgttggagttctcgccgccgctcgacggcgacgcctgctgcatggcggcggcgccggcgccgctctccagctgctgcccatcgaggcggtggtggtcgctcacagagcttgacattccatgttcagccacagtgacattgttgtgattctgatcatcaatggtggccttgcttggccactgatgagagagcaaggggttgtggtggatggacagtgggttctgcagctcctgcagctgcatgcagagctggatcctctccatcgccgacgcgctcagcgaccgctctccgccgccgccgccgccgtcgttcatgccgccgtcaccaccggccggaagatcgtcggcggtgctctggctgcggtggtggtggccgccgccgcggtccttgcgccggccaaggagtctcttcttcagctttgtgttccagtagttcttgacatcgttgtccgtcctccctggcagctgtgctgctatgattgaccacctgtggttaattatgtcaagtttagtgtgattatgatgattgattgatagttagtgagaagggagagtggttagtggtgtaattatgtacctgctccctatgctaatgtagaggctgcagatgatgctgtcctcctctggggtgaagtccccatgctttatgtttggcctcaggtaattcagccaccttagcctgcagctcttgccacacctcttcagccctgcaacattacacacataaactaaattaactacacatgaacacacaaaaccagaagatacatttgaaaacatttctagaaagaaaaacagtcacatgaaaagcttgatgatgagcacaatttgcacagatgacaatcttagcatgtctgaaaatttataatctcttctgaaactatcagtgataagtaaaaatggtaataattgctaccaatcttgtgaggcagtgcaatccagttgccaccggtgccatgctcctcaatgtagttcttgagcattgcatcctcctcaggtgaccatggccccttcttcactgttgccttgtcacagcaaggtgccctccccatctctctcagtctctctcagaacctcttatctctttctgcttcttctctctgaatgtagtagtatcaccttagcttgaagctgctatggatgtgtgtatggaatgtgatgagatgagttgtgatgggtttggtcatggtgctgggatttataggagcagatgaagagtgcattaaaatagtacggatatggtttgacctttgattgctgatgctgctgaaagagcatgacacacataccggctcttgttctggtctattggtactttggagatgcatgcatggcctttttgtttctgcattgcatgaatgcatgcagaaaggtgcatggaatgatttgttgtgctttttgctaaacttctgtgtcatccatgcatatatatgtcctcttttttgttctctgggacatggatttctgtctcctaactgttctctgcaaaataatcattgttttgggttatctttgttatagataatctacattaactaattagtttgatttaaagattataatttttggtgctattacacagcttaatttcgggaaattgtgaattttatggcaaagtggttgattatagcaaaattagttatttcgacggtaagtacggtgtaatttgcctcaaattcaatggatgtggtcttggtcctttcctgtacaaacaagtctatgagtacatgaaacagtagtgtcccagtctgttaggggtaaaatcaccaaccttactcctgtagcgttgtcgaagtacaattgaatcgtcttgttttcttgagtttttaagttgaactggttgatgcatgcgactcaataaatctaaacggtggatgcgagaaaatgcattcaaaatggcactatatatttagagctacatgtgggtttaggagagattaggagtgcacagatcacgaagaacagtaagtactctgaactctgcgtaggtttatgggtatcgcagaaagatgaacttatgctctcaagtcaagaactctagcttcaggcaggtcatgtggcagatgaagctagtgttaccacctgtacattgcaaaccaactgccatgaacatagttaaattcagttaggatttagagcctagatggttagaagaaatgaagcctttactgaatcattgaaacgtgccaaaggataagcatggaatgcagtcttcttgtttccttcttgtctccatgcatcccttaggatcacaccgcattgagataagcaacattgattgatcttgatattctattaattttttaattataataatgtagtagtaataatagtatggaatataatgtgaagctgctggaagcctgaaattagtgtaactccaactctgaattttggcatcataaacagggcaatagtggaactagaagaattactatcagactttcagttagggtttctcgtaataagcagtaaacaggccatcacatccaaatggattcccatttctgaaatcaaatagtttgtgctattttaaagtatgatagttattcaaaaactgttttttgtgatattagcaagaacctcttgcagctttcacaatgaactgtgcacatgaagtatcataccaagtactgcaataaagctgaatacgccaaaaaaaaaaatcggcatacgaaaaaattcctccttttctcaaagaaatagagagaacaaacgtcaccaataatgtagttaccagtactttgacaacaagtgtactctacaatgcagcgtacatatagatcaagattcacagcatgggtatgcatgaccagtccaagtcctgcattttcagttattgctgtacccttctctcaagtcaagaactctaactcaaggctgggccatgatagaaaaaaaaaatgttcatagctagatggaataccaaaccatgctgtttgtaagtaactctctttgtagggacccctattgctggctaggctgacctgccaaaagtccatgggcagttacaactgacaatgcagcagcatcctccaatggtgtcatcatttttgaccctcaagactggttcctacaagttcagttattctatacttaagagcaaatgttaagttccttcttttgtcttgtcatttcttttgtgtgcaatcatggttaatatgatattggaggtaatatgatactgcctctattcgtaaatacatgtcgccactcatattaaaacaaaattataaacactttttttattttttagataatggcattttttactcggcctctacatcctatcggatatacaaaatcatttaaattgagaatttagctccacaaacaatccaatctgaaattcactcctatggagatttgaactcggacatttgggtgctattctagtcactgcaaccactaggctacatgccctttcgctattagctatttaaaaaattgaaatgagaccatattattgaacttgccacatcttaatataaacactaagatattgtttattgtaggctaaccatttaaaaattattagccgtcaaagttcaaacagtgctagtcaacggtgacatgtatttttttttcgggaatacgaaaaaggattgcgcacttttgtattaagaggaataaatttacacaaaaggcaaaacaaagaaaagaaggggggtttgggaagaaaaggaggaaaaagtggaaaacaaggacttaagcctattctcgcaattacaatgtgatgaccaaacgacctagcacgctaagaaggaagcgttggcgacaggcaatgggcaagataccaaagggcggcctcttgcgccatgcctacgatcacctcggaccagggtcgagaacagttgttgaatacgcggttgtcccgttccttccaaatggaccacgcgccaagggtcacgatagtgtcgaatccacgacgatgctccctcccaactttgagccggcaggggtgacatgtatttgagaacggagaaacattgggcttgccttatgttctgtggttgtgtgtactctttttatcagcatatccagatatcatacaatgcacgccgtgttgaacagtgctgtatgcgcattgtgcaatgaggatcaagtaggtcttttgtttggagcatggacctttgtgttttcatattactagattattgactcttttcttgtttatgttctccctttttgttagagagtaaagtgacactgcattttggggtggttggttttagattgattgctattgaattgtgatcagccgcaatttggataaaaatatggtactaatgagacccatcttgtgtagttttgtgataatataagatgaacattatggtaaaaagaggtagtttgatatgcattgaagaacaacaccagaaattgcgattcttttcttgatttttttgttggaactcacaaaagccttgcgtgtcattccattggacataggaaaaaagaagtatttatattctagaaaagaaa

SEQ ID NO: 36653 - DNA, 18223 bp, Oryza sativa
cctttggtatcctaaggggaatagtaccgtatgtgtaccatttttgtggtaccggttttccagcactggctgccttgttaatatggagtatgtacatttgttcagtatacagtcctgtcagaatcctcctttggtcagagagaagcaggtctgggcattacagagggaagaggtacacttttgactaactgtatgaagttgttgcagcttcaatatccatggtgatgtatagtagagtagtgtgtatcatgctcacactaccagaagctaccaatgaagatatctgtagatcacaatgccattaggtgtgtctagcttagtattctactatcattatcacaccagaagaaatcttaatcgttgatttatgagttctactataagttgaaaaaaatattctacactgtagtggtggtataaatagatatgatccgttggattagaaaaaaaaaacattctagattggttctactactaatagagagcaatgtagaacaccttgtctagttatgtactacattgtttactttgatcaggaatgaatgcatgcatccatcttggtggtgttagttgttgtttcagaagagatatggttttatccaagatgctgccctaaaagaagtggcattagtaaggaagacaagccctaaaaaaggagcaaagctaagacagagaaaaggggtgactttgaatgatatatgcaattagaaatccatgtcttgggcaaaagagattgcatggccaacttgccactttgtcaagcacaaaagaacacttaagtaagtagcagggcatgaagcatcacaactctatcagtaggatccaagcagaagcaggttaaaccatctgacaccatggagtagactcacctaaacaacttacaaaaataaggtcattagaccttcacaagtctaatgattaatcaaattaagtaatgtgagcctgcctgttgcttaatattttacagggataaggttgagttgaccacattattcaaggatcccaggagaagtaagataagcttatagtggtgttgttggcagatcaagtaagtaaacttgaaaagctgattagtatctcagtgcaattaacttcttttttgtcctaggaagaatattttgcatatgttattatttttgtaccttttgactagtgtttgctacttcttttctttaatgatggatgacaaaaaaaggctgaacaaaaaatgtttattatgcacttgcacccgtggatagaccatgacataatcctggatttcttgtgtctgagtttcttaactaattaggtgctactgctgggagaaaagtttagtaccattgtacatagctttgacagctgttctacacatctcgtgccatttggtaagaataaagaatttgcatgatagaatttgagtattatatacacaaaatgtttggaactttgattttgtcttcaaagttgaactcaacattaataaatgataaaagaaagagtaaatttcacaaaactacatatacttggtcaaattatcacaaaactacagatttaagaatgcgtatcacaagactacaaatttagcgtcaaacttttcacggaattacagatttaatataccatatacaaaactacagatttagtaatgaagttatcaaagaactacatattctagagtttagatcatagcactattaattacttaaagttataaagtctgtagttttatgataaaatagttttaaatgtgtagttttgtgataaaatagttgttaaatctatattttttgatataaatccttaaatatgtagttccgtgataaatttgacactaaatctgtagtgctgtgaaacacattcttaaatctgtagttttgtgataatttgatcaaagtatgcatagttttgtaaaatttactcaaaaagaaaggatagagacgctttaattgttaccatttcttttatataagcccgtctgctctttattgtgagcagtgaaccgaatatacatacttataattgcatgacgcgaaaaacgacacatgttgattactagcaaaaacttgataggaacatgtagtacacaagcaagctttatattgattaatatggtctaatgcactaacattttcatgttgattactataaagaacttgagtcaatttcataaaactacatatacttcggttaaattatcagaaaactatagatttaatatgatgtatcacaaaacaacagatttaacactaattttattatagaactatagatttatggtaaaatatcgcaaaactacagatttagtaacaaagttatcacaaaactatagatttaatatcaatttaatcttggacttttgtaacttaaacataacactagtgcaaaaaaaattaaaccgtaaaatctatagttttgtgataattttatcaataaatatgttgttttgttatacttagtcttaaacctatagttttgtgataaatttattgctaaatatgtagttctatgatatatgaatatatagttttacgataatttggttaaagtatttgtagttttgtgaaatttactcaaagaactttatataaacatcactgtgttcttcaccctattttccgaactcacctcgctcgtttttcgtgcgcatgcttttcaaaccgctaaacagtatattttttagaaaaaaattctatataatagttgcttaaaaaaatcatattaatctatttttcaaaaataattttattaatacttagttaatcatgtgctaatgaactcatctaacgaacatagcctacaagcaaactttatatttattactatggtctactgcactaacattttttacaaagaagagtatgaagtaacatgctcacaaacaatgctactgggaatcgatcatctcacggttaaaggcttcagatgagctagagttcaatgatgttttcaactatacacagttaatatgattacacggtaaatacactacaattacactgtaaatacactataattacaccttaattatattgtaattacattctagtgatgtctattaaaaactttttcaagtgatttattgtatatttttgcttttaatcatgttcattagttttgttttgatcctatggctgaaaaatcgtgtgagacgtaaggaaaaatctgtcaaatgatatctaggtagtttctataaaaataattccaatattctctccacatgttatatggaaatatttagtttatttgtttcaccccagtatctcatgaagtaaacacgcattatgctagaataaggcgatatgttaggacgacacatgctaaatatatatagcgagaggtgatcacaggctggcttctcttctcgtcattccactttttcctatcagtcacgcatttagttgatattctttcccacgattcttctcgttctgattaactgggcgctgttttgtgtgaaggaaatactacatgaaaactatgtgagaacatcatgcaaaaggaaggaaaggagtgatctaatctccgtttatactggtattaatccggtgcgacggttgattggtaactacggtagttacattttttttaataaaaagtaaattgtgccgaaggcataacgccttggccggtgagtgtactgagcacaacaacctaaatttcagcatacaggtacagcaacttagttctgggagtattgactttctgaccacattggcaggccatgggcctccaaccagtttaggaaaaaaaaaccttaataatccttagttacttcctttttgtgacaattactcatcttttatatatcgtatatataatccagtctttgcttcaacatgacgtacttcctccgtttcataatgtaagtcattctagcattttccacattcacattgatgttaatgaatctagaaagatatatatatctaaattcattaacatcaatataaatgtgggaaatgctagaataacttacattgtgaaacggaggaagtatatagaatcatttattacaaaataaagtccttagcttaaaaccaagcacataaaatatctaagcaaaaacgtttggaactttgattttgtcttcaaactttagtgaaatcaatattagcttaaaaccaagtatggaaaatatctaagcaaaattgtttggaactttgattttgtcttcaaactttagtgaaatcaatattaacaaataactaaagaaacaataaaggcattcctgtgggagaggattatctattcgttagagactccattttcccattgaggacgaacctcaacctgtgctcgagagatagctctccatacactgataagggatgtatggattctcgagaagagaggagccgtactcctgtggaagaggattacctattcgttagttgaagcgccatcacgttgctgtttctttcttcaatcattttagaagagctagctcagtgactcctgcttgtttccaagtttgcattgtttttcatgaatgcatcataagcttacacatcccacgttgctgtttctttcttcaattattttagaagagctagctcagtgactcctgtttgtttccaaatttgcattgtttttctttgaatgcatcataagcttacacagcccaaaattttaggtccttatcgagcctatagaacccaaaaggctaatttgataggtgagaactatccccaccctattaagtcgtgcttccctattatcaatgattgatgtgggactaatcccaacagctaatcacgaaaaattttacttcaatggaacaattttacttttggatagtaatagataagcacagactcacaatttttacagtctagtactaatgcactagattgtagtatttgtttcttcatgagtccttccaaattgcaggcctgtaattttctgaaggaaattaagggtatctacacgcattcttggtcaaagctgccacatgtgattttttttttggtcacattcgtggtccacgtcaacaacagccgggtgaaacagccagttgttgttactgggcgcactctgcacaagagaagactctgtttaggaaggcgaatgaaaggtaaagtttagaataataatgacctatttgctcggacaatgtggcaactgtcaaaaactgccactcctgggacatggattgatcacggtgatacaaaatgtgtgtttcatgatatccagagaggttgagtaagtcatcacctgcattccactcggcaagagtacttgagaagatcatgatggtcctcttatctgtccgaaattcaaagcgcatatcatgttcagttcgaactattcgataaaaggtctatatttccagaaaccccccttttttttttgttttctgaaaaagaacaccgcatatggcttcttcagagagtggagggtttgacagttctcttttgggaaatcatggataccctccacttgcttttttaccaaacctgaagcttggaagtgacattctgattgctggacccatccacttgtgtttatgtgaccctgttgacacttttgcatgattagaaagtgaattagagcattgaatcaacaaagtgaagatttagaagttccattttttagacagataagtcaggaagttgctatccagaagacattttggaagtccgcatgatatccgccaggcatttagaccccagcaatgaagtcatttgatggattgtactatgaaacatgcttactaatatagtacttcctccatccaatattaagttcatttctaactccttccatttgtcccaaaataagttcatttttggagtaatcattgcataagagtttgtgaaagtaaggaatagttgtattggaagaagataaagtgagaaatagttgcattgggattttataaagtaggggtattatagtttttttagttttgtattggtatatttgggattgttgaaaaaaaataaacttattttgggatggaggtagtatttggttttagctccaaaggagcagccattgaaacccatgcagttttagtgaaaagagccttctatactaatagatattgaatgaattatttaaaatggatattgaagtgaaaaacatcatgcatcgttgatgcattaagcagataagttccaactcaccggtaagtggggcacttgcacaaatgccttgtaatcttgatctcacggtcattcccttgcttggagaaggtcgagcgcaacccaagcaagctcaggaagccatttgatttcaccaatggcttatttgtaagcacatcagtttcagtctatcacattcgaacaatgttcatgcgatagaaaggttatagacacagtaaacatttgtcaagcttaatcatgaaagtacactgaatactattgtacccctacaacaagccagcatggctttttttcccaagaatctgtgagaatgtagcaacatggcttgggagtacaacttcctacaggaataaaaatggccttgatcagggtaattgtaacaaagcagatggacagagcataaaagcaaatgaggggattgtggtgtcaccttgtgaccggtgccagcaggcttcgcgctgttcaccagcactctagcaacccatctgtaaatgagttcagagacttcagaacaaaccaacagaacacccactgcaagacctttccatcatagaattagacaacgtcacatcacattcgtgtcaaacactaagctgttatcaagcaaaatcaacactgatctagtaggcatttttttattgattttgcagggattcgaacctggcacaaggcacagctcgaacaccattttattcaatcagatattgcttagcaacagaatttatttatttttataatcaaatactgcattcggtgaataacaatacttttctcttttcttcagtatggaaaaagacaaactagtgctgacccaacaatacccataattgaaatcaatgaaacgctcttgattgagatacataccttggtcaagaatttattcttcatacaactaatttagagaaggccaatgatgtctgcataactgtaggcattttcaaacagccctggatttcacaaaggagtggtacttctcagggagacccttcatatgttgattgtacttcccacttgaaaccagcaaaatcagtaactcagcagtggaagcttcaagggagaagtcatttttatcaattttggacagataaacaccagccctgcctatctcccctttctgaagtaactttctgacgatgcaattaagcatacgggagttaggaacacagccattcttctccattgaaagaaatagattatcagactcttcgagcaagccatcttctatgagattttcaatcattaaggtataggtcacaacatccggtgctaaaccatttgccgagagagcagcaaacaaatcctttgattcatcctttctgccacttctaagcaaggaaccaatcattatattgaaagttctagtctcaagctttacatccatcaaacatagattctgaaacatctgaagtgcctcaccagtgagattatttttgcaaagtccttgaaggactatgttgcatgtgctaatttcaagctgtattccccttttgataatcctgacatagatttctttagcagcacgagtttgtccagtctgaaataaaccttgaagaactatgttatacgtgataatattaggactaacaccattgcacaccatctgcctgaaaagagataatgcattctccatcctactaattttacagtagccattaatcaaagtgctataagtaacagtatcaggtttcaacccaactgagaccatgtcagaaagtaacttcattgcttcatccatcttacctgccaagcaatatccatcgatgagtgtactgtatgtaatgacatcaaccttcacatcaatgttagaatttcaatggttactctcattgagaagaggatggcactcgagatggggcaattttctggttttcttcattcactaaacacaaaagccatgtcctcccaaagaggattggatacatatttatagctgcttgtagcagccatgcagccatgctagtctaagagggtgctgtcagcatcccaacaaactgtcctagagcagagcatcccaacaaactgtcctagagcatctcaacaaactgctgtcctaactgtcctagagcatccaaactgaaagtagagatgctgtcctagaaagctgaaaagcaggaaaaaaggcaccacaagaccaagaccaaccagccaagacttattcctacattctccccctaagtcttgtgcgccgtcttgtgggagagttgagccatcccgatccgggagcaaagctcaaggaacttgatcctcccaaggggtttggtgagcaaatccgcaagctggtccttggtgttgatgtagctcgccttgatgctcccttcctccaagtagcttcggatgaaatggtacctcactcggatgtgcttgctccgttcgtgaaaaacggggtttttttgccagggccagagcggacttgctatccaccctgagctccaccgctccagtatctctgccgaggagatcactaagcagtcgagcaagccagagcgcctgggtcgaagcggcggatgctgccatgtactcggcctcgcagctggacagggccaccacctgctgcttgattgactgccagctaacgaggcactcgccgaggaaaaagagaatcccgctcgtgctcttgctggtgtcgatgtcgccggcgtggtcgctgtcgctgtacccgacgaagtgtgccttgccaggacacctcgggtagtagagaccgtggtcgagagtccccgcaacgtagcggatgatcctcttcacagcctgctggtgctccgtcgtcggtcgctgcatgaaccgactgacgtagccgacggagaaggccaagtccggccgtgtgtgggtgaggtagcgaaggctccccacaagacgtcggtactgtgtagcatccacctcctccgctgtgctgtcgcggctcagcttcagtctctcctccatcggagtgagagctgggttgcaatcggtgagcccagccagctcaacgacgcgcttggcgtaggcggtctgtcgaagcgtgatcccggagttgtcctggtgcacttcgatccccaggtagaaggagagaggccccagatcactcatctggaaggtggccttcatctcctccttgaacgccgcgacctctgcatccttggtgccggtgatcactaagtcgtcgacgtagacacccaccagcaaggcatttcctccattgccccgccggtagatggccgcctcgtgcgggctttgctcgaagcccatccccttgagcgtggaatccaacttggcattccacgccctcggtgcctgccgcaagccgtagagggccttgtgcaggcgtagcaccttgccctccttgccggggatcacaaatcccggcggctggtgcacgtagacctcctccttcaagtcgccgtttagaaacgccgacttgacgtccatgtgatggacgccccagccttcctgagcagccagcgcaagaaggagtcgcacggactccatccgtgccacgggagcgaaggcatcgtcgtagtcgatcccctcctgctgcacgaaaccgcgtgccaccaagcgagccttgtgcttgacgatggctccggcttcatccctcttcagcttgaacacccacttaagggtgatcgcgcggtgaccacgagggaggtcagcaagctcccaggtgcggttctcctgaaccgcgtccatctccgactgcatcgcggcacgccatgccgcgtgtttctcggcctctgcaaaagaccgaggctcaccgtcgtcgcacgcaaggtgcaactgcgcctccaggttgcgaggcaccagtcccggcaccggctggtcgccgagaagatcctccatcgtacggtaccgtagctgctcgccgtcatggtacgcgtcgatgcgctccccgtcgtgggagagcggagtaacgaactccaccgggctgcgctcaacacgagctggcgtcggagtagacgtgcccggaggagtggctgttggtgctggagcgtgtggggacaccggctggggtggtgtcgacgaagagctcgtcgtagtcgaagtcgtggcccgagggtgtgttggtgttggagtcggtggaggctcggggactggggtagacacgctcggtgaagaagagctgcctactcccccagctccctcgaagtggacgtactcgatggtgaagtcgtcgtacgtcggagtcgaaccatcatccaccgccttgtcccatacccaccctcgcccttcgtcgaacacaacatcgcgcgtaatgcgcacacgctgtgtctccgggtcgaggatgcggtaggccttcgagccctccgcgtagccgatgaacacccctggggtgctcctgtcgtcgagcttgccgatgtggccaagctccttggcgaacgcgaggcagccgaagacccgcaggtgggagaccgccggcttgcgcccatgccaagcctcgtacggtgtcctgccatcgagggccttggtaggcgagcggttgaggatgtaggcggccgtcaccaccgcctccccccagaagatggccggcatccccctctgcttgaggagggcccgagccatccccacaaccgtctggttgcgccgctcgacgacgccgttctgctgtgggctgtacggcgcggtgtagtggcgctgaatgccctcatcagcgcagtacgacgcgaattcagctgccgtgaattcgccgccgttgtcggtgcgcagcatgcgcagcttgcggccgcactccgcctctgcagcagcctgcgcatgcctgatggcgtccgcagcctctcccttgctgccgaggaccatcacccacatgtagcgggagaggtcgtcgacgagcagcaggaaataacgtcgtcctcctggtgtggccggtgtcactgggccacacaagtccccgtgcacgagcccgagccgctccttggctcggaagctcgtctgctggggaaaggggagccgccgctgctttgtcaccacgcagacgtcgcagagctgctccacgtggtcaaggcacggcatgcctcgcaccatctccttggcactgagctgcttcagggcctcgaagtggaggtgcccgaagcgctcgtgccactgccacgcctcgtcgtcccgacgagcggcgaggcaaactggatgtgcgacctgcgcgctgaggatgtagagtcgattagtgcctctggttaccttggcaagaaggcgacgacggcgatcccaaatcctcatgagtccgtcctcgaccaacacgcgtgagccgttctcatccagctgtcccacgctgatgatagaattcctcaacgcggggatgtagtagactccggtgagcagcctgtgctcaccggacttggcggtgaaggtgacggagccaacacccttgatctccacgccggaggcgtccccgaacttgacggtgcctcggacgctggagtcgaactcggtgaagaactcccgtcggccggtcatgtgatgggtggcgccggtgtcgaggtaccacccatcagccttgtcgttgctggagccgtcacagagggagacgagtaccttcggctcatcaaggtggaggaaagccgctgcggccggtgccgctggaggtagctcgatgcttgcgtgagctaggagcagagccggctcttcctcctccacccgtgcgacgtgggcctggccgcgtcgtggctgtcgacagtctttggcccaatggccaagcttgccacagttgcggcaggtgtcgtctcgtgccggcttgtggttgccggtggcaacgccctgggcgcctctgcgggcgccaccctcggcacgtcttcgcgcccaccgtagctggacacctccccgcgccttgcgcggcttatggccgcctgtcggggaagatgactcccccttcctcccgtcaccctgagaggcctcccactgctcccgagtgagatggagcttcccgccgatggtgatgggccccgagagaggccgtggctcatcaccatcgacgaccttgaggcgacctaacgcctcctcgatcgacatcgtggagaggtccagcagagattcaatcgagcgagcgatctgcctgtacttctcagggacgcagcggaagagcttctcgacagctctctcctcgtcgtaggtgtcgtcgccgtactgcaccattttctgcaagagagtgttgagacggagagcaaagtcatcaacatcctcacctggcttgaaggccaggttctcccactccttgcggagtgcctgcagtgtggacttgcgggcgcggtcgctgccgatgcgtgccgcagcgatggcgtcccaggcctccttggcagtccgcttctgggaaagcgagaactgcatctcgggcggaactgcagcgatgagggcatccagtgcccgccgatcctcgtcgtagtcgacgtcaccgtaccggactgcctcccacatgtgccgcacctggagcctcaccctcatcaccgcggcccactcgatgtagttggttttggtgagggtaggccacccaccgccgggaccaaaatccctgaccaccgtctggacgccgtggtgaccatggcgccggtcaggggagagggagccgtgccgcctgcgagggccgcgtgcgggctccgggctgccgccggcacgcccgcgcccgtctgggttcccgtcggcgggcgcacgatcccttgggccgccgccgccgccgtggaggtgggctgctgcccaccgctctgctcgctcccgtgcccttcctcttgccagctcctcaagctccctgtcagcggtgatgtcgccggcgatggagccgttgatgctgctgcgcaaggtctcaacctctacctccgccgcacgtgccgcatcttccgccgcctccgcctccgcctccgccctggctgctgccaactccgctgccgccagtctggccgccctcgctgctgctgcagcggtctgagccgttgctcgcctgcgctcttctgctgcggcgagctcggcgtcctgctgacgccgagtgctcgaggcgaccgaacgccgagaccgagcgtcggacatggcgcacctccggggggctgctgtgtggagagggggaagggaaaggggaaggaggggcaaccggtgctgctgctgctgctgctggctgagagctcaaccgagcttgggaaggggtggaacaagagatgtttagcctacaggaaagtgtggctctgataccagatgttagaatttcaatggttactctcattgagaagaggatggcactcgagatggggcaattttctggttttcttcattcactaaacacaaaagccatgtcctcccaaagaggattggatacatatttatagctgcttgtagcagccatgcagccatgctagtctaagagggtgctgtcagcatcccaacaaactgtcctagagcagagcatcccaacaaactgtcctagagcatctcaacaaactgctgtcctaactgtcctagagcatccaaactgaaagtagagatgctgtcctagaaagctgaaaagcaggaaaaaaggcaccacaagaccaagaccaaccagccaagacttattcctacaatcaatacgtcccatcaggccaaagagtttttcagattctataaacctcccttctttgcaaagattatcaattattgaattaaaggaaattgtgtccggacagattcctctgttaatcatttcagagattaactcctcagccttctcccatttgtcactggtacagagaccatgaatcagtgtgttgaaaataacgatgttaggggttacaccttcactaatcatctgctccaaattaagcattgcatcatctactctgcctgacttacaaagtccatctatcaatgttccgtaggtcactacatccggagttaatctttgctgcctcattttgctgaatacaaacatggccacatctacattttgatgcttagtgcatgcacatattagtatgctaaagacatgacgatcaggttggataccatttcgtaccatcaaatccaagagatcacgcatctcaacaagagctcctttcgtagcataaccatgaagcaaggtactgtatgtaataacattaggctttaggcccctcttgatcatagaatcaagaatctttctagcttctatgcatcttccgttcttgcagagatagtccattagagatgtataagtaacagcatctggttcaacaccatcgctgcacatcttttccaaaattccaatagcttctttcgactgtccagaagagcaatatccatgcacaatactattatatgtgatgcaatcgggcatgactccattcttaaccatcctattaagtacatccatggccttatccatagcttgagccttgcacaaggcagcgacaatagtgttgtaagtcacaacatctggtaaaatccctcgctccagcatttcatggtatgtactgtaagctttgtccgaatccccctctttgaacaagccatcgatgatggtgctgtacgacaccacatcaggagggcagtctcctccatcatccgccatcatgtgcagcagctcgagagcttcttggcttctgctctcatgacagagtcccttgagaagaatgttgtaggagaagacatgcggcgcgcagccaagctctgtcattctgcggagcactatgttcattgcgttgctcgtcctcttctcggcacagaggctcttgagcagaggagtaaagatgatgggttccactctatatcccttcttaataacattgcccaatcccgcgaaaccgaggtccaaacggcccgcgcggcagcagcagccgatgaggatgccataggtgtgcaaggtgggagtcaccgcgccgtcgctggatcgtgccatgcggttgaagccggacacggcggccgcggggctgtcgcgcgcgacggcggcgagggcgcggttcaagctgcggatgatcgaggcgcccccgcccccgcccctgccttgccggagcaattcgtcgaacacgtggagtgcgtcctcggcgccacccccgctggcgcctgctgctccggtctttggtccgggtcgcgcaccctcggagcgagggccgccgccgacggatcgtgctcgggcggggacgcggcgtgccatgcgtgcgccgacggagctcgcagcaacctccgggtagcgccgcgccgcgccgcgcctgagcaactaactgacccgagggaaggaaaccggaggcaaggaaagggaggagctaagcagcacgcgaagaatggcgtccggatcttgtgttggcggtggcggcggcgagccggcgacggcgacggcgtgaggggacgacgggcgcaccgggataattggctgagagactgatgatgcgcggagagaccgtcagagtagagtaaaagacgcgaagagatcagcagtttattaaatttgttattttgtctttttttcccccaaaattcccccctgcaaatttacattttttttgcctgttgttagtggtgcattgtatttcaattgcaactttttttaaaaaaaaactagttaaataaaatgcagataatgaaaaccccaagtatcaactattaagaagtaataaatcagcttagatggatctggggagatggatgtggtggctccggcggtgggtatggaagcgaggaggtggcattagggatgtggatgaggaggtaaggctgtcgaaaaagctcgaggcttgagagctgctcaagctcgactcgtcctagcttgattcgagctcggctcgagctcaagcttctaacgagactagatatacatattttttttgttgttattttataaattaggagattaaatatattatttgtatgtcttgtagtggcatcatatatttattttattctttttcctcttctattaatatgatgaaccataaattaattactttttaaagattatccttctaattaaaaatcaagatcggtagtcgagctcgagcttgatcgagctcaaacctagacagacgagcgagctcgttgacagccctatgaggaggagagcatctcgtcactgaagctccatgaggcgatcttcggaccttgggaggagattgcagcggtgcttggcatgggagcaagatggtccattggcggggctcggtatggggaggtcgggaggaggacgacctagcggtggcagcaaggaggagggaggaggcggtggggctcggcactcggcatgatggttcattgttaaatttaatgaaacttagtgttgtagatgttaataatttttttctataaacttaatcaaaactaaagaattttgagtaagaaaaaagtcaaacaacttataatataaaacttataatataaaatagagggtgtaccgtacagtagcggcagtgcgtagaggcatttgacagtgtaattcaggcatagcagggacgttttggtgatttgtctggctggaccatgcctgttagtgtgctatgtttacaatgttgatgctttctctgtgtttctacaactttacatgttttccattttatttttctattgggagtgcctagcgaacctgaatgttttttcacccatctcactcagatttttcagagtctggatggacgtcatgatgccaagtgaaaacggacttataatggttaattgttgttatgtatatgcatctcagtccatgggccgattgttagtgcagataaagagaagcccagccggctcttcattattattgtccgtaaaagcccaagatgcctaacaaaaagaaaaatattactaagacatctactaaaaagttattacatctagttacattaattataactagcatggtggcccacgtagattgcgcggctagtatcattatattttctcttatataatagcatacattatttctcaatgtattattcaaatatattaaaatgacaacataattttaaattttgtactaactttacgaaactactactccctccgttccaaaatataaggcacaaccactcttaacccaaagaccaagaaacaattattatcatctcctagtttggatcaccttaataaatataatgtatgcatccaatagaattagagatattgaggatagatgatttaaaaaagtaataatttaatggggaagtgctcctaattaattgtatgcatgcatgcaagccttatattatggaacatccaaaaaaattagttgtgccttatattatggaacaaagggagtaatgtgtaatatgcacattgtattttatatatgttttagttattaattatttttaatatcaaattttagttatttgtaaattatattactatatggactctagactcatctttcaatatacatagactctaggctcttcttcaaataatatttatttttaattctgaaactttattatttctaattgtatttctatgtgtactctaaactcatcttttaatattctttaatttttaattttaaatatcagttacttcgaaattgtattcctatattgattttagactcttcttcccatgtttttttaattttgaattttatttatttgtaaattttatttttatacggactctaaactctacttttaattttattatgtttattccgaattttagttagttttaaattcctatatggactctatactctacttctaatattcgttatttttaattctgaatttctattatttcttaattgtatttctatatggctctataaactacttctaatattccttatttttaattccgtctttctattatttcctaattatatttctatatggactctatactcttcttttaatattctttatcatatctagcaaatcgctttttggataattctgaatttcagctatttctaaattatatttctatgtggactctgtttttctttttctcctgttaatatgagaatttctaggccgtgagagcgaacgtggaggctcctttttctattcctttaataagttaatagattgtaattagatagtagtaacaatataattatagtgcaattatattatgatactgtaattttgcactttatctctgtaaccactaaccagtatttattttttttaggaaccactattcagcattagctgcttgctcggtgttaatgactttctagcgggaagcgtaggtcgtgtgatagactgatccatcactcgttttttactccctccatcctaaaatgtttgacgccg

SEQ ID NO: 36654 - DNA, 15579 bp, Oryza sativa
ttatgtatatagttttacacattcacaaaatttttcgaataagacgaatggtcaaacatgtttaaaaaagtcaacggcgtcaaacatttaggaaaggagggagtattttctcgcccgtacaaacactaatcttgacacaattacacggctagaaaattgaaaatctgtaaccaaaaatattttcctgcccatacaaacacgaatcttgacataatcctacggccaaaaaaatcgacaaataggtaacaaaaaaattgtcaaaagattaatacaagtcctgacgctcaattaaccatgagcacggctatttcaataggttggttttagtcacactgcagtggatgcacgcttttccggtagtctgtgatatgcccaacacatgagcctagtcccaatacacgagataaatcacgacctagtttttctggatcttgtggcattgcggcactcgcttcaaagactataaatccccatgcactccctagctccttcatcccgccgcgccagtcatgaggggagtcttggactccgatatatcaaaggaaatgaaagcaaacaatggttcattttactcgatatgtcattaacacactcactatcctttttctccattcacaacacatgaagttcagaaccggccatgactagggtgtcgtcccatcagaatcacctagtccactaggtctaggcctatatgagaaaagcggtcgtagttgttcgtttcctacatattttcttaactcggttcttacctagccagggtcggcgctaaccttttccaggaatcactcaatttaattcttgccaccctagccaaaaaatagttttgttcattaaatttggtttttcacaaacaatttaggtgtgcatcgcaagtggcatttcatgtctctacttgcagcaatgtaaccactcactacccgaagtgatcactcccatcccatccaataatcatataggatatgaatcatctatcaagcatgactaagaatttatcgataattgattagggacataaagtagtgtatagcatattagcatcaaggtatatggcaacaatatcaaaggatatacacacgcaacaatgtgggaatacaatttaacatagcatgcaattttagttgcaaacagaacatttgacgataggatcagcatgctcgaaggagcggaatatgatgacttgccttgcctagctacatgaaccttctcctcagcgtcaaattgtttttcgcacaaatgtaacctagacggcgaacagctaactcaaaatacggtccagtggctaattaataaggaattaaataccaataaaaatgagaaaaataacaagccaacgccaatagataaagagagtatctatgcatctttcgaaagatttttattatcatatcacacagatttttaatctttagattaaaatctaatagatacagtaaaagacaaaaagcaactaagaaacaccataatggacactaattgccatatcttcaagaaaaagaccaaatccaatataaatttcaaaacttacgtgcgaaggttccaaaattatactgtaacttataaaagttacaatataagtttataaattacactgtaacttacaagaaaatacactgcaaatttgagtgagaaatcaggtgaaagataagaaaaatatatttcgagtgagatatagcaaaatcgattgataaatcttgatttagatgaatttaggtaaaagcttcactagtggtgatggggttaaggtggactaggtcaatttgaccagtcaatggcccagagccatatatcggtgacatatatcattaaacatcttttgatcagagtttctaaataaccaggaaccatatgttatactaaggattaagggggtcattatcttaatatttcattagtgaataaggaaggattaaagaaaggtgggccctgcatgctagttagagtaaggtggtgcagaagggtggtggcggcgtaagagggctagcggggttgccggagctttaacacccgacggatgagcagcggtgggccttggggcaggtttacgcaggcagggttaaacctatcggtttagtcgatttaatcggtgcccaccgaaatggcgaaatttccgaaattgcaaaggtgaatattgaagctaaccaaatttttcgaattatgggattagctcaatcatctccatggtcgaacttgcccttaccctgatatgctaaaaatcatatatacaagatatatacacataaacaaaagatgatggtcacgcaccatttacttccttatattctcctcggttgcccctctcgcgttgctctaggaaagttcctgcatactcctattcaattttgttgtcaccatattttactccaatatcccaaaattcatcaaccttaggaagcaaaaacagtcaccatatgtagacagatacacaatgagagatgtgatgtcctcatgtgtatagaaactccaccgcttattatgttttgctgcagttgatttgttcgatctgtcttatagcatctatatatactactgtactcttgttcggttcgtttcacaacttcatttttggaagacagaacataagtacaacttgtgtgttgacgaaggatgaaaaaagtgcctctagtcatgcgattgttggagggcaagcatctggaccagcaccatgttttcatgacattgtaaagagaagaaatgcttgtgtatggaaattgaaaggatccggtttacatgacaagaatcgaggaagtctgacttgtaatggctccattccacaatccacatctgtcttgctgtaccatcaacttgtgcagcctcactttctcgcttatgcttatacttattagctaaaatttaaatttttaactttaaatttgaaattgatttgggttttttttatcaaagtttatttttaacctttaagtacatgtatagggaaaaaatatttttcgtttacaaataagccaaacagtggtgtccggaagtatggtgaaaatccgtattagggtattctgactgcaacgtggattcaatttgccaccatgaaacaatgcacccatgtgtatgaatgtaacaagaaaataatacggcctgctcagaagacctgtataggcccgaaaacggaagcaaattacaggcccgtaaacttactcgcatcagactgagaaaggccgtttgggttcgccggttttccaccgccgccaccgcctccccatctcgatccgaatcgccggcctcctcccgccggcgatctgcctggccggcattctcgcctgccgtctatctgctcggtctgtgccgccggagtcgatccgcgcggccgacctcctcgagtcgccgatccaagcggttgcccgctggcatcggtccacggcggcggccatccgcgcgcatcgttgtcttcaggccttggcgaagccaggttcatcagccatccttgtcatctcatcttctacccctttcggtttgcctcattcgcttcattgcacagtgcacccgaacaacatttttttttccttctgggataataaaataacaaggctgtattttttttttggtttccagtaattacatcggtaaaagatttactggtgaaagatagtactaatcatccaacctggctctaaatatatatatatttttaaaaaggattaaatggtaagatttgtgctgttctttaatgtcatattattattctgatgtgattttttcattactaaacaacaacaactggatagtgcaaaggtgcaaacgggagcaggttcaggggtctgagaaaccaaattgcaagtccagggggctaggttaaatattggcgtaaaaccaatatttactcttttaaaccatgggtaacacctccaaaatacaaaaatgaaatggataaaaattacaagaagagaagaaaataaactgtactgacaatattctggacttcagaaacaaacaaagtatgcttcagtaagtaacaacttctcaagcagacaaccaaatctagttacattcattgcttacccagattacttcgttgctcgaaattcattatcaggcatatgtatgagctgagaatgccttctttatagcattcaattccttgactacattatccatcttcattctttcccttggtgattccttgcagcatgctagaccaagtcgaaatataggataaacaactagttgtgtcatatcttgggtgtttccattgtaggttgcattagtgtccaatatttccaatagattgttaggataggctgtcttgacataatcgataagacttgccataccattgataaaattgtcagttggtcttcttccagtaaacatttccaacaacaacaccccatagctatatatgtccccatccatagagaccggagatcctgagccatattctgcaaacatatataaatcataaaaaagttttagtggatacatagtgagtatgggataaaaggtggatctcgcactacaattttcagtcaaatataacatcaatattacattttgtttttgcatcgctaggtcacattaaaatactatcgtatcattttgttaaactagtaaaatatatagaatggaaataattattgagatcctgacatagttgagttgaataatatccacttacctggtgcaacatatccaattgttcctttaattacaaatgagctgctttctttgcacggttcagcaatattgattatctttgctagaccaaagtccgtaacatgcgccaccatgtcatcgtctaaaagaatgttgcttggtttaatatcacagtgaactataggcggcacaatatgatggtgaagatattccaatgcctctgccacatcaagagcaatatgcagccttttcatcagatttagccttctgtagcttgtgctaattgctgccgtgcttgcatgcagccactcatctaaacttccattacaaatgaattctaggacaagcgccttgaactcatcaccattttggtctgatccactgcatatggtgatcaccttgacaagtttccgatgtcgaattctcctaagagcatcacactcagtcaagaaacttctactggctcctcgttggctaaggttaagaaccttgactgcaataggtactagattctgatcaataatcaaatttccaatgtaaacattgccaaagcttccagaaccaatcaaatttgccggtgagaatgactcggttgctgcttgtagttcggcataagatatcctctcattcgtctcataaagaaataggttttcattatcaatgatattcggtttcatccttgtcttaatgaagcagtatgcagtcatacaaaacaaagagaaaatcaaagttccaacaatgcaaaagattaagacatgtagtcgatgcactgaagcctggtctgaatctttagatgggcatgaagggaattgcaaatctggagggccgccacatagcattgtattacctgagagtgacactatagtgccattacaaaaaatccctgtatttggaacaggacctgacagtgcgttgaaggagaggtttagattagttagaagcgtgaaattcgctagaaattcaggtatgggacctgccaagttgttgttagagagatcaaggatttcaaggctcctcaaattgttcagattttctggtatttgtccctggagaagatttcctttgaaatttaggaaactcaattggacacagctgccaatagcttttgggatttcaccagatagcttattcattgagagatccattttgacaaggctgttcaagagcccaatctgtcttggaatagagccacttagagcattgttggagaggctgagaagtttggtaagggaaggtattgtaagtatttcttgtgggatttggcccatcaaggcgttaccggaaagatccaagtattgaagttttgtgagattgccaaggcttgatggaatgcttccatccagaaaattatttgacaaagtgagagagctcaactgtgaggcattgcctaatgattgtggaatctgcccagtgattctattatgtgatacatagatagaattgattcttgtaagccagccaatatcatgaggtaaagttcctgtgaagagattatatgacaggttgagagatgtaagtttaagcttccacaaatctgcaggtatggtcccaattaattggttgccacttaggtcaatccatgagagctctccgctcaggttggcaatgttattggcattgcaccaacaaggttgttctggccaacatctagcatttgcaagctgctacaattggtcaatgatgtaaaaaattccaaatcactaggccgtgtggcttggagcacattgtctcctaacgcaaagaacttcaggttaccatggatgccaatttccctaggaatcatgccgtgatatttgtttccacgaagttgcaaggattcgagagcagatgcgtttgagaaggtcggtggtattatgccctcaaaatggttagcaatagtgctaaaaatttttatcctgggaagcttaaaaccaatatcgagtggaagtgatcctgacagtctgttgaaaccaagatccaagaatctaatggaagaaatattgaagatcggtagaggaacatggccttccaactgattatctttgacattaaagtaaataagattagccattttaccaaaagattcagggatgttaccagtgaaacggttcccttcaagaacgaagtgtgtcaatgatgtgaggttacccatccagctcaaatctttgccatcaatgaagttcgtctctatgataaacttcacaagtgttgtgaggttggagaatgacttgggaacattaccagtaagattgttgtggccgacatcgaaaatggcaagctttgatgactgaccaagatcatcagggattgaacctgacaggtggttcgtgctcaagttcaatgtacgaagctttcgacaaccaccaaggctagctgggatatcaccatcgaggctgttggctgacagatcaaggacacggaggtgggtcaggttgccgagctgaggggagatggtgccgactaggccagcgccactcagacggagagtggttacgcgacctggatgccggcgattgttgcaggaaacaccagtccattggcagatgacaggtgctggcatgtttgtaccattgccagcggtgtcccaagatgacatcacctctcttgggtcatcccttatgagggatttgaatgacaagagtgctgagagatcatcaccattgatggtctgagaggtgactgtttgcaagaggagggcatgtgtgagaagagagagcatggtttccatggcagaggaaggaggttgagaggttgcaatatggtgataacacttgttaacaagagtatgtcagcatataaggtgtagaagaacgtaggatgactgcacttcattacatttagaagaaataaacaattacagagaagggaccaaaactccaaaaggtgaccccttcacaccaaaacccactcacacatctcacctggccggcgcacgaccacaatatcccttgtgaaacgacttttgtggtgatattgtttaatttcacatgttttgtaacttttgtcttgttgatcaattcatgcaatggttgtcaatggagatataaactacgtgattccctcttgttgcattggcaagccagaaatatttcagcactcctgagagccactatatttggaaggttctgttttttctgcaaaattagtgatgcaacttacatgttttcttatttagtatttatgacaccaacacacactaccaccacttttactggctgtgaaatggatccttaatatagtggctgtgaaatggagccttaatatctctctttcattcttatgcaaaggaaacgtatagtggctgccaaatgcagccttaatatatctcctttacgttaattcaacaaataatacagaaatgtttgtatttttcaaactgtaaaatatttgaagttaacaattcaaaatgaacttactgtagaggcttacattttcatgatgcttaggggttgtttttttaaaattatcaatccgtatatatttcaaatctttgtgatggctaattaagcagaattgaccctgcaaatgatgttttgaaataagtagataacattttactttgagaagtatggtctctatcaggaattagtatttgtgacaaagactatagcatgcaagaccaaacctcgaactgttcaagtgatgctgaaatctcgtacatgaaaactaacagtgtaaaaaaattagtcgtaaagagataagttgtgttgaattcactgttcacctggcacaatcaactcaatcagaaagtgacacattttgatagttctatgtaaaatagtttgcccacatgattttgcaaaacaatgggtatttaatattgagatagtcaattttgaagtttacagtttcatctgatttgttcaaaatatatgttgatgctttgatcatttacaatttcggtcttctgtttgagaagaccgaactttctttagaccataaggaccagaccgaactattggtccagaccgattgcccacccctagttaacaagtttactttcactaacatctgaacaaaagaatcagcagcctttctattcaccgatttcaaaaatactgaaaatgggaatatccaattcagttgtagatttggaggcaattttccaatgtcggcacaacatgaccaacatgtgaactttgtgattgcaccatgctattattttgtcttgcaaaacctcttttctaactgtccaaaagatggtccaatatcagatatgacatttgacctaacacctattctaaaccacagggctgtctccatagcagcctgcatcatttggaacaggaacacaaacaaactgttgcctgggagcagcagtttcatatgctattgtctagtgcgatgaagtcacgatgcttttcaaaattcgtgttgtaacattcgtgttgtaactttgcttcaaaaaaaaaaaattcgtgttgtaacatttgtcatttgtcatttccccagggaatccaaaggttagaccgcataactttcaggtgatattagggccctacaagttagtgctgtgccggccattggaatatgatacttgatgtaacgaaatgatcaattattgaggcctaacaatgttctttacattgatccacgaggagtgttgaagttgagaaagatgctgacaagatatcaaccagacccactcagcatcctcatcctctcaactgaacctggttctgctgcagtttgcagtgtatctacaacttttaagctgccacctgtttgttgttgttggataaaccccaaaacacttcattttaggagttttcattttcccttgatttcagcacttttcgccgtcggcgcagcgtgtttatagcagttcgtgtgcaacttctgtttgctattctaaattagaggtaaaaaaaatcaagaaagtgtgtggttttggctgcacaaccgtgttcgatttgtccaatttatccttcttgatatgtgctttgtttttccgtttccagtccattgtcagattcttggtgctcctactgcaaatctgttcatggcaaggcacaactccaacggctgtcagatccaaatccaagggctcacatgctctatggtactatagaaatacttaggttactgtaacatcagtattgtggctatgtatctaatacgttcatcagaaaaaaaaaactgaaaaagatggataaaacagcatggagtccttcccaattgcctctcaagcatattcgccaacaacgatcaacgtttatctttgggttcaaactagagatgttgctgagttgacgcattgaacattgacttgcttgttagtaatttggtagacttgttgactgcttgatctttgatatcctttgacctttgatatgcatgccatctgtactgtaactcaggagagtgagagaggggagaatcgtaagacatgacatatactccctccgtcctagaaaaaactcaacctcgtattacgatgcgacacattctagtacaacgaattaggacatactctatatctagattcgacatcctagtactatgttgtcttttttttggatggagggagtacttagtacattcagtacgtacttgattgaacttattggtaatactacaggcgattcaatcattgattacagaaaagccttcactagacataacctcgattaaaaggggaaaacgacagctgacatgttatcatcatgcaaatcatggtgcggctctcacgcggttgttgtttatggttggacccaagcaccgtaggaagagtgtgaaatgtactagcaaaaattaaaaaatgcaatagtattgtgtaatgatatgtatatttaatttgtgcacgatggtttctaatttgtcatcatcgcttctccaaaaaatatgctcctggtttttcccaagtgaactttaggtaggcacctcggtacatttctaattttagtgttactccgttaatgttttttatccatccaatgtaatatactattctttatgactcaacgtttattatcatggacatcttctcaacagtttattatcatgaacatcaccaccggcacatttgctatcggcattactttcatcttcggccaactattgtcaacaaagttatttgcttcatgagtctggacttcgtcaacgctaaaatccgactggatcaccaacatcattatcttcatcagcaaaaggaaactggagccatatccggctatgttttcctctttgtaaccttgtccgtcaacctatatacattagcaaaagatggcaagcgagccctccaaggacataagcacgatcagatcgtcagatcaatatacattcggcggatacaatcccttgaaataagtagggtattacctcttatctagagggtctgaacttgtctaaatccatgtcttccgcatccattcacttttagatctcgtacgctaccccttttattattgacggtttacataatcgatagcttacaaactgaattgaattattaaaattttggcaaataaactcctaatcaaaacaaaatgataatgaacctaatctgaaatgccagtacacaccatcgtaaagcgtccgagccttatcactgctcttttttcttcccacgtctggttgtaaccgattccccacataacattagacacatctatcatcaccaaactttgaacataaaattaatccatctgttctacagagaaaccctaggaaccagcactacctaggaatcctagttcacccgccaccatggatgacctcgccgcaatccgctcacttccatcacggacgacctctcatggatctgcctgctggccgttatcgataatccatagctatcaccaccgaccaactccgcaaccttcaactgccgaattcagtgtgcccgaggtctcaaagccgctgcacacactgcgcgagccgcaaaccttttgacttttgtagacacagcccacttcgccgttgtcgataccgcctcgccacatccgtctccatggttgtcgttgctgctagatctgttgatcctgagcacctaggaagccaaattcatcatggagaccatcagggaggaatggtggcagttgccagagtggtggggggactacgaggggtggaagagcgggaggggggggggagccaagttgtctaccaatagggtgccaatacaccattatacatttataaaatgtttatatagcaacgaaagattttttacgattgcatccgctcttgtcctacaatataatgaattttatgggaggtaaacatgtcatcaaaaagtgtatacatgcaaaataaccagagactttgaccaaatagaaaattggatgatccaaccaactagcatacggcctgaaattgctaattagcgcgtacgcgctattagcgcaagttgcgcgtgtttctagcccacgtggcccacgccctcacgaagcccatctcttttctctttttctttttttctcgcttctttttttccaccacggggagactgtgaaacgttttttttccgtgattttttattttagaaattgaatctttcatctttaatttctactgaaagttttgaatttgagttgaaagtttttaagattcgagatgaaaatttttaaatctgagttgaatgtttttgaatctgagatgaaagtttttaaatctgagctgaaagttttcaaatctttagttgaaagttttcaaatcatgacttaaatagttgaaagtttttaggttttgagatgaaagtttttaaatttgagttgaatgtttttgaatatgagatgaaagtttttaaattcgagtagaaagttttcaaatattgacttgaatttttcaaatcaagattttaaagtttcaagatgtgagttgaaaatttttaaatttaagatgaaagtattcaaatcttgacttgaaaatttttaaatctgagtttaattctggacttgaaagttttcaaatcttagttgaaaagtttccaaatcctaaataaggccctgtttagttcccaaaacatcacatcgatctttttatacatgcacgaagtattaaatatagataaatttaaaaactaattgcatagttaggggggaaattgcgagacgaatcttttgagcttaattagtccatgattagctataagtgctacagtaacccacatgtgctaatgacggattaattaaactaaaaagattcgtctcgcggtttccatgcgagttatgaaattagttttttcattcgtatccgaaaaccccttccgacatctggtaaaacgtccgacgtaacacccaaaaattttccttttcgcgaactaaaaaggccctaaatatgagttgaaagtttgtttcagtcaactaaacaagaagacacaaacgcatgacaaatttttatcaaaaaaaaacttaaaaaacggcgccgtgaaagtgcgcgcctccgttgctagagcgtacgcgcggaacaggaatcccccatacggcctgctcggaagaattgtattgggccgaaatcagattaaatgaccataaacttattcgcatcagaccgagaaaggccgagtgggttcgctggttttccaccacctccggttgccgcagctggtgacagcctcgattcgattaatgcggtctcctcccagcgtcaatctgcttggccggctgccggcgtcgatccgctcggccgacctcctcgcatcgccgatccaagcgggtggccgttggcatcgacctacgccctcgcgatggtggcgacccaccgtttctgagccagccaaggttaagaccgcacggttccctcacgaacgatcacatgtaagtataccacatctaattaagtggtgaacacatgatgaattttcttccacacatgttttgcagatcggtagcaatatgggcagatggcctatttatcggagacgactacgcgtcggatgtccgacaaaatacaaaaaatcggacgtcacgcccagctcagcatctgtcacacgcaagagcgtccatctcagcctctgtcacatgcgcaattatatatcagtcgaagagatatggcatagccacttactagtagctacatgcatgcttagtagggtagtacaagctagtagggtaggtataacacttattttccaaattttaaactagtttatcttttaaattatttatccaatttacgatccgattacatcatttaattcattgcaattaaatctttaaaacaagaccacacatgcatatatttcgatgaaaaaaatattttaactttcttaatggttttctttgaaatgttgcacatgttatatttaaatgtttcagctagtatacatatgttgtttcattagttaatttgcaaattttgtaggttgttttccttaaatgtttcactaagtatttaataatgtttcaatagttatagtttaatactcattagtcatataaaaatatttgaacaatatcaagtttttaaaatattttgtaaatctcatatgacttttcttgtttcgctctctgagactcaatgtttcatataggtggttaatggtgttgcagtcgatatttttttaatgttacatttctctagaacattttatacaactgaaacaatttttttaagggggtgaaacaacatttattttttttatcaaaatataattgtgtgatatctttttataaaaatataattgtaatgaatacaatggtgtaatcggattaaagaacgaataattattttagatacaagttgtgatccgattgcaccgttgaatttgttgcagttaaatctttacaaagagatctcacatgattatattttgtataaataaagcatatatatttatattactaattgaaacatttctatattataaatagaatattgatttgtaatcgctgaaacattacaaaatacacgttgaattatcgaaagaacaacacgtgcaacaacctaaatgacctagtgaaacatttgctaaaacatccaaataatacaatatgcaacatttcaaatgaactactaaaataccttctgaggcattcaaataacaccacgtgcaacatttcgattgagctagtgaaatacgttctgaaacatcacaaaaataccttctgaaacatccaaagaacacgacatggaacattccaaatgcaatagtgaaatatcacaaaatacctagttaaacatcacaaaatacctagaaaaacatcaaaataatacaatgcaacacttcaaaatgacctagtgaaacattagctacaatatcacgaaatacctcatgaaacattcaaagaacaccacgtgtaacattaaaaaaatgataccgtgaaacatcagccgaagaaatcacaaaatacctcctgaaacattaaaaaacaccatatgcaacatttcaaaatgacctagcgaaaacatcattaaatacccattgcaacaattaaaaaatccattaaaaaaataaaaaaatatatagtcaagtaagatcttgttgtgaagatttaattgcggtgaatacaatggtatactccaattacggattagataaatactttatgaaataagattatttgaagttatacattaagaagtaccagcaagcatatgaaagggaataaaaaaaggagagggtggactacttcatgtcagagcagtgcatgctgcatgcatgcagaagttagagtgagaggggaggggttgcaagttgcaacgggcaggataaaaaacattcatcacatggtttgagaagaggcgtgcgggtgtccgatttttttcttaccatcgggcgtccagataggagcgttttccctatttatcacaacattgttcttccaagattgctatcttttacccaactaatgttcttccaagattactattacaatactactctcttatttgtactacctgcaattcagactttgctacactgtttgtccatgttctttttatatcaattttttaattggtgctcaatttaatcctaaggcaaattttggtacaggacacttgttatgtgtggttttagccctaggatactgccaaactcacttttggggg

SEQ ID NO: 36655 - DNA, 7122 bp, Oryza sativa
aggcgcgcggcatcgcctacgagaagaagcgttggaaacgcccgcccacctcgtcttctcactctcaggccgccgccgccgctacctcctcgcgagccagccgctagcccgctgccgccaccgccgttgccggagagatcagccgacgtgggagcttgtgtcgccatcgccgtcaccatggggtgcacgccactctcgccagccgcccgccgccgcggctcctatcgcgcgctcgctcgctgcctcctgccacgcactcgctcgccgccgctgccgctccgccggccgcgtgctcgtccaccgccgccgccgccccactccactccgctggccgccgttctcaccatctccgccgtgactgatgctaccccatgcgagcgcgctctgagagagaaaagagagatagatgaggagagggataggagatagaactgacatgtgggcccaaggacatttttgacatttcacgcgatttctctctcctccccaaccggaaagtattattttaattggcgcggtgtccactggcaaattaccacgtttatggagtgttttcccccaaaagtgagtttgggtagtgtcctagagctaaaaccacaaataacaagtgtcctgtagcaaaatttacctaatcctaatggtgatcacacttgctctctcatcgtatctattgattattttaggtggttgactgtgcctgattccttaatggtggttttatgtgcacaagtgcaaattaagagcaaagccgaggtaagaaattttttaatctgttggttccttttgattatgttcatatggattgtcctccattgtgtacatagtttattccaaaattttgcaagtgtctgtatctattttgtggttgaagtcgatattcttaagttctattttctttatttgtttgacagcgtaaaaggctgtggatgctgccatctgattcaccttcaactggaacccatctgaccttaaaggacagctcagaaatttcagagaatacaattagttggtaattaaattattctctttgtattgtgttttcagaatcattgtttcagtgtcacaccttaggtgacaatcttcggaatccatttttcggttggctaacgtgctattcggttgattgtctgtctgtctcaattttaccctcctgaccagtttggagttgacagattttgtgggcagtgaaatcctaagcttcacaacttcagtttgtgcatatacagaaagacctctctgactgatcgttcacataaaacaatgcaaccaagctgtgtaagttatgtcacagcagtaaactagacctgctactgtctcttggatgaacatgctcaaaatactatttattttcacttgatgaattgccaatgagctacaagcgtagctggaagcatggaagaactcaaggagaaagaatacagcaaacttgaaccgggaagctacaagcatagctggaatggtacaactctaggtataaactgtggcttgcagacgttttcggattcacgaaaattcgtgatgtgtttatgtgtcttcttctgtttttaatcgttccttttcatttatttgccttttcagtaatatgtcaacatattatagcactttgtgatcctgagtaggtttaatttatctaaagagtaatatgtaggattcaattagttttatgaaactattcatcacagttgttctatacattcagcaatcagcactgcatctttttttttctactgcatataccgtagcaatgcgcgaggtatcaactagttatacgtatgatgttgccatgcaatttaatagaattttttttgttcttttccatacactcttaactcatcacaattggatgtgtatatattcaatcatttgttaatttgtggtaatcctggcattatgaaagagaaaaatacaaattatcctctagacccgaaaaccagacatctttcacccttaactattaatatcagacgaattacccccctaactcaatttaaagtggttttggtcctacgtgacagtctagtcagcaatttttttttaaaaaaaaacagcaggaccctccatatctctctgactctgtctctttccaaaatcctcactctctctcttctccctccctcacctccatctctctctgtcaccaaggcagcagcgaaggggaagtcaaggattcgacagcggagggggagccgaggatggcgagcgacaacacctccatctctctctatcaccgagaggcagcgtcggagggagagtcaagaatggcgacgggcaaagctcgcaggatggcggaatgggcgggtgggtctcatggcaacggaggggataggcggagctcgaggtggcaagcagagctcgggacagccgaggatggcgagcggcggagacggcactctctttcttctccctccccttctatcaatcggttcggatggtgagcggtgtaggcggcgctctctcgtttcccaccccttcagtcaatcggttcggacgatgagcaacggtggcggcgctgcattgtgggggcggcgagtggcggaggcagctccttcgcagcctctgccgacgtgcgcctcctccacggccgcctcgtgagcttgttgctgtcatcatcgtcatcgccgctgagacctgccgcacccaaggttgtctacaatggtgtgcacgtgtgacgtcaccgtcgcctcccgcgctcaaggatgctcgcagccaccggcgcacagtttgtcctcggcttccgccggtgcacggggctcctcctcggcatctaacgcgtgcgagagagggggtgagagacgaaagagatagagaggagagagatctaataggtgggccccatcattttaataaaagaattatggactggactgtcacgtaggaccagaaccgcttgcaaagctgctggggaagggggggtttcatcaggtattgatagttgagggtgaaagatgtcagattttagggtttagggggtaattcgtactcacccaatagtgcagggtgtaatttggacttttccctagtgaaaagtatcataccaattggcatgcttcctaatgttgagcgttaaaagaagattaaaaaattaggtctgcatataagcacatatcctttatgattaattttgttcaaatgataacttgtattactaatcttccaaccaggctccaagtaacatttattttagaaatgaattaaacggtacgatttctgctgttcttttaacgtcatattgttactctaatgaacaattgaatagtgcaaaggtgcaaatgggagcaggttcaggggtcggagaaaccaaattgcaagtccagggggctaggttaaatattggcgcaaattcatcaagtttactcttttaaaccttggatagcacctccaaaatagaaaaaatggaagggataaaaattactagatgaaaaaggaaataaactgtactgcaatatactggacatcaaggaaaaaaaaaagcagcctgctgtaagtaacaacttctcaagcaggcaaccaaatcaagttacatatcattgcttacccagattacttacatagtatattgaaggagaggtttagattcattagaagcgtgaaattcgctagaaattcagctacgggacctgccaagttgttataaaaatcaaggatttcaaggctcctcaaattgttcaggttttctgggatttgtccttagagaggatttcctcttcccaaactgtcatggaattaatggaacaacttagagaattgttggagaggttgagacgtctgataacggaaggtatatgtatctcttatgggatttggcccgtcaaggcattaacagaaagatccaacttttgaagttctgtaaggtttccaaggctaactggaacgctgccgtatagtaaattattagacaaatcgagagagctcaactgtgagatattacctaatgattctggaatctgcccagtgattctattatgtgatatatagatataattgatacttggaagccggccaatatctggaggcaaggttcccgttaagagattatatgacaggttgagaaatattagtttaagcttccacaaatcggtatgtatggtcccaattatttggttgccgcctaggtcaatccaattgagctctttgctcaggtttgcaatgctaattggcattgcaccagcaaggttgttctggccaacatctagcatttgcaagctgctacaattggccaatgatgtaaaaaattcccaatcactaggccgtgtggcttggagcatattgtctcctaatgcaaagaacttcaggttaccatggatgccaatttccctaggaatcgtgtcatgatatttgtttccacgaagaagcaaggattcaatagcagatgtgtttgagaaggtcggtggtattatgccctcaaaatggttagcaattgtgctaaaataatttatcctgggaagcttaaaaccaatatcgagtggaattgatcctgacagtctgttgaaaccaagatccaagaatctaatgcaagaaatattgaagatcggtagaggaacatggccttccaactgattatctctgacattgaagtaaataagattagccattttaccaaagattcagagatgttaccggtgaaacggttcccgtcaagaacgaagtgtgtcatgatgtcaggttacccatccaactcaaatttttgccatggatgatgttcctctttatgataaacttcatgagtgttgtgaggttggataaagactcgggaacattaccactaagattggttgtagccagcatcgaaaatggcaagctttgatgattgaccaagatcagcgggcattgaacctaacaggtggttcctgctcaagttcaatgtatgaagctttcgacaactacctaggctggctgggatatcaccatcgaggctgttggctgacagatcaaggacacgaaggagggtcaggttgccgagctgaggggagatggtgccgactaggccagcaccactcagacggagagtggttacacgacctggatgccggcaattgttgcaggaaacaccggtccatcgacagaagacatgtgctggcatgttggtatcattgccaatggagtcccaagaggacagcacctgtcttggatcgttccttatgagggatttgaatgacaggagtgctgagaggtcatctccattgatggtctgagaggtggctgtgagcaagagcagggcatgtttgataagagagagcatccaaagctgccacttgatcgccatgatagaggaaggaggttgagaggttgtagtatggtgatagcacttgtaagcaagagtaagtcagcatataaggtgtagaaatcggcaccagtagaatagagttgtaccggtgatagcaagtagtggtaattgtgggcttccttggaaacgcaggatgactgcaattcattgcatcaagaagacataaaaaattaccaagaagggaccaaaaggtgagccggccggcacaccacaacaatatcccttacttatgaaacgatttttgtggtggtggtttttagtttcacatgttttgtaactttagtttattgttgattcattcaatgattgtcaatggagatatataaactaggcgactccctcttgttggagcggcaatatatttgaaagggcctgttatttctggaaactagtgatgcaacgtacatgtgaaatggagctatgacacgaacatgaactccaacgcacgctaccaccacttttactggctgtgaaatggagccttaatatctctccttcattcttatgcaaaggaaacatatagaggcagtgaaatgcagccttaatatctctcctttaggttaattcaacaacaaatacataaaacagaaatgtttgtatttttcaaagtgtaaactatttgaagttaacagttcaaaataaacttactgtatgaggcttatattatcatgatgcgcagaggtcgttttttaaacttatcaatccataaatatttcaaatctttaatatggctaattaagtagaattgacgtccttgcaaatgatgttttgaaataagttgatagcattttactttgagaagtactttctctattaggaatcaatatgtgcgacaaagactatagcatgcaagaacattttacttggagagtgatgctgaaatctcgtacatgaaaactgacactgtaaaaaatttagtcataaagatataagttgtgtagaatttactgttcacctggcacaatcagctcaatcagaaattgagacatattcaacaacaaaccatgcgaacaaattttaaataatcattgtttgttcgcatggttttgcaaaacaatgattatttaaaattgacgtagtcaattttgaagtttacagttttctctgattagttcaaaatatacattgatgcttcgatcatttacagttttggtctcctgtttgagaagaccgaactttctttggaccaaaaggaccggaccgaacaaaagaatcaattttagtttcactaacctctgaacaaaagaatcggcccttctattcaccgaattcaaaatactgaaaaagggaatatccaattcagttgtctagatttgaaggcagtttaacatgtgaattttgtgattgcaccattctattatcttgtctttcaaaacctcttttctaactgtccaaagtatggttcaatttcagatatgacatttgacctaacacctatgctgaggcacagggctgtctccatagcagcttgcatcatttcaaactacaatatccaccatgtcatgttcatgggtggaaaaccatctatcaacggtgttatgtccctggttttttgaaaaattcagtattataattgacgggaatactacaattttatgaaacttcggggaaactaactccatctgttccttttgtaaaagaaaaggaagacactattgatcatgtatgtagggcctatttggaacaggaacaaaagcaaactgttgtttgagagcaccaatttcatatgatattgtctagtgcgatgaagtcacaatgtattcatgctctttaaaatttgtcttgaacaattgtcatttcccctggaaattgaaagggtaggccgctttactttcagg

SEQ ID NO: 36656 - DNA, 15343 bp, Oryza sativa
  unsure (1)..(15343): unsure at all n locations
aaaatcggtgaccaaatttcattaagaaaggggagtttaaaatacaaatatagctttgcatcgacagtaggctgtcgagatggggttgaggctgagcctcttccccatcaaagcggaaaaagaaaacaaagcccgaaggctacatcacgaaggtgtgtttctattacagacttggaaataacctccggacttccacacgaatatttcctccttgatgctctctagaagctgctccgccgtctgcaatctgtgctgaaaaatcctagcattgcgctccttccacagcagccaacaagacagggcaacaacacaacactgtcgaaattatccctgtagccggtccgaaaacgcaatcgcgctatcagccaccagtctgctagcgtctccccgtcctgccccggcaaagggaaatccacgttgatccaatcccgcagcagacgccatactcgttttgtgtagtcgcagctgacaaagaggtgcaaacaatcttcctgctgtcgttgacagaggacgcattgatcttgatgcggccagcccctctttgccaagttgtctgctgtgaggcatctactcttcgttgcaagccagagaaagaatctgactttggaaggagctttggtttgccaaacaagttgacccgagagagaaacctcccttgccatgaagaagaggtcataagcagatgacacggagaaaaatccatctggagtaagcttccatcgtattgtatcatcctcctggttcaggctgagctgctgttctttatcttgatccatgaggattgtggaagagacaatgacaaccagcttcactaaattaagaaagatgctgaattgctgaccagagatcaattaaacccactcgccaaacagccacattgctggagtgttggtcattgttgaataaactccaacacatttcatttttaggaatttcactttctctttgatttcagaacttatctccatctgctcagcgtgtttttagcatttcgtgtgcaacttctgtttgctactctaaataagaggtaaaagaaaaagcaagtgtgcggtgtgccgttttggctacataaccatgttcaatttgtccaattttgagttcagcgcctccttgctatatgctatgtttcccctgtttttccctttcctattcattgtcagattttttgtgcaactactgcaaaggtgttcatcgcaagggccaactccatcggctgtaagatcgctcacattatctccagtgcagtagacagcacttaggttactgtaagagcagtattttggctatgtaatttatctgatccgttcgtcagaaaaactgaaaaacggtggataaaatagcatgcagtccatcccaatcgcctctcaagcatgagttgtcgagccgggatgactactagcatttctgataatcaaccaatttttacaaacgtcaatgggaaattggaaatccaaagtggcaacatcaacggcggagcccgggcggctgcccaactagcccgggaactagctccactgctgcatattcatcaactgcaatcaatgtttatcttttcgttcaaactagatgttgctgagttgaggcattgaacactgacttgctttttactaatactccctctattcctaaatatttgacgccgttgacttttttaaatatgtntgagcgttgattttattaaaaacttgaaatatgtaaaactatatgtatacataaaagtatatttaacaataaatcaaatgataggaaaaaatttaataattacttaaattttttgaataagacgaacggtcaaacatatttaaaaaagtcaacagggtcaaatatttagggatggagggagtaatttggtagacttgtttagtcgttaatcatctttcgaaatccatgtaaaaaattaggcaaaattttctacaggacacgcaaaaaaacgtgtaattggctgggggacaccgtaaaaacgagacactgcccatggacagtacaaaagttgtgtaattggctataggacatcggacgcattattttatcattttcgggatgaaagagtggagagaaatttctaaatgacgggaatgccccctctactcctccttcctttcttcacactgcagccgacatgtggacccgcacacagtgtcgtcatcctcctctcgcaacgctcaatgccggtcgcgtccccgccctcgatgccgctgttgcctccgttcgccgctgcaccaacgctcagaccacctcctccacctcatatcctccctcctcaccccgcccacacctcccctcctctgcgagccgccgttgccttcgcctgccaccgcgccgacatccagatcacctccctccacctcatttcctccctcctcgccccgcccgcacctcccctcctccactacgccctcgcccacacccgcgctcaccccgctagattccacagcggggacatcaagcgctgtccagatcgtccaattcggtggcaatatcagattctgacggcgcattgtccccctcatcatctccaagaaatccatcaggctcggcggcaagaggcgacctgtcttcccctatctcgtcgtcggagaggtgggaggggttcttgaagaagccgggcaggttggggtcggcgtcctcgacatctctgccctcgctgatgaccgggctcagcggcggcgcgacctgctgtgcttgctggtggacatggcggagacgagggagaaggacagattgcggctctgaggcggcgggcagaggaagaacgcgcagctggcgttgagcgttggcgtgaggaggacgacgacactgcgcgggcccacatgtcggctgcagtgagaagaaaggaggagtagaggggggcattcccatcatttagaaatttctctcccctctttcaacccgaaaatgataaaataatgtgtccggtgtcctatagctaattaaacaacttttgtagtgtctatggacagtgttacttttcacggtgtccctcagccaattacacgttttttgcgtgtcctgtaataattttgccaaaaagttatcaaccacaagcatgccatctggtgatctggactgtaactttttttttggtgggaggggggggggtgttggagggaatggtaaaacatgacatatactccattatacatttgtactacgtatatacggagtatatagcagccaaatctatactttctatatagttggtacccactaacaatcattagaagctaaagctcaacatgcaaatatgctacatcatcacccactagcaattactattttagaccatttaaaatctcatgcaagcatgccacatcttcactcttttaaaccatggatagcagctccatggtttaaaaattacaagatggaaaaggaaataaactgtactgacaatatcaaattttgaatatattttgataatatgtttattttgtgttgaaaatactattatatgttttctataaacttagtcagactcgaaaaagtttgactagaaaaaaggtcaaatgaattataatataaaatggacggagtactgaacttcagggggaaaataagcatgcttctgtaggtaacaacttctcaagcagacaatcaaatctagtaacatatcattgcttaaccagattacttcgttgcgcgaaattcatcatcaggaatatgtatgtgctgagtatgtcttaattatagcattcaattccttgactacatcattcatcttcatcctttcccttggtgattccttgcagcatgctagaccaagtcgaaatataggataaacaactagttctatgatatcttgggtgtttccattgtaggttgcgctagcatccagtatttccagaatattgttaggataggctgcctgacatagtcgacaagacttgttgtaccatagttaaaattgtcagttggtcttcttccagtaaacatttccaataacagcaccccatagctatatatgtcaccatccatggagacctgagatccggagccatattctgaaaacatatatataaaataaagtttgattaggggggtaaaaggtggattccacactaacaattcatcagtcaaatataatatcaatattacattttgtttttgcatctttagtcacagtaaaataatatcttatcattttgttaaactagtaaaatgcagaacggaaataattaatgagatgctaacacatagttgaattaaataatagccacttacctggtgcaacatatccaattgttcctttaattacaaatgagctgctttctttgaacggttcagcaatattcattatcctcgctagaccaaagtccgtaacatgcgccaccaggtcatcgtctagaagaatgttgcttggtttaatatcacagtgaactataggcggcacaatatgatggtgaagatattccaatgcatctgcaacatcaagagcaatatgcagccttttcatcaaatttatccttgtgtagcttcttctaactgctgtcgtgtttgcatgaagccactcatctaaagttccattgcaaataaattctaggacaagtgccttgaattcgtcgccattttggtctgatccactacagacggtgatcaccttgacaagtttccggtgtcgaattctcctaagagcgtcacactcggtcaaaaagcttctactggctcctcgttggctaagattaagaaccttgattgcaactggcactagattctgatcaataattaaatttccaatgtatacatggccaaagcttcccgaaccgatcaaatttgccggcgagaatgaattggttgctgcttgtagttcggcataagatatcctctcatttgtctcattgagaaataggttctcattatcaacaacattcagtttcatctttctcttaatgaagcagtatgcagtcatgcaacacatagaggaaattaaagttccaacaatgcaaaagattaagacatgaagtcgatgcactgaagcctggtcagaatcttcatatgagcatgaagggaattgcatgtatggagggccaccacataacattttatttcttaagagtaacactatagtgacattacgaaaaatccctgtatttggaactgggccagatagtttgttgaaggagaggtttagattagttagaaacgtgaagttcgctagaaattctggtatgcgaccttccaagctgttcttagagagatcaaggatttgaaggctcctcaaattgtttaggctttttgggatttgtccttggagaagatttccttgaaaatttagggaactcaattggacacagctcccaatagcttctgggattccaccagacagcttattcattgacatatccattttgacaaggctgttcaagagcccaatctgtgttggaatggagccaattagagcattgttggagaggtttaggcgtctggtaagggacgttattgcaagtatttcttgtggaatttgacctgtcaagctgttacaagaaagatccatgacttcaagttttgtgaagttgccaaggctagttggaatgctgccatctagaaaattattagacagagacagatagctcaattgtgtgatatttcctaatgactgaggaattttcccatcgattctattatgggatatgtagaaagaattgagccttggaagcccgccaatatcaggaggtaatgttcctgtgaagaggttatatgacaggttgacagaagtaagtttgttaaacttccataaatcttcaggtatggtcccaattatttggttgccacctaggtcaatccatgacagctcattgctcaggtttgcaatgttaattggcattgcaccaacaaggttgttctttccaatatctagaaatcgcaagctactacagttggtcaatgatataaaaaattcccaatcactaggccgtgtggcttggagtgcgttgtctcctaacgaaaaaaccttcaggttaccatggatgccaatttccctaggaataatgccatggtagttgtttccacgaagaagcaaggattcaagagcagatgcgtttgagaaggtgggtggtattataccctcaaaatggttagcaagtgtgttaaaacgatttatcctgggaagcttaacaccaacatcgagtggaagtgatcctgacagtctattgaagccaagatcaaagaatctaatggaagaaatattgaagattgataaaggaacatggccttccaagtgattatcttggacactgaagtaaataagcttaaccatcttaccaaaagtttcggggatgttaccagtgaaactgttcccttcaagaacaaagtgtgtcaatgttgtcaagttacccatccagctcaaatcttggccatggatgaagttcctctcgacgataaactttgttagtgttgtgaggttggagagtgacttgggaatatcacaggtaagattgttgtggccaatgtcgaaaacagcaagttttgataactttccaagatcagcagggatggtacctgacagatggttcctgctaaagttcaacgaacgaagctttgggcaaccgccaaggctggttgggatatcaccatcaagactgttggctgacagatcaaggacatggaggtgagtcaggttgccaagctgctgggagatggtgccggttaggccagcatctctcagattgagagtggtaacacgactggggtattggcgatcattgcaagtcacgccggtccattggcagaagacaggtgctgtcatgttggtaccattgccgatggcgtcccaagaggacagcacccctcttgggtcgtttcttatgagggatttgaatgacatgagtgccgagaggtcatctccattgatggtctgtgaggaggctgtgagcaagaggagggcatgtgtgagaagagagagcatcgaaagctgccacttgattgccatggtagtagaaggaggttgagaggttgtactgtagtgatagcacttgtaagcatgaatatgtcagtatataaggtgtagaaatcggcaccagtagaatagagttgtaccagtgataacaagtggttgtaattgtgaggcttcttgaaaacgcatgatgactgtgcatcattgcattaagaagtaaagaattactcgtacaaatcagggaccaaaaggtgaccccttcacaccaaaacccactcaaacatgtcacctggctgacgtacaacacaatatcttataaaacgactttagtggtgatattttttaatttcacatgttttgtaatatcattattgttaattcatttaatggttgtcaatggagatatataaactaaggccctgtttaaatcacaccctaaaatttttcaccttgtcacatcgaacgtttggacacatgcatggagtattaaatatggacaaaaaaaaaccaattacacaatttgcgtgtaaattgcgagatgaatcttttaagcctaattgcgtcatgatttgacaatgtggtgctacaataaacattttctaatagcgaattaattaggcttaataaatttgtctcgcagtttataggcggattatgtaatttgattttgttattagactacgtttaatacttcaaatgtgtatccgtatgtccgatgtgacacgccaaaactttacacctctgcatctaaacaccccttaagcaatttcctcttgttgcagtggcaagctagaaagacttcttagtacaatatatttgaaaggggctagctgttttttcggcaaactttgatgaaacttacatgtgttttcttatatgttatttatgacaccgacatgagctccaacacacaccattttactagtcataagttcgtgaaaactcataaaactataatgatatggaaatttttcatgccaaatccacttgtcccacttttacatgaaaatcttattatcttaggtggtgttttggaaggagggactaaacttcagttcctgagggactaaaatttttgtgagttccttcccaaacacccccttaatctattcccaagagatctttaaactatgacgcaagaatttcaacatgaaatttctttctgaatgaagggtgtatagcttgtaactattataaaaaaaaagaaacaacagtagattatctcatacatagtaagagttattaatctgagtaactcacatcgcatcctaatgtacaatgaacattttcaacattgacgtatcctttttgcttttttaccggcaaacattcacaagctcttgagaatgcaatttcaaaattattatgcaaaggaaacatatagtggctgtgatggagccttaatatctctcctttagattatttcaccaccaaatacagaaaaaacagaaatgtttgtatttttcaaattgtaaaatatttgaggttaccaattcaaaattaacttaccgtatgagggcttacattttcatgatgtttagaggttgtttttttaaaaacttatcaatccctatatatttaaaaacttcaatatggctaattaagcaaaatcgaccctgccattgatatttgaaataaatagataacattttattttgagaagtatggtctctatgactctatcaggaattaatatatatttgtgacaaagactatggcatgcaagaccaaacctcaaactattggagtgatgcaaatctcgtacaggaaagctgacagtgtcaaaaatttagtcgtatagagataagatgtgtagaattcattgttcacaacttcacatagcacaattaacccaatcagaaagtggcacatatggcgagttctatgtaaaatagtttgtcttcatgcttttgcaaaataatgcgaattttaaattgaggtagtcaattttgaaatttacagtttcgcctgattagttcaaaatatatattgatcctttgatcattaacaagtttagtttgactaacctcaggtctattgaccctcataaattttcatagtagtaaacttgacctctgaacaaaagaataatcagctcttctattcatttatttcgacataataaaaaactgaatatccaattcacttatctagatttgaaggcaattttccaatgccggcacaacatgaccaacatgtcaacttggtgattgcaccatgctattatctttatctttcaaacctcatttctaaatgtccaaaatatggtccaatatcagatatgacatttgacctaacacctatgcgaggcacatgatattctccattgcagcttgcaactctttgaactggtatatccacctagtcatggtcttgggtcatctataaaactaatcaaaggtgttatgtctcaggttttttgaaaaatccagtattgtaattaacgagaaacattgaaatttatgaaagtttaggcaagcaactccatttaagctgagttcgtttgttgaggttcccaactcacctcactcgtttttcgcgtgcacacttccaaaacggttaaatagcgtgttttctgcaaaaaaaatctatatgaaagttgctttaaaaattatattaatctattttttaaaaaataatacttaattaattatgtactaatgagtcgctccgttttacgtgcgcaagggatttttttaccaacgtcagcagccgaacacagcttaattatttgtccaatcaccgcatatctctttttcttatttgttaacaaacttatatatggttgtgtgtcttacggtagaagccagagatataaatcatctctattatctaaaaatataatacatttgttcctttcgtaaaaaaactcacaattgaccttctatgtagggcctattggaacaggaacgcaaacaaatagcagttcgtgtgagaacaataatttcatatatagcctattggctagtgcgatgaagccacaatatattcatggtcctcaaaatttgtcttgaacatttgtcatttgtcatttcccatggaaattcaaaggctagaccgcttaactatcacgtgacactacaagttagtgacagccattgaaatctgaggcttgatctgacggaatgagcaattattgagacctaggagtaacagtgttccttatcttgatccatgaggagtgtcgaagagaaaatgacaaccagcttcaccatgttgagaaagatgctgaatttctgaccagaaatcagccaaaccccactcgccatcctttcaactgaacttggttttcctgcagttctatagtgtatctacaacctaagcagccagactgtttttgttttataaaacccaaaacacttcattttaattccattttccctttgatttcaacacttttagccatcagctcagcgtggttttagcagttcgtgtgcaacttctgcttaaataagagcaacaaaaacaagattgtggttttggctacataactgtgctcaatttgtccaatttcgagttaagtttctccttcttcatatgtcctctgtttctgtaaaatcaaagtgggtttaattgttattttgtgatgaaaaattggcatgtgagataattagttttgatatgtggagattattggcgaggtggtttttgcatcgattgggccggggtatgtgaaccggtcagaccgggtgatgatgaacagggttttcagatgttgaacaggtgttgcggttgtggtaagccggtcagactggagtatggcgactagtcagaccaaccagcccgcggtctgaccggccgacactttgttagtttcggtttccggttgtttctttggatatccgtggataattcatgtttatagcttctagatggatactatgtgtatgtaatattgttgtttggtaacaatgagtcaagttggttagaacttgtgctcggatattggcgcaaattcatcaagtttactcttttaaacctccaaaatacaaaaatgaaagtgataaaaatcactagatgaaaatggaaataaactgtactaacaatatagaggacttcagaacaaaaaaaacatgcttatgtatgtaacaacttctcaagcagacaaccaaatctagttacatatcattgcttatccagactactttgttgctccaaattcattatcaggcatatgtatgtgctgagaatgccttctttgtatcaatcaattccttgactacattattcatcttcattctttcccttggtgattccttgcagcatgttagaccaagtcgaatacaggataaataactagttgtgtcatatcttgggtatttccgttgtagattgcattagcatccaatccaatatttctagtagattgttaggataggccgttttgacaatgtcgacaagacttgtcataccatttataaaaatgttagttagtcttcttctagtaaacatttccaacaacaacaccctgtagctatatatgtccccatccatagagaccggagaccctgagccatattctgcaaacatatataaatcataaaaatgttttagtggatacatagtgaatataggataaaaggtggatcccacactataatctttagtcaaatataagttcaattttacattttgtttttgcatctctaggtcacattaaaatactgtcgtatcgttttgttaaactagtaaaatatagaacggaaataattattgagatgctgacatagttgaattaaataaaagccacttacctgttgcgacatatctaattgttcctttagttacaaatgagctgctttctttgcacggttcagcaatattcattatctttgctagaccaaagtctgtagcttgcgtcaccatgtcatcgtctagaagaatgttgcttggtttaatatcacagtgaactatagacagcataatatgatggtgaagatattccaatgcctctgccacatcaagaccgaactttctttagaccaaatggaccggaccaaactttccgtctggaccgattgcctacccataattaacaagtttagtttcagtaacccctgaacaagaatcatcccttctattctccagtatcaacatactgaaaaagggaaaatccaattcagttgtctagattggaaggcaattttccaacgtacaacatgagaccaacatgtgaactttgtgattgcaccatggtattatctttgtctttcaaaacctcttttttctaactgtccaaagtatggtccaatatcagttatgacatttgacctaacacctaatcaccaatgctgaggcacagggcggtctctattgcagcttgcatcatttcaaactagtatatccaccatgtcatgttcatgggtggaaaaccatctataaaactagtcaaaggtgttatgtccctggtttttttttttggaaaatcctgtattgtaattaacgggaatatgacaattttatgaaactttaggggaagtaacttcatttgtaccttttgtagaaaaaaataaactattgaccctgtatgtagggcctatttggaacaggaacaaaaacaaactgttgtctgagagcaacagtgtcatatgctattgtctagtgagatgaagtcacaatgtattcatgctcttcaaaattcgtcttgaacatttgtcgtttgtcattttccctggaaattcaaaaggctagaccgctcaactttcaggtcacattagggccctacaagttagtgccgggcattatatagaaacttgatgcttgatgtgacagaatgaacaattatgggacaattgcttatttgaccccgttttgaacggtaaccgctgatttggcctctacgttttgaactttgcttatttgaccctccttttagagtacgaagcctctatctgaccccatttcaatgactctgttagggttcgatttaaaaaaaatagaaaatgtttcaagagttcctaatggcgaaaataccttccaaaccctattttgactctctctctctctctctctcttactcgtgcatgactctcacagtctcacctctctcagtcgtgcgtgcggcagcggcggcgagctacgcgtgcgagctaagggggcattcggcaggcatagtgaaacattgtgagtacattaggtgaaacattttttgtagaacaaaaaatgaaacgagttcccttaatagagggttttcaaaatatgtgggtgatttgttgcaatggagtatgtggtggagacatgtggtggggcccaatgggggagacacgtgcgcgtatttggggagcgactgatctgggcgccgggcgccagtcgaccgatccggcgcattttccatatcattcacaagaagtgagcatgctctctttttcatttgttccattttacttgacaaccatttccatcttcagcgtttacatgggttctgtttttaggaatggataagtattcttaattcacaaatgtgagggtaggggtggggctgggggcgtaactatgtgagaggtgtattttacctacccctccgttttaggttatgagacattttgactttagtcaaagttgaactactttaaatttgattaagtttatagacaaatatagtaatatttataatattaaattagtttcattaaatcaataattgaatatatttttataataaatttgtcttgggttgaaaatgttattatttctttctacaaacttagtcaaatttaaagcagtttaattttgaccaaagtcaaaaagtcttataacctgaaacggaggtagtataacacaacctattgttgtatagtatgtatatatatgtttgttttatatatcgcagatgagcacaatagtaaaagaactagtgacttgaactatagacttttgactcaactccgcatgccaacaatcatgtttctagttagtcatatgatttttcatgttgtctaaattgaactgactaattgtatctgcgcatcagggggatccgttctctagcagtaggccaatatcgtaacatttcccttctcctttgcaattggcggctgcttttcactactagaaaaaacattttcgccgacgttggcaaatcattttcgcaggtagaaaattttctacctatggaatgatttcactccaatatccatgaaaccatctccagagaacaaaatggttaccaagatgtgatgtgctggtgaactccaccagttataatgctttaccgcatttcattgactatatatggccatgtttagttataggggtgaaaagttttggcgtgtcacatcggatatacagacacacatttaaagtattaaatgtagtctaataacaaaaacaaattacagattctgtctgtaaactgcgagacgaacttattaagcctaattaatccatcattagcaagagtttattgtagcaccacattgtcaaatcttggcgcaactaggcttaaaagatttgtctcgcaatttacacgcaatctgtataattagttttttttctatatttaatacttcatgcatgtatcaaacattcgatatgacgggatgaaaagtttttgcgcgggaactaaacatggcctattccttgtagcatctacatactactattacactcttgttcttttattccaatttatttcacaactttattttgggatacaaaagtgcatgttatgtgccaatgaccacggaagaagtgtgacatcccggcttaggacttaatagaattaatagaatactcatatcaacaagttacaacttctttttcagaaattgatctctaaagaactccagggttaagcgtgcttgggatgggtgactggccgggaaattattcccgggtgcgcacgagtgaggacaaaatatgcagaaaagacttatgttgatctgtgaagcgggcccggtctggaaaaggcgggacgttacaacaagcatctggactagtaccatttttttttgacattgtgaagagaaacgctcatgtatgcaagcaaaaaagcatctggattgtacgacaagaattggggaacagcctgaacctgtaatgcctccattttacgtcctgtatctagctgtactattattttcttaactgtcaacgtcgagtagtatggtggaatctttatttggatatattctgacagcagtatctgtgcaatgtgaattctgtgtaccatgaaaagatctataacgagaacaaacaaaggaattgcaaggtggatgataattgtatggcagacctccagagttccactactgttagataataattctgtgaggttagaacccaatgctacaatggatgccttgtttttaggctagaagacaggaggcatattaaccaaggtgatgccattgtagaagttcagagtatcggcatctagcacatacagtgccactaatctgtttggtacagctctaactcctaaatataacttcaggagttaaatctggagtggag

SEQ ID NO: 36657 - DNA, 7839 bp, Oryza sativa
agtatattttgtgacagagctccacccaacttcactcccagttttggtggagctgaaattgtttggctgagctccagctccaggaggggtggagttggagctggagctgtgccaaacaggctttaagactcatgttgaaacttgctccatcaccatagctgaaacctctatttgtatgcactcccattagaataacggaacgcgggcgtgaccacaaacacagatcaaatcactttgttagctggcaactggctcttgttgctggacgaatatgccatcacactgtaaaaagacgtttttaaaggtgccacccttttactacacaggcggctgtcattaatgctggtttgtggtttcttgaactctgctattgccctttcagccatatttacatattcttcacatggatgctttgttttctcccatatcatagtgtggatacgtctctcctagctccactactgtggtctgtggccacagatttgtgaaagaattataaccgtgcaacaattcctaactcaccatttatattcaactttaatagacaagggtcttgttaacctctctctctcccttttttaaaaaataacttttatagacaagggtcttgttaacctctctctctccctttttaaaaaaaatgatactgctggtttgttaacccaaattagtcatgtaaatttttatatgatggcaatattatctgttcaccagatcaatttgaacaactaaacaaatgtatgcatatgtattatagtaagatttgcatgtatagacttttcatcaaacttctgcttcatttatttatgtgggagaaaatattctttcaaaaaatagttcttacaaacttgtacctataaacactttgtctatgttttcagcgtccatgttttcagcttcttcccatgtcggagagacaagctcttcccatgacattaatgtttcctcaatgtggttagcagaaccaaggagactgttgatttgctttactccaacatcacaatgcataacactgcaggtattacacatgaccttcctagctacagtacattgcaactgcagatcttataaagaatacgaaatgctattctcccgaaccactcatatctataatattggggtaagctctggaacatgtttaacgcgtcaaagaagcatgaatgactacagtgcaaaagtatgggctgatcttagattcatgcaaatctcccaaaatgctcactagttcgttctaaagtataagatgcattagagtttttagatggtctctaacattatgcattgatcactaattttattcataatgtattatgaaaaacaatgaaattaatgtcatatgtaaatacttttagatatgaatatagcaatactatatatatgtttatagaaacaaatacacaattttttagttcaattattaactaaaagattcaaatattgattttctggaaaaataaggatgatttatactctattttatttttgacagagggaataccatatgttaaaatatactcctattttttttgtatgatgttgattagtttaaaaatgaactaacgaaaaaaaaacttttttttgggaattggataggttcggttggatagttccagatatttttagatttagaaacgaattaggattgaaacgaaagcaaatacagtaagggcactatccgttgaaatcgaaaaacagtaggaaactatccggaatttttctccggttattctcatgtagcaattaatttttagaaggaaaacacgtatatatacacctaactttgtcatacgaaaacagatgaagacaaactttatatcaaattgtagagctcgacaagatatacgactttgttgctgacagtttattgtttgaatcatatatgggggtccaaatattcattagaaaataccatatctatttttacaaaatctcagatctacaattgaaatgacatcagatggagacgtactctggatatcaaagttatatagttcagtgaatctactactgtgtagtttatgacacttgtatttgaaaatattttaagtgtaaaacaaatattacaagtttcgaagaggtgaaatacaatgaattcaatctataaaacgagaacttgacatgtgatatagacaagtgatatagtaagtaagctatgcatgaagtaagaggtattggaactaggaagtggataatcatattaaaacgtgggtcttttaggggaatgtccatgaaaatcgattttcacatacggttgtgagacctcctaaaaaaattgatgatacaattttggagatgttgatatcttattttagaaaaataacaagcgatacctcttgcttcattaaggaatctcaattcgaggtattttttatattcagcaaatattcgttattgtactcattccgttttgtattcgttccgtatttgtattcgataatatttgattccatttccgtatccgtgtttttgatttcgattccgatttcatccctatggcacagtatacttgtgtgctggactagttactactagtcaccaattgagcctaaaagcctgggtaattaattaatccgatcatagttgattctctctctcttttctcttctgctttttttcaatgtgactgttcttttacataaatgtggctgtttatatgtccattatcatccattctaatcctttcttgtaagttgtaaggcatattttactgtactatggtgtatataacaacgaatggatcttatgattatatccatgcatagtttgaaaatgcacatcgtcgtcttcaggcctgggtgaagcctaggccagcttagctatcttcttctctgctttggtttgtcttcattgcacccaaacattttttttcttgggtaataaaatatggttgtattttttttgcccaatgattacagtcgtaaaagatttacagctgaaacattattactaatcttccaagtagcccctacataacattttttatatggattattttttgagaaacccatttttatatggattaaacggtaagatttgtaatgttatttattgtcctattattatcctaataatgatgtgatttttcatcgtaaacaactgaagattgcaaagctgcaaaccaggacaggttcaggggactgagaaagtaaaatgcaagttccggggcctacgttaaacagtggctcaaattcatggagtttactctttaaaaccatatatagatagcacccccaaaatacagaaacaaaagggatacaaagaaatacaagatgaaaatgaaataaacagtagtgacaacaatataatggacttcagatacaccaaaagcatacttctgtgacaactttttgagcagacataaccaaatttagttacatataattgcttacccagattacttggttgctcgaatttcatttaggcatagctgtgcatgccttctttatagcaatcaattctttgactacatcatccatcttcattctttcccttggtgattccttgcagcatcctagaccaagtcgaaatataggataaataactagttctaccaattcttgagtgtttccattgtaggttgcgctagcatccaatatttccagtagattgttaggataggccatcttaacatagtcaacaagacttgttataccattgataaaattgtcagttggtcttcttccagtaaatatttccagtaacaacaccccgtagctatatatgtcaccatccatggatacttgagatcccgctccatattctgtgtatataaatgaatgttttagttgctactaataagtagggataaaaggtggatttcacactacaatttttcagtcaaatagaagatcagtatcacattttaattcttttagcatctttaggtcacattaaaataccatactatcatttttatgaaactagtacaatttagagtggaaagaattttcactgtggccatagtttagttaaataataatcatttacctggtgggacatatccaattgttcctttaattactaatgagctgctttgtatgcgtggttcagaatgcattatctttgctagaccaaagtcggtaacatgtgccaccatgtcgtcatctagaagaatgttgcctggtttaatatcacagtgaactatcggcggcacaatatgatggtgaagatattccaatgcctctgcaacatcaacagcaatatgcagcctttccaccatatttagctttctgtagcttgtgctggttgttgtacttgttgcatgcagccactcatccaaacttccattgcaaatgaattctaggacaagtgccttgaattcatcaccattttggtctaagccactgcagacagtgatcaccttgacaagtttccggtgtcgaattctcctaagagcatcacactcgctcaggaaacttctgctggctcctctttggtcaagattaagaactttgattgcaacaggcactagattctgatcaataattagatttccaatgtatacattgccgaagcttccagaaccaatcaaatttgccggtgagaatgactcggttgctgcttgtagttcggcataagatatcctctcattcgtctcataaagaaatgggttttcattatcaacgatgttaggtttcatccttgtcttaatgaagcaatatgcagtcatacaaaacaaagagaaaatcaacgttccagcaatgcaaaagattaagacatgtagtcgatgcactgaagcatggttagaatcttcaatgagcatgaagggaactgcaagtatggagggccacctcatagcattctattacctgagattgacactatagtggcattacaaaaaatccctatatttggaacaggacctgacagtttgttgaaggagaggtttagattagttaggagcgtgaagtttgcaagaaataaaggtacaggacctgccaagttgttgttagacagatcaagggtttcaaggctcctcaaattgttcaggctttctgggatttgtccttggagaaggtttctataaaaatttaggaaactcaattggacacagctgccaatagcttttgggatttcaccagatagcttattcattgagaggtccattttgatgaggttgttcaagtgcccaatctgtgttggaatggagccacttagagcattgttggagaggctgagaagtaaggtaagggaaggtattgtaagtatctcttgtgggatttggcccatcaaggcattactggaaagatccaagagattaagttttgtgaggttcccaaggctaattggaatgctgccatccagaagattattagacagagatagaaagatcaactgtgagatattgcctaatggttgtggaatctgcccagtgattctattatgtgacataaagatagaattgattattggaaggcggccaatatcaggaggtaaggttcctgtgaagaggttgcaggacaggttgagagaagtaagtttattgagcttccataaatcttcaggtatggtcccagttatttggttttcacttaggtaaatccctatgagctctttgctcaggttggcaatgttaattggcatttcaccaacgaggtttttgtgtgcaacatctagccttgttaagctgctacagttggtcagtgatgtcataaattcccaatcactagatcgtgtggcttggagcgcgttgtatcctaacacaaataccttcaggttaccatggatgccaatttccctaggaataatgccatggtagttgtttccatgaagaagcaatacttcaagtgcagatgcatttgacaaggtgggtggtattataccctcgaaacggttattaattgtgttaaaacgacttatcctaggaagtttaatgccgatatcgagtggatgtgatcctgacagtctattgaagccaagatccaagattcttatggaagaaatattgaagattgatagaggaacatggccttccaattgattattttggacactgaagtaagtaaggttaagtatcttaccaaaagtttcagggatgttaccagtgaaaatgttgccttcaagaataaagtctctcaatgatgtgaggttgcccatccaactcaaatcttggccatggatgaagttcctcttgacgttggagagtgacttggggaatatcaccggtaagattgttgtggccgacactgaaaaccacaagctttgataactgtccaagatcagcagggatgttacctgacagatggttcatgctcaagttcatggcatgaagctttgggcaaccgccaaggctgattgggatatctccatcaagactgttggttgacagatcaaggacacggaggtgggtcaggtttccaagctgctgggatatggtgccgactaggccggcatcgctcagattgagggtggtaacacgacctggatgccggcgatcgttgcaggaaatgccggtccatcggcagaagacaggtgctgtcatgttggtagtgttgctgctggtgtcccacgaggacagcacctctcttgggtcgttccttatgagggatttgaatgacaggagtgctgagaggtcatctccattgatggactgagagctggctgtgaacaataggatggcatgtgtgagaagagagagcaaccaaagttgccatgtcctcttgattgccatggttagagtaaggaggttgagaggttgcagtctggtgataacacttgggagcaaaaaccaagtcagcatatatagacatatggtggtgtagaagtctgcaccagtggaacagagttatactcactaggtagaacaagtagtagtaacagggggaccatatcccactcatgaaagacacttttatggtgacaccttttattttgtaaatttcctattcttaactcatttaatgatggtcaatggaaataaataaactagacgattcccccactacattgctgcagcaatccagaaaaaaattattccctccttcccaaattgatcatcatatgatagaattcaaaatttctcaaattgatcatcatgtaacctccgcatagacacggattccatcataatacaattaatgcagcatggaagaatgtgtgcatgctaaggatttcaaaaattctgactgcaagaatttccgaatgaaaagggtgtatagctaattattgctcagtttgtttcaaaatataaggcctattatgttttgttaggtactttgaccaacaattattttttataataaaactaataaggtaacccgcacattcgcgtgggtaagtatgttttttacacgtgtttgaccatttgtcttatttaacgtttttatgcaaacatgtggaaatgtaagttatgcttaataaagttataaaccaagtcacaacaaaataaataataattatttatttttaatttaaataaattgtcgaacgtgtaccgaaaattcaatggtgttatctatcgaaaattgtacctttaataatcgtacattttttttgaaaaatattctttatcgacattgattatttttaagctatttgttagatatttatagatcaatactcactctctaaagtataagtatatttggattttggtacggtgtttgagatcctggattttttttacaatttggtccttccaaaaacttaatttacaaatacatcccttaaaaaacttattccagaaataatcattttttgtgtgccagagtggctggtgttgtcatccaatagggctccacctgccatactggcgccaaccccccaccaccccaatgcgctagtgcctcttgcatgctcctccggggtggggctagcacttaacccgtgggccccacccct

SEQ ID NO: 36658 - DNA, 511 bp, Oryza sativa
attcacttttcccacctacctccagtactcatccaatcataatcctccaccattcacttctacctactttcttaataaccgtggccaactctaaaacgtcttatattttgggacggatggagtagtaaaaatctgagtagatacaattcccccataatatttcttacccaacagctgtgactgatacttacaatgaaaccgttcaaaagatgagctccttttaacatttgatgccgaactttggttgcctgcctgatatactcttctgtatataggtaaccataacaatgtacgactgggacacagtgtgcaagtgcaaagttattggatctgtaactgtagccgttctcggtgaagacgaagcaggagctacttggttcgacctggacagtaaatctggtcaggtaaagtgtaaaattgatgaataagtgatattgtctaacttaccactattgctgtacttcaaatattcaatgaacttttaaggatgtatttacaattaacgaaatat

SEQ ID NO: 36659 - DNA, 43210 bp, Oryza sativa
  unsure (1)..(43210): unsure at all n locations
caagcttgacaagagcaagttcgagcaacggctgcagctctgggcgctccgcatccaccgcgagctcgcctacgccgtcacccgactgctccgctcggggtaacttctctctcgctggtcgacgaatccacgatccaatccattcaagaaacggagagcatagccctaggattgtttgatgctattagtaggagcgaggggtagtgctgaaagctgagctgagcttgtcttcccccctgtttctaggtacctactggacaagccgcgggtgaagccagtcgtggaggatcccgagagcgacaagaaccggctcgtcgtgttgtcggagaagatccagaaccccggtatgcttttccctctgctctaaaatttgcaccaaatcgctcgactttgcaaagtagagcttgtcaattggacctcctgtatgtatgtttttcaggctgtgtttgttcttggtagcctgttcttatctggaattgtgaattagaactaagcaaatattgtgagttgctgtaaatatttgaatgccgtcaccaatacttgattgagtctagttagatccatttggttgctcatgtcttgagtaccatagtttaccatgcttgcttagcgccttttgatcgaaagaaaacttctctgttttagtgtttctaatctgtttcgcctctgttgaaagaatgcttacgcctggtttttggaatacagacctgtctgatattgaggagaaggtttacgattcactgaagcaaatttgcaacattgatgttgtaccttacagtttgacccttggttattcttactggagtgcaggtcggtttaccatctaattctctaagatcttatttctgttcttttgttgcagtgtgttacttaggcacattcaatcatgttttctttatgttatttcttgtgcaaagtagtagatggcaaattggtcttccaaatcaaggacttcttttcaaaagttccagttttctagttgtgaatgctactaatattctcttcttcatttgtgtaggaatgtaggattccatattgttaaagctattttgatgtgtagtgctgaatttcatttgttgggttttcatcccttttatttcctgtagatcatattctgaagcagatcttgcctgctggagtggaggtaccctcttcttttgaaacaattgttaagtatactaacttcgacagtgcttcctttctgttgtccctttccattttttggtggaaccttgttactaatagtaatttttatggtacatgcaggccatgttgcacatctgaacatacctgatgacttgcttccatacaaagatgtcatagcaaaggtcatctatgatgtaaggatatcttctcgagtaacttgctcaattcctgattcatcctttctaagtacacttaatatgatcaaagcacatgttcatgaacatgaagcatatctacaatttgtttctgaatgtaaaacagtaaggggctttagcaactctgattatagagagcaaccacaaatttacatttagcatgtggcttcatgcacaaaagaaagattctgcccatgattttactattgtaatgttcctaaatgtctgtcttgattgtcttgttttcatcctgtgagcagagaaccattcaactgtcacatggaaatagctaaaatagaattgcaacccatgatgtgtaagcaggaggcactgtaaaaaaacaatagacacatctagctattcactgtttgttctctaaagcagcaggattattcataactggcaagaatactatgtttgttcccattattcagataaaatatttttacatggttatatgcagaaaaattatccaaggattcagactgtggtaaataaagttgggaccattacaaacgagtttcgagttccgcagtttgaaatcttagcagggaaaaacgatatggtaactgaagtaaaacaatatggcgctacatttaaacttgattatggattagtctactggaattcgaggcttgagcatgaacacatcagattggtttcccttttcaagaaaggagatgttatatgtgacatgtttgctggtattggcccattttcgattccagctgcacagaaaggatgtattgtatatgcaaatgatttaaatccagacagtgttcgttatctaagaacaaatgcacagattaacaaggtggacgattatatatttacatataacatggatgccagagtgttcatgcaaaatttattggaagtgccttgttcagaaaataagtcagactctcaagttgctgctaattgttctagtgaagacattgaccctgctaatgaaagttcgacttcaaatggaaatcatagtggtatttttctttctctcctcctacatattgctttgttgcagattcgttcttcatacacatgatgaagctatccacttcctgaactcatgtagatgttcaagagagctgccataaggatataaatgactcatccatgataagcactgcgacaaaaaggcgtcaagaaagctcaaatggaggtaattacgtcatttattatgtctttaggaatcttgcaactcctatgtctgtcaatctactaagttaataacaactgtgataagcatgaagattttacctattatgttacttgtagtagagttacacttttacctctcctataggtgatgggtactgccaagaagatgctagtcatacaaagaagaggaacaacaaaagagtaaaaggctcaggaccaccacctgtcaagccatgggaacactttgaccatgtcgtaatgaatttacctgcttctgctctgcagtttcttggtaatgtttttgtacttttatcctctccatcaagcttttctgttacattctaatgatcacattatgtgctgggcaatttgttgggttacatgacatgctcacaagccatgttagtagtagaccattgataacatttctatactcaagacagcagtgttgtcctttttgttcttttgctaaaaacactagaactgaatcttcttcacagatacattttgattgctcaatgaagtccaaaacttaaccacagatccttcatctgtttgcaataaatttctgcaatactaaaatgatttagattaaccaatgataggcaattgtaggcactaggcaagtgacagcagggcataagcatatgggatctgtcatgcacaaataattatctttgaattttaaatttgtaacaaaaatgaccatcctatgaaaagccacacaaatagaggtgaaattttcttagaaagcagacattcataaaccatgcagtggcggaatactgttgaagcgggaaggtttcttttcttgtgaattgtgaagaccattccagattcaatggaataagtaactgtggataagtatcatacttggatgcatgtattgcaagttgccaagtttgttcctaggatttctacagtctgcatggaatgctaattttgtggcatttatacgacattttgtggcctaagtacgtgcagtatcaatctctagttcatccatgagaccatgactatatgttcttctcagaccctctgttggttttgaatttgttatatgatggggaatgctatttcaccaatttaggcccacattcttccactgatctgaaacctctttctccaaattttcaaacgaccaatttgaattgcaaaattttgcatgcctgtatttgtttgtcaacatgacattcactttcgccttcaaggtcattgttctgtgtcaaaatacatcattcatttcaatccactggcaattcaagatttgtctgctgatgggggagttctcttttctacataaagtacctttcgtttgtgttttaatttttataaactctgcataacttgccacgtgggcctggctcattcatagccataacatgtgtctgtaagttccaaacatgtagttgcactcttgtatttgtttgatgcatttgattctcatgttactaagtattgaactgttacagtttctctttgagtctttgttctagtccataattgtagatctgctgtgcagattgtttcagtggtcttgtccaaaagaaatactggaccggaccattaccttggatccactgttattgtttcatccgttcaagtgaatctgaagaattgatattatccgtaagtccatacctctttggctgtttctcaacatgagataaatcgcttttatatgctcttatatattttgcgaggcatttccagtttgttttaatggcccatttcccctttcaggaagcacaaaataaattgaatgcgaagatagcagagcccatattccatagggttcgtgatgttgcacctaacaaggtatcctctgtctcatataataagactaagattcatgtttattgtctgcaagattacatgcacaaatttctttattttgttgatcttaggatacagaaatctttttcatttgtttgagagcacaatgtatggcccaccgcccataatattttcctagcagaaactgtctcttggtgaatggtctttaagaactttgtggttagccaccaataatagtttttctagttttcctgcataatctgggaaagtaactaagcaatggatatttttttatgtttgttgctagttcttgtgacacctaatatattgtgttttatatttcttgcaggctatgttctgtttaagttttcagctacctagcgaatgtctcaaggatgaaactgaagatcacatacaatcagttgactgttagcctcttctatacagtactcttgaagttgtattagttttgcctgcagttttggaggttctataaaagaaatggcgatcatccgatgtctcctgccaagatggaacccagttgcatctcatggtgaaggggaatcaatgcgatatttttgtagactttaaggtgctttgcatggttgaaatcaattcggagccctatccgattcagaaatctgctgccgtaggtttgcatatctggttgcagggcttttcatgtctgcgctgcttctggattccaatgccttatcagttttttctagagtgtgggtggagttcatgtaaaacgggaaaggatagtagttcggaaaattatactgtccattatcgttgttctctgtatttttagttccagattaatcctattgtttacatcaatctcatggccgtttgccagtgtatttatgttcagcccattttcccttgtgcttgctaattacctctgttccaaaataagttaatctagcatggaatctgataacttatttgaggcggtatacaggctggtgtttgcctttcagtcttctttctgtactggtaatctctttctgtactggtaatctcggaagattaaacataagagcagagcctggagctcattttcagaaaaacttatatcagattgatcactgatggcatgggacggaagcagagtggctcaaatatgtcacagttgagcaggactaacgttaaacacaaaagctagcatacaagcagaaaacacaaggacatggcaaaacccaagaacacaggaggaggatcttctcctctggaacgaactcctcttcaagattcaaccaagatcagggacgatgaggtaatcctcctcgtcgtcggggagctcgacgcgggccttcttgctctggcggaagccggtgcccgcggtaaaggcggcggcggcggtcctggtcggcggcctgtagtacgccacgtcgttggccgcctgcgaagcgaagagctcggggacctccgccgtcgtccggccggcggcggtgccgcccttgggcgcctggttgtggaacaggtcgatgtcggcgaaccactccagctcctggaacccgagcggcggcgacgactccttctgcagctgcagtataatcacaaggcgtggttgcgccatgagaattgagaaagagggaacccaaagcatggcatggtggtttgatggtttcagtttgtgtaggtgcttgccttgtcgccggtctcgtagtcggagaactggaggagctcgtcgacggcccagccctgcggcaggaactgcggcgagggcgtgtcgacggcgacggtcggggccggctgctgatgatggtgatgatgctcggaggagcccatgggcggggcgtggtggtcggagtcatgggcgtcgctgccgccgtcgcagggcgaggcggaggcgaagccgacgcggatgccggtggcgaggtagcgctggtggttgccggagagcgtgccggggacgtggatgggctcgtcgcagtcgcggcagaagagcgcgcggtcctccacgcagaagatgaacgccgccttctcctggcacacgtcgcagcgcgggagcctcgccgagagcgcctccagcggcagccgctggtgcttcccggccagcttgttcgccgcgtgcacctccacgtcgcacgccgcgcacagcgccgccttgtccgcgcagcacaccaccgccgccgccgcgctctcgcacgcgtcgcactggatcttcatctcctcctcctcctccccaaccaagaacacaactcaagaacaagataagacagccgcaaaggtgtggctgcgcagctgcgtgctgcgcgtcggcaatggaaaacgagcggcagaagaaggggatccagaagcgcggctcggctagtggcgcatataaacccgtggcgcgagggagcacgcaaccgcgcggggcgcgagcaatcaaccaaccaaccaagcgagcgagcagcgcgcgaaacttgtggtggagaagaacttgtggacgcgagcgcgcggcggtggactactactagtctgcgcaagtcgcaactcgcaacggctttttttgccgcgatcgcgcagctgcgaagattttgatctcgatctctgctgactcgactggccgatacaagaagaatggagtagattagtaagattcacgataaaaaataatggaagcttatggctggctgtagctcgtgcagggcgcacaggggtcgcagcctaagcatggccacccattcgcgtgcatgcaaaattaatcaaatcagatcaaatcagattggcaatgtactcggtgttggtgtgcatactttgcatgttgcatcggtttctttaatctaggagtaaaatgcgctctagcgattaaattagttgtgaatttgtgatcgacgtttttgcattgtttttttaatatagggggagtatcatactgtagggattagattagtacgtgatcgatatttctatttcgggtggctatgacttactgaggaactagtagtggaaaattccttcaacttgaaccgagtgcatgatgcaactgtagttggtggtggactggtctgtgactctgtggtaagtacgtttaggaggattgcagttggggcgataaaccaagctggggtgatttaggttggtgctgggtcattattgcaaggattatcggtcagattggcggtgtccctgtcgtgataaatgatcaagtttctggcttttttaagcctccgctgaaaaaattatgaggttgtttctttttcgtcttgttatttttgtgtaagcgtatagtatatcagtttgtcagctattctgcattctttgccgacatgggatactgttagtgatctgttcctcaaaccacagttgctattgttaggttgtggacacgatccttctaatctccaacgctgtagtattactgtatgcaactcaacgctgtagtattactgcatgcaactgtacatgtacactagtacaaattcccagtggaccattgcttggctagctatcacgcatctgttctctaagcagcaacttgttaagatataaagcacgctcgtgaccacgaaaaaagccccctcttttcctgccaaaaagcccctctaatcacatcatcaagacatcaaccctgccggccgccaagttgctttcagtaagtttcagcgtttgtggctgtggatgatcgagttccttcggggagggagagatcgagatcgaataataatcccttacaactccttatccctttaattaacaacgtcaatatgttgaaccggttgtagtcctttcgttctaaaatataagaacttaaaatcggataagacattttctattactaccaacttggatacttggatagatagactatcaagattcatagtactagaaaattttccattcaatcttaggtcattatagtttggagatagcagcgtacggctccagctacgcccaccgccgtttggcctattctatttggaaattgctacatacgattggtgtgtacgacttgcatccgaccagtacttacccgctccttgctctagcccatatggagagtagctggctcgtactccctccgtcccaaaaaaagacaaactccagtttccgtgtccaatgtttgactgtccgtcttatttgaaaaaattatgaaaaaaattaaaaaaataagtcacgcataaagtattaatcatgttttatcatctaacaacaatgaaaatactaattataaaaaaaattcatataagacggacagtcaaacattggcacgagaatccacggtttgcttttttttgggacggagggaatatgaagtaaattgattgcagatacgacagggtcggataggggttgaataatagggtcggatgtatagcagtactcattctattttgcaaatttctgcatgtgatgtgaggcaggcagctcaacttggcagacgaccgtggtgaaaaatccgaccagtgtttagacttgtgtcactgtacagttggcttggattattgcaatgcaaagcctcgtcttttcaagtataaatcagcccggccatcacggcatcaatcacccagctagcgccaataggattagtttcggaaaaaaagaacccagcacagcaccaatcattcagagatcatatcattaaataagaagaggaaaaaaaagatcgagagccaacgccagccacacgtacactgcctggtagtagtacagtgcatgcaccaagctgacacagctcgctgctgtggcaggcgcagcaacagggagtagcgctagtggcaatggcaaaggccgaaacgggccggggagacgacacggtcacgagctccgcattcaatttgccgacgacgacgacgcgcgacgacgtacgagacgcgaccgctgagccgccgtgcgccactagctcgcccgatcccctctccctctcctgtctcgccgcctcctcgtcgccgccgccgccgggtttgcctcttgggcgctgggcctgatcacgagcaggcgcaggtgcatgcacgcctcctgtcgcgtcgcgagtctcgaggccgcgatccgcctgaaccggcaggtcaggcaggcggctccgctcgctcgctcgtggccgtggacgcacggcgagtccgctttcgctgcgtttgcagcgcattcatgtgcagaggtcgacatgggtttaggctgggacgaagagacaatgtcgacatggcttgtggcttgggtttttttttggctgtttggataatacgggggccatggaaaaagtgctggggcattttgctgttgtgtgtactgtgcagcgtgaattggatggcttgttaaatttttgacgtggaatgcggagtctcttttcttcttcggtcgggacggggcctttcatcgatcgttcacttttctatgttcctagacggggttgcaattgcatgtcaatgtttcgcacggctgataaatttgtggatgacaaatttagcgcaggtcagctgagccatcaggtggagtaggcatgtagcctagctagcgggagtaatcgtccaagaaaacgtacgtgagagatgagcgagagtaccacattcactttccaagatcgtttatctagtgtacgtgtcatattgagacacggttcaaaagcaagagcacacgtaagctatctatctggagtactgtaagctatggtcaaactatcataaccccgaatgtttcattaagtgatcgaaggatattagagatcgacattcatatttggtttgagtattatcttgccattgtccaagtatgtggactgtggtaaaccatccgaaaagtaccagttataaccaagtgtgttacaggtagtatgcacttatgcaaaattaggcaaaaaataggttaggtgagatttaagttctcattggttgctcatattctctaataagtcaacatgactaattagggaataaaaattaatttacaggtaaaacttttatatatgtgttattatcacttaaaagtcaatgtaaaaaaatacgttgaaaatatcttaaaatccacttcaaaattaaatttaaaaattcaaactttgatatatttttttggcttattagggtaaccaatggggctcaaggaggtataataattttaaggataaatttaagatctaattgttcgaacgctaactttaccacaagttaatttgtcaaaagtgtggcaacaaattattcataggtgtagcaaaatttagctacaaaatcctatctttctataaagttagcctactacatcctaaggctcaatatgtaaagatgcaacatcatccactaacatttactacatctcaaatctcatgcaagcatgctaatttattaatttttagagctttaaaatgcaagcatgtgaattaaattatcatcccacataattcacataatattttaatatatctctccatcaccttttataatatcctatatgcctatagttcatcctcacttaaattttatagctttaaaaaatccaagcatgttaaatcatcattccacataattctcaaaatatttcaatatatctctccatcattttgtataatatctatatacctatacaatttattcttatttagttaatgttatttctctcttctctcattaagccatatcacctcaattgcttctatccctcaaatgattaatctatggttggaattatctctcacattttcttctcttataaagccacatcatattacttttaaatttgggtcatcattctatatactgtttaaattatgataaactacatcaacttatgcaagtttctatcatctagctatcttacacattatttctattttttattagggaaaattggaaccatgccattatcatatcaatctcccacagctacgcgcggggtttcacctagttagcatataatatgtgagccaacaattaactgaattgtggctagtgtttgttaggcaagttcaaccaaacgctagcataacaaagggtagcgcacgtaacatgtggcgtggcaaaccgtgacagtgaaccgaatctcatttgaatgggatgattcttaatggagtttctcagaaattacaaagatttaaatgaaaatcatgtataaaattttatgccatacaaataagtagatgttaaagtttgaagcaccacattaacgctgagttcgataaaactttttggctagcctaatcaccaatgttctaaatctccggctaagcctcttaacggttgtgctctccaacagctaagagcggctatagcgggttatagctacaactaaggtatttagcagttttaaaaaatattaggggaaaaataaaaaaacttatagaatttgggctaaaatttgacatgtgactcactatttgattgcacatgttgctgctcgaggtgccgtaggagccgccaccgtcgccgcttgggggctggaccgtagaagccactgcagccacttgggggcaggaccactggagctgccgccatcaccacttggggcaagactacgttggagttgccgccatcaccacttggggcaagactacgttggagcagctgccgccgccgccgcttgggggcaagagagtaggagccgccgctgccaccgccagtcaccactgctgggggtaggagccaccatcaccgggagagcacaattctggagttgagactaaagaggagcctcgcacgagtagggggactagggagtgtgggggatttagggtttggttttgagctgaatttcgtggaccacgatgccaaaagcccattttcgcgggccatcgctaaatgctgtatctattttctgttagtttagcggctatctccggctaagcacaactattagcgcccaataaatcttagtgtcaaaactgaagtctcctagctgtcccctccctatccgctatctccggctatagtggcagtatagccagacatttagaacattgctaatcacccatacaaagcgagatggataattaagtattaactgttataaatttaataaatagattatttgatttttgtaaaaatatatatatatatacttcctccgtctcataatatagcaacttaaaactgaatgggtacaaatttgttgtactataaaatgtcctacattgttatattatgggacgaagggacgaagagagtatcatatttagcagtttggaaaacggtgtgagaaaacgagagtccgaatacttcagccgtcgcacgggcgcttgcgattgggctgcgcttcgatcttcgcggcccaatcacacagaaagcacaaagatgattgggccgttggaccgatgcgtgattgccatttcagcccgcacttcccaagggctccaagcccataacgcctgtctcacaaaacgagtagggccccacatgtcagtggccgtgagggagcacaacccgcatccggtaaaacccacccgtccccaacctctccgtccaatcccccaccgcgccgccgcatccgcctccgccgacgccggcgccgcccgtggtcttcctcccgcccgccgcgcgccgggagatcgatcgtcgcagctcaccggatatggcgtctcagccgcccgccctcgatatcctaggtactctttgcccccttcccacccttcgttttgcgccccccacgatctcttccgcgaggttggctacttagtacttacctagtctaccacccgtttgacgaattgctcgacccggggcaaccgcagtgcgcgagccggatggattcagcgtgtggtcgggcccgccttacccgacgggctccgccccgccggtgaggctcccgaagacggcgtgcagcgccacctacttctcgagcgacgggtcccgcctcctcgccacggtggcctcggcctcggccacggtctacgactgccggacgctctccgtcgtcaggtcgttcgagctcccgggcctcctcgccgccgcgctgtcgcccgcggggacgttcctgcagaccttccagaagtcgtcctcgccgcaggagaagaatgtcaccgtttggcatgtcgacaccgccaccgcgctctaccagcactaccagaagaatatgtctaaggccacgtggttcgttttactgcaactttgcttcttagaattatgattcttgaactcccatgcttaatattacaatctgatttgagagcttttagtatgtgcatgttttctggttgtgtcataaaatttttccgcatattatgcttgtagaactttgtaagaaggagcgtatattttctttagttgcttacattctagtgcatttgttgttgcaatcattttgtctatagtaatagcagtttgaaattataattgtaaatgaaccttgtcaatgctcatatgctactgcaagtttgtttctctttttatgcttctaatacaaaacttctgaagaaaataattctagtaagaaatttatcctatgcacacgatgctttgactggatactggttaaatttgttgatcctgaatttgtgagtgcagtattacttgtattataattctaaatggattaggtgaaaaatatgacctacagcagcctgagagaacttgtattcatgaatttgaccaaatctcgattgccaaatggtttgctgtgtttaaatttgatggaacatgtcatgttgattcacaggccaatggttcaattttctgcggatgagtcagttgcttgccgcatgatgactaatgagatacaattctttgatccaaaagatttcacaaaaggttttgtgtacaagctaagaatgcctggtatagctgctatgcagctagcaagtgcaccgggatctcatgttgctggatttgttcctgaggcaaaggtctgatttatcacaaccactttgatcatgctttcacaagacacaagtctcacaagctgattgtttttttatttccttttttctctttaagtagggtgttccagctagtgttcagatcttttcttgtgacaaggatgcacagggccaagctgttgcgcgtaggagtttttttcgctgttctactgttcaatttcactggaataaggggtccactgggcttctagttgttgctcaagctgatgtggataaaactaaccagagttactatggtgaaaccaagttgaactatttaacaactgatagggcctttgaaggaattgttcctctcagtaagtactaaattcatagatattgatgactgtttctctaatatctgatcattaagcccatcgttaactggcagaaaaggatggtccggtgcatgatgtgcagtggtcttactcaggttcagaatttgctgtggtctatggatgtatccttgcagtctcagtttttacatgcaatgcggtaattcaagtttaatatctcaaatactttgtgctccctttgtctccttggagtgttccttgacagaatctcagttatgccggccagagcaacaatattcaacaaaaaatgcaaccctcttctggagctcggtgaaggcccctacaatacaataagatggaacccaaaagggcgatgtatccttagcaataatttgatccagtagcctttgctgtgtggtctgctttgaagggaacacactctttataaaagttggtctgttactgttcaagtatagccatataaattttacaggtcagtcatgatttgcctggtgatatccttgacctcattttatcgaccagttatcgttttagcagggtttggtaatttgcctggtgacatggtatgttactacacgactaccatatttatatgagccttttacctttatatgggaaataccaccgttttcttgatatactcttttaggagacaatcttaaacaaactagaaaagctaaaaaaatgatttaatgttgctaggcgatttgcaaaatagccacagtgtaactgacagagtattttctgcctaggcattctgggattattcagaaaagaaattggtaggaaaaacaaaggctgaatgttctgttacgagtgaatggtcccctgatggtcgccattttatgactgctacaacagctccgagactccaaatagacaacgggtacattttttgcagcctttggagtattaatgaaaatgggtagcatcattgtgatctttatctttcctattacaggattaaaatatttgaccacaatggatctctgcagttcaagaagatgtttgaaaagctgtatcaggtatcaccgggcacctgttcacctcagtgtgaccagtttgttgtagacgtgcatgctatgttggttctgcatgctaactcctaagtcctaaacaatttgtaacgagttgataaaatatttccataatcacacacactccatccttgatttttctttttttttgaattacacaggctgactggaagccagaagcgcctgaaaaatttagtgacattgccgacctcacgatatcgttgggtagcataaaaattgaagaaacgaaaaaacaaggttctttacactttcttatattccatgttagtaagttctggtcaattgatttacatacttcattttctgtatagtttcagcacagggttctaaatcagcacaaccatcaagcaaggcccctgcaaatatagcagcgaaacctacagcatatcgaccacctcattcaaagaattctgcagatgttcaggataaggtatatattagagatcaattagtaagccgtgttagagttgcaacaaaaagaagtgtgcataaatcttgtttactatttgttgcatcgttgtgctgagtaaatccttggttatgctggctcaattgctgacttatagtttatacacatccaaggctgcaaaatccctatccaagcaaactgctgtggttttgtgcagaaacaagtagtattgtttgttggtcgcactcggccaaatatatttggctcctttttttccccgatgttttattggctctatttcaagttgttaaagaactcaaatttttgatattgtctattggcttaacacatttgtttggtgaattgcagctttttggtgggcttgcttctacggggttagtttcttgatcgataaattagttttcttgtcttgttttatgtaattatttttacctctatgcatgatcactaacattgcaactgggacagaggagagatgagcaaaaatgcactgagaaataagaagcgcagagagaaacagaaggagaagaaggctgctgaaggatccggagcctctgctgatgacaattaaatccacttctactcagtgaaatggtgtctcaatccagaaaaatggcattttgccatttgaaatgtaatcacgcgaatatgctgtcaaagtaacactgcctgggaaactgtccttgattccgcgcgattaatgcaccctgcttcttagatctgttgtttcttgatacaagaacggctcgaaattttgatagtttttgaagtttgaactgatggtttgtatgacaaaaccaaaagatactatcaaagctactcctttcatttcgttagtaactgatgattaatagaacttcactgacgatgtgaaaattggagaacagagaaatacgcatggtatcatgtgaaaattgatcaaggaatctttttcacgtggaatgatagtgaacttatttcggatgtacacgtctatggttagattcatatataaaagtgagcttattttagaatggggggatatcttattttgatgcctagtatagtcgacacgcgacaagaatgtataattcgtgttgagagaataagcactgtggtccgtactactcgttttacattgaagattatacatttggagccacgttgtcaagggtgacccattacattccaacgctaaggaaaccaaaccaaaatgcacaggaaccaagctacaccgcttgaacttcaacataatctacaatttgacgcatatgacatgagacatcaggtgattatatatgcgatgtcatcaacttcaaaacgggcatcatggttctgactaagattgtgcttaacagaactgttaaaattctgcttaacgatcaacggagaagcgatcactgccccgggcaaggaacgctatccagattccaggtcattgcaccagccatgaaaacagtactgctcatcgccacatccatgtgcttcagaaggccaaaaaggaacaagggagcacctgaactaagactcctgcgcatgcgggcgccaatttcctcggcagagttcctccataagatgaacaaacttttgaggctgttgccaccaagttggtttggaggtggctgctctttcatactggtcttcttgtgagccttcactttgcataaagctctctgagaaattgcgccatttttgcatggcacgtttcaaccgcgcagtacgcttgccagtaacaagatatctggtgtagtccctggcgaggcgatacagctcctcacctctgattatatggatgtactgcaatattacacaaatacaaattagtttcttaatatatatttagtgcctgttgtttattttgaagctacattacaccgactttttctgtgactacaccgagacttttatggaatacccagataatattgctcttaacagtgaaatggtgctctcagtctccagtttctatgcagtttcaatgcatgtagcaagtcttttagtgcattgaccatggagctatctacaggtaagttgtttcgacattacagtatgtcgttaatagttaagctaatcataataagatacttggaaagcaggactatgctacaaattggggtaaaagtgaaagtgtcagaagaaataacattcggaaagagagtacaaacaagaatgtaacgttagttaccacaagaatgaatgcaacggttgctaagataacttggactagttcatccaatgattccttgaatgattcatcttctgggccaccagaatcaccactgcctccacgacgatttcggtttcctccacctccaccagatccttgttctctcagcttagctatctgttctttcagcaagtcttgaataggccgtggctttttggcatcatccatggccttcttcaaagattccataaagggctgcaacaaggcaatatacatgcattgttaagcagataattctgcaaagcaagtgcaatgctaacagaaattaaatctatgtaaaaattgtaaatgcatgtttctagcaaaaaaaaagtgtagtgcaataaactggaaatgcataaccatctctccatataaacttatgtattttgtttcagtatgctagagtactgtttcaatatgaatagcaaactaggacgtctcaaataaataagatgggccaacagatgctcagatccagtaatgaagtactccctccgtcccatcccctcctaggttgaggttttttggaacggagggagtaagtaattgtcacattcagaaaaagattatgctcacgtaaatatgagccacaactacattgacttcacttaaggtcttacaagatgacaagagattgagagtttaaccaatacaggtatcaagagatataaaatagaaggaaacaacagtttgataggcagaagtttgttttgggagaagatggagcacatatgaaaaaaaaagaaaaagaaaaggggttgagcaaattgatactacaaaaattgcaattatcaaatcagaccatatgttccatgctccatcatacattcatgcacaaaaaggacatgccagagacttacatcattttctgcctctgggttcacctttccactcgaggcacatagaggaggaagctttttctggctagcagcaacaagaacaagtcgcgggtacacctgcttttgaagcttgggaaatcgaacagaatgtgtcgttagggaatattgaggatgagatagtaatctgcctgtcctcccaagaccagcgacgggcctatccacaataagcccactgttcggcttgcaagtgaagtagctcatgcttttctatttcttgaatagttagatgcaccagatcctagcctgcaaatttttcaggcagcataagaacttctcatgaattacagagaagtgctaatctatcggaagatacagaaactaacatagttcaatcgtgtcgagtggaaacatagtgaattttataatagaaaaaagggaatgctgggctccccaactccctctataaagcattaagcgatgaatatctacttatatataccaaatattgcaatgtagactttctaaaaaaacagatgaatttgaacccttctgtctaatcatacacatccccttccatataatgaggtaaggagattgtccagtgtgacatttgcaagcaagtcataaatactaactaacctgtgtacccaaccatccaatatggaaatcacataaaataagtgacgtcttattgaaaataagactgttataggagtaaatagaactctacaatagaaatgttgtcatgagaaaaactctggttactggacatgaggacacaaaactacaatactaatcacataatcccatcaactcattggtgccaaaactatgccacaaatcacaagcagaatgccagaccacatgcattcaacatgttggaatggacggcacaatgcacctgtctttcttgctatttcacacagagggacaccggacacggaaaatcacacctttttttcccaagcaagtccaactcaagaaccaaacttaagctgagggggtaaaccacagcgcaaggcaagcatctacctccaccaagaaagcaccgccaaataacgaattgaattggtgcaggttacctcgaacaccaacggtgatggatacgtattccgtaaggtggttcatggcggtggacggcaggcggcgaggcgggggtgcggggttggtggttggacgggcgaggcggggtttccaagaaggcgggtgacgaggagaagacgaatcggaataccaaactagcttctcctctcgctatccccacaattccaaaactatccccacaattccaaaacgagcgaacgcatcctacccacaaagaggcacaaaccaggaaccttcccggcggcggcgacgacgaccaccgtccggagttaggaatcgggctgggcagtgtgggggtgggcgaggagaggagtttccggtatgtaaagggattccggggcagcacgccggaccgcctccgccgccggcgcggcggagctggctgggggccggcaaggatcgtggcgcgcggagaagaaacacgacgcggagattgaccggcgaggaggaggaggaggaataatacgaggagggtaacagggattaccggagaggacgaccgcgtcggcgccggcggcggccgggcggtggtggtcgtcggggttcgatgtgcgcgtcgaaccggggaggggggaggagaaaggaggacggaagggataagaatcgagatgcattgtatttttagatgggtcgcacccgttaggaaaccggtgagccttcaccttgggccccactttttacagcccgtgggccgtggcgcgtcttctccaacgtgacaaaggaccatgggctttaataacgggccgtcttttatgggccacctattccaattgccaaagatggcctaaatgcaaacagatgaacaatgaaaatgagatggagcgatggatgtaccagggttccaaaaacgaataccacgcccgagtggtcgttaacgatgaaaactggtaagatttggatgcattttgccggaaatttgaatttcagtttaaactctttcgaaacctgtgagtttacaaggtggtttctggatttaccatggcatttttaaacccgatggagaccctgtgcgaactgacagtaatagggctggaaccggacatagcaatggcaacacgcgtctcatgaaaccagaagagcaagagcaatcgatggctttgcaatttttcttttcctctgcacatggtgctctcgtctcatcgagacaaggggagaatttcgtcgccgtgatcaacttgcatgaattttcgctgacaaaaaaaatgccgtgagcgtacaaaaatccccctcctattttcgccctgcacggaacgggttgccctctcccgcgcgcgcgcggctcttccgccgcgccgcgcgctgcaacggagctcacctcatgtgcgcgtccgatcctcgcatcgcgtacgcacgcacggcacacatgaagtcggcaaagttcaacgtcgatggctacgtcgcgcgcagcaaacacctgcgacgacgtttctacttctagatgcccatatccactagttcgtcctgcctacgaaatatatccagtaggagtgaaccaacggcacgcacatgagcaatttagtccacacaagtggacgcggttcggttcggccaccatccaaccggaacgtgcagatgccggcgtacgtacgtggacgtcaacgcatttgaaccggtcctcgtttgaacaatctcgcgcccaaagtcagaccatgcatttgccggtcgttatcgattgtcctcaactcctcatccatgcatcgcctgtcagctctataaagccacacgagccaccggaagcttgacatcacaattaaagtcacagcatagtaaccaaccgaaccaatcatcagccatggcgcgaaggctctcgctgctggccgtcgtgctggcgatggtggcggccgtgtcggcgagcacggcggcggcgcaaagctgcgggtgcgcgtcggaccagtgctgcagcaagtgggggttctgcggcaccggcagcgactactgcggcacggggtgccaggcgggcccctgcgacgtgccggccaccaacgacgtgtccgtggcgagcatcgtcacgccggagttcttcgcggcgctcgtcgcccaggccgacgacggctgcgccgccaagggcttctacacccgcgacgccttcctcaccgccgccggtggctacccttccttcggccgcaccggctccgtcgacgactccaagcgcgagatcgccgccttcttcgcccacgccaaccacgagaccataagtaagcagaaacaccaaaaaaaaaacatacagtataatactaccagtagagaccacggtatacctaacatgacgataacgttgttgcagagttctgctacatcgaggagatcgacggaccgagcaagaactactgcgacgagacgagcacgcagtggccgtgcatggcggggaaggggtactacgggcgcgggccgctgcagatctcgtggaacttcaactacgggccggcggggcagagcatcgggttcgacgggctgggcgacccggacgcggtggcgaggagccccgtgctggcgttccagacggcgctctggtactggaccaacaacgtgcacgacgccttcgtctccggccaggggttcggcgccaccatccgcgccatcaacggcgcgctcgagtgcgacggcaagaaccccaccgccgtcagcaaccgcgtcgcctactaccagcagttctgccagcagttcggcgtcgaccccggcagcaacctcacctgctaattacagggattgacatatgctatgtatgtgattttgtacgaataataattgtcataagtaatcaaataaaatcgtattgcattacgtcaacgttgtttgcggcataggagtatatatatttccgtggacagattttctttgtcgtctcagtcaaattttgtggctcctgaatattttcacgtgacttgtttgtttgtttgttgtgtttttggatatttctccgccatgcaagatcttttcgttggggaagctgtcttaatctgtttgaaccgagtcaccgagagtgtgcagcaagtatacgatggaaagtaagtatgactagtaagaagcttaagtcgtgtacaataaatacttgagatacttttgtgtcatatatatgtttaactatttacgatggccatcacccatatttgcaatttttgagagtattctagtatgttaataagctcaatatatagtatgttaactatgcacgaactgcatcgcaagaataaaagtggagtaatttttaagattaactttaaaaaagcttatgataaggttaaatggccttttgttcaacagacttaactttaaaaaagcttatgataaggttaaatggccttttgttcaacagactttgaggatgaaaggtttactcctaaatggtgtcagtggatagcttcttttatacaggggggtcatgtgggtattaaagttaatgatcaaattggtaataactttcaaactttaaaaggtcttaggcaaggggatcctttatctccaattctctttaatttagtagttgatatgcttgcattgctaattaagagagctaaagatgctagttttataaatggggtgattccttatttagtggatgatggtttatctattttgcaatatacggatgatactatcatttttctggagcatgatttacagcaagcaaagaatctgaaactgattttatctgtgtttgaaaagctatctggcttgaaaataaattttcacaaaagtgaattattttgttttggtcaagcaaagaattattatgatcaatactctagtatctttggttgtaagctgggtgcttttcctgtaaaatatcttggtattcctatacattttagaaagcttagtaacaaagactggaaagttattgaagaaagaattgagaaaaaacttagtagttaaaaaagtaagcatatgtctgttaggggtagattagtgttaattaattatgtactttcaagtttagctatgtttatgatttctttttttaggttcccaaaggggttcttcagaaaatagattattataaattacgcttcttttgacaaggggatgatcataagaaaaagtacagacttactagatgggatattatttgccaacccaaagatcaaggcggcttgggggttcataacctggaaattcaaaacaaatgcttgttgagtaaatggttatttaagttaataaatgaagaaggggtttggcaagacttgttgaagagaaaatatctttataataagtctataacccaagttgttaggaaagaaggtgattcccatttttgatccggtctaatgaaagttaaggatactttcttgaatatgagtttttggattcatgaataatagggaacaaataagattttgggaagataaatggttaggtaacttgccttttaaagataagtatccttccttgtataccattatccaaaggaaatgttcttcaattgctagtgttatgagttctgttcctcttaatgtgtcttttaggagagcattagtgggtcagaatcttgtttcttggcatgatttgtgtgcttctattgttcatatccaattgaatcactcatctaattgttttaaatagaactttaatcagaatggtatgttcacggtaaggtcaatgtatcttgctttaattaataatagctatattgagagaaacaagataatttggaagctcaagatgccgcttaaaattaagatctttatgtggtatttgcttaaaggtgtcgtgttaactaaagacaatctagcaagacggaattggaatggtagtttgagatgttgtttctgcatgaaaaatgaatctatccaacatctttttatagattgtcattatgcaaagtttttatggagagcagtccaattctcttttctttataccttcctagtagtataacccacattttttatggttggcttttggggtagacaagaaaaggagtaagcttgtacttgtaggagcttctgcaatatgttgggctctgtggttgagcaggaatgatttggtttttgataaatcaccatccatttcttataggcaggtaattttcagggcaacatattggctctgatactgggcgcaactacaaaagtttgaagaagacagagagtttataaaatttacatgttgcaagcttgagacgacaattatgcaactttttgtcaattatagttggagattcacaaatagacttcaataatgtgttctccttattttagtttcgttacttattttgttcatggggtgttctcaatgatttgttgaactacactcttgtttgagtgctaatatgcaataattggctgtagttctcttgagcaaagaccgggatgttatattccattatctaaagaaaaattcgtatatcattcctacaattataaggctataatctacaatttctctatatgtattttgttagttgtggggtgtttggttgcatccacgaagcctgactcacattaggccatataaaatagtcatgcactagcccgcgagctaggacgagacgatgcaaaagtgtcctcccagctacgctgagcataaaggtaggagtcgagtattagagtgcgcagcccggcccacatattatgggccacccatgtcacattgggtctactccaccacaggtctatcggagtcacaactttaggtcttaggcttacacaacacaaagtctttcgggttgtgtaggcccatgacctaaagttgtgactccggttagacctgtggtggagcaggtccaatatgacatcggtggcccacaatagatgggctaggcaacgcactctaacatcgagcttcacaactcatcttgccccgcttgatgcagcgcgctacatccgcgcgtgcatcaggtgcatgagacgctcgatgagatcaccaccccgccctttcccccttcctcgtccctggacagagagcgaagccagaggtgatggcttggcgatgagctcgacggaaggaacgatgatgggcacggcagagggcacctttctatccatggccgtctcgcaccttcttccgccgccatccccaacatgacggtgatttagttatacagtgaaaaccataccatgctagttttaccttttctacaataggaatggacaatttttcagtgatatatattcgatgttgtagtattgtaaaagctgatgtgtttccttaccattgtattaagatatgtcacattcacttaaaatctcttatattttgggacggagggagtaattcactatcatgttcaatcgagctagaactagagttattatcagaggaaagaatttgtaaaaaaaaaaaaaaaattggcccaataactcgagcccagaaaattcagcgcattcaaatgggccatggaagagggaatgtcgaaatggcccaactcgaattcagaatagagcgccggtcgctgctcgaaatgaacactgagccaaggctattttatttgaacttgcgttcaccggccggttaactttgctttcctactgttaatttgtgctattatggcagcttatctacatgcatgtctaatgtcaactttgaaagtgcaacaagcatttcgtgagcaggaatctcctgctcctcaacatacggccccaaccaaacaacaaccccaagttatctgctagttgtcggttgtcgcgttaacttcggctagcttttgccggtgaattcctgccaagaagaaataggtgccaaatttaaaggtcgaccctatatagcaatagcataaagttactactactaaaacgtgttaataagtttttcttttttctaaaaaaaaatacgtacttcctccgtttcacaatgtaattcattctagtatttttcacattaatattgatactaatgaatctagatagatatatatgtctagattcattggcatcaatataaatgtgtgaaatgctaaaatgacttacattataaaacggaggaagtactatatatatgtcgagtgaaacgaaatataatgcatgttaaaaacagaacaaagatggatctggcatcacaattactccaataggcaaggtaaccttaagcttctcacattgttccagcagaaaaaagcagctggatcactacaaaaaggaagagaagcaattgaaaccgaagaaaaaaaaagaaaaaaaaaaggaaaaacgacagaacccgatcaggacgacaggacagcttcttccaaatgcacgaaaccatggggaaaaaacctcttcgtgcaaagggagctctcttatcttcgccccttgcacgtacatacatacgcatgcacgcacgtctcatctccagcttaattagctagtgaccggggcctttctggctcggcccggccgggagctgcgccgtccacgccatgaccgtcgtcgtcgacctcgccggcgacctctcacgcagcgtggcgtacgccgccgcgtcctggctctggactaacgccggcgccgcccggcggccaccgtcgtcagctgctggccgcagctgcctcgcggcgtcgacggtggcggcgcactgcagcgccgccacggcgaacagcaagcagaggaagacgaagacggacgccgacgtcgtcgtcgtccgtgctgccgccgactccatagctctgcatgcaccaaagcaatgcaactaattaactgttccggctactatagcgccgaacgctactttggccttgcagttacacacaaggtcacactgtcactatcacagatatatgaactactccggtattgattttgtttgattgcggagtggagtagaccattaatttagatctgttataaaaactcgagtgttttgtcggcatacaacggttctgtgatccgtgagttcgcccgtattaattgtagcgcgaaaacaaaaccgggggaggatgccaactcccctcatcttttcacgagagcaaagtctgaggcacatgcatggcgatcgagtacatgaaaccaaggctacagatttcgtgcctattaaaatgcacactgccgtttcaaccaaactaaacgagctagagtagtagctacagcgagtgtgtctgggttgtctgcgtgtccagttgcagggctcgctgtagattcggagcacatatagtagctgcagtacggttggacactgtagaggtcgtcggcggcgacggcgccgggatcgaaggaaatcacgcgaccgcgcggtcgtcgtcgtcgttgcacctagctgcatatgcttgcactgtttgcacagtacgtacgtacacttgcagcgcagtagttgcatccgcgcggcgccacggagttggccgagcgcgaacacgggcaagctaggcggcgtagtgtacgagcggttcgtcgtcgtcgcggctcggaggacgggggattttgttagtttacggcgcccgacgacgggactagctaggggcctagggaggtgtggcttttctccggccggagcagagcacgaggaggacgcagattacgcatttcgtgccgcgatacaataccggaattaactaacccgtacacgcgcatggcgcatatgggccattttcacgtgggggcccggtttgccgttgaccaccttgcgcccgtgcacatggccccgcataggtggtggtctattagtttgattgttttttaggttctcaaaacgccgcatgagctagcaccgtattattttatacgcctgtactctgctcgtcgttactgttaacgggtttcgttttggaacacgaacagtcaaactaaaagaaagacaaacaaatgagtcttcaagaattgaaaaataaattaaaaacggagtttggaccatggatggatgacaatgtcgaggatggccaaattaatagatctgccatctactatctccggtttcattttaatgacgctttggacaatgacatactctacaagatatacctttgaccttatttttctattataatatatacaataaataaatgcatgtttatttttattatagtgttttgaaagaaaaatctatatatgtttttctagtttctttaaactaaatatattcaaagttaatgatggtcaaagttataaaagtttaatctcaaccttgttcaaaacattaattaatatagcaccagaggtcataaaaattagtgcggtccattttcttgaaaaatgcagggcctcttaaatacggttgatcagctgtttagaaatataatatcgtatgataccgtctttgcatttaaaatatgtaacatatagaagtaggaaattactatgcatatgacccaaccatataacttacgtatgattaaatttgatcaacggtttcctttagttaatctatggctgcatgttagagtcgtacgtctagcagaagtaatagcgaagcttcagacgcttatgacaaactaggactgattaagttacggctaagtcgtagaaatacgaacaagaaaaaaaatagtttatgataaaaaaatatcttacggtgttattattagagcaggtataataataggcttttagccagctataaacatattttaatgagataaacgataagagagaagagcagcaggctacagatttgtaaccagctgtagcacagactccaatacacaatatgtgtatgacaggtgataccatatgttaatattatagtaaacaactattgtatgaattgactattagattggctatagataaattggagctagtagtggactatattattaaacttgctcttagcgacttagaaaacaaaatatgataaaaagaaaactgctcaacgctaatctttaaaagttaaaatttggctaggacgggcctgccgacgagagttgaaaacgaaagcgtaagagtaagaccaggattatatatccaagtggaaacgttcggcaagttaacggtgagctccgtttccgcgtccggctggcggtgcgagggcagccgagaagagaaggtacggtcacagggccactcacgcacatggctgatcatctccactcacatccctctttgtgatggtacgccgcatgccaacttgccaagctgctcaagcagtccaactttgacctgcagccatccgcaccgatctgcctcagatttgcaacgcgtgcagtataagttcattttaggtccagccactgagtctgaaattcatctctggaccaaaataataacatatataacacatcttttaactttaaaaccaatataaacttgatcccaaaatagcttggatgacggttttcgactgacgtggtgtttatgtggtacacttgtacttacaatcataagaaatggtgagacccacatatcaataggggtgtaagtggctaacccgcgaaacctatttataggttaaaataagccgcgaactcgcttattttgacctataagtgggtttacggctgacccacttacacccctacatatcaatgagtatccggttaaaataaaataaaaaatttacaatggaacttaccgtcaaattaaaggatctaaagtgaacttattcctaatgcgtggccacgcgtgttgggccagtcggattattcccacccccacattaacacataacatacaccccttacacagttacacttgtcattttgcagttgcattgacaaaatcaagcggataatgagctaacaagcattgcgagaacgatatgcgggcatattatagggtgaccaaagcctgtccgtccgtattctaacttgtgaagttgtgattctgtgactatatacagtttacagcatgcagttataaagcgtgtgttcttggccgtgaaccttctgatcatgttagacgctgaactgctgctgctgctgctgctgctatcagcattctggcaaacctgtcagcatgattgcagacgctcatgttatgcgaaaaatgttctgttaccacttaccaagaacgaacagattggtccaagtgtaatatctaatttgtgagggttctgtatatagatcttcaggatgttacaattcttctatttgttggtgcgtaccactgtatcatatttgttcaccccacggctctagtgtcacagaccgatcgcgcttctctgactttacatatttgttcaccccacggctccagtgtcacagaccgatcgcgcttctctgacgtaaagtcagagggacgtatgttactgatgggtggacccaacctttatgggtcccacatgtcagtgataaagtctctttgaagtaagactcatctgtcacggacagcttgtacatctgaatcatggtttcagaggtagaaatgtaaagctacaaattgcattcaacgtcctaatttggtatttaagaattttcatggattttaatgtttaattctacgattcaatctggaatgcaagaattagctagtcagagggaatatgcctcctatgagttaaacgtatcctcaagtgtccacagtggctaaatatatcaggaaatcaggctatgtgaaaattcccatcccttctttaccggatgtatcatgtaccaccccgattcaccgaatgaacaaatgggtttcaagaggagaggatatcttcaaatttaaatttggatgatctgagacataccacaactctttaacacaattttggttgtacatgatcagcatcaactagaatcctaacttcacgtagctattacatcagttccatgttcattggtggtagtgcaaatggatatactcaggaaataagcatctttcccacatgaacctctgaannnnnnnnnnnnnnnnnnnnnnnnatgctaaaaccctcgaccatgtgtctagcgtcgatgccgacggtcgtcacgcctgcagtgacagaaaatcaaagtcagatgcacttcaccagaactctgagcagtgctaagtaagaagagtttttgttctataataacaaaaaaaaagacatacgaaaattacacatttgctgggtaccttgactagaaaatttaattaattcatataatacataatgcacagaatggaagttagtattgaactctacacaaatatatacatcccaatattttcctgaagaacatataacactttgatctctgaagaacatatttctatatttttcctgagaaattttgaattatcataatgaacctggtgccttcagttgacttactttgttttagcgcggtagtaaaatataacagaaattaattttgcataattccaactttatctgataagcaaattaagtaaatgtaagcatacccgtatcgatcatagtctctggaacggtccctaggggagcgtgaccttcggtagccccttgaatcataactatgggatctccctgattctctgtccttgtccgacctactttctctgtcatggtatcgatcatggcttctcctgcggtcataatccctgtccctatcacggctgctgcctcgatctcctctatggcgatccttgctagatgctctgtcacgttccaggctcctgtccctggacctagttatattagagaaaattggaacgtttttagtgccacacatatgaaagaattttgttttgctattaatcttagttttcttaagaattctaaaatatagagtaccttctttcatgctcagctcggtctatcttgcgccttttgtttttctcttcctgtacacattttaagcattaaaaaaaaaaccacatcttcatctccaataaaaagcacattcaggaacaaacaaaaaaggttaattatacatatccatgttagccaaaacctcgtaaaagacaaccaattctccaggcaaatcttgtttgtagtgcaagttaacttctctgctaatttcttatctacttagtagcttagtcagttgatcagttatcatgccctctctattctctctctttgtgacttgacgtttgaacctttggatcctctgaactatattttagacttattttattattaatatctgttttccagtaggacaatcctactgttcccataaaaaggcccttgtctaacatgcaaccccaccggacttagctccattcaaaatagcacaatttcgaaaaacctcacctgcagttcggataacttctcacgtatcagcatataacccatatgaagtttccctccaaaatgatctgccaaacgccggtcactgtttggaagaaaattgtaagctaagatattaattgtaaacaacacgcatgctattatgtaaaagattgtgataatttattagaattcttaacaagatatctataatccacaaggataaacatgtataaaataaacacgcacattctttagctgcaaaagtaatcctcgaaaaagtggacccaaaagcctgctggtgaaaaggagttacaggtgttcgtcaaaagctgaagcacttgaaaccccaaaattctcgtacattcatgacccccatgcagaaattgatggtgaagttaaaaaggataaatttacctgtcatatacgctcaagaatgctccacatatgtcacacaggcgcaacttttgatcagtctaaacagagattgaaaaataaaaatcatcaatataaaagcatcacaacaaaatgcatccacagttcaacacagtgataatttcttggagtgaaaacaaaacaactaaatatatcaattttttatgtgcactgcaatgagcgattcaccacacttacaatctgaacgtgagttgacatctttgcagagtccggaacaggctgtggccgagcaccaagctgtttaaacatgacaacagaacacataagagagatatggaacactattcctttgataacgaccatagaggatttattcctaaatttctaatcagttgcaccaacaaaattaaaagccaaggtcgatcaccttctttagagcttctgcttcatccaaaagtttctgagcttcatcgatcattccattctcacctgttcaatatggaagctagaaattaatgaatttttgtatattaacgatgaacagaagacaatgagccatgtgctttggtagttcaaggaaggaatatatagggagcatgattaaaaaaaatcaaacctagttcttctgcctttttgagtttttcatcaatcatttcttgtgtgcgtgcatctggagcagcagcaacaggtggtggtggaattgattgattagcagtttggagtgaagtcattagtgagacacggtccttattaaaagcttcaagtagatgctttgcctgaaagggtatgaaaagttatacaaacactaatatgcctgtaatcttccggtggcaaaccattgtatataaagcaatatgatggcaataaatttagtcatataaaaatatgaagtcctcgcactacacaaactccattgtggtacacatatttcatgatcattgatcacagggacaatacctgctcttcagccctctgttccttgagcttgtcaacctcttcagtagcccgaattttgccctcagtgtttccctcaagatctagaggaagagacagttgatacaatcaaactcaagagaacaaaaggagttgttttatgtagtgtactcggaaattattcacaacggcaggcaaagttagaaagattgagtaacaaagagtcaaagatttaagaaacaaaatagcgagggggaaaagcaaaaaatatttgagaaagaattggttaatttttcctaaatcaatactatcccattaggcacaataaagaataatttgataaattatgaaaaaaaatataaagcattcattttgattacggaggtcaaatttccatacttttatcatgatttcagcaattgtatgaatgtaaaacattcttaggatcatttttagtttagttccttcgacttcgcttatttaaaaaactccattgattaaacacaattaggcagaagccaatttggtccatgcaaaaagccaaacacatatttttccgaatatcttctttgtctagagacatttccttgttgaatgagataaagagttaaagcgaatatgtcatgaacatgatgcatcattctctctaattgaataattttcaggagaaaatattaataaagatatggtcaattcaagtggataggatgtggccatgatggaatttcaaacaaaacaaaggtaaacatcagatttaccaaaagcatcaatctccttcatcttctccttgatttgtttggagaactcaatcacttctttactctgcatttgtacatacatattgcaacttagtttatctccacagtcgtgggacccaaggagaactaactattataaaggaatatacctgtgtgacttcagtgatggaaattgctatagctgccttggcatcgtcctcctctagacgtttaagggctctctgaatcttcctttcacactccgatattagtctttctatagtttcttccaattcacggtcataattgtccatacctttggctttcgcttcttcatatctattactaagttcaggaaacaaatagaacagagctcttgcactcaatagcaaacatacagtacagactagcatgtgtcacaggtttaccaataagaacagccgaacaggccaaacactttctatgggttctggttttgagaataaccatactaaatctaaacttttaccaataattcctcaagaatcttctatttttctcaagttgacctcgaatcatttaattttggcaagaaaagaaaagggtaacatgtgactgaagccaaaaaggaaaaatattcacagctggcatgatctaacgcttaaaagaatgccggttcttgtcaccaggcactggcaggcactaaaatagaattacatcactaatattattcataacgtaaatctttcagaatgtaaaccttatacaccaaattgttgtagcatactcaagcatcacaacagttaatgttagcaataagtaaacacaatcaactccataaatatagatgccacatggcccacatctaaaaaaatttagaagtaccaaaagttactaaatatgcgttgaaggccatcctagccgaacaaatcgcagaccaaacatcccacaccatcgataaaatgtctaattcgtcgctctcgccttagaaccacctcggctgagcactccgcttctccgattcaaactaaaccgtcaagcaggttgcatggcacaaatctatttctattcacacacaaaatctaactgaaacatactaaaccctagttaccctacatgaataatttgaaggggatctccaaggatactccttgcgcagctgcagcgagtgcatcttcgggcatggccccatgtccatcttctgcaaaaaaacaaaacaacgcaggcgcacatcagccacgcgataaccgaatccgatggatggagtggggatataggagggggctccgccgcgaggggatcgagagtagcacggggaacgcacggtgagctggaacaggtcgtgggggcagaggccggcgaggaagaggcggcagacgtcgcggtcgtagtacttgcggctgacctcccgcacgtcgccgttgcggttggcgcccatgagctggtcgagctgcttccggatcgcgtccatggcgcaccgtcgcccccacgccccgtcgcccccgccggcgctgcccctcccctttgctagggttttgcttggctcgaggcggggctggttggttggttggtttggtgggcggcggtgccggaggaagaagaagaagacggctaagcacacccccacacaccgtgccgtatccattttcgctccacgggccgtcggatcgacgatgcacggtccagatgggctggatgggctacagaaggacggccacgcggcccatgagtccattgatgacctgttctttccttcctcctcttctcgtgggccttcttctctctccccctccccgtggcgctgacgcgacgcgctctcctccggcgaggtctctgactctccagcgctgcgcggcgccgtatcgccggccgcgaactcgaggctgggctgggcgggcgtatcgttcctgctcccggaggtaaccaccctcccctcctccgcatcctctcgacggcgcgtagccttctgtccgcctctcgtttccggcgtcgcttcgcttaccagttgctaggatcctcgaggtgtgcggcggtgttcccgtttcgtccgatgcgccgattgagtcttcgattgctattatcataggagatggattgtttcgtccagttttcaacttccgttttttggctccttgcatcgttggtgttgtgttgttatttggtactcgctactccgtatcccagtgtctccacattttcgttggcgttgtgcaaagcaatcatgtcaaatgtgtgggatgtgaagtgctagattgccaaatatctcattcagttctagatttttccaatgaccaattcatatatttgtatattggagtaattgggtttgattgtgctatagcctattgcctatagtagttggaattggttttgttgtgcatggactgtattgctggcagtggcattattgatctctagatagttgattcatatgaaacgcttctgactaggcgatgtgcagcccaattgtgagccacgtctagaagccatttaggtgttgtttgaacagtgacgcatctttggagaaccttacctgcataagttttaggcttcattgctttgaaaattttatgtatgttctttataagaatgcatgagcatatactagactaagtacataaatggtttgcttcattggaccttttcagaagactgttatgatgatttgaactactgcttggtattacaatggagaaccttgaatgcacagttgggaaagatggcttaaattttcagtgcaacctgtgtgattcagatgtagtgcattccatggcagaaatcctgcttcgtggattggcaactgcctcagttgacagcactactggtgatatcttcaagagcccatcttctgtagctgttggaatgaagagcgagctagcagaatatttgattcaggggtccatgacgcttgttcgtgaggctgtcgacggaggcgaggatcactcagaacaattaataaaagcatccaccatgccgacggagttcctctcagacttgatcgatggttttgtagcatcaaaacggaacttgttgagccatgtgtctgggtttttgtctagcgaaacccgcttgaacaaaattaaagacttcatacagaagctggagatggagaacttctgggcaccagatgttagagaggctactgcagggactattcttaagagtatagacatgaaatgcattatccattgccctgagagatttgacacacaagataagctggctgaacacaggaatctgtgtagatttaggatagtaaactgcaaaaatgatggatgtttagcttccttttctgctaatcacattgagaagcatgactctgtctgcccattcaaagtcctaccatgtgagcagttgtgcgagcagcatgttatgcggtgtgagatggacaggcattgtgcatcagtttgccctatgaagcttattaactgccctttttaccaggttggctgtgaatcagcctttccgcagtgtgttcttgataagcattgttcagagcgccttcaaatccatctgatgtatattcttgaactaactacaagacatgatgcttttgttaatgatatgaatcaacgattacacctccttgagaaggttagtattatttgtactgtaccctttgaagccatatttgaactatgcttatagcttaccctcctttcctatttagcttgatatctgctcagtgtaagattagagaataaaggattaacaattattcaagtattcaactcaacagctagaagcagtatgtaattgtagaactaatgaaataatacccatggtttatcggaaggcaacccaggacaatcgaagtatggaataccttttttcactcgttttgttggaggactgcattgaatttcattgacttgagacagagaatgagtacagttgggctagagcacacgcaatttttttcgtctgaaaaacaagcaactggttgtctgtactcagattaatttcctgagcttatggctctgacaattctagatatcgcaagcagtgggtatatttttgtttacaccaagttgtaatttttgaatcccgctggggcttgttacccataattattaagggaaatatgcatgtatttctgatgaatcagttcccaaataggatatctggattaattactattttcaatcttattacaggcccagtcactgaatgaactctctggggctttagataacagaaccctcactctaacagcaaaggagcaagaagcaaagatcaagaaactcgaacaggatctcaaagtgcaagagacaaagctgaagaaacttgaaagcgagtttaagtcagggaaagtgtgaatacatccttcggccatcccggctaaaaagaagtgtgaatgcgtgatgttgtgattatagtgttactgtaaaaaaccagggcgtcatactttagtagctgtaaataataattagcacctccttacagtttaccatacttctgtgtgttgttcatgtacgataagaaaataaggtttagaaaagtcagcttctcttgaattcttttgttagtttgaagtaacagtgtttgatcttttctgtatcatgcagtaagtacatatatattgtggagatgaagttcatttggatcatctgccatcttcttcaatgtgctggaagtatctgtcggtgggaactacacatgggtttacaactacagtttttcatgttaaagatattgcctcaatttcatgactggcttggttgtttgactcttcttttaggacatagtcacaggcagcttccaaaatcttgcaaacctctctcctgtactgcaacatatcatgtcaagaagaaaccattaaatcctgtttttggaggggaaacaaaatctttaaagtgtctctgttaccatatggttgcataattagagggctttgtggtacagagtgccctagaatcaattgttatcacccatttgtcttgcatctaatttttcagtggtggtgactgcttttccacggcattaagatcaaggagttcttaagtctgggaactttggtgactggtgaaatcattttacgaagtgacacaggaggttagaattctgaactattgttcatccctttttttatgccatagagttgtgaaatttgaagtagaataatgtgttcctagtctcatattcattttaggccaccttaagatagtattagcatacctcatcagttgctccagactttattttggattgcaaaatgcaccatttcttcatgtttactcctataatgtgcataagcataatgtaatatttaacagaaacatcttttgctagcaaaagtttagcttaatacaatgtatagccaacttaccaatctttatatcaacttgacatgttgaactggaggttgttcttagatgccacctgcagtggatctatgaccaaggtatcaatggcaattcctctctcaggaaaaataattacatcttactgggaagagtgaatattttgtggttttatacagagaaagaaatggttaaagacgggccacttggtctcctcttcattagcattagtatctattgtgcaaaatgagtactttactatattaacttcttagacaatagaaaagattgctgaaaagacatagaaacggagaagcaagtaacaagttctcacaaaattactactttcctgaccaaacaatctttctaatatttcaaattttctatttctatttgttcgtgttgtcaataatggtggcaaatacctcaaagtaagaaccaaatggaacatcatgtgcctgatgctttgtctcatagatctgaaatgagatagtaagtcataatttcattaaagaagaaaaatcaagaaaacctgattcacagtggacctatctgttactaatttaatcttaccagatttgttttgttctttgagaaagaagcacgttgccattctgtcactgcagtatctgggggacataaaggactgtggcatagagacctgaacatcacttcgcggatcttgccgccatactcatctgaggggtaccacttgctaagctagagaatgaaaaatcaaaacactataaattaaaaaaatgttggttatgctaccagtcactagattaacacatccaaggattgacatagcaaatagaacatgcgattggtgctactgacaaaataggaacctttaaatctgtatcttttcttccatgtcgatactgctggaaaaacattgaattgtcacctaatatgatactgaagaacttctcagatgtgccagggaaggttttctgatggacaatgtcatgttgaaaattaggggggaaagggataacaaattgtgcattgaatatgtaggaaaacaacttgggatgctcacactggttgcatctacaagaacatgttcattgatgaaaggttggaatgcttttgcttgttcaatgcttctttctgctgtctttaggtcatctattttgctacagatgacatcgctgcttcttctttgttgaagtgaatgcattctgacctgtttgtaggaaagcattacagatgctcagataatttctgcaaaatcaacagaaaatattcaagctagaataatttctggatacctgtttttcagcttctaaggttgccctgtaactctgcagagcattctccagggcccgaaatgtgcggtttctattccagaatgatgtgaatttgtacctgattcttcctgagaaatcaagccaggtattttcaacagaaaatctctacatagatttctaacatgaatagttaatctaaattgtatactccctccgtcccagaatataagaagttttagagttggacacggttattaagaaagtaggtagaagtgaatagtggagggttgtgattggatgagtagtggaggtaggtgggaaaagtgaatggtggagggttgtgattggttaggaagagaatgttgatggagaagttgttatattttgggataaatcctgagggctaaaagttgttatattttgggatagagggagtatctattaggtttatgattttctttgctagcgcaacttttactggtaaaagccacttcttttagagtaactcaacttgaaaatgatacagttcaagctctctggagttcaaacttgcacaaatgtggtaattcgattctatgatattaaactacttttccaatttaggcattttcttgaatccaacgttttaaaaattatgagattgagccaataaattaccattttgactgcatgaagggggtgttccatgaccacctgaaccggtacgaagaaaaatagtaattgctgggttgataagggaatgctgacttctttttatctgcgggataaagtgatgtggatgtctactatctcagctgatagaaagcaaatactaagtccacggaaagagcttcgtaggttgcatacctcatctatatcttgtaatggaataatcacctaaaaaattgcaggtcttagaaagcgaactggaagttctcaaaataaaagtaataagctcaagaaaatcatctaagggataataagtgtgtaaatttacttaacaatatttccatgctgttattgatttaccatggagataactagaaaggagcataaataacaatgttcagcttcaagtaaaataattaagcaatgcatgtttcttcagatccatgtactttacattcaactgtttggagaatacattggagtggaagcacagatgccataaggagatgtacatacgcccatggtgcaggaaagacctctccagagcacaagaataactttggtgaacaatctggaagtacaagagacagatggaatgtttcagcataagaaacatgaatcatcatgaggaagagtcaattctgatgagtatgaaatactgtataagcaattgtaatatcaggaattaatacttcatcatgaggaagttcaaatatagcttgtagaaggccactatcttgagttattggcaggtattgcttgcttagcatcatcgttctctcggactcgattccaacacattggtcaaacagactggagaaagaggggaaaaaggaaaataagaagattgcttatcatcaggtatgctcgttccccaacncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 36660 - DNA, 26352 bp, Oryza sativa
tctgaaagctcagctgcaagccaggcagccagcaatatataccgcttggccgaaggatccaaatatctaatcagcaaggatgaaaagtagtactagtacaatagtgcaaaagtatagctttgtatcatggaccaaggctggcatacaccctgtgccgtttttcacatagcatttgtctaatctgaatccatcacactcatacgtttttgcttttctcgcacgcttaagatgagaaaaacagactggattaaagctggattaactattttatctttttgggggcaacctgagacactatgattagagtttcttggtgtataatggaattgtaatgatggacactgcatcaccttttcacttgtgacacagaaacttggaatgcaattgagaaacatatcagaaattcgaattcacaacatggcaaactgttggtacctcaactgggagctctctaaccaggaagttgaactcctccccccacaacgggtttcttgagctaggcaccatggaactgcaaacgcattaggccatgcttgctttttagaatgattttttagctcagacatgattatattagaacaaaatactgtgtgaagatgaggcatagcgcagagaagttgtaatggcaggtgacctgaagcgtctttgctcgccgcaggagatgacggcgtaaggatcggagctcccgttcaagttggcgccgatgaggtacttggcacagagcagctccagctgattgcaaaaacagaaaaaggcacacggaaacaattcagacatggagtcaattaaccttgcagataatataagcaagtaccttgatcacatagctggttctgccccgagagtgagggctaccatctggaagagcaacctgcaatgcaaacaaattgttctgataattaagaaggaagtgcaaatgtgcaatgcaaacaaatataatgtggctcaccttgctggtgcctccaagttcagcggccgctggcttccccttcgcccgccggcgccggcagccgcagccaccacaaccaccgtctcggcggcagctcgcggctgccgtagtggtaggagagggcggcggcgacgaggaggaagccggggacttggtgctggactggaccgcctggtcgaggaagaggaggagcagtgccgcgacgagcagcgcggccgcggagacggcgacctccgcctcccacagcgacggcaggagaaaaccccgcatccacgagctgagccccgcagcctccatggcaaactcctcgaggcaaaaaccaaagctcggttcgtgcggggcgctgcacgcatttaaagcgagccaaagcccaagcgtagcgtggtgcaaccgcgcggttggtgatcacgctaccactgactagctagtgagattgccaaaggcgagagagcgagcggaaggacacgctcggcccggggagccgaaaggcacaaggctacaatgattagagggcaaaatttttgatatagagaatatggctgtatttagttcacgctaaaattggaagtttggttgaaattggaacgatgtgatggaaaagttaaaagtttatgtgtagaaaagttttgatgtgatagaaaagttggaagtttgaagaaaaaatttggaactaaactcggcctatgtaatagtacgtgctggcatatgcatgctcggacgcacccttccatagttgataactgattgttgttacacggacactatttgtcctgttcactttcagctttgtaggtgccagtattttgatttttaatgttgtgttatgttgaggggttagaaacccacactgcttaagtattagctaaaaaactgaaaatggattgatataatttttatatactttttaattaacaaaatatactatttagtggtttgggaaacatttttttctgaaataaaaagtagaagttggaaaaggggtaaaagaacacatgctagctacacctcgcgattcggggcgcagtgttgtgtggaactgtggactgggcgttgttgtcgtattttgctacagtgctggctttttgccgctcagtacgttactctgttaagtgcgtaggttgttctggaatgggcactctgcatgcttttcccatgtaatagttgcattgttgcaagcctgccactacgatacttctacaccattattctctgttcctcagcaaagcaaatattcggtgtcaatgtttgcatttatggactaaactttaatctttgtcacatcaaatatttagatactaatttagagtattaaacataaactacttataaaactagttacgtaaatgagagctaattcgtgagacaattttttaaagcctaattaatccataattagtacatgtttactctagcatcacatagcctaaccatggattaattaggcttaatagattcgtctcgcgaattagtctagagttatggaatgagttttatcattaatctatatttaatacgtctaattagtgtcaaacatccgatgtgacagggactaaaaattttagccctatccaaacagacctacatgtactgtagtgattggacaggaatggccaatgcccaatattatggacaagacattaacacagtcgcaaatagcactgatctagaatgtttgaatcatggaaatttcacgcaaacaattgaacaattgggacggctagatcgacgaagcagaaagaatgaagagcttgtaagttcatgatcgagagcggcaaattgaagtgcaactcaaagccacttcatcatgcggaattaattataagcgcgccggccgtagcatccaaagtttgatactttgccagttgcatttcttggtgctttatcattctattaaaccacgcaaatagctgcgatcatagcagcatcacagcatgcatagcaatttttttttcagctaaagctagcaaattaagaaacgcaattaatattgcaatgattggaacgactagacttgtagttgtggccttgtgggacactcgctattcgttaatcaatacgtacttgtcaccttcgagtttcgacttaatttatgtagcggtgaggctcgatcaggaggaggagagataaccgggatctgcccgagctgtaaagcgtgagcaaagatggtggcaggtgaagaagaacggaaaagaaaagaaaaggcacgtacgttttcggagagtccaattgttttgggggggtatatggtgctttcatcaatcattactaatctctccgttttatattataaaatattttaacttttgtaaaatcacctttttttcattcatttaaatctataaaaatacatagtaatatttttaacccaaaacaaatatactattaaaatatactcaatattatatttaataaaactaattaaatattaaatatattactaaattttcttaaacttctgtaccttccctttttttttctccagggaaaaccttggatgttgtatggtggtaaaaactttgtttctcctcctgcttaattaaactaaaaaaaaagtcatttcctccatgccggccctgcgcgatcgcagctactgtgctgtgtccgttccaacgccaccgtcgcgcgtcgcgagcacctcgccgacaccgacgagcgacagcatatctgccggcagtcgaaacggccccgacttcacgggcgcaccgcgcgcggtggacggatcgcgtcgcacttgcattacaatgtcatccggcgcacgcacgcacgccgtcgcaatccttcgcggtggacgccgccacgctggacgagcaggcgaggcgagccgcaccacgtaccgatccacacgcgcgaaccagtgttgtacagacgcgtgcgggccgtgacggtccaggcgcagccgcgcggcagccgaattagcgtcggcgcggcccgcagccccgcaggtgaagccgatatgggccatcctgccgaccttgccctccgggtccaactccaaaccccctgcgtatgtgtgcaattctggtggccgcacgtctcgcggtcgcgggcacgcgaatacgcgatactgtggaattgtggaagcgatgtggtgctcactaggcaggggtagaaatggtcacgaaaaagcgccgttccgtataatgagtaacgttttttaccgttactgtttatggctgtatttaatttttgttttttctattttctttatgcactgtattaatatcgacattgagtagtttaagtgatacatatggtcaattgctagccgatcgaacgtcgtttccgaagagatgctatcgattccgaccgttttcacccttttttggaaacggtcgaggaaaggtcgaaaaacagctcaaccatcctcgtaacctttttttttctgaaaaccaaaaaggaaaatggtataaaaaatgttgaggactctgaagcggaattgtacaaacagaaacatgtcagaatcgatcggatcatcggaaaccgatataaatgtgctttctcaagtaccctacaaattttcaaattgtaaactatactacctccgtttaaaaataattatctttctaggattcaaaatttattctaaaatacttgtacttatcccatacatcacctcctattaaattttgtccctattctactcttagtcaactcccaaccatacatcatttaatgaggaacattgtaatatttatttttaaaccttaatctatactaaactatctacatttaacgagtagaatgataaatatttgaggattgaggaagtatctttttagccttgctcttaagttagggatttgattgaggagctaacaggcctcattagatcaaatagagaaaaaccgtacatattgagggtatctagagatatcgtaagtaccatattataaaaacggtaattttcgcaagaatacggtaagataaagataaagaaacagtcgatataacagcgaaatcatttctatttttgtttgcatatttttttaatttcatcggttaccattttcacatgactcggttggtagaaataaaaaaatgagctttggttggttggtaattttcgtgaccgttttcacacctcattgctttgcgggttttgccttcctgcccctcgatcggtttcacgcgattttgccgacgagattacgaggcactactgaagtagtgcagtttacctgatgtgtgatgaccagcaggcaagcaggcaggctcagccgcagaaaatacgtgcaaccgcgggcggcaatgcacgagtcaatgcgctcagctggtgaaccgaaggcaccaccggccggttcagtgacaaggctccgacatcgagtcctttacaaatcacaatggatagaagtctacttctcaacccatacccatgccatattgccatacaggggttgtcacgaaatgtttatctgtaacaatctataaaatttattggaacgcattgtcagcaaggtggtcgtgccggagtggttatcgggcatgactagaaatcatgtgggctttgcccgcgcaggttcgaatcctgccgaccacgtttttttttctcatttctgccttctgttttcacaatttccattcttttcgtttctgccatctgctttcaaatttccctttttctttttcgtttctgccttctatatattttcacatgtttgaaaaagataagtcccagttttccccctctagtttaaaaaagatatgttccatttggtccaaagtacgcaagtatagcacctctgtaaacgtaacgggcatactactgcacacgccaccatccgtccatacccgaaatgccgaggtgagcacatctctctctctctctctctctcagtctgaccctatatatccccagtgatgatgaacaaaatctccataaatgaactctcgtaatatcccactgtatcaaccggatttcgcgaggctcgcatgcacacgccgcattagccaaggagtgaattcgcgattgaaaaccaatctggcattaatgtgtccgatgttttgttgccaactgctaaatgaagtgccagcagagttgccccccttccaaatcattccttcgcgagtagtagaaactggtgttctcatttgttcgaaacacacaccaccaggcagaggcagattttttctcatttcctctttgctttttttcatttcccaactcgagttcgcttcgatgatgcagcagcttcatggctccgactccgtgcaagcgcagcgccgccgcccaaggtgttcgtcatatgcatatgtgttcgcacacaaaaaaaattcctttctctttttttcccctcaagaacacggagaaaaatatctcgttttccccttttgagaattatgatccttagatctgtcgttgtggacgtgtttgatggtgatctcttcgtgcgtgtgtgcttgttttgatgcaggaatggtgacgccgccgccaaaaagcagccgtggtacatgcgggcgttgggtgggctgatcccgtcggcgcgacgtgccgccatagctgcgccgccgccgccggcggctgccgtggcgggggcggtggagaggaggccaagctggtggtgggggtcgtctctgaagacgacgtccgccgcgttcgcgagggaggtgtgcatatgcgctccgctgtgctcctacgacgggatcatgggcatccaagtcgacgccgtggcgccgacgatgatggcgaggagcagcgccgctatctctccctcgccaccgcggcgggcgtctccggccaggtcccctactgctggcgccgccggtggtggcggtcgccgctctcccgcatcgccgcggacggcgtcgtccccgaggtcgagcagggccagggcgcaccctgcgccggtgtccgtggcggcgccggcgccggctgcggcggccgtggaggggccgaggaagagggtctccttcagcggcggcgagtcgctgtggaacgacgagctggtgcggcggttcgtgcgggcgcaggaggggatgccgcgccgcggcgagatagacatggccaaccgccaccgccggaggaggtggcgggcaccggggaagagccggctccgccggatgtcactggcccatgtcgccgacgacgacgaagatggagagaccaacgctctggcctagctagctagtggcgtggctgctatgtggtgaggttggctagctatatatatagctcaggttgctcttgctcacaagtcccctttggttatacttttatgctcttgaggaacatgctctatgttgttagggttgtgatgtccgttcgatgctacttgttgcggaagaaaaccgcgaggaataataatagactatccgttactatggttgggatgtcggttcgttgtcgtttaccggaaaaggaaattgcgagtactaacggaatatctattagtaggattggtatgtcggtttcactttaattattgcagaataatgtttgcgtttaacgcactggtggttattatggttgggatatcggttttatgcgatttttattgcagaagtggtagaatgaaattttgaataatgaatgtactatccaatgttgggggttgggatgttggtttgataccaattactgcagaatggagttgtgagtaatgatacacgctatggttttttaggttgggatgttggtacctcgctgatattacaaaattgaaattgtgagtaaaaggctataatatcggttagtagagtttgggatgtcggtttagtgacaagcattgttgaacaaagttgtgaatatcacattaaggtttactgttgttggaatttcgaaagggaactgttgttgggattttggtcatggtctattattgcgcaacgaaaatatgattaattgacaattggttatttagagttgggacataggatgaattaatgtcaattactcctactttagaagaagtagccagtactatactatccattttgcattgttaaatagcagtgggatgtttggtatttttgttgctcctaagtttctatttcctagcacaagaattttgacaaagagtatatgtgccggtacaataagtagacttgtggatgaaacagtatgttgacagaagaaaaaagggctggactaactatagattttacagtatcaaatgataaatactgtatgatttagcatacttcataagctaattagatttttataagataaacatcatgaatgaatgtagaagattaaaatcaatatatatgcatcttagaaatatgaaattagatcgtgaaacctcactttctttcagccattgtaaagaaaatcatcgtggaccaccctgtcgggagtagaagttggatagagcagtaatagtacaatacagcttcccttattttgtaatgtcaaaattatgattatatttttcgtgtgaccaaatatttacgtgcacactgtagccagtttgaaaagtttttactatagattattccattataatatctagctttaacatggttttaatcttttcaatgcatgtctcgttaattcttttttttacggagaaatgtctcgttaattcagatgttgtgagtgataagttagagaaactcttgcagaaacatttcctttttcttttgcaaaattttggcatttcaaacatgccgcacggtggctctggcctgtatgctgtagcacatgcattggatatgtgcaggggaaaccgtgctagaccaccagtataaaatagaggatgccagcgatcgattcaggtgcaaaaccaatctacgcctatcattctgctatgctcttcgatgctgattaatttgcattttttttctgttaacatgcatatatagtaacataacattaagtcatttttttcatcttgattggttcaagtgtatatacccagttgtagtttttcatttctgaatatcacctaaaaggagacatagctgatattgtttcatttctcttgattaaatagtgtaaaagttgttatagcaaaattagcccccccccccccccaaaaaaaaaaaacagagagagagaagttaaaactatacaaggattagcacaacattatggcatgatagtcgactagtggagactggagagatatctatccttgctcccgccatgaccgatgtttgaatttcattctctagctaggaagacgatcgatgatggaatttgatgaatgaaacgcaacgactaaattaggggactggtgatgaaattgaaacattgcacggttacaaagaaactgtaacatttgttgtacatccatatgaacccaggttgataaatctagaagcaatctttctgagacaatgattgtgaacgacacaatgtaacattttttttgccaatgtgttcacaaattacaaaaaatacatttcttgccagattcttgtaactattatccatccatcactggctgatcactgcgtgttgagcacggtgaggatgcagctggagatgtcctgagagctgtaccccgtcagctcctgcagctccgagctccacggcagcgcacccggcgggttcagcgtccacctcgcgatggagatcgccgccgccgccaccatggacggtaggtagcccaggcagccgtagctctccagcgaccggtcggcgacgtgacacgccagccgctgcacgcgcagctcttccttccccttgctgtaccgggtgaagtgctccacgaacgtctccgcgttcgggccgcccagccgatagcccagtgccgccatcatctccctctccatcgcgagcacctcctgcgccgacgcgaactcgccgtagctggcgatctccctggcgtccagcttgaagaccgtcccctggtcctcgtacttggccgccgtgtacacggccgtggcggcgacgaggctgagctggtgcgcggtgtagctcggcagggctctcacggacaggaaccggtcgaagtaggacacggcgcggtggagcgtgccggcggcgagttcgtagcggtgggtgagcctccccatccaggcgacgagggaggcgcgcgccgccgcgctgatctgaccgccttgcaccgtgtcgaggtagtccggcgacgggcgctgggcggcgtccttctccatgtcacggaggttggcgtcgatgtcgtcgtcgtagggcgcgcacagctgcgggcgcgacgccgtggagttgtcgggggccggagcgtcgttgtcgccgttgtactgctcgctccactccagctgctgcatgaacgccctgatggcgtcgccttcgtcgacgggagcggcgtacacgggctcggctttcgctggaacggggaggggagggaaccccggcggcggaggaagacggcgagcgggcgcagcgtacacgggctcgtcggccagccctggaacgggaagcggagggaagcccggcggcggaggaagatggcgagcgggcgcagcgtacacgggctcgtcggccagccctggaacgggaagcggagggaagcccggcggcggcggaagaagggcacagggcaccttgacatccaccttcgtgtcccagtcgtagagtacgccgttggtgtcatcattcgatgccatggactccacctcggcggcggcggccaggtcggcgccgggcgccgctggatgcgccgggagcgcgccgatggcgcggaggtacgcgtcaagaaccccgacatccatttgcgccgcgccgccgtcgccgggcaagagctcgaccatcgaggccgttatgtcgtcagcgagaaggtcggcgacgtagggctccatgatcgaatccatggccgctctcgctcgctcgccggagcagtgtgggagactgggagagcggaggctagtggtggaagaagaaacttgcacacgctggtggcgactggcggcgaggcgatggtgatggtgtcgcgctgcgctcctcgcctcttatcctggctgccaccatgggtgttcgatccgattcaggccaggcttcgcgcgcaattccgaatcgggatcgtattgatctgatatatttgatttgaaccaagcgaatcggtgtgaactcgtactaggctgtaaaaaaaaaaacctggaattaggttgtgttcctttcctattttggtctccgactctgtcccgaattcctgatgggattaacggatagctgtaatttcttaatgatgattagttgattgtttatagtcctgaattagtatatcgacttacgaaagcgtttctttctttcttttttctttgggttaatttggcgtccgtgtgaatttggttacaagaaaattgggtatcaggttaatgtttccaaatcgttctggagtcatcaaaactcaaacacgagcgcaagaaaaatccatcaagatttctagcgctgtaaattaattcaccgatcaatactattttgggtaggatattactaactccattccatatacaccggaacacaccaaaaaaaaagtcaactgtgcttaaattcttaaaatacatatatttctctaaggaacacggtagagacattatatatgatgaacaaaattacttaagaatgattaattgatcagttagtcctgaatggtgccaaactgccaacaacatgattaagttttcgtctgattagagcaatttgaacgtgagtgcactcctgcagatttttactggatttgatcagagcatatagagaatgtgaattcgatcattatcaagctaaatattggtgtaaatctcatccaaaaatcaagttagagaaaatacatgggcagtttgttttgtctatctaataacgccgtagattatatgtattctattctttgagtccttttttctaaatttctttggagagctatacaattctcttttggactttatcctccacatagtatatctcatatgtttgggaattggcttgtgggtgttagtaaaaaaatcaaaaaacttattcttgttggagcttccgctatatgttgggctctttggcttagtagaaatgatatggtttttgataaaacaccatcaaaatcctatttgcaggtgcttttcagggcaatgtattggcttcagggttgggctcagttgcaaaggcatgatgaagatatcaagctaataaatgatgaatgtcgtaaacttgagacgacaattatgtatctatttgccaacttcgggtggaggttctctattagaattcagtagttagaggatctttttcttttgttggtgtctattagtttgcttagctttgtttctgctttcgtgaactttctgtgtgagttctgtaataattggctgtaactctttgagtaaacgccggaatgttacattccattatctaaaaagaaatatgtattattgggagtaagcaatatcagaaagcttggctccgaaactttgttcaatccgtataaaacacttggctccgaaagctcgactttgtacaaatatccaaaaatcgcagatgacactcatcaggtgtgagaatatagatctcgatgatgtattggagaacatactggtgatgcgtcactaccagtgaaatacctgggattacctttcaccgttggtagattgctcaaggcagacctccaaccactcttcgataaatggcaggaacgatggctgtttggtgggaaagaaacatggggctagctagacgcaccactcaagtcaagtaagtgctttccttgcagccaatctatgtcctaataacgcttaaatttaccaaggtatccctataaagtgcttgacaaccaatgaaagagcttcctatgggtgggttaggaaaacataacgagcgggaaatgcaaagtataatgtgctcgccaactgcctacggcagcctgggcgtgctaaatctagaaagctttgcactagcactacatgtcagatggctatggtatgaatggaaatccctggacaaagcatgggtcggcttggataccctgtgcgacgaaaccgataaaatactcttgtcaactacaatgataaccattggggacggagcaacatcacatttttgggacttagcctggatgcacggtcgccacccgaaggatgtcatgccacaagtgtacacaatctccaaagggaagaatagaaccttgagggataccatcacagacaatacctggtcgcaagacctaaatctctcaatcatcggagacatgtcaactaagcttctagagcaactagtgaccttgtggacaacagttcaaagcgtgcaactctccccaggtgttgtagatgaaatcatttggaggctcacaaatcatgaagaatactcggttccacctaaaaagagtagttccttgaatccactagcacaaactatgacataatcatttggaaaccatgggcacgaaacaaatgtaagttgttcgctcggcttgtgatccgtaatagggactggatattagacaaactagtgattcaaggatgtccaaacaacacttactgcctgctctgcagacacgaattggagactgctttccacctcctcgtggactgagatacatgagaagaatctggaacatgctcgcaaactagatgttgcaagggcacataaagtcagccagctggattcccgctatagtccatacctggtgtacaatcatccggaaagcgtaggcaccaaacaaatgtaagttgttcacctagcttgtgatccacaatagggactggacattagaaaattagtgattaaggatgggaaactgtttaacagctcgagtgggcgtccacccatttattgcatgtcatctaaatggttatgaaaaaaatgaaaaaatatgaacaagatagatcaatatgtaatatatcaatccacaaatatgcaagttgaaattcaacttctacaaattgtaacaaacataacaaacaaaactcaaattactatatgtatatttacaattaaatttgttatttttgttacaacttttagaagttgaatttgaacttgcatgtttatggagtgatatattacatattgatctatcttgtcaattttttgaaaatttttcgtaaccatctaaacgggtggacgtccactcaagctattaattagaatccatctccgattaaggatgtccaaacaacacttattgactgctctgcagacacgaattggagactgctttccacctcctcgtggtctgcagatacatgagaagaatctggaacatgctcgcaaactagatgtcataagagcacataaagtcagccagctggattcctgctatagtccatacctagggtatggcgttgcaacctaacctaggacatccaggaaagatgtttgcactctgctactactaacggcatgagagatatggatagagctcttgacaatatccctcgttacgaaaataaaggaggacactaaaacttgggccctagtagaagcaaaatgccttgcacatatcaatccttagtttttttagaaaatactttcccatttccttttccttttcttttgtaaatctcttcttcctatacagtttttccatcccagtatactcaacgaaattggcgcacctaaataccgatttgttaaaaaaaaaaaagctcgactaggtggttcagccgttgtgtactgcatcctagtgcaacagataccaccatctatcacgtggcaggtggcacgagaagttgtgagttcgcgaatgcatgtacatgcagtagaccagtaggaagaagagaaacggtacagatcgatcgataaagatgtacagaaaccagagtacgaaaagttagtaattttgaatttgatgaatcatacatatttcaaccaaaactcacaaatttggacttatagatcgatgtacatacgaacgctagcaacaaaattgaagccatcatgcattgcatcattgcatggttgtgcctttacagactttttttttgacataagcttttacagactctcttgttcttcctatacattggctatggatcctggaagaagtactcttgaaagggagcaaagcgaggacatgcgatttgactgtacatgtcgcagacgcagcccatcaagtcgatggcctcgtacccggtgagctcggcgagatccctgctccacggctcatgccccagcacgtgcagcctcgccaggaagatcgccgacgccgccaccacggacggcaggtagcggtggaacccgtacgtcagcagcgacccgtcggtgaaccgatgcgccgcctccttcaacagctcctcttcttttccgtcgccgtagtacctcgtgaagtgctgcacgaacgtggacgccgtcgggccgcttaggttgtagtcgagcgcggcgaggatctcggtctccatgcacgacaccatcttgtgcctggtctcgctagtgtagccgcaccgggcggcgaccatgctggcgtcgatcttcctcagggtgtactggtcctcgtacttggcggcgaggaacacggccgtggccccgacgaggcggagctgcagcacgtcgtccgactcgggtgtcaccgacaggtagcggtccaggaagtaggcggcgcgctggagcgtgccatcggcgagctcgtagaaccggctgaactcgtccatgaaggcgatcatcgaggcgcgcaccagtgcggtcatccgcccaccttgtgtcgtctccaagaagtacggggagggcctctccgcggggttcgtctccatggcacggagggtggcctcgatgtcgtcgtcgtagggcgcgcacagctgcggtcgtgtcgtcgctgagttgttggtgaccaccggctgatcagcgtgctctggcagcagtggtgcgacatcgatcgtcttcttgggtggcaccgggtgatcgccgccttctggcagcggcaaggtctcctggacgacggtgacggagagcggtggaagatcaccgtagattgggaggaagctgccgtaggtgtgaggggtacggggggagtccggtggcggcgccggtgcgagcggagctgccggtggcggtgcaagcggaggcagtgcgccgatggcgcggaggaaggtgtcggtatccaccatctgcggagtgccgccgccggagaaaggatggaacattgggagcgatgtttgatcagcaagaagttcggcgaggcagggatgatccatgatcgcgtcctccatgtagggatccaagatcaaatcccccatggtcgccggagcccggaagcgagatcgagggagagcgagaggagtcaagaggcggtggcgggaagaaacttggacggtcgcgtggtggtggccgaggaaggatggtgccgcactctcgccttttatcctcgtgccacgatccgactctgatcaggctgcgcacgcgtgaaggaatccatcaaattcaaagttcgcgcggttttccgaatcaggatcgaactaatgatgtttgattagagaggactaagcgcgtgcgtttctttcctttgtttgcatctccgactcgatctctgtcatgatgaaattcaccgatcatacgatactattatacatacactgacacacacacgcgaaaaaaaaagagcacatcatcacgcaaaaagaagtccaagcactcaaattcttaaaatccactagaatggtagattaagcatgggagatgacataccatactattatggattcatgcacattgctagagaagttacctaacagtgagcatatgctaacactctatcaaaatcttcaggatttctaagcagctgagcagaacaaaaacatggtggacgtccaatcgagtgactaaaagagaaactacctgttaatctttcggtagatttatagcatcgatttttgtagaattttcaaccaatcaatgtagctcgttttaagtgaaataacataaaaaaaagacaagcatgtaaaaaatcgtaaatataaagaaaaaaaatgttgcaaaatctaattttggtgtactgtaattgagtgtaagagctatgtaattaagtgtaactgcaagttggatatagaagagcacaaattttgatgcaaaatcctacggatgaaaaagtgaaagataggagcccaaaattatgtcgcagttgaaacaacaaatccgttaaaggagtttcctggacaatggtaaaagtgcgttaagcgagttcaggtaaatctcaggcaaaacgtaagcgtagtactacctctattctattatgtatgacgctacaagttaaactaaaacgattcaaaatgtatgacgttgcagggcaaatcatttatgtatgacacattgtgtaccgactttgcccctatcctccgatggcgccgttgaattctcctcctccgctaccattgcgcaccgcagccggttccgcctcccaggcgatgtcgtcgtcctgacctccaccatggctagatctagtggtagtcagtgtttaatctttcggtttgatcatttttagcggggtggccgtaatatcgcaattttgaaaatttcagcccgaaattatatgaatttttaaataaaatttgatacaaatttaaacaaaatgttactaaattcatgaaaagatgaaataaataaaaaatttcagccaaaataatatcatactgggagatccaatagaactgaaatttcgatccgaaattttgaaccgtggcagtacaatggctaaagtggtttctccgcagcggcgttgtacgagctctgcaagctagcggagaacatgcatcgcatcgtgtgtgcaagcgggcgggcgcccgcgctcaccgactctgcccgcgtcgcggatgtgctcatcttcttcgccaagtccagtgagagccgccacgagctgtccactgtccggtatccctagcatcgtagtcctgctcgccgcagccaacattgtcagcagtggcaacacccgtgcaatcgagcgtgcgctcgtcgtcttcgattggatttgtgccaagatcaacgaattggcattggcatgggaggcaataaatcttggtctaagagaaattcttttgaatcccaaatcatccaatctgaaatgctctatgatatttttctctgaaatggctcctgttaaattccaatgttctcaatgctgtcctgtttcgttcttgatgcttattcagatgcttgttcagagtgacaaggagcagcggtcttgatggatccaaaataaaggaggacatgtcattcccagaaacatttcatcatcttacagctcatgtataaactgaagtagaattcagaaatgaactgaacaccaaaaagctgaatcttaatcaaggaaatcgaggaaaattttgtatcttaatcaagttagtacggggccaaattcagctacaggatcacatgtcactatcagctgtgaaggaagaatatttttgttctgctttaattcaaaaaaacctgaaatggaagtaaagaaaacaccaattacaactgatgcaatatatattatgtacaaatacccagaaagaaataagattaagagtataccaatagtctggacacatatgtaattagtccttgaacacgcggcacgccccatcctcgcatgactcttccttctgggcccatgacaggattttttttttcgccaatactcgtcctcctgtcctgctcttgcaattctcacattcacttccaatgattggtttgtgatcaatggacaaatcaattgccttaagatgcaacataaatagggaaaataataagcatcaaattaatgcattagctagcactacaaaaatccgtaattttcttggcggccaaaaaccgccaagtatagtatgaaaatcgccaagattaattattccattggctgaccgccaagtctagaaagctagagatattcagattccgtggttgctaaccgtaagggaatatcttcttggcggtcgaactaccaagcaaattaagaaagttgtgaactttcaaatgcgccaagaaatgtaaccttgtccctttagaccaacaaaaatatatctttccttggctgctgagaaactgccaaaaaaattcttactcttgaccgttagaaccgctaaggacattttttatccttgacggttagtaccaccaagaaagattatccttgtcagtcagggccaccaagaataacttattgatgtccaaaactgtgtctttccctggcggccctacctaccatggcaatcaagaatatatttggggtgtaatatgagtaatttccatggcggctagaaatgctagggccgccaagaaattatctttggggtacattatgcagatacagtccaaatattggtgacacacacactatatacacacatgcagtccaatgcaacacaacatagcgaaagtaatgtgaaagtcaatatagctggccattatgtgaaagtacgccgcgagaatcgccaacatttccaacaatggtaattttatcttacctaaaggtataatattttttagtgtaaaatttagtatctttacgtactatctatctaaagataaaaaaaaattagtgtaaaatttagctatctcaaggtgttttctcaagaattgtaaaatttatcttccaacgatgatctgatttcctctgatgattaccatgtgtgacgtgtttcttttgtataacgacgctctgtaagcctgctgatcagggagcaaaaatcccaattgaagtgtaaaaacaaacaattcaacagttccatgaaagaaaaatgctacaaaaatgtgtgaaatgacaccggagaaaaataaaggcatacataaaatagaggagtagaataagagtcggattctatactaaagggatatacctattgtagcaggatggcgacatggcgacttagcatagcgagagggagcggctgccagcgacgttcggccaagggttgctgtaactctgatatatacgctgtaatatgttggatcggggatgtgtacccgttatcagtgcctcggggatataagctacgactctcaatgacgtcattgtgtttggatctcctatgacatttttcgcatttggtttctaatgatgatcttgggccagttttataaggcttttacgtgtttgtgaataaaaaaaagatgaagatgaagacaacctccgggccatgtttgcaaagactctctatcagggggccaaaaaacctcaatcaagttgcgttgcatggcaaccatgaacaatcaacagaaacatgtttacaagggatctctactcctaccgatgtcctcatcgatcaaccgatcgatcactgcgttctacatggcgaagatgcagctgacgaggtcctcgaagctgtaccccgtcagctcctgcaactccgtgctccagaccagcgcgtcgtgccggttcagcgaacacctcgcgacggagatcgacgcccgccggccgccgcctccatggacggcaggtatagtagccccgggcagccgtacgtagttcattagcgactggtcggcaacgtcgcgctccagccgctgcatgcacccgtagcttttcctctccccggctgttgtacacttgtaccgggtgaagtgctccacgaacgtgtccgcggttgggccatatgtagagacatcagagtaccaaaagctaataaatttgaatttgatgaattaatcacatatatttcaaccaaataacacgcgcaattttgagtttacagatcaatgtacaggcaacagtgcaaaatttaagccatcatattcatgctttgcatgcttgtgcttttacagactcttttgttcttcctatacatgggctatggatcctcgaagaagtactcttggaaaagagcaaagcgaggacatgcaatttgactgtacatatcgcagacgcagcccatcaagtcgatggcttgtaccccgtgagctccgcgagatcctttctccatggctcatgcccccgcacgtgcagcctcgccaggaagatcgctgacgccgccaccatggacggcaggtagcggtggaacccgtacgtcagcaacgacccgtcggcgaaccaatgcgccgcctccctcatcagcttctcttctttccccttgccgtagtaccttgtgaagtgctccacgaacgtgtacgccgtcgggccgccgaggttgtagtcgagcgcggcgaggatctcggtctccatgcacgacaccatcttgtgcctggtctcgctggtgtagccgcagcgagcggcgaccatgctggcgtcgatcttcctcagggtgtactggtcctcgtacttggccgccaagaacacggtcgttgctgagacgaggcgaggctgtagcggtccagaaagtaggcggcgcgctgaagcgtgccgtcggcaagctcgtgcaaccggttgaactcgtccatgaaggcgatcatcgaggcgcgcaccagtgcggtcatccgcccaccttgtgtcgtctccaagaagtacggggagggccgctccacggggttcgtctccatggcacggagggtggctcgatgtcgtcgtcgtagggcgcgcacagctgcggacgtgtcgtcgtcgctgagttgctggtgaccaccggctgatcggcgcgctcttgcagcagcgatgcgacctcgatcgtcttcttgggtgacaccgggtgatcgctgccttctggcagcgggcaaaggggcttcccttgggaaggggaaaccggcgccagagagcggtggaagatcaccgtagacagggaggaggctgccgtaggtgtgaggggtacggggcgagtccggtggcgccggtgcgagcggagctgccggtggcggtgcaagcggaggcagtgcgccgatggcgcggaggaaggtgtcggtatccaccatctgcggagtggcgccgccggagtaaggatggaacaatgggagagctgtttgatcagcaagaagttcggcgaggcaggaatgatccaagatcgcgtcctccatgtagggatccaagatcaaatcccccatggtctcgccggaagtgagatcgatggagagcgagaggaggcaagaggcggtggcggaagaaagttggacgctcgcgtggtggtgccggaagaaaggatggtgttgcgctctcgccttttatcctcctgccacgatccgactctgatcaggctgcgcactcgtgaaggaatccatccaattcaaaatccgcgcggttttccgaatcaggatcgaactaatgatgtttgattagaactaagcgggtgtgtttgaagttgtactagcttgcgccgtacgctcgtaaaaccgtaattaggcttctcccatctgtgtttctttccttaatttgtttgcatctccgactcgatctctgtcacgatgaaattattgtctagcttaattcaccgatcgatcatacgatattacatagactgacacacacggtcacgcgaaaaaaaaaaagagatttgctcccatccagcaggtaccatcggtactgtccggtacgaaatttgagccatccaatcagctcaatcggatgatggaaaatctgtggtacctccaggtacaaatttgcccatgaggtggtaccggaatatttggagtggtggaagggtaattttgtcttttcgcgtagaagtgtccaggggagggaaatagggttttctaccaaatctttgccattcgatccgtgagaggagtaagcggcgagcaaatctccccttcccatccgatccgatccgtgagaggagtaggcggcgtcggcgacttgcttcatcggcctggagttgatccgcgggaggcggcgggatctgtgggaggcggcggcgacttgcttcgtgggagatggcggcggcggcggcgagttgcttctgtcggcgcctacttgctttgtgggaggaggcggcgtcggctgatccgtagccggcggcggcggctgatccgttcgaggcggcggcgaggtgctccgtgggaggcaaggcggcggcgggggaggcgaggcgacggcggcggctgatctgtaggaggcggccggcggcgaagtgctccgtgggaggcggaggcggcggtggcatctaatccatttgaggcgcaggtgtcggcggcaccgggttgttcgtgccggcgaggttgtggcgggcgcagtgatgcctagcgcggcgaaggcctggtgctgcggtgctgctggtgacgggcgcgacggtggcctggtgacggccgcgttcacgaggtgacgacggcggctggtgcgtgacagccttggctgcgaggtggtggcgtgcgtgatggtgccgcccgcggtgacgaggtggtcgtcggaaccggcgttgtggcggcagcgggtttgggctttgcgcggctgcagtggcgaggtggtcgtgtagtcttcttagccggcgacgtggcagtgtatgcatcgatttttttcatctaatctaaatcattagcttctgttggttgcagcggtagatactttcattttctgggctgcatatgctcttcttcttcattgcttataggatttgtattgtacgatttattggatgttttaatgagctcagttgttgcttgttctatgtgaattttcaaatgttcaataccctcccctatcatttactgattacattgcaattcgagtgacttcaaaataaatcatggatagtaacaatgagtgactgcaaaatgataataggatagaagaaagaaattgttgatagcataacgagtggtacactgatgagttgcttgttttaatcatggatagttacaatgatgtctatatgaatcttagcctagagctagttgcctacatttgcctcggtcactaggcgtttaatatcttgctgcacttcaatcacttcgttcatagtagaattaatgaggttggctacaaccttatgtttgaaagtggtggttgtatcctgaaaagcaagttatgaaaaaatatcaattaatgtcattttatttacaaagagtactgaatgcaatttaaaattaccatttcattgaactcaggggagagttcttttccattccaatgctgtatgaatttcaatgtgtgcaagccacatgaccagctgttgcaagcatgttctttgtaagtggtaattcgttatagataatttgcgacaaaaattaactgtttgtttgacttgtcactttgctgagggactttcattgggcagaatggccaattggtaatcctggtgttcttccatttgttttcaacgccatcttctagccttgcatactggataaacttttcaattccttttatctgagttatcaaatagagtattacatatctaatgtaaaaagttagtaaggaatagtgatgaatctaaaggcacaatgtagcatactgtattattgaggtctttatctttgtcgtagtagctcttttccatgcgcatcgagtctagtatttgaattttttctttagcaccattgagaacagccacgtaccaatgagttgagtttctattgagtggtaggaaaatctacataggaaatgaaatgtaagtcatgcagttattattatgaaggatatttgagggaacattgatataacccatatcatgttgcaaatattttgctgtaacttttgctctcttgtctcgatattgcttgttgcgggttccaatttgttcaccatttgttttccaggcctggcaatgtgctgtactttctagaaatgcagtaccatgctctcttggactttcacttgcatgtctttaatcaacataatgtatgcatctatgacctgtgaaagaataaagaacaaaatttagatactgataatattacgttgtatggaagaagttaagtatttcttacactgcctttcaaccacttgcttatgatttgtgagtctttgggattgacaagtggcctaagaaattcatatgtaagttgtatgccatcaatacttgatagcaatttttcatcatcatcacattgcttcatgtaattgatggtaatctcatcctgcaagctcagttctgtagtttttggttccttacttctctttagagcacttgcaaatgttttttttgtagtataagaatggactgtctgatctgtgagttggcttgctaacccttccatgtggacgtctcagccttgcaccgattgtgtcaacctgataggatcaattatataattattactgcattgctaaataatttaatatgttgtcatggttgtaattttaattgaaataccatgtttttttcaaacaaactatcatcatcgctttcaatgatgtgtggagcttcagctatccctatatcaggaatgcatgtgattttgaatgcttgatgagaattctgaaatgttaattttggaagggattagagttgtaatagtgatatcatattacaagataagaaaatagcagcaccttatgatccatattctttccatcgttttgattatcagtttttggaatttcttttgtttgggatgagtgctgcaaaatattagtaatgcttaggtactctcatagtagtaatagaaatgtattgagatatgttaccaccttctggtccttttgatcactccacagaatggcatgtatttcacaggagttcgagtaaaaacagcacaatggtgctagtagacaaacaataaacaatgtatgctctgttcacagctgacagtaattaagacaaaagctccattcaacgatatacatgctttgttctccagcaaaagcttgtgcttttcacacaaattcattacaagaaccatgacagattgaattgttcattacaaaataactagaccacacaatataatcctctgaccaacaatacaacttcccaaacaaggcatattcaacttccaccagtgcaaagaaacacttcaaactccagattcaacttccaccagtgcaaagaaacacttcatacttctcatacatcttcttctactttgctgaaaataaaatcacagatcaaattagtaatatatagagagagtttacataaattgacatattcaaaataatcatattatatttcaccttaggaaaattggacatgttcgaacagtgtgcccatggccacgacaataaccacaacgcctaacacgcttctccatgaatcctcgtagtctttttgttggagctcctttaggcacaatttccataggatcatggaccttatcatgactctcaatgtctgtacgtaaactttgcgctagcacatgaccacataaagacaaatctgagttctttgtctcacattcatcagtttctaagtccaatttttctagcatctccatcaccattaaagtagtttccttagacaccgagcacttgaaaaacacttcggtgcccatgctacgcaacctgtgatatctctccatctggtttgaccatgtatatacttcgccatacctatcagaaggaaacatgtgtttcgctttaattgtccacctacgcactatgcatgcttcaggaatggcatcgagcttcaaatgatgcataattgcaaccatatgctcacatgggaggcattcacgatccatttttctgcatgtgcaatttatgctcttcattgttgattccacatatgtacaattcaagatttgtagcatctcagaatcacctttcatggaaataacatacttaacc

SEQ ID NO: 36661 - DNA, 2913 bp, Oryza sativa
ccatgttctgctcaatgtgccaagtgcacaaccaatgctcagaatccggcatcacagctgctattgctctacgcatggcattgtccccatctgtgatcagtgctttaggatgcttctgatacatgcaatctagaaactgcttaagaatccattcataagttgcaaccttctcatcagctacgatagcacatccaaaaataatagtggaaccatggtggttcacaccaacgaatgggataaaaggtaagttatacctattcacccggtatgtgctatcaaaaactacaacatccccaaatgcatcataatcgatacgggattgagggtccgaccaaaataaccgtttcaaacgaccagcttcatccgtctcatactcaaaaaagaactccatgtcatgtttttgcctccattgaaaatactttataacacgctctgcatcaccacctaaaatatgtttcttccttagcctagtaaaatagttgtacaggtccctactaacaaaacctgtagcatcaaaaccaccatgatgcctctccatgacatccataacttgatgctgacgcaaacccacttctttcaattccaaaatattagccttttgagcattgctaattgtgcgatgtgaccgtaagaaagctacttcatctgatttagccaacggatgattatgctttgctacatacttcacaacaaaccaatcacctttcttcttgtcaagtttaatctcaaaaagtgcattacaaccacatctagtaagagcttttggttctctacttctgttagccgcttccatatacacttctttcctatgtccttctctagagcattggtactgcctatgggttaccgcaacagtaataggatcacgtctaatgtaattcttccttacactaaaccctttttctttggcatacctgttatagaagaggaaaccttctttctctgtcttaaatctcatggcagtcattgttctgtactcctcttgttcttctaagcttataaaattgtctcccatttcatcacccatacaagttctctaaaaagaaaacacataatactcagaaatcatctaaaatcaacaaacaaactgctacctatctcttggttctaacaaaaaaaaaattagaccacaagaaaatcacatacctgagaggaaaccctaaaccggtagggggcatatgctgcttgagttgtccagggggataggggcaaaaaatacccacggcaccgtcgctccttgcgcagatggatgggcactggatgagataagaaatcggtaacggtgggggcgtgaatgaaaccgctggtgaaggagtgttggttccccccccgcggacggcagatgcggggccagcaagcgagcgcacaggcgggggcgtggatgcggggcgggcagatttggggcgagcctgcgcgcagctcaggccggcttcgcacgggcggagctgtgctcgccgaggggaggaaaaaaaagagattagatgagaaagcggcgccgcacggagggaggaaacgagaaagagcgaaaaggagaagagggggcgcgactactttctctgttttccaatcgtacccttctaacatggacggatggatttatctctgtacctcccagtaccagtacctaccggtacaagttgctggatgggagcaacgctcaaaaaaaaaattgcacgccgtcacgcaaaaatttgtccactagaatagtagattaagcatgggagatgatatatcgtactactatgtactcatgcacattgctagagaggttgcaaatacagtgagcatattcaggattacagagcagatacaaaacatggtgaagcatcgaattttgcagaattttcaacaaatggatgtagccagttttaagtgaaataacaaaaaaaattattacatgtaaaaaatcgtaaatataaaaaaatttctataacatctaaatttagtgtattgtaagtgagtgtaaatttttttagaatcacacagtacaacgcagacactcacaacgcatgtacgcacactcacccatgaacgcacgcacgcaaatcctccccctatgagcttgtgtatgtgagtgtaattaactgcattgttactacaagttagatatatagaagaacacaaattttgatgtaagatcctacaaattaaaaagtgaaagataggaactcaaaatcattcatgtatgaggacgcagtgtgtatcgtctttgcccctatcctccgatggcgctgctgcattttcctcctcctccgctaccgtcgcgcaccgcagtcgtttccgcctcccatgcaacatcaccgtcgccacctctgccatgcatgggcagatctagatgcggcacgatggctgaaatggtttctccgtagtggcgtcgtccggtggcgtggccacggcgttgtacgagctctgcaagctctagctaccggagaacatgcgtcagagatcgtgagtgccagccagggtggcgcccgcgctgatcacctacttcgccgatgccgactctgcccgcgccgcggaggtgctcgtcgtcttcgccaagtccagcgagagccgccacgagctctccagtatccctagcatcgtggtcgtgctcgccgcagacaacatcgccagcagtggcaatgcccgtgcaatcaagcgtgcgctcgtcgtcttcaattggatttgtgccaagagcaacgaattggcatgggaggcaataaaccatgagaaaattcgatccatagcacaagaaaaaacccgatatcaaaaaatagcacaacaaatttttcacttcgaccataagcacagggcaccaattttcttgcgatccatagcactcccgttacatttgtcatccaaacatgtgagttgacatgaaaaaaagacttatttgcccttcttctccaagcaagagggcaatggagctta

SEQ ID NO: 36662 - DNA, 21785 bp, Oryza sativa
  unsure (1)..(21785): unsure at all n locations
cgttcgccggtgtcggtgagtggtggcagcgaggtctcccggctagccggcggcagatccggcgctgccgtcgccggatctagcaaggccctccggcttcggcggtggagggggccgctacagcgcgaggcggcggtgactccagcgcgcacgtggccaagggaggcaagtgctcgggctgacacgttgaggcggccgctggctttggtggacagcgagacgcgtcggagccagccggggtctccaccatcggcttctccgccagccaccgaatcccctttgtccacgctcccaatggcaccaccagctccgtctccgcccattgggtcatcggcctcagcatcacctctaacgacgacgacggcctcacaggtgggtcgaccgcgtgcggctgcgaagcgaggcgacttggtttacggcggcggcggtggcggcgactgcttgcgaggtgtggcgaggcgacgacggcgatggctggagggtggttcgaccgtgcgcggttggtccatgcgatggctgcgaggcacggcgaggcgacgacggtggctccttgctcgaccgcgcatggcacagtagctgctccgcacggggctgcaacgacgagatgacatggtcgaagggtaaattagtccgaggataattttttctactgcaaactaaaaccattagcttaaaatacaagggaagtgctatgtatcgaaggaaaattggtctcctgtgtttctggtcgaagtgaaaaatttgttgtgctaatttttggtaccgtgttttttcctgtgctatggatcaaattttctcataaatcttgggctaagtcgctaagaggaattcttttgaattccaaatcatccaattaatctgaaatgctctatgacctttttctcttaaatggctagctgtgaaattccaacaatgatctaatttcctctaatgattaccagtttaccacacaagatgtgcttgcttctttcgtataacagcgccctgtaaacctgctgagggagcaaatattccaaatttccaattgaagtgtaaaaataaacaattcaacagttccatgaaagaaaagagctataaaaaatgtgtgaaatgacactggagaaaaataaaaggcatacataaaatagaggaacagagcaatagtcgactctatcatatgatttctcttaaatagaggagcagaaatgttgtaaccgcatggtgatatgacgacttaacatagcgagagggagcggctgccgacgacgtccggccgagggtcattttaactcgaatacgtcgtaatatgttggatcagagaggagtgcccgtaatcagcgccctgggatgtagggtactgctgaatctcgtaaacaaatatcgtgtttcagtatcgtcatcgtgtttggatctcctatgatgtttctttctcgtttggttttcgataatgatctcggaccggttttataacataagtcttttacgtgttcgagaaaaaaaaatgaagacaacctccttgccatatttacaaagactctctagttaggatcttgctgagggggccaaaaaaaacctcaatcaagttgcattgcatggcaaccatgaacaatcaacagaacatgtttacaagagatctctgctcctaccggtgtcctcatcgatcactacgttctacatggcgaggatcgatgcagttaacgaggtcctcggagctgtacccgtcagctcctgcagctccgtgctccagagtccagaccggtcgggccggttcagcgaacacctcgcgatgaagatcgacgccgccggccgccgccttcatggacggcaggtagcccgcgggcagccgtagttcatcagtgactggtcggcgatgtcgcgctccagccgctgcacccgtagctcttcctctccccggctgttataccgggtgaagtgctccacgaatccacggttgggccataattgtagagagatcagagtactaaaagctagtaattataaatttgaattgatgaatcacatatatttcaaccaaataacacgcacaattttgagtttacagatcaatgtacaggcaacagtgcaaaatttaagccatcatattcatgccttgcatgcttgtgcttttacagactcttttgttcttcctatacatgggctatggatcctcgaagaagtactcttgcaaaagagcaaagcgaggacatgcaatttgactgtatatgtcgcacacgcaccccatcaagtcgatggccttgtaacctgtcagctccgcgagatcattgctccacggctcatgccccagctcgtgcagcctcgccaggaagatcgacgacgccgccaccatggacggcaggtagcggtggaacccgtacgtcagcagcgtcccgtcggcgacccgatgcgccgcctccttcaactgcttctcttcttctccgtcgccgtagtacctcgtgaagtgctccacgaacgtgtacgccgtcgggccgccgaggttgaagcccagcgcggcgagcatctcggtctccatgatcgacaccatcttgtgcctcgtctcgctggtgtagccgcaccgggcggcgaccatgctggcgtcgatcttcctcagggtgtactggtcctcgtacttggcagcgaggaacacggccgtggccccgacaaggcggagctgcagcgcgtcgtccgactcgggcgtcaccgacaggtagcggtccaggaagtaggcggcgcgctggagcgtgccgtcggcgagcttgtttttccggctgaactcgcccatgaaggcgatcatcgaggcgcgcaccaaagcgctcatccgcccaccctgagtcgtctccaagaagtacggcgacggccgctccgcggggttcgtctccatggcacggagggtggcctcgacctcgtcgtcgtagggcgcgcacagctgcggccgtgtcggcgccgagttctcggtggccacggccaccggctgatcggcgcgctgctcgggtggcaccggcacgggctcctggaggacggcgccggtgagcggtggaagatcaccgaagacggggaggaagccgacgtaggtgtgaggggtacggggggagtccggtggcggtgcaagcggatgcggaggcatggcggcgatggtgcggacgtaggtgtcagcatccatctgcggaagcggaacgccgccgccgccggagtaaggcccaaacattgctgggacctgggagcgctgcgtgcgtgtgatcagcagcagcaagaagtccggcgaggtctcaacggaagtgagagggagagcgagaggcggcggctggaagaaagtttgcacgtacgctcgtgcaggtggcgtggcgcggggacgatgcatggtgcctctcgccttttatcgtgcatgtcatgggtgttaatccgactccgatttgattagggttaagcgcgcgtgctaactactaagccaagatgatgttgatttttaactaagcgcgtacttagggcctgtttggcacagctccagctccaactccacccctcttggagctggagctcagccaaacagtttcagctccaccaaaattgggagtggagttgggtggagctctctcacaaaatatactagagttgtggagctgggtttaggcagctccacaacttcactacagacaactcctggagttatatttaaaagttggagctgtaccaaataggcccttagttcggaatccgcatgcgtggcgcgtgacatggcgagcgtgcatgcggcgagcgcgggaatttcgtcccaggtttataacgaactgatcgtcacacgtttcaatgtgttgtctgacaaaattttggtgcctgacaaaattgaacctgtcatttgtagctctcgagtggctgcaaaaggatccaaaatgttacaatcgagagggaggattgaaagtgcgagtgtttcggccgattgatttgaaaaattttcatatcaaaaccgttagcgataggttggttatagcactctcgaaagaattcagaggacatgttgacttgcatatgaactgtgcattggtttgctgcaggcatgcatgcagggttcggttttagaactactgtattttggattttgcaagttcagctttggctggcactaaaaacattggcatgatgcagtttttggttttacgatcatgctacttattcagaggtctgtgctaacctccctgttgatgttgatacggattttgcatgttcagatttgactttgttttttaaaaaaaaagaaaatccaaaaaatatcattgataaacgtcttattccaataaatgataagtacgagtttaatgaaatgttatcgtataaacgacttcatcctagaaatgtcatcagcgttagggttcggttagcagttttccgttaattgttataggatgaacggaaccctaatgacgacgatattttgggggtaaaatcgcttgtatgatggcattttatgtaactcgcattcgtcgatgacatttcttcgacttggatgtttgtccatggtatttcttggattttggggtgaaaacgagccgcacaatcggatcatggtattcatatatcctaactcatattttccttcaaattcagaattggttataggtagtatcgggtaaaatttcactcatcccatattatttcctccgaattggattcggaaacggatactatctatttgtatctctaattgataaatatttaatataagaagacgagatatatcaaggagcaaattgtacaatattatacgtgaactcgcaaaatagttactaaccaatatttcatcatgtttataggtgaatttataatagaattttatacaaatttcataatatgggatatatgggaagatacaactcttcctatatcctaacccatattattttacgaattcagatacaacactaagataatatcgagcatcccattttgtctcccatattcttcctgcaagtctcgggtcaggccagcggtcaggaaatactcgcgccgttttcatccctacttggattttctatttttcaaaaaccccgacatgttcagatttaaatttttctttacaattacacggaagatgcacacacacgcacatacaaacagacgtaacaccatatatatactttgatgcccgtattttgatttctgcatgctttggtttgggtgctgcttaagtgtctatgtttcacgtactgctacagataagctgggatccccaaaattggatcagtcctggagcttggagtctcatctgaagattttctgtagccatattcttgtcaagcacatatgaatgactggccatatgattgagacaaagaaaaatattgtttgacacaattcgtatcatagcaagcaaacacactacacgcattcctagcacatcgatttggcgggaatggattctaaaatctcgaaggagtgtagtgttatctcttaaatttaatttaaattgttatgaaaaaatctaaaataatttgacaatgtagagtagtacttcctccgtttcgtaacgtaagactttctagcattgcccacgcattattaaacggatggagtaataactatcattccactaaaaataaactttaaactcaatctacacatttagaagtaaaaaagacaaatttgaactatatttgttcatacgttattttttttatttttaatttcttgaggtgtgagttgagtttaggcctaaggttttgtggagtggtgtatatatattgaataaatgttgtcaaatattttgagattttctttataactatttgcatggtgtttgagcaaacaattagacatttccctcaagagtttaaaagtattttgctgatttgctagtggattaagatgaaactacgctgatctctcgaggatattcccgttaaaaactataaaaaaatcctttaaaaattttgacatttttttttgcaacatgcaatttaagttccaaactcaactcacacattgagaaataaatgaacaactgtatattgaatttgaattgatttttagtggaatgataaatgttgctatatatttttaaaaaatatacatttacaacttttttttttaccggaatgaccgaaggaggtcattcaatgtaattatttacaactatttgcacacaaaggtacacgaggatatatatctgtcgagattagaatccgtttcccaaattaagcaacaatagtgttgaaacacatgatcagtacaaagtttccaatgtgcctcaagctcggagcctacggatacagagtataaaattgtttggttcagttctaaattttcaatgcacaaattggctcgcgtaatcattgtctgaaaaatagcacatgctcctaacaacgcagattacagcacgaaatggctgcaaagattaaatctttatatacaccagatgaccggacacatcaaattgctcgactcttacaaacgtgagaacaatactccgtccacttcatattataatattataagtcgttttgactttttttactagttaaatatttttaagtttgatcaaactgattgaaaataaagtaatattttcaacacaaattaaacataatatcaaaatatattcaatgttacatttagtgaaactaatttagtatggtagatattgctaattttttccataaaacaatcaaatctaaaaaggtttgactaaattcaaaacgatttataatatgaaacggaggaagtaattaagagatcttttttataaacgtgcaaaagctttgcacatcgatatatgggaaactatttcaacagctcgagtggacgtccacccgtttattacatgtcatctaaatggttataaaaaaattaaaaaaatatgagcaagataaatcaatatgtaatatatcaatccacaaacatgcaagttaaaatttaacttctacaagttgtaacaaaaataacaaacaaaactcaaattattatatgtatatttacaattaaatttattgtttttgttacaacttgtagaagttgaatttgaacttgcatgtttttggagtgatatattacatattgatctatcttggtatttttttttttgaaaaatttttcataaccatttagttgacatgcaataaacgagtggacgtccactccagctattagaatccatctccatcgatatatatattaaaagaagattttacaactacgacctacagagtacaacactatggtatatggatgatcatctctttgatcatcagtacaagttcctaatgtgacagtatgacaatctgcaggacctgcagagtacagcattgatgaatccgagttgccgctcatcaagaagccgacgccgcggcttggccggccgccggaatttctccgtacgatgccctctactccgatgagtgatcccgatcaacgtggttgttcctcgcgcgccctcttcctctcggcgtcgcggcggagcctctccgcttgcgctctggcgatgagctcgctcatccgaccggccggagccggagctggagctgcttctctccggctccgggtcagcttctcccccatcttgtaagcttgttcggcgacctgcggcggctgcggctccaatggtttggtggccacagcttcgacgacgacgacggggagatggtttgctgtgtttgggttgctgctcgcggtgtcgccgacgccgccgccgtcggagtcggagtcgctgcctgaagaggaggcggatgtgcttgatgatccggaggcgttgccgctgctcgaaccggtggtggttgagctaggatttcctggcgacttgtcgattgtgtcgccgtcgatgtcgacgaactcgtcggcttctggcttgacgagcggcgacgcgtcgaggagatcctcgtgcgccggtagaggagagtcgccgccaaagatgtcgatgagatcgtcttcttgctctgcggctgcaggtggtgatgataaggcgagaggaggaggcttgcgcgccgccgccggcaggggagagacgccgccgcagatgtccatgtactcatcggcgacctcgccgtcctcgagtccgcggggcgacgtgcggcgaacggcggcctcgtcgtcgagcatcttcctcagctcgaacagcgcggcgtcttccgtggagccgagatcgatctccagctcgtcgtcgtcgccgtcaacgccgggaaccgcgcgccagctgcaccggcgccgcatgaagtcggcgacgtgcgacgggaggatccccgccggcagcgacgacaggaggccgaccagctgctccttctgggccatggtcatggcctccttgtccttgacgcggcgagggagcgggcggcgcgccgccgcccccgccgccgccttgcgcaccagcgcctccgccttcttgaggaggcctcgcaccgcctccatctccgaccggcaccgcttcctgaggagggaaccggagccgccgtggccgcgcggggaggagcggccgatgatctcctccatcgccggggacggtggtggtgacgaagatctcgagagttctcgctcgctctcgcctggtggtggcggagcaagaagccaagaacgtgtggcgggaatgcaggatcgagacaggacaaaagggcgcgcgcgccgatcgttcccgcccttttatggcccgatggctgataccgtctccgagtaagattcgaatcggactctcccaaaaatccgagtaggattggttcggattcggactggacaccaagcctcgcgcgcttgcgtaggatcacaagctagatggcaatgcgagttggcgagttgaagcaaatggatagagtacaaaatgcagaggttgcgttaggagaaatatgcaccatccgctcacaatcttaggcctatgaacaatatccacagtattgagtgtgatcagcgccatgtgcccgggggaatggtccgggcaaccaaggacgagaaaatttcagatgtgacgactgatgaatagcaagcaccacagataagtttattgagcataaattagacggagaagtcctcgcttctatgcaaatgcttgttggatctccattatatgcaatctttatccagctctccaggcagaacaggcacaaaagacagaccatgcaatggtgaagagatggctcaaggccattcatagctaccatggtaagtctagaaccgactagtttcaatatgtaacaccagtgtgatagtacaaaagttccatataacaacagtaactcattgatacatttgagtatacatatccagggaaaaaattgctttatactagtatcgtatctggggattcatgtggaatttgcctatccaaaaaatgttgtgccacactcgttaggccacagctgacaaccctccctatcacaaaagataataaaaatgacaaaggggaaaaatacatcgatgtttctttctttgcctttacagtgtacaatagtttatttcactcgccacgctatataaactctgctgcctccaagttggatggcaaaaagaattgtcctctacactacctgcagaaacaaaagaacatacattttcagaaacttagttctggacagatgaattagataaagtatcacacccacaaggtatctgactatttcatgatttccttccattttaggaacaaaaagctaattctggaacccatatcagactaacttacaggtaaaatttatcaggtcactttggtcttaaaacttatgacccaatacccaaacaatgggagcttcggttttatatcagatattcaggtcacacatttgatgccgctattaatctatgcggagagtctgtctctgcctaattcccgcaaatcaatctagttattctatccaccagtttgtgggcacaagcacgtctctgtttacttgtccataatttcatatcttagcttgtgccatattactagtcactaaagcaaacaagccacatcaaccaaactaaaagttctggttaaagaagccatgcgtacctcaaaaaaatacttcatgttggcaatagtggttgcctctcatcagttccaatcctatggctggcctgaaatgataatgtgcaactaataatgtaattgttctaacacaaattaatctttttttctttagaaataaatgagtcacatacatcttcagcagcgccagcagtcatatttacaaaagaagattcagatgacctgcaacataatatgtatcttatgaggtaatgcagcaagaaatatttggaaattagcacatatctagatgcacagtacatattaaagtcactataaccttgtttgtcatttgttgattagaacgaaggtgaaaaccaaaaaaatatggcaacaagtaccatgatccaaccatttaaaacaaggtagaaacgtaccgatgattctgtgtatcttccaactctaacaattcagctggtttgtcatctttggctttagcgagtggagagaagaactgagaacagatagcagttatgtatatggaagacaaaaaatgtcgtctcaatgaaatttagttaagcaggcaaactcacctggtgcattgaaataaacacaactgatatgcccagtagaaaattaatggtcagggtatgccccaagaaggcagcagaagctagaccagtaaaaattgttgcaacagttgacgaatacttcttcaaaattgtgtctgcaaattgattataacattaacaatttgaagatataaatttatagaataatataggcggaacagcaaatgatagtgtttacacaggaaactaaaaaaaagtacgcacggaatttacctgcatacttgaagaagaatgaagaaagaatgccttgcgcagcattattacatatgagaaacatcgtagcccttgaatgtcctcgaagaatattgaaactctctggccctgcaaatagacaggagatgattatgtcaaagaaatggtgctttgattgtcaaaacattagacaacatggcgttcactaaagattatatgaatatgaccacataagacagttaatggttgtcttattgtagaatctgacgctgattactgataaaaatattgatcatgcatgataacactccaaaaaaaataattgtaccttggaataaggcagtcccaagaatgccaaggaagttgaatattgcaccatatccatataaaaacaaattctgcaaagtatataaaaagaacagtgaagcaaacaaaagacaagaataatgcggataaaaaaaagaatcatcatatgccttatactacaaaatacaatcttggacaactaaacaaaatagctaatacgaaataagtagatagttggatagaagaataaagatcattactcaataaatttccaatactacgtaatttacctgaagatatatactagtatcatattggcttttcaaggcatattcattgtagacagaagccaatgatggaacagttacctacaatgcacagttgcaagagaatataaataattttaaagcatattgtctgttgagagagctgagaaaatgaagtgaaagaaaatggaaatcctaagaggtcaaatggtgtggaagctacttacaaaaatcagtgtgtatatgtacgcaatagcagtgacaggaaggccaaatgcagtattgcccgctggtacagtacgaagttgattgatgctgattccaataagaagtagagcaagagcttcccactgacaaaattaaggggggcaagagagcaggagaaaatcagcatgattgatgatgctagaatgttgcgtaagagctatgcaaaaggcactttgtcatgtaatatacctcagtaacatagtgagttacaagtaatccagattgaagattatggtcatcaacattaaatgataaaacatggcaattctagtaaagtacaagttgaacctagcattgtgatgcagacttatttgaaacataccataagaccagtggaaactgacacaaagacaatagacaaacattcactatcactgctagctttattgagactcagctttactatgcaaaatcacttacaaaattctctcacacttgattttatttaagagtttactaatactcctaaagcatctctatgtacaaagtagccgaatactggcaatatgattctatagaggatatgtaacacaaagcagtgaacacatgacccagtaatctttaaattgcactatagtggtagaagactaacagatggtatatagcacaaaaatttggttatatttacccccaaaatgcaacctatatatataaagtcagaaataactgcaacacaacctcaagcttacctgaattacggagaatctccttttcattataaatttcagaagaacagcaatgaccagcacctagagaaatttggattacaaaaggtatgatatatgcgtatacacactaataagaaaagcacaacacctgagtagtgcataaaatatgtacctttaggttgcttagcattttcacagttgacggattgaagtacagctgcataatcagctcaaaaatgtcagacaacataaaaatatatattcatggatgatgacaatagaggggtatatagaagggcgacaactatggcttcagattcacctgcatgataaattttaggtaattgttgatggcatacagaagggccggaaccgctagtagtgcattattacgggctgcctacatatgaaaatgatggagagtcagatgatcagacaatgtcacaaaaagacatgcaacaagcagtattatgttagaacataggtagcggaaacaaattattggtaaagaaaaaaggtatttaaaaatgagtatgtaaaaaagttctactggtggttcatataagtcatgaaagcagaaaacaaatcacctggatgaaggttgaacgtgccagaagtggtttttcgccaaccttttgctttctagactgccacacagaaagcagcatcgagaaggtaaacaagtaagaggtaggatcataatggaaagtatatagaaggcataaaatgtacatctgttgcagcatagcaattgcgaatctgtaggacttcaaattttcaaggaacagtgaacatgctgacaagctaaattgcgcataaagataatgaagtgcaggtagcacatagaatatcaaccgaaactgctttcacatcttgaaaggctgttgttgtgatctttagttctgcattagttgagcttatcaatttggaagattagcacaaatttgctgctccttccattttttttaaatgtgcaatcacttctgatacacgaatgtactataagaaattggacgcagaagaattgtaccagaagaattcagtaggctgctcatgtaagagtacaagtgatctaatgaactaacagagtattttaccaatccaaagccatcaagacaaactataagtgtactctacatatcattttataggggttaaattactcatcatcagaatgcaagcacaccaagaaacatcagcaaaagtacacacctggattattagcatcacgatagcaaagacaacttttgtaacctccgtcaaaaagttaacgctgatgggactgaactgaaacttcccatcaacctttgacatgaacactaggatgggctgcagatacaaagcaaatcattagtacagctctccaggctcaggatgattattaagcataaacaggaattttcgtcagaccatttcaccaaactaccgagtatttgggattggctaaacatgtaacacagacacctagcggttggatacttgaatgaaatatatagctacaaggagggtgaagccacacctggaggccgacaaggatgcagtccccgacgacgagcaggacgttgagcgcgcggaacttggacgatatcttgctgcggtgcttgtcgtacgccctggacacgctccgcgggctcggcaccaccagccgcgaccggcacacgctgcattccaccaccccgttccgctgcatcttccttccccgaccacctctccgcagcacctcacgccgccgccgccgacgacgaggtttgcctccctcccactacccgcgggccgcggcgaccgagtcccgaggatcacggactcacctaagcatacctacggcagcagcagcagcaacaacaccaccaccattccagatctgggggatctggcgtgacgcctcggggaaggcgaggatggggggcgtcggtgcggatctctcagatctggcgcggcgtcggcgtcggcgccgtcccccccacgtgcgcgcggagacccgggggctcggcctgggcgggggcgggggacgggtgcgcggtttagctcggcggcgactccggcgagcgcgcgggggctggatccggcggcggggaagggagggggacgcgtgcgagacgcggtcaccgggatctcggattccggtgtgtgtaggtgaaggcgaaaggtgtgagggggaaggggagaaggggggaaggtgggtgggaggagggagtgcgcgcaaggaaaggaaaggcgggtgtttctgtctatttatatttgctcgaatcacgaattatttgctcggttcgttcaaaatagagcgaaatttcgataaaccccactcattatgaattatgatgcaagttgcatataaaaccacaggtattataaccagcggcacctaacactttaaagttttgaaaaccccccacccttatatatatatatatatactccatccgttcttaaagaaaaaaaaagtaaactctagctgctgtatcagatagttagagtttatctccttttttttcggagggagttgttgtcaagtatttactaaaaattttaaacataaaatatataacgtgtatatgaaacatttagttgttgattgcttgattgaggttgtcggtttaactatttaccattttaaaatatattgttttagatatattgaattcaactgaaatttaaataaagatggtgttttatgaaacatttagaccataaaatatatggttatgagacacaagacaaaatatcagcggttttgcacaaatttgacaataaatatggggttttatgaaatctttaaaaaataataaaatctttcgcatgcatagtatatggctcgcaaggggaacgtctatgccgcttttgtggtttccttcctgaactgcatgagaaaaatgatgatttgtcatttttagattctcatttatcatgaattcatagtgatatgtgagattcttctctgaattcgtaatgtatgggttaggatgacatattctccatttagaagtgctaaatcatcaactagcatcatggagaaaatggtcgattttaagtattttaggtgggctggcatgatgctcaggtattcaatgatttatccgtctttagattgagcatatgtcatataaacggcaaagtatggactgctgacttcaagcattttgggtgggtgagattggacctcgatcccgacacttccgaacgagaaaatgtgcattgtttattgttgaggacagaaataatgtagcactatgtcaagtgaccgtaactagtactgcaaatgtgtgcgtgtatagtgatgaaaataaggtgtgattcaccataagaaaaacatccatccttgaccctcagcctaccatgaccccttctttcccagcaatagctatatgtcatagttgtttcttgcatggacaagctcatcatcaatgtgttcctcttccttctcaagctctatcatggtcctccacttcctccataagttctggcgaggtccttcgcttcctgtcaatgtgttccttttcctcatcacgacaccatcaagctctatcatagtcctcttcctccatggtctaccctcgataggtgagcccacgactgctcgactattatgcttggtcccctattgaatgggttgtccacgccgccacgcaagcctattccgacgagcgtcattatgctgagagccagcccattatgctgagagtgtcactctcacctcctcacctcggtgtgactcagagaccagcccattctgttgtgcctacgtgcaggtggatgggaagctcttcatcatcgacgaaggcatcttcgagatgcttcgtgagccaccaccaccgcgagataatggacctgctgtaggcgtcaaggtcaagttcgactggtcatggtgcacgcttccatcgccaccattccacaatgtgatctctcatggcgtgcaccctgaccaacggaccatggtcttcagcatgacgaagtattccatgaagaagcgcaccggccttcttgccaccttctcctttgacttggagagctcccggtggacgcagcatggtgcatgggcgttgccgttcaaaggtcgtggctactatgaccatgacctggatgcttaggttgggttgtcctgtgatccggacacccttggccacatctgtgcctgttatgttttatcagctgacaacgatgatgggcagcccccagcttgtaagctcagtaaggagaggctgttttgcgtggacaccgcggagaaacacattggcgcaacccttgtgcatatgggtggtgacaggagtatggtctgcctcgtgcagtatctatcgattgacaatcaccaaggggacatttggaaggagttcctgcctcaacgcattcgttatctgcttcggataactactttctctcccaagtatgacaagcacgaagatctgcgaattgcaaaatgccaccacattggatcctatcaactgcctgaaattgcaacggtttacgatgatcatctaaagagtcctatggcgttttggatgtatgccgtaatatagctaccactttatcatgtggttgcatgggtgtgatctttctaacttgatattacaaaatgaattctacaattatcttgctcctgtgttgtccgattgacagattgtcactaaccaacaagttccatgagcagcttaggaagcaaaaggtagctaaattgtaggtggaagtcaataaaaggcttcaatctcaaagggagcgttctctgcctgtgatctcaaagataatatctcccttcgtgcttggtatacatacttggtgtacatgctcatttatttgatttgatagagtaagggcatgtttggattgccacctaaagttggcacaacggaacctgaggccaccacagttatattagtaagggcctgccaaagttagacaattatgagtaaaagggagttttttttttgttaatttacatgtgtaattttctgctagacaaccttttgcactgaattattagttctacttgtatgctatctttcatgtacttgaatcttctacttcttttagaacgtgtgattgcaaaggcttttttcagccttgtgggattgtggatctatcattttcacaatggaataattccaaatgatgtggcattttgctatttcggtctatccactttagatacttcatgcgtagaatctggaattagtgctaggttttatctaattttttagggctttggaatctgaacatcagtgagccactccataagaaaatctaatggaaaaagatatatattctttgttagcttagcaacactatctttcagtaaatccccccttgtaggaaatgtaaagtcgcttggatgtgctatacatgttactacatcattcttaatctagcctaaaacttagtggctcatgagtactgaataatgtggtgtcctttttgtcttgcttaacactatcaagattttattatgtcaaccatgtccactgcaactgttactgaattagtgactggagaccaatgaaatagtttctgtttgcatcgaaggatgaatataatgtagttatccattcagttttcttcagccattgttacagctgttagatcatgtttgggcatgcatctaactgtaacttcctgatgcaggggcaccaattccaatatctgcagatgataaggctgaacagatgactggttatgttagtattggcctgttgagtacccataatgtggtctgatgtcctcaatcctactcggcaggcatcatgatgacgtagtcatactcaagtctatgaatccagacgggtttgatacacagttgattaaagaaggtgccaacatccatttggaggcccttcttttgatgcccacatctatcttattgttaatttcatcaaatccttgccttaatagcattacctgataactgtggctgtaagcaagtttggaaaaattgtagcgatgaacaaacatggtatatttgaaattttgaacagtgacttcatgaaagtattttctgtgtccattgttttgaaacattgtgcactatttgttgcaatataatgtaataatctgattttttttaactgaaaccggtgtaatttgactttgaaacggtatgctttgtagaaagatctcatttccatcatatcacagtttccctgccaaaatgcctatgagcagtcactatcttaacaaatgcagatttttgtgctgattctatggtgaaaaccgatcatagcatgttgacatgtgtccggcctgttaggtttgcatctgatgctctgaaatcgaaaccgtgcataacatgaaatattctatcatagattattctattgtcttttcctgatgtgtcccattgttgccgagctggtgagaagcacgtaactagtacaaatgaggatgaatgaagagctgagatgcacacaatgacacaaccctatgaacgtgcacagaataagttatatctttagttgagctaactgaatacatgcagaatgtacaggcactcacaaatttagttgttgactgaaagcatgtacagagctacatcaaaacaaagcattggaagagaagatagaagtaacccaattaatacgggaatccttaagccagaataatcgaaagaaataatacaattccaattaagtgcaggccggatctggtaacgtaaggtctcaggacacatgattcgcactttaatacagccattcgccacgatacctaaagtgggctttgtttgtatcaaatcaagtactcctagaaactagcaaacaatatccaccatgcagtaatatcacaacctgtatagctgttgatcatgagagcatatcacaccaccaattgtaactagaacagtatactcaaagattagtagccaaactacaggctgcatagttttgcagatgtacaaaaaccaacaataagtacaaggtagttcgcaaatacagaccagtaacagaagaaataaatatcatagttaaaagaggctgtatcaggacaagcaaacaagtttgccattaatcctttttaatccgaacctttaagtaaagaggaccctactgctaagcaaaaaatgactaccaaaataattagcctagcgtcaaagcaattttctgtaactgtatttctatgtacatatcactgtaaacgaatgatgttctctttgaaccgtacaatcattcttaattagcccagtgtcaaagcaattttctgtaatttctatgtacatatctatgtaaacaaataatgttatctttaaaccgtacaatcattctttctacagagttaagttgacaaaaggtagtacgcaaaatccgagcgtggtggcaattactcaattgaaccattgtttatcagcttcattccttcatcaaaatatgctacccagaactgactatttgggtagctccatcatcaattgaactatgagccccaagagaattgtgcccaacatgtgttccatctgtttgtgcacaaaaaaacaccacagttttacctcttggacatgcgtagagtgatcctttatcatatggtgaaagtagtttctgtaaagatataaaacccttcagcagaatcttcatagttggtcatgcggtttttgaaggtgaaaactgttggtatttcttaacgtttcaaataaattcgcaagcgcatggaagataccgatgtggcacttcacccgggagtatttttagttatcgatttccacaaggaatgtgtattactttcttatcatgttcatctaaggacacaaagctaaagttagccaataatagagacgattttctagtgagaaacagtgtccaaggaaagcttaattttaatcctagcgcaatacttcaggcactggcaactgggccatacccncgttgttcccaaatgtcgctctactacgtacccgaacaggaaggacttaagtgctcttgagggctgttaccacctacgcattgtgggatacacaacaattactagatataaattacctaaacaccatatgtaagcaattaatatctactctagtgtttataactcactaaagcaattattataatttagttgattatagtgaacaataatctcgtatgctgattaggaactaacccatagataattcttgcaagtaaatttaaattactcaggaagatatttctattgaaaatagagtaattaacagaataaaagaaataggagaggattaccgagaactccggaattcctccaagttcttctactctactctctttctaattttagtatacaaagtagtacaatagagcctcttataattcagctcaagcttggagtgtgtgtgaatgagggagaggagagggatatttatagtgtggaggtgacttgagagagtggagatgctaaggaatattctccatagaatccaaatagcatattcatccttctcttgccaagtgtctcttttgatgaccgtttccaccggtattaacggccacaaccgtcataggatgagaagtacaactatcatgccgaagttgggctggattgggccagctgggggttcggtccaactgtggccggctcccctggcccatatccttcttcagaatgctaacatgtgggccccactttatggtacaccatgttttggctcaaaatgattgcacattttatatgctgtagctcaaaaccttgtgggtccatcagcacaaaatatatttgtattcttcatgctcattctttcccatctttggtagttgattacctgcatacgaatatacaccaacatttgtggaaatggttagaaataaatcctatcactatattggatgttttacttttatggttttatgcaggtattgacggcgagaattttgtatttaacagccgtcaacaaaaactcccttgacatgcttgttgcaataggcgtaaggtttccagcaaccatttccatacagcgaagccaaagcagagatgatgcgctgatacttcacggcatctgttaccattagagcttcaagttcagtgaatattatgtggaatatagtagaaatcttgttatcttcattcatcaaccccgggtgatgagcaattaatacctagtcactagcatgatagtctttaagaaggtccaatagcaatttgacatcatttgggaggtcagcttcacatttgattccaaggatgtcttgcttgataattagcctcaatcttttaaaatccttccttttgttcttcatagttgctttcttaagcagcactctttgtgactaaacacttaattctgttgatggatcgacacagagatcagaggcctgaaattttccactaagagaatagccagcactatgaagctgaagtgcccattttattgtagcatctgactttattcttgattcctcaggaagaactttctggacctttgaaacaatcagattttgtccagacacccttttcttttgggatagataccctggcacttggacatagataactgttggtgttgaagttgggtggattgggttgcaatcattagctttttcaccacaagcgaataatgatgaaatttcattttaagaccaagctgaaatgattgnnnnnnnnnnnnnnnnnnnnnnnnnnnnnnnnn

SEQ ID NO: 36663 - DNA, 404 bp, Oryza sativa
tcctcctgggcacgaggcgcggacgcagcggcttcgccatgacggtggtgaactcgagcttctcggcgaactccacctcgtcgccggccacctccttccactcgaactccatcaccatggatcccacgaagtactcgaggtgcatcacgccgacgttgagccccgcgcagatcctccgcccggcgccgaacggcatcatccggatctccctgctgcccgtcacgtcgaccccgtcgccgtcgccgccggcgaggaagcgctccgggatgaactccattggcttctcccattctctctcgtctcttccgatctctgccaccatgaagttcaccgtggcgcccttggggatgaggtacccgccgacatctatgtcctccgccgccttgtgcggcagcagggtgtgg

SEQ ID NO: 36664 - DNA, 2005 bp, Oryza sativa
tatttgaatctgttcgcacatttttttaagctcgatctactgatctacactcttgtataagtaagatttaccttccttaactctgttaccagacgttttatacttatgaactcttaaaccagatgtgctaagcacgtattaccattctataccaattttcatttcatcatatcagtatttgattgatcctttcaagcttcctcgccaagtcaatcgagatcatgactgtgatacgatcaagtaaataaagtagtataaaacgattcatacgacgatttttcaagcgtaaactaacagttaaacacccctataaaacaggcgccccgaagtagccagcacagtacgaggtggccgtcgtcgagcacctcgatcgctcgcgccatggacgcctggcagctgttcgtccccgcgatcgccatcctcatccccttgctccggctcatcctcttccgccgcggcgacgacgggagacgcggccgcctcccgccgggtcctccggccgtgccgttgctcgggagcacggtgtggctgaccaactcgttgtacgacgccgagcccgtcgtcaagcgcctgatgtcgcggcacggccccgtcgtctcccttcgcttcggctcccagctgctcgtcttcgtcgccgaccgccgcctcgcgcacgcggcgctcgtcgagagcggggcctccctggccgatcgccccagccaggccgcctcggccaggctcgtcggcgagggcgataccatgatctcgcgcgcgagctacgggcccgtgtggcgcctcctgcggcgcaacctcgtcgccgatacgctgcacccgtcgcgcgcccacctgttcgcgccggtgcgcgcgcgggtgcgccgcctgctcgtggacaggctgcgggaggagcaccggtgaggcggaagcggcgccactcgccgtcgtagagacgtttcagtacgccatgttctgcctcctggtgctcatgtgcttcggcgagcggctcgacggggacgcggtgcgcgcgatcgccgtcgcgcagcgggacgcgctcctctacctgtcgagcaagatgcccgtcttcgccttcttcccggcggtcaccaagcacctcttccgcgggcgcctccagaaggcgcacgccctccgccggcggcagacggagctgttcgtgccgctgatcaacgcgcggcgggagtacaagaaacggcagggcggcgccaacggcgagccgaagaaggagaccacgttcgagcactcgtacgtcgacaccctcctcgacatcaagctccccgacgacggcaaccgcccgctcaccgacgacgagatggtcaacctctgctccgagttcctcaacgccggcaccgacacgacgtccaccgcgctgcagtggatcatggccgagctggtcaagaacccatccatccagtcaaagctccacgacgagatcatggccaagaccggcggcggcggcggcggcggccagcgcgaggtctccgaggaggacatccacgacatgccgtacctgaaggcggtggggctcgagggcctccggaagcacccaccggggcacatggtgctccctcacagggcggcggaggacatggagatcggcgggtacctcatccccaagggcaccacggtgaacttcatggtggcggagatgggaagggacgagaaagaatgggagaagccaatggagttcatgccggagcggttcctcgccggcggagacggcgagggggtcgacgtcacaggcagcagggagatccggatgatgccgttcggcgttgggcggaggatttgcgccgggctcggcgtcgccatgctacatgtcgagtacttcgtggcgaacatggtgagcgagttcgagtggaaggaggtcgccggcgacgaggtggacttcgccgagaagatcgagttcacaaccgtcatggcgaagccgctgcgcgctcgtctcgtgcccagaagggcctagatcaccatgtatgtatgcgttagggtcaccgtttcagtagcttagctcaat

SEQ ID NO: 36665 - DNA, 182 bp, Oryza sativa
tcatattgcacgaggattacggcgaaaataacaccacactgaacttacaatattaaccctctctatgtgacgcggtttttcccggttctagggactatccaccaatgacagtcgcagctatcctcgttaccatttgttcgcctcctctcccactggcatggtgggagttgatttgggagggg

SEQ ID NO: 36666 - DNA, 225 bp, Oryza sativa
acatttcgaaacggagggagtacgttgtgagttttttggtcagtcagattaccttgatgatcctggcatcgtctactctgcagcgttggtgtgtaaaataatgaatggtggaaactggaaagtaactcctctggcattgccggccatctgcacggcgcccccgtgtctcctgctacgcaaacgatcggcccgtgcgagccttaaccgtaactaaatgggccgttt

SEQ ID NO: 36667 - DNA, 406 bp, Oryza sativa
cacgccgccgccgccaccgccgccgtccgttcggttgaaggcgttgttcgccgccgccggctgctgcggcctctgctccatcatctccttcataatgtcctctggctttaaatcgcagcgttacgcaatcagcattggatcaccaaaaacgaacagcagcgtaccacatgtgtacgcgccaattcgctacggccacacggggaaatgcacacggatggatgcacgtagcttagcttaccttcttcgccgccgcgccggtgaagaacttgttgccggcgacgacgctgccgttgctcgcctgcatttgcatgcccccggagccgcctcctcctccttcgccgttcgcgccgtttgtactgctggtgccgttgccgttcttggtcgtcgtcacgggctgtggcggcgg

SEQ ID NO: 36668 - DNA, 623 bp, Oryza sativa
catctagcacactcgtatgcgagcttaattcgagcctgccagcttcacttcgccaacaacactcgagcattgcaatctgcaagcttccagcagcaagcagcctagttagctcacagactcatctcagtatcacaccccatgatttcttagatgcatatgcatgcattcaaggacaaatcaaagcattctgctaataagctcgctaacgcggccacaaaatccgtcgctgacagatcatcagaagcaaccaaaaacccacattaatcgcggcgactccgctcagatcgatcgatcgatcgctgcgcccaccgtgatggccaccacaccagccgtcgtcgtctcctagctccacacctcccccttgaccaccgccaccgccaccggccggccgggccatgcacggcgaccggccggatcgaccaagccgacgccaccaaccaaatccatcccggtcatatctctgtcgcctcctcggacccccaagctccatcacatggtggttgtcattactgtcactcgatgaaaccccatccattgctgcggacacttatataagaataaaaaaaattttggatgcacttaatagtttagtgagaagggacgtgtggtttcaacccagaggt

SEQ ID NO: 36669 - DNA, 272 bp, Oryza sativa
tccggatcgggtggaggcctctccatcttcgtggcggatcggcacctggcgcacgcggcgctcatgccgccggcgccacgctggccgaccggccgcagacggccaccagcatgctcctcggcgtcagcgagaatcatcacccgctccaactacggcgccatgtggcggctgctccgccgcaacctcgtgtcgcagacgctgcagcagtcgcgcgtcgaccagttcacgccggcgcgcgtctgggcgcgccgcgtcctcatggagaagctgcg

SEQ ID NO: 36670 - DNA, 514 bp, Oryza sativa
aatcatgtcgacataagacaaaattttgatgacaacacgttgggggtgcactgtgccattgttgttctttgtattgttccttgcttcccagatgtgccaaaaggtgacagccaaaagggtgtttgcatggctggatccccgtttcaggaaatcaaagatccattgcctcatggttgagaacccatttcttcctagtttgacagcgcacttacccttgatttcctcccagatttgagcagcaaaggggcagaacaggaagacatgttccactgtgtcatctctgttgcaaaaaacacagccatcagtagaggggatatgccgtcgtcgaagttgaaacccagtcgctaagcattcatgagcagcacgccagagagtaattttcatctttcccggcgcattgatttccacaagcccttccaatccttttggctttcaagcagtctcgacgccattcctcgcccactgttgctctgatcagcaaagaaagcttctgatcgcgccagaatgtaagccg

SEQ ID NO: 36671 - DNA, 401 bp, Oryza sativa
catgcatgtgtggcccacgtatgagcgtgcgcacgtggcgatgcggttgggggtacgtacaagggacggtcgggtgtattcatttttcttttcaagcacacgacacggggcgacgtctaagcggccgggttgtggggggtgtggagttaaatgatgcaaagatcgtgtcgtggattgcgtggtccggccggcgtcaatgccactgccgcgcgcgccaatgcattctcgccgtcgtccatcaatgcgtcctcttgcccgcgcccgcgcgtgctactgctacctttgcttttttttttaagaaaatgactgctaccttagctagctgcagttacacacttacactctactccacactactacgagcaagtttaacagtatacccaactattaactccaaatca

SEQ ID NO: 36672 - DNA, 2104 bp, Oryza sativa
taagtagcaacatttttagaatgaatatagtagtttcgcttgtggttgcactgatccgctgtaaattttcttgtggttgcatgatccgcagctcgattgtaatcccagggatgatcgatcattgccaaacattaagttttggaactttttaattgatttaaggtggctttcttttgtaggagagaggttttatttataaaagcatttcttttttatttttaaagttttgtacggtttatcggtaggcatatgtagctccgatcataaagccatacgtacgcacgtacatttctcaaccgtcgatagatgcaagtgttactagcttactaacactggtggagaaaccctttgtagtcccggtttgtaacccccctttagtcccggtttccaaaccgggagtaccaatccgggactaaagatcgctatctttagtcccgggtgaaataaccgggagtaaagatcgatctttagtcccggttggtaacaccacccgggactaaagatcgagctgaccttttttttttgcatgcccctgttgctgcatggtttatatatatatatatatatatataatccatgcatatatatgtttcaatacatatatatgcatacatatatatatgtatatatatatattatattatattatatgtatatacattcataatatatatgtatttatacatatatatatatgttatgcaaatgcatatgtatatagatatatatatgaacaaaatatatttacattatagaaaatgtgtacacatgcatatagaaacatatgtagtcatgtattaattataatccattatatgtcctagctagctacgatttcgacgtagtagtactcgctgctagctcagaagctaaggaccggtgaattgtgttttcgtcgtagtagaattcacccttgggatcaaggatttcttcgttgatgaatcccatgagttgttcttgaaccgccgcgataaattccttgtgtgtggtcaggttatccctcatgcgaataaactatatgagtgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaaggatttcttaattaacaaaggaacttatgaccgtacctgtctataagttcgaaaaccttgtcaaacgtagactctttttatccattgagtcatatacgttgacggtgcaggcctccatgtcgatgagtaaaagcacccagtggaatctgcaatgtacgtgggatgcattacatatgaaacacttagcaagttcgtacgggaatgaaatttggtatgtatgaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatggtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccatgatccccgctccgatcatctctctaccggtggcgttcatctccatgtacagctgatgga

SEQ ID NO: 36673 - DNA, 181 bp, Oryza sativa
tgaggcgcagctgctacggtttcctgacgggctcccattcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctct

SEQ ID NO: 36674 - DNA, 366 bp, Oryza sativa
actttaggcaggataagaaagtggttctttaatcagcaaaattatgatgctccaagatacacacagctactgatagtctttcaggacaggcaaaacctcgaaacgaacacgacgcaacccataagccctagcttctcgttcttcttcttcttcccagggcagcggcgtcgggcgcctcgtcctcctctcctcccaaagctcagaacccgagcttggtgcggcgccagtgcctgcgcttcgcgttgtacctgaaggacaccagcagctcagggatcggatcggaaactggtgtctctcccttccatagacggatcggattcaagccggcgacggcggaggtaacctgatggtgttgtcggtgcgcat

SEQ ID NO: 36675 - DNA, 751 bp, Oryza sativa
  unsure (1)..(751): unsure at all n locations
nnnnnnnnnnnnnnnnnnnnnnnnnnnnnnnnnnnnnnnnnnnnnnnnnnnnnnnatttattttggttgatggcatttaactgacaaatacatgatttctaggaaaatattatgcactctgcttgttctattaagaataaatattattttcttttatgagcaaagtaatttcaatctgaacttgaaactgtagttatcctggtttgcgcgtggcatacattgacgaagttgaagagagagacggtgaaaaggtgcagaaggtcttctattcagttttggtaaaagctcttgacaatcatgatcaggtaatcatttccacaaagttgaattaccttgatggcattttgatatgatgtacatctcgatagagcttatttacttttgtatactgtgaaggaaatataccgcataaaattgccaggaccagcaaaattaggtgaaggtaaaccagaaaaccagaatcatgcaattgtctttacacggggtgaagctctccaaacaattgatatgaaccaggtgaattgaacggttgttctaaaaaactgaagagctatgctgccactcaagatatatctaatctgttgcattcttaattatttttaggacaattatttggaggaagctttaaaaatgcggaatttactggaggagtttcacgagaaccatggtgtgcgccaaccaacaattcttggtgtgcgtgagcacattttcactggaaggtctggttggatgctttgcagttgttactgaa

SEQ ID NO: 36676 - DNA, 752 bp, Oryza sativa
ctgtggaaccttcacccaaactaccagctaatctaacagagctacagaaatccaaagtttttcatccatccatgcctcctgcaaatacagcctcagcagaaactttgtctccaaaacatgtaccaggacatcaccagattgaacaaaagaggatcagcttcctatcttccatttcatcactcattccttttcttctgtttcttagagcttccctcgccaggttcttctattccagtctgccagctcctatcctccagccatgctttgagttgtagatgtcatttgctacctgctttagcagatggagaccccattatagatttcttgtatttgccaccgacctctgcaaaattgcccacgaggagatccgagagctgatataatgaattagctcaattgggtgtgataatgattcattcttgaaacaggctttgttcctagtcttcaaaattgcccacaatacagctgcacttctgatcgctatccttctctgtaagtttctgtcatatttatttagccaagcacccagtaaatgatgtgttttacatccttcaggatgtagaggccaggttttatttaatccattatctaaaaaaaagtaaatgatgtgtgtcatggataacccccagatcagaagtgctagctgtatcatattccagggcaggtcaggagtaaattttttcttccccttccaccctcttttcagcaagttatatttggttaagggtaccgagctcgaattcgccctatag

SEQ ID NO: 36677 - DNA, 818 bp, Oryza sativa
  unsure (1)..(818): unsure at all n locations
nnnnnnnnnnnnnnnnnnnnnnnnnnnnnnnnnnnnnnnnnnnnnnnnnnnnnnnnatagtctactcacggtgatagtattacattactagtctacaccatagatgatatatttaaatggagatcaagatcactcacctcaccgaaatccgaattcccaaacaggggatgagtcatccattccaggggaagcaaacatcaattgctaatttgcaatcaatacagaaccggtaactaactaatgcacctttcagcttgtccaggacatctccaaggcttttgacttggtcagatgggactacctacttgcgctcctccaaaatagaggttgcccgtaaaaatgacgcgaatggataaccggattgctgtccacttccacctcaaagatcaccctgaacggaatccgggtcgaaacaatcagacacgggaagggtttgcgacagggtgaccccctatcccccctcctcttcatcttagctatagaccccctccagcgccttttagacaaggttaccgacatatgagttctaagtaagctgcggggcaaagttgtgcgcttctgcacatttatgaatgctgatgatgcggccgtcttcattaatccgatcaaagaggatgtgagcgccttcgccgatctgctaagtcgttttggaaaggtatcaagattatgcacgaacctacaaaaattgcaagtggcgccgatcatatgtgataacataacctgaccttgatgacattctacatggcaagcctacaactagggcaagcttccagatgaagtatctggggtggcctctgtccactggtcgtctgcgcaaa

SEQ ID NO: 36678 - DNA, 568 bp, Oryza sativa
agaaaaaaaatagcacgctacaacaggcctcaggtgcagaccaatggctgctcgacctggacctgccgcagcctcaggctggacaacggagctggtcagttagctaatcaatgtctagagtgcggtgcacaatgtgcaattcacagagaacgaagaggacaagataatgtggaagctcactagccacggtgaatttactgtgacatcggcctacaaggcgcagctcctaagtactacagccaccaacttcaacatcctaatatggaagccgtgggcaccacacaagtgcaagacctttgcctggttgatcatccataatagagtttggacctctgacaaactggcaaccaggggttggcagaacagctctttctgtcccttatgcagacaacacccaagaaacagctctccaccttctcgcagaatgaagatacaccaggaaaatctgggcggcgttatctgaatggactgggtgtggtcaactgaatcctggccaatggcaaccagcttcatcggtgttagagtggtgggaggccaccgctcccttgaacgaagccccaaagaaagc

SEQ ID NO: 36679 - DNA, 677 bp, Oryza sativa
ttttccctctcgaaatggtggcgtgtgctgccgtgccggtcagttgtcccgtgacacctggcgcctgacgtcccgccgcagcggttgggtggcgaggttgtaggatcgaatcatattaagtaagccaattagaaggggtgaatagttgatatactcaaaaacccaaacttttagcggaaataaaagttaccctcaaatttgatgtagatcggtctgaccgaggttgatccgccggtctgaccgagctcatgtcgccggtctgaccggtgttgatccgagctcatgtcgccggtctgaccgcctgaagattgcctgccgcgtgtgaagtcgccgccggtctgaccgcctctcctcagtcggtctgaccgccgcctgtcaccggtctgaccgccggtatgtcgctggttagaccgccgaaacccgatgaaacacaaatcgaagaactctcaaagtagatgacaactttattacttctctctgtgtttacaaagtgcatcaacagcactccttacaaaaatctcgactaaactcaaaaccctaactaaactagcaactcaattgctctcaaaaacgataccgggaagcctcacgctccccctctatttatacatgaggtaggcagcctaaagccacgaaccaagctcatactaagagtcctagacaccttaggaaaccct

SEQ ID NO: 36680 - DNA, 737 bp, Oryza sativa
  unsure (1)..(737): unsure at all n locations
nnnnnnnnnnnnnnnnnnnnnnnnnnnnnnnnnnnnnnnnnnnnnnnnnnnnnnnnnnnnaaaaaggctggctgttattatgatcttagcagctataatagctctgactgattaatgatccgtaaaaacataatgatccaagcagctacgagacgcgtgaaccggttaaagaatgttcggttctttgtcttgttgactggtaatctcagtccaaatatttccggtgcagagaggagagttaattactatagtactaattaatagtagtagtaatagtagattgtttttgcttggaccagctaatataattactatagtactaattaatagtagtagtaatagtagattgtttttgcttggaccagctatatagccgaccaggcatgcatatgcagtgatgcaccgaattaacctgggtgatctattggggaaacgccaagaggaactctctgcattcacagataatacagattgttctaatgctgtacgtgtgccttaattntgttttggcatgtcatgtcttaaaatgcagaggtcgtgtttggtatctttgatacagtctctaattcgcatatttcgtaattttatttcgcatatggtggcctttcatcgtttaccccgtggtttataagctatagcaaaattttaaattttaaaatgtttttgggcttttgtatcgtagtttacccaagaggctgttctgtggaagaaagctgggctcctcccggattagggtg

SEQ ID NO: 36681 - DNA, 400 bp, Oryza sativa
  unsure (1)..(400): unsure at all n locations
nnnnnnnnnnnnnnnnnnnnnnnnnnnnnnnntaaagacttattgtgatcattgtttcctatttatgtttgagtgcaaagtagagaaggtaaggaagctggtatttgtgttatgtgaactgtttgagttagatgcttagtgaaagtctgcagccaaacacaatggatccaaaatgtgatgagctcttttatagaaatcactaatctgtgtcttcattcagtgttccaatagcaacagatacacaaaaaaaaagtccatttgccgtgttacgacaactacagttaatcagttattattctgatccatcaggaaaatgttcaagtgcattctgttttccattgacgtaaaactcaatcactgctttcatgcgttccgacttatcaggatggtaattcaagtg

SEQ ID NO: 36682 - DNA, 893 bp, Oryza sativa
ttttaagagagccccttgtgcttatttccacacctatcagaaaatttttggagctagttcattgccgatgatacagtatgttcatatggagtccatgtttagaataagtttcttcacactctctggttctgaacttggttgatctttttttagtttcacatttatacaaggactaggccaacattatttttcttttgagtcacaatatagaatagtatgttaatactcaacggcaaagcataaacagatccattgtgagaaaaagaaatttatatatgtgttattctttcatgagaaatatacatgttgaattgtggctattttttgttatgtgttggtgaaatgtttggtgcgagttctctggttctagatgtaaaaatcgaaaatcatagtgtggacattttgtatatacttctgtaccaaatgtttggattagaactgtacccaagtaataaaagtgcatctggaagtattatataaaatgctgtttggagctacctatcaagcaattctacatcatggtattctgtgtctatgatcgatgaatccatgcatttaacatgcaatactttttgtttcattttctttcactcatctagaaaaggacatgcatttggaggaggatgaacaacttgcaagagctatccaggaaagtttgaatgttgaatcgcctcctcgtgctcgtgaaaatggcaacgccaatggtggcaatatgtatcaaccactgccatttatgttttcttctggattcaggttcattttcatttttcttactttagtataactagatactttgtagtagatactttatgtggacatgctattttgggttcattgatgttgaagtgccacataactactgatacgagtattcaccataaagcagtataata

SEQ ID NO: 36683 - DNA, 1304 bp, Oryza sativa
  unsure (1)..(1304): unsure at all n locations
nnnnnnnnnnnnnnnnnnnnnnnnnnnnnnnnncaaggaagaaaacccaaaggagctcatcgacaggttcttgaaattctctcaggaactggatcatgctatcttcatcgcccaatcacagaccaaaattaggcatgtaaaagcatgtggttccaattcaacatcctcagcttcaaccaaagctgctttgaaggctgcattggataggaagcagtctgccatcttatggatcagagaagccattgaagcagacctctcacctttttctagccatacaagacccactgaatcaccaaagctatcactggcagagtcaaagcctatgaccccattgttctgttgttccaagccaaagtgcaactgcagcaaaaggtcctcaaggaaagcatctgatggttcctctcaaggaagtaacatgagtgctgccatggacctggctgtagcactgagatcagagtgcaactgttggttcctcaagtacatcgacaagttcttggacgatatcgaaagcgagaccatgtatgcaccatgtgattcccaagttgcaggccttctgcagcagcttaaaagggtggatgactggctcaaccgtgtcgcgctacatgagaggatgctttcggttgaccgaacaaacaaggatatcatgttttctgaagaagaggagagcgatgcgtgcgagagggtacgaaaaaagatttatggagcccttttaaggcatgttcaatatgctgcaatggcgctagaaggtctaaatggtgtaattgatgaagagaaggacgagagaaaataacagttactgtgcaaagagctttatcaatatatagaatgaacaaataaattttgtgtagctgcagataatataagtttaccatcgtcagaattctagctggtagaagcatgttaggcataacttccaaatgctgtctgataaatgttggatgctctgatggtattgttgcaactattgctaatcttgtctgtgatgagacatggcatccaaaaactaacaattgcctcaagtgcgactttaaggccatgaaagatctgaatagtactattggtgaacctaagtaggacattgaaacaaagctgaggatatctggtgcaatttacactctgatcaattacttgctacacttgtcattacatacttgcatacatgctcatgactgcatctcacatttcattacatgttcttcggtacatttcaatttgtgttgatgtactggtgatgtcaattgtcaagtgtactgcctttttcaaagttagggcccctttgaatcaaaagaattatgaaggaattt

SEQ ID NO: 36684 - DNA, 822 bp, Oryza sativa
  unsure (1)..(822): unsure at all n locations
nnnnnnnnnnnnnnnnnnnnnnnnnnnnnnnnnnnnnnnnnnnnnnnnnnnnnnnnnnntcctctaatagagagagtgatatagcacgagcgatatcttcattgtcaaattctgacgggacatcctaaattgaatttgaaaatagatcagctacatagtcaaaagatgtagattcccattctttttaagcactaaataacagatactactacaatggcatataagctcattatatttggaagcaatttgtgtcatcctgaacctagaggcatatgcacaaaaaatcagtggtatagtttttgttaatacttaattcacattgaccaatcaccaaatcacctgaaactcaaccaacaaaaccacataacagtattacagataagaaaaattatgtttatatgacctactaagcaagatagcaatgtgaagcgatgatgtatttttcagcaggggaaattgcatttgtgcacctccaaattcggagattagaatagtacagatttacaccaacagaactggtaatagcgttatgctctgcatacaaaggaagacataaaacacacagaattgttctccctaaccagggtaaaaaatttcttgttttgtacaagagcgtcaagatatagttacattttacactgtaagtggcgtacatacaccatgctgatgagcatgagaagtttgcaagagttgcaattgtgagtacataggtgcaagactggttgggcctgttgcctcaacttacaacaatgtacatcgtcaatgacaagttgacggagatcagtagccaacaatagcaagtcgagttgaccaaatgtggac

SEQ ID NO: 36685 - DNA, 680 bp, Oryza sativa
ctttttgtggcacggcagaagaaggcaggtgacccgctcccccgtaacaccgcggggaagttggggggttaatccatctgtttgcagcttggtaaccgtgtaataaactaataacactgccttaaaaaaacgaaaattttaaaatgggttggagcatccatggttgatagaggagaaaatggtgagaaaacatgtattcgagaggatttgaacttaaggtcaatgcattagatccggtttagatgggattaaaagtaattttaagtctctatcgcatcggatgtttgggcactaattataaatattaaacgtagactattaataaaacccacctataataagtttttggatctaaataccatcttactctaagtagctgtcctatcaccgagctacgcgccggtgcattactccctctaacttgacgctagatctgtttgttcctgtaagcgaatacgaccgtctaattgtgaattagatgaaagtttacaagttatcgaataattatctgaacagatataaataaaatagcgtaactacatatttaaaatcaaaatacccacttcacaagaaaggactagacagcctatacatccttaaagttgtcatttgtttcttttcccttccagaaagtcaaatatgcagttttgcacggaacctattcgcttatatcggattgg

SEQ ID NO: 36686 - DNA, 1048 bp, Oryza sativa
tatgtgtcatgaaagtaaatggaagcaaaattccagaggtgctactggaaataggaaaaaagttgggaagtaactaaatgtagtgaagccaataggtgtattttggtatgccaacttataaatatgcccaagcaatgtgcctttaagtaaaataaatggatgtctttcctggatataacaacaatgaacatttttttttttgctcctgctttctagtatctacattactctatgtcatgtggtttcttttctattagctacactaattgtataaataactgcagaaacgaatttatgttgtccgtgggatgcatgaaagcagtgtttcactttttaagtaagttagtttttttaattgtttgcttttttatccatgaaaaaaaaactcattctcttgtattcaactcaaaaggtatacactattttggatcttgctgctatgctccaagtttgcattcagtaattttgtccaggtaaattttacacttggatattttggaaagatgatttgacaagatggctctgatgctcatactaatttacagataaaacctctgatcaagccaacaaaggacataatgaatgttcataatattcattatgagtggcatgaattctttccaaatggtaatcaatgtttatttttggggagtgttattatgtatttttccaaactgataatagctgttgtcttttcagcatcatataatgttggtgctgtcatgtcgctctgggctcctgtactcttggtatgagcttatccaacttccatattagctgaccacagtgagcagtggggtcttattatttttccggggtcatattattcatttccttttcttttgaactcatgtactaagtcataaatgttcacttgcaatgccttcaattcttgtaggtctatttaatggatacacagatatggtatgccatcttctctacaatatctggtggtgtgtctggagcacttggaagacttggagaagtaataatgaatcttgaacttttacctgtaactagttgttttactttaggaagtcatgaacat

SEQ ID NO: 36687 - DNA, 482 bp, Oryza sativa
gacttagcatatacgcacgaaacacttagcatatacatgactattttagtcttagcatgtaatattatttgagttttaatataagattattttatttgtaattagatttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggagggga

SEQ ID NO: 36688 - DNA, 508 bp, Oryza sativa
  unsure (1)..(508): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcggagtggccgtttcactctacatagcggcgaaacagtgcgctgctacacggtgtagcatctagtactagtagtagaagtaacatgtatggagtctgtacagtggcaggtagcttgcacaggtatgggattgatggagctcgcgaattgtagccggtgatctgtgcaagacaaatcgtcaaatcgcgagttgcgggaccagcgtttctcagaccaccggaccgggattatcgtgtcccgacgataagcggtacccatagtaaccatgacaaatcgtataaaatttatcaaaattttaaattaatttttaaatt

SEQ ID NO: 36689 - DNA, 1456 bp, Oryza sativa
taaagtccgtgctacagctggctatagatatgtagcccactgctcttctctctcatcttttatctcattaaaatatgtttatagctggctaatagtctgctattgtacctgttctaaggttacagacggcttaggcatatgaaccaagaaaatttgtgagacaaacagatgaatcatgaagagctaaccactcggctgagagatatatctcattaaaatatgtttatagctagctaatagtctgctattgtacctgctctaaggttacagccggcttaggcacataaaccaagaaaatttatgagacaaacagatgaatcataaagagctaaccactcggctgagagataggctataaagatctatacattcagcctggttatattatgattcttgctcttacgtgtgctcgatctgtaatagtacactgcacgatcaattgagatccagtgcagtctattatcgcagtcctgcttgcgttgtctataatctccaagtgatcatatagacgctagcatttggctgtttggttcccaacaatattttgctaggcatcatttgtcaataaaaattaccacactttatctaagatgaggcgatcaactttttagacacaatttacaaaggttgagggaatcttgtcatacttttagtcattagcacatgaaacccaatttattataaaggaatcttgccacaactatagttacaaccgaacatctatcaagttgatcaaatttacctaaccttagacataacaaagtgtgacttgaaaccaaatattcctgcttagtcgcttacttctcaatacatataatgtctaaaaagtctaaaataatttatcatcacaaatatatactgctatttctttcaaataactatctatataaacaattaatgtttagaccatatgtccattccccacagcagtttcggttatgtcgattataaactgtaacagtttattagctataaaaaataatttataaataaaataagagttttaataattaataatttatatatatctttattaatttaaaaaaaatacccgaaaaaaactctagtttctctgccaagcaataagagcgttagttctctgttctggtctattgctatggtcttcacgtgttagattcagggtttcccaaaccgtcgaggccagggttaccacgccccggcggtaagcacagttatcgcgcggtaaccgtgaaaaaccgtacgaaaccacgcaaaatttatcaaaaattcaaattattttttaaatttatttgaatttaaggaggttaccctggtatttctattaccgtaccccgcggtaaggccagtaaccacagtaaccgcgcggttaccgacggtttgggaaactctggttagatttcatgctgagtctggctctcatgtactcccttcgtcctgagttcggctgtcatggaaaccatccgttcaaaaaatt

SEQ ID NO: 36690 - DNA, 739 bp, Oryza sativa
caaaagatgaagtgcaggcatcatgtgggacgtagcaaatcgacctgttcaagaagctggtagctacaattaatctaggaacaaatagtagttcaagagactgatagttacaatctaagaacaaatagttagacaggatagctcagttattaagcatttagtacaagaaatatatgaacagaaagccatcagttggccaagagcgattatatgccacacggcttattagcaacgtaaaacttttatacatgtattcttagcaacttaaaagacaatggtaaaaagaaactacgttgaaaataccctaaaatcaacttactttgaaattatgctgtaaatttcggcagctgctaatttgttataggggacaaaatattatagcaggcataagtctattggcggtccatgcttggtatggacaaccaacagggagtccaaatccaacctgaccataggcccatgattatcaatgcgggcaactgggaggcggcgcgaggagctggcaggagaaagtaattaaagatgtgattaaattgtgatcacatgattaaccgccgaataggaatggaatatgaaatcctgaatatggctgaactggcaccttaaagaaataaagcaaggttaacctgaattcccatggcttgcttgatattgacacatcactttggttttgggactcgatgcttctttccatagaaagacatgagcagctggaaaagtggcaacctgaaatccaaag

SEQ ID NO: 36691 - DNA, 1192 bp, Oryza sativa
tcttattcaaacaaatttatgtaattatcatttatttttttgtgacttgatttatcatcaaatgttctttaagcatgacataagtatttttgtatttgcataaaaaaattgaataagacgaatggtcaaccgttggttaaaaagtcaacggtatcatacattaaaatatggagggagtaatatgttaaacattacaaataaagtgtacatggataagtgatagaacattgttagctgttagagctgacatgagggcttccttagtgggacacatgaatattcttggtgtttcatgtgaattgttcagtttcacgaaaatcctcaataaattctctgatgaataatacttctattgaatttgttacttctagccgtcggggttcaaattattgaggattcgtaaatttggaagtgtcacatgtataatccatattatccgcataagctggttagaacagaatttttaattatctttcaactttttaactttttatttttaaaataaactcttccaaattttttttttaaaatgggaaccttttgatcaaccatcccgcctgacgtggacgctgctagcaatgggcgtgccaatcttaactagcgtgaccaaaagaccagatttggttttggagtgtttattttaaacaaaataaaaatttagaaggttcaaaaaaagtttttaaaatcattagagcatcccttaacgatagcttcccaaatcagctctgaaagggatatgtctcatcggatattagattgttatattttggaacgacatagtactcgtaactgattagaacatcccttaacgacaacttcctagatcaagtttgggatcaatttgcttggagctgcagatataaaaaaaaagacttggagtgagagcattactacgaacatttttcaagaagaaattataaacgtgttggaaataaaggggttgtttggatgggagggactttagtccctcacgggactaagggcatgtttggatcagggactaaagttcacatttgatgtttggacactaattagaagtattaaacgtagcctaatgaatctataaccttgctaatttgcgagacgaatctattgagcctaattaatccatgattaacctatgtgatgctacagtaaacatgtgctaattatagattaattaggcttaaaaaaattatctcacgaattagct

SEQ ID NO: 36692 - DNA, 505 bp, Oryza sativa
tttacacaacattagacgctgacgaggaggaggacgatggacgaacacatggcgtgcgtgcgtgcgtaccaggtcgacggagtcgtcgtagatgtcgtcgagggagagggaggacgccatggggggtttattgggaagatgatgaagacgatggtggccggtgcccggcggcggggtgggcggcgcgggcacggagggaggggcggcggcgggcgagctattgcctccctctctcctctcctctcctcctctccttctcagcgtgggtggaggggaagggcggcacgggccggaagacggcgagccaatggcggtcgcacggggcgtcttatagggtcttttccggtttccaccatgggcgtccgagcgagcttcacggggcgcctcagcctgcgcgcacgcaccggcgctcgaccgccgcacgtgtcgcccctcccccacgacgccgcgttgtgaggcccaggattccgcgggaaaatggggagataatccggcttacatgcaa

SEQ ID NO: 36693 - DNA, 376 bp, Oryza sativa
atcttgcacgcgaatgcggtaatcatgaattaccaatcacaaattcacaagcaaaaaataacatataatttttttccatacaatccaacgcaatgcaccaacgccatggacgccatggatgcatggccattaattaccttctcttcttcgtcttccagaggtgcacgacgagagagaagccgccgccgtcgttcatcgccgcctcctccgccgtggcccagtcggccaccgtcgccatgctcccggccgacgacgccgccgacgtcgacgccaccgacaccgccggcgacgagtccgaccccgacctgaacggccccctccttcaccctttcctgtcgctgtcgctgctgcaccagctctcggcggcggcgccgcc

SEQ ID NO: 36694 - DNA, 912 bp, Oryza sativa
  unsure (1)..(912): unsure at all n locations
cagttttttttcgtctgaaaatcactctaatatgcatatatatatatatatatatatatatatatatatgaacttctgcaggtggacaaacctttagatgccaaggcaccgagtgatatttatggcgaaatgccgaagaccgacgatgtgacatggcaggtgcctgagttccagcatcaccatctcaagcatctgtagttcagtggcttcaatgaagaagaaatgcactggaggatagtggagcttgtcaaggagagagctgtgaacctgcagagcattgctctggatgacggatgccaagcctgcgatgttgtggcgaatgaatatgttctctccggtgggatcaaaaacaagaaaccggtgttgttatcagtgtcccagatcacaggatctcctcctattctcacccttgtatagagggtgtatccggtgcgttgtgctcgcaggcgagtatagggttgacgctgactcttttaaatatgttcctaaattattgacatcgttgactttttaaagcatgtttgatcgttcgtcttattaaaaaaattaagtaataattaattcttttcctattatattatgcattgtcacagatctgtttatgtatatacttatatatagagagagttcgtcatacgtctcaaaagtttttaactaaaacgaacggtcaaacatgtttacaatgaatcaccagtgtccaatatttaagagtggaatggagtcagatacagtcactcaccgcataagcatcacaatgttaggatgccttcacgggccgtatatttaaaatgcaaggcatggccaccttcggattacaattcgctgacgcgtctccaactacaggctcagatttgaaannnnnnnnnnnnnnnnnnnnnnnnnnnnnnnnnnnnnnnnnnnnnnnnnnnnnnn

SEQ ID NO: 36695 - DNA, 534 bp, Oryza sativa
aacaggcgcttttcactctcaaagcgcttcgctgaggtcccaaataatagtaacaacattttttttcatgatggatcttctaaaccctcaaatatttatactacaaaattgattgcacaggtttctcccagcaagagaactgaggctgctaagtttgctcagttgtggaatgaagtgatatgtagtttccgggaagaagatcttataagtgataagtgaggcccctggctcatgtttaggaggaaacatgttatcatttgctcatagcaatgcgtttaatgaacttctgctattcagggaaatggacttactggtggttccttattcgtcagaccccagtcttaaactgatgcagtggccactcttcttgcttgctagcaaggtttggcagaataaaattaaagcttctcttttctcctccttacgttctgtgttcaattgcatgatcgcaatttattttgtgggaaactctgcagatacctatagctttagacatggcagcacaatttcgaccaagagattccgatctttgga

SEQ ID NO: 36696 - DNA, 641 bp, Oryza sativa
tcggtacccgtgatgaatatggtaccgcctcaaacatcaagagtagagtcaatcgtcagtctgttttggctgccattacctcagctcagcagaggctgaagctctataacaaagttcctccaaatggattggttctctacactggaaccattgttactgaagatgggaaggaaaagaaggttaccattgattttgaacccttcaagcctatcaatgtatcactgtatctttgtgataacaagttccacactgaagctttgaatgagctcttggaatctgatgacaagtttgggttcattgttatggatggtaatggtactctttttggcacactaagtggcaacacacgtgaggtgcttcacaaattcactgttgatctcccaaagaagcatggtagaggaggacaatctgctttgcgttttgctcgtcttcggatggagaaacgccataattatgtccggaaacagcttgagcttgctactcagttcttcattaatcctgctacaagtcagcgtaatgtttcaggcctaatcctcgctggttctgctgattttaagacagaattgagtcagtctgacatgtttgatcatcgactaaaaacaaagatccttaatgtggttgatgtttctggggatcctcta

SEQ ID NO: 36697 - DNA, 651 bp, Oryza sativa
gcatgggactggatatgtcaaaaagggagtggattcattatagacctggagcacagttaagaaattacctgtcggcttgttcccctttgtcgagggcacgaacgtagttctcgtagtactgctggtagaagctctcaatttcgcgggcatcggtcttcttcacgcgtttcgcgagactgggactgttatcctgcgggttgcataagattccaagtgaagatttatagcaatggaccaaacattagacttaaaagttgttgcacgactaagctttgtggcaacttatgactgccaaccaaacaagccctgaactcaaataatttgggtggaaatcaagataatgaatacatgatcagtgcaaatggaaaataataccatgtgaaattgatgtatcgactcaaaatcatgatcgacaatatatcagattttttttttttaaaaaaaaaagagggtactccaaacggttcgtcgcattactgaaaaaggattacaagcataataaataaaatttggtcatgctcaattaccagaagttaattagaacataaaacatctcatctgaaacaaaagaaaaaacagcatcacacgtcattctggttctggaaaattgtgctttgtgtagcaggttgttcaatgaattcattttgcatg

SEQ ID NO: 36698 - DNA, 863 bp, Oryza sativa
tcatttcatcaaatatcagtgcatttatgttgaacactatccttgttggatgaaagaaatattcttacttctctgaaatctgatacgtgtgccaacagtcatgattcccaagaatagctgctttggggagctgaagatctgaaatgcttttaacaagttgaacattctcgttgccataatcacctgccataaatggaggacagcaaacaggagatgtaaggaataagcatttaagtgtaacttcacaaagtaacgagtatattatgtagtacagatataatagggcaaagggcgcacctgtaaaaagtaccaaatctggctgcattcacacggagagaaagttagatcttctgggaataagaaacataatgttatagaaaataaatgtagtacggatatttttctatcaaactccagtgtcattttggcagctggactgtacatcagtacatgttgatggcaggcatacaaaaaggcgtagaacatgaataaagaaaaggacagactgcacttcagatgatcttacatcataaaactagagacatgctacaataatcagatgtgaataacttaatgcaatacacagatacaattgactgaatttatctggatttgcaatacctggagaaaatgtagggcttttgagtcttcctcaagggtccaatcattatgctgcaatgttcagcacatcacaacagccaattagtgcattgttctcatcaagaggatattataatcccttgagccataattgatgttataaccaagtcaagcatgcaaataaagtaaaagccatcatattcctcttagtacaagaagtaaagcacatctcgacaggaaagcgagctaagagatttcaaacc

SEQ ID NO: 36699 - DNA, 32072 bp, Oryza sativa
  unsure (1)..(32072): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaattaggaactaaccaagaataattctcacgaagtaaatcttaattactcagaatgatatttctattaaagcagaataattaacaaagtacaagaaatagaagaggattaccgaaaactccgaaattcctctgacttcttctattttactatctccctaatttagtatacaatatagtacaatgagcctcttatatttcagctcaagcttggagtgtgtgtgagtgaagtgagaatgggagctctatttatagtcaggtaatggcggttataactatgtgaattgtcggaattgcccggcaaccgccatcaagagagcatctggagcgtccataccaaaacctggatccaatggtgatcaccagggctgaacctggattgggccagatggctcctagatttggtctgggcctctttctcactctgccttatccatttctcctgtagttgggcccattttctgatgttttgatggagtttaagagcccaactcttgtatggatagaattcttattcactttagtctaaatttcctcccaactttagtggtttagtacctgcatccaaatatgcaccaacactcgtggaatatgtcagaattaagccctaccactatgttggatgtatcattatctaagtattatgcaggtattggcggcataaaactagcatttaatagctgccaagacagagcaaccgctgtccaccacaccatgttgccgccaaatccgcaccctcccacgcgcgcccgcacgtccaagcgtgtggaaccgggtcccctccacgtactttgccattttccccactctcgccgcggagataggcgccggtttgcctcgacacgcctcacgtcgccgcccccactttaccggtgacttccgcctcttccagcctcgtatcgcacccctgagccctataaaaaccctccccagacctccctcctcctttttccccacttgcctaagctcctcgcgctctctctctcgtgctccccacgctgctcgccgcctccgccactcaccggagctctctggctatgcgtcaccgctagctccgccatcccgagtagaaccacggctgccactccaattccgcaaatcgcaactgggtcatcctcttccccatgctaccgaggccgccgccgcattcgccacttctggccggcgatagccgtcgaccggtgccaccccaagccatgccgtttcctccactggctctgcagctttaagccgcacctaggccaccacttccccgccatcgggagcagctgaaaccctgcccttatcactaaaggtgagctctacccagtaccgtcaccaccagctgtcgtttctagccgcgccacgctgtttctcctctccctaatccctcctactccttccgcaggtcgagggcgacctcgtccacccttcgtcctcgtgaaccgccgctgccgttcttcgctgccgctaccgttcttcctgccaccttctcgccgtcgcaatggcacggtcagagccatctccccctctcctcttgcccgtcgccctcaacgcgccttctcgcaccgccgccgctcgctgccggagtattccaggccgcgcgcgcgccgctaccatcggttggtcggcattggccacacggtcctctcgctgcgccgcacctgcccgttgctgcccgatcggtcgccctggccgatctgggccgtccacgtggcgagcccgcgtggcaaagccgtgggccacacgtggactctgtccacagtggaccgttgccccttgtgccactgccgcgtggggcccacctttgatggactcggtccacacccgccccactgctgatgcaataacctctgaattcctttaataaaaataattaataattacgcaataaatcgaatttaattctagaaattcatttaaatggctcaaaacttctaaaattcataactaattcatacgaactctaaattgggccattcaacttgcagaatttatctaaaattgagctctacatgtttgtttacttttcatgtactgtttatttggttttattagagtttttcctcattttgcgtgccggcgcgtagattctgcgtttcggaagatcgcctccgcgaggaaaacagttcagaagattgtttgaagaagcaagacaagtcaaacattctccttgagcatgttgaacctaatttacaaatgctttaccgttcgcaaataaaattgcatgttttgctaattacatgggaatagggtttacctatctgctcgcttgtaccatatttacttgatatccgccctttgtcaattttgggtgataatttgactagttcgtgtcacttatgttgatcttgctataatcatgatatgcttcgccatggttaattaccaatatctcacataatgggataattacattaacattagcatcttgatgagctgcaagctcgagatatctggccatggttatttggtcataattatccaactaaaatatggcttaatggtgggctatgggtgcatggttttgctagtcacacccaaggaccggtttgcgggaaatccctggaagacttaatgtgcttaccacaagcaagtatgggcaattgctggacttgtaatatagctttcccctttctgatgttcccaggcaagggtgagcgtgatggagttcggaggagccctacgacggtctattaggctatcggatttacctaggcacgaggggaggctccctactatcggtttaggggtgggggcgaaacccgaggtgtagtgctttggttagggggagttatacgaagggtcttgtcacaatcactcaacatggtgacgtgtccggccgggtactgtaacatgccggtggcttgtgtcttatgggtactgttgtgcacctctggccagagtaaaactattcgaatagccgtgcccgcagttatgggcgatcgaccagtttcaccgtgattagtcccactttattaataacctgacataatgaactggtgtagttaaggtggtttggttgggcctgttcaacatagtgtagcgttgttcagtggagatttaatcctgcctttcaacaataaaataatttaccaccgcctttatgcaaatagccacagacctctatttgttacccattgcacgcctgcatcattggtgtggcttgctgtgtacggtggttatactcagccctgctattatacccccttttcagatttgtagtgcttctgagttggtcctctcccttttcacttaaatggtccgcacgcgaaaatgagcatattttcgcgtacggacctattaagagagccgcacgcaaaaatacacaccctctcttttcctcctacccactttaaataattttgggaaaattggaaccatgccattataattttgcaaaatttgagatatgccatcctaacccacatgtcattgactcatgtgggtcttacgtgtcattgagataccgatggcatatctcaaactttgcaaaattacaatggcatggttccaaattacaatttaattttccccactttctctcctctcctctctgtctttttcttccctcctttcctctatcgtctctatctcattttccccgtcctcattttctccgagtcccgacagcgtaggcggcgatcgtccccgcatggatccggcggccggccagcctctcccccttaggatcccgctcccctcccccgttccttccctcaccagatccggtggaggggaggggcgtcagtggcggtgtggccagaggggagcgcggaggccggcgggcccggtgcgcggatccggcggctggccgccctccccccgcgagatccggctcccctctcctccccttccctccccttccttccctccccagatccggcggagtgggggggggggcccgtcggcagtggtgcggctggaggggagcatggatgccggcggcaagcggcacggaggccgccgccgcctctgacgagggcgggagtggcgtccttggccgacgaggacgacgatgacgatgacaaggaggaggaggaggcggccgggagcggcgacgccaccgtcggatttgttttgttttgaaattttattttttttggttttttattttcccgtgcgggcgacttaagcacccgcaagaaaaatcacgattttcgtagacctttcggtatgtgcgggctgcccacccgcacgtgaaaataagattcgaccgcacggaaaaaccattctcctctaggccaacaacagccaaatgccacctagggtgttgcttgcaactcacatttgcccaactctggtttactggggatttaggggtttgtagacatcgacaccttgttgtcatgctcagggcatttcacagggcatttcaccgaatatatcatgctcatcaatgtattcagcttaagttcgatgatcatccttgatgatatattctctacggactaaacaaatgctggaacgaccttagacatattaccacggatttatggatgtcacctttgatgtaaagacccaataccaactacttgatgtacgtctcttggaataggttagggctgtttcccttaaaaaaagaaaaaaaaagcttaggggatttgtttcaagacaattattttttatttttatgaactccaatgtaatataaaataaatatattttataataaataagataaaataaaggtcaacttatttttaagaggaaggaagaataataggagtacgagcacaaatgctgtgcaggttgctcacatgtcaccttccgctgtcatttctacgcccactctctcttatcttgacttcgccgacaccccttgctgctagtacgcctctacctggacccgcacagtagtctgttgtcgtcctcgatcggatcagctaccggctttccgttgatatctccgcgcttgatggccgccgccgccgcggtcgcctccctcctcggcttcgtcctcgctctccctttctgcttggcggcgccgtccatcacaacgcatggcagcgacggcggcggcggcagctacgtgtcggcggtcggggaccccggcatgcggcgcgacggcctccacgtcgcctgggaggcatggaacttctgtaacgaggtcggccaggaggcccccggcatgggcagcccccgcggcgccgactgcttcgacctcggttggttcctccatccattgctcttctttcttctaatccatgtcgcgctcgcgagattggtcaagttaattggtccgtcgaattgacagtcagagctgggaaattcgcagagaatggcgtggacgagaacggccagccgacgtacaaggtggtgcaccgggtgaccgacgccgacaacaacctccgcgccggcgaccctctcccgggctcgccggcgaacatcacggacgtcgacctgtacgcggcggcgaaggagctctacctgggcgaccggtgccaggtgcccgacagcccgtcgccgtggcagttctggatggtcatgctcaagaacggcaacctggacaccaccgccgccatctgcccggagaacggccgcccggcgcgcccgttctcgcagacctcgaggttcccctgccccggcggcgccggctgcatgaaccagccgctcgtgttccacaaccgcaccgcgctggacgccacggcccggcgcctccgcggcgggctgttcggcacgtacgacctcgacgcggcggacctcggcagcagagaagtgtcgtactactcggtgacgtgggagaaggacatcgggagcggcggcgacggtgggtgggtgttccaccacaagctgcgcactgcgcccaagtacccgtggctgatgctttacctccgctccgacgccaccaagggattctccggtggataccactacgacaccagaggcatgaccaagatggtactacctctcttctgttaaaacttaaaagtgatgtccttttcattttcactttcactgaactgaactcaactgtgtgtcatgctcacgtccaacttaaattccagataagttttcttcacctcacggattcaattttcagcaaaataacatgtgattatttttatatattcctcactgaaaaagtacaaatatgattgctcttatacgattggtagttggtatggcgccttctgtattagattcacagaatattgtagcatgtcgcattcatttggtactttgctttagcgtgtggagaagcagggatttgtcccatcctccactacgttttctttatggattttgggtggactatgtccaaatttattatactaggatgcgtcacgttcatccaaaattattttgtgagatggacatttatggtgtctattattctaaagggttttatcatatctggttagtcttcatatttgaactgtttggggttattcactttgtagcctatttcaaccttacggtttaaatttggacattatcaaattttgttagtgttagatatatatttggtttgaagccttaccaacttttggtagaatttttaagagtgcaaatatctagaattatcaaaatcgggtaatggaacattgataagaatatatgtttagtttgttgaatttggtaaggctaaaatttggtagggttaaaagtggtacaaaagaaccctttgaatgcatcttcaagtgcaaaggtcagaattttgtttttttacaaaaaaggttgaaatgaagtccttttggatggagaaatgaagtactactagaagtatatctgactggaaaagttgcaattcgatagactgaccatgtcagtttcgaaataggagtaacattttttttcgtgaccaaaattagtagccttgtaagatcttctgactaaaaatgtgtaacgccaggtgccggaatcaccaaacttcaaggtgagggtgacgctggaggtgaagcaaggcggaggccccaacagccagttctacctcatggacatgggcagctgctggaagaacgacggccggccgtgcgacggcgacaccgcgacggacgtgacgcggtacagcgagatgatcatcaacccggagacgccgtcgtggtgcacgcggaggcgcatcgaggagtgcccgccgtggcacacgttccggaacggcacccgcgtgcaccgcaccgacgcggcccgcttcccctacgcggcgtaccacgtctactgctctcccgggaacgcgcgcgccgccgaggagccgaccacctactgcgacgcgtacagcaacccgcagccgcaggagatcctgcagctcgtgccgcacccggtgtggggtgagttcggctaccccacggcgaaaggccaggggtggatcggtgaccccaggacatgggagctcgacgtcggagcattgtcgcaggcgctctacttctaccaggtactcattccgtcccaaaatataagacctagaatcgtagatgagatgggatattttctattgttacgaatcagaaatatccatctgaatttagattcttatattgtaggatgtagggagtccattgcatttgtgcagttgatgttttactttggttgagaaatttcaatgcagaatgcagagataggaagtgatcgttcttctttttagcaaaatggaaaggattttgggtgagtgtgattgatgttgttttgcaacatggatgtaggatccgggcacgccaccggcgaagaggaggtggtcgtcgctggacgtcggaacggagatatacgtcagcaagtatgcggaggcagagtggacgctgagtggattcgacattgttgtgccggaggaatgcattgggtcgtcccaaggaggacccgtcagtcgatgtttgtaaagttggtgatcaacgagttaattaagaaacacttatagattcattattggaataatatcgtgttcccttccctcttttggtgtgtgcttggcacatgtctgtctttctgggaggaaactccaaatcgaacgtccgattcctccataaaaatcagatggaccaacggatgaaacattaaattatgcacgatgaaaaaaaattattaattgaaacattaaaaattgtgaaacacaacaagaacacacatgttggaacttgtcgttatcatgttggaactaccgatttgtagtgttcttcgtctttcaagtgtcttaagttactggccttctgtgggatgggccaagatgagaaaaggagagaaggtgatattctcggggcctagaaaaatggtcttcgagaaggcaaacaagcacaggccacggccaacaaggtaagagcagcaatgctggagccaagggattagcatggacggtgggcaagacagcggtgtcgtgactgacatctattgggccttcctgattggcggggcgggggcgcttcaagtacaacaaaactcctgataggtatcgactcaagtgtgccaattcatttaaaattgacaccaatagaaacaatacctatgaagagttctcaaccgacacctataagggttcatatagtagtggctgctcatcatgggaggcgagtagtggttctgggaagaggggcagaggagagggaagggaggccgattttgtggcttagttggtgctggaggtcaaaaagggagcacacatgggtggagtcttcgtcttattttgaaaagggacaagttcatttacacccttaactcttgtctttatctaaaattgaactcaaactctaaagttgtgtatccaacaaccttgttggtattttctacgcacacagataaatcctcaagcacacggataccactgtagcacttgccttgagagtattctaagggtattgagcacaagaaacgtgtgtgtatatctaataacaggattcaaccaaggacaacaactaaatagtaggcttagaataaagaggattcctatggattcaactatagctaacttaagttcccgcaaaaaaaaaaactagctaacttaagttaaaggtaaaactctatcaaatgtttcgggcaccgacccttccctagtctgtcaggctaagtccggtcttaagctctatgatatatccgaacgtggagagacacaaaggatgaacagggttgtcaccacctgtcgtctaactcactttccgtggagcacacaataaacgaagataacctctaacctagacactatgtctacactatcagaggaagcaaaggcggctcggccgaccccttaggcccacctcccagcctctctttcggctgggaggctacttgatgggcctccaatatcttgtactttggttgggctcaattttaggtggttttgatggatatgtgggcccttcaatccatgtaatcatgtcctgattgttaagaggtgtattttgtcgcatggcgggtggtttttgtccataattcacctgcataaaaatattcaccatgacttgtggaaatggttaataataactactacctctaagtttggtatttcattttatattcttttatttgcttttatgcatgatttgatggtcgaatttggtacttggagaagaacaattgttgttctgttcatgaagttcttggataattctacattgatatgtaggcttttagcatgaaaggcatatatatttggaaagcttatcaagtctactttccaacggatccaatggcacatcattcagagttttctatcaccagtaattgtaagttaaagacatgttgcacaagcagcggcatcaaagttggatgtgagccttgtacaacatgtttggatggggttctattatcccaaggcccatcttgggttggtatggagtctatttacaggttccctacgaattgaagccttccaaaacaagaagtttgaagataagaaagaaaagattcagtttgaactcggtttgggctagcttggacatacctggactaaaatgcttgtttctctcttgtctggagtctgttttggacgtgtgtgcacttgttggaaagctaacttcatgacccaagtgacggaggggccaacagaaacaaactccttctggttccactacacgagccaaaagaaattaacagtgttgtagagaggtttccatattgtgttgtatttgatttctagttagtttctaacccatgtatttgtaaaaatttgctcttgttcttctcctaggttttgtgctgccaccgcaaaacaaaagagagggattgggagttctgccatatattgttcttgcttttccttgtagggaattgagggggcaatagatccacttttgtttggtcgagtggatcaacctatcaaagctagtggtttttgcgaattcatggtgaaaggtgcgttgcaaggtaacgtattattcattcagttcgtgaggtttcatggtgtatccgaatcctacgtcacgaaggtcgggctttccagtattgaagtgctgaacggtgtacttcatgcgaaaacaacttattttaaaatatcagataaaactatttttaagtttaaaataattaaacacatttaaacatatgttaatattttttattttacgtgctcgtacttaatcttcatcatcagggcacagttcattggatgacatgcatgtaacaacagctgagtccaacagagaacgggttcgatgttctcatacattagatatccctcttcactcctcacgatcaactgtcaccatagacgatcctacagcagtcgtgcttatcgatcgtcgatcgccaggaatccactaaaaagatactttccatattaaaatataagcatttttaagattcagacatggtcgagatgctactttgactatccatatctatacaaaagtaatatgttttaaataaaaagagttacatgttatgatagtttgtttaatgataaatttagtaacatcaattttacatgattgatcttttttattcttttgttgttaatagtgaaagttaaaaaaatttgaattgtcactattttaaaaatgcttatatttttttaatctgccaacagagaagtgtacttcagacagaaggctctgataacaacattcttcgtctgctgcctgctgtgtaacgaagaaagcgggtgaactcataaaagcagatcaattcttttaccttagtcacaggattgcgaatgaagtagatgtagaatattatagcttttcttttacctagtcacaagattgcaaatgaagtggatgtagaatattataatgctgtttgtatgtcattggcaattccaataaccaggtttgctgtgtttctgcaatatagaagcgtcaatatactgccccggaaaagaatcctgccatctaaaagttatagaaagtcgatatgagggcaaatgatgtgctattatttccaaagtatcaatacatgaagaaacaatatgacgtcagcactgtactcataggcaatatctcgttttttttttgcgtaaacaactaaggtcgcagtattgcttatccacacacagcgatatatttcatccatatgttatattacctatatattaaatacagcatgatacatcaacaacatttgatattacatgccagcatcacagttgtgtagttatgtattctttttgttatcagaatgcgacaagcggaggtccattgactgcagttggttcctgaattcctcattctctgcgatgagacgctcatactcggtaagcaaaccttcagattgcttctgtaaagccaaggtattcgcttcagctgtttttagttcctcagttttcgtttctgacagacgcttgaattcttgcacttgctcattcaacctggaaatctctttctgatattgttgaatctcctctacactcccatgttttgcttcttctaaggtcctgctctgctttgttacagcctccatgtttttcttcatggtccgtaactccctgatatagtgatgtagccggtcaataattaacccaagaaacagagagtatcctgcaaaagaacagaaaaaatgtcaacattcaatcaatctaaaagttaaaatctccaccaatatattttagcacaagaataaccatattatggcacttatttcttgcctgagtccataccaatcgttaattaaaccaaaaacaggcattggagtatgttcaacctttttttgtgggaccttgaatacccaagtttaccagaaatcaacccaaccaaacccaaatatgtatgttatcactccaactaacaatatcaggaatttgaatccagccccaccaccacccaaagccaattcacctgacttcagagttcaggccttatagggaacacaacattcagtttgttcttccatgtctcactaataaaccgaataagaggatcaacagactacattaagtgaccaatgcatatagaatagcctctcgatgtaacgtatcgaggacaatgtgaagtcttctttgaaattgtgctcatgtgaagccacggatactcaggaggggacaaaaaagtaacactggcctagaattagtgtggctctctcttagttgttgactaggcatggcatgataggttagatttacaccgcattcttcattgcacaattgcacaaatgggtggattggatttgtgaggggagcagagtcaacacaaagttccttagtaggagaccacaaatatgtcagctaagggggtggggaacagctaaaattatttcaaacgcatttgatatctttttttttcccgaaagaccagcatttgataccatcgatctctgaagaatagtgaagatagaaggtctgtgcttttgtaatatgaagcttctcagtgacaaacttatgtgataagcaatcttgcaagctacaaacatgtacataatgcactacatgaaactcttagtcaccatgaaaacaaaaggctcaaaagaagttttaaacatctgctctgactagttactattctaggatgactagtggtcctagtggatgctggcaaaagtatacatgaaatgcaaaattcacgtaatgtgcaacggaattgaactatgattacagatagagaaaatgctacacttagcatatattatggtttaattctattaaaaatgttaatgaaatattaaatctcttgggtatgtaaaccggcaaaatttgtgaaacagtagtagtaaattttaaaacatactccaagttagcatcaataagtgggtttgcagttaaatcatgtttctttttcttcatttgaccaggaaggaaaccaaacatttactttttcctacttgttgagcttatagcattcatttccgcaaaggtgtcaaggccaatctaagatgtatcaacgtgtcaacatcaaaagttattgtttcattggatatcatctgacatgtgtactggccgtttccacctgtctggtaagtagtaacagaacagataagctggaacaattgagtgcatgtggctttgccaaaccaaagaaggacatgtcgtctcaataattcctttttatttaataaattctatcttgtttccatgagattaacaacttcttgtggatttacatcatctgaataacatccatatggcctaaaaatgacaaatcgacaatttcaattgcatgttcatgtttctttaatgggcacagtcaacctgtattctggcaaaagtacagatcatcaaacaaaaaactatggatatggaagagcacaaccgtcaaaactcaaaagacagtaaacagtctcaaaatgtgatcttcttgatgaaacctttggcaagagagtattgaattgtgaattgtcataactttttgagggacaataattgtcaacgttgttggatgaacaataattagatgaagaacatgcatgtgcaattggggttaggttgtcctatcaagaccttctgcaagcaaatttctcataagcacaatgcaattctttcacgtctttcctaaacaaaaacctccagaacattataagtttataacataataactattattactaaacatttatcgctcaattttccaattaaccagagatccccaatcaacgggttccaattagccgcggagaagaagaacaagggaaggtgacacatacccatgagggatgcctcgaggaggtggcggctggcgagcacctggtcggtgggcgtgagctggccgagatccccgacccggcgccggatcttggcgatgctgtagccgctggagcccagcacgacgagcatggtggcggcgaccgtcttgaccatgacggggccgcgcccgcgcttggcgcggtcgatggcgagcagcgcgaggcgtcggaacggcgtgcggaagagcagcacgagcaccagcgccgcctccgcggccagcagcgtgaagagcagctggatcatggctgcggtggcgagtccgtcgatccgtcgaacaggtggtgggcacggaggaggaggaagaggaggaggaaatgggggaggagggatgtggaagcggggggatctcgaggaaggcgatatggggagacgggatcaggtcttctagaagtgaatccagccgaagaattcacaatggacggcttctggaagctgtactcggggcctcttctttttgaccctctggcaacagatctataaaaattatagtttttggtgaagtacggcagctgcgctgcttgtcttgctacgcagtcacgttactgttgccctgttcatctgcttgctggccattggatcagcccatgcatgtttctaatccgatgcacgacgagtctttaggtcttttgcctgcttccagcgaacccattccccatcgttctttcccgtcccctgtacaaccacgccgccgccggtggtcgcctactcgccatacgcccgtcccatcatctggccgctagaggacggtaggaaatccatatcgctgtcaccgccacggtcgccgctgtcgttgccgccgtcgccgccgatgtaaatctcggctcaccacggccgtcaccgccgatttgaggtcgattccccaccacctcactaaactgttcccctgctcatcaaagcctatcgaagatccttccctgcccccctaaagttctaccattgcctcccaacaccgctgtcaccgccgtcgccaccgatgtaaatttcggctcgccatagtttccaccgccgatttaaggtcggatcctcaccacctcacgagactcttccgctgtaaataggtgagcacggattgctgatagcatcggcagctgcagcttgctcgacaattctgggacaagctgttcagcctctaggggcgaagccaggatttgatattaggaggtgtggggtgagaagccatgagaccgaataactaatatttatagcaaaggaggtcaaatagtcaccgtcaataataatcaatgcgtaaactagtcctttaacaaaatcttgaattttagctctttaataatatcattgaaagtttgaaatagtcttaatttattgctaaattctttcaatgtaaactattgaataatctcacaaataagtattatctattttactttgaaaaagatgagaaatcacaaactaattttgtatatcatgtttcttgctaatatttttacatctgctaactaactaaagtgataatactttcaagctacacaaataaactagataaatacttatcttagttaaccttaatacagagtaaaaacaggggatgtagtggggataggggggtgttggcaccctccggcacccccctagctgcgccactgtcagccccagcagcctcaagctccaaccgaagcgcccaatcactagaaggtaatgcccctcgatcctccttgcgtgtggctatgctctgccggactatttttgctgccattgctgatttgtgtaatgcacggttactgttactatcattggtagagctgacataaagatcggtggttgcgccggagtcgacaccagattgcatgtctcctcctcagctgcttctgagcttcattgcgtttgcccgtttgtatttagtgaactacatttctgtagtgcttatggtttttagaggaaggccatttgaaatccatgcctcctgagtttgaggctacattgtgcaatagtttggaagggaattggattgtaaaaataggtaattgatgtttgaactgatcctaaaattacaagttagcactttagctgtgcctattgtttttttttgccataacgtataaaatgtagctggaaccatttttatgtgctttcacattgttctcagattaggggtcgcgttggaatttgggattgctttttttagttttctttatgtaataagaatttaatgtacttccattccctaattagcagataacaacaaaaaggaaagcactaacaatatataattatcctttctacgctgagcaatgcatggaacaaactagccaaattggaatgacctttgttgacctatttaaattaggctatcaataaaggtttaaaatacaaaccatccaatgccgtgccacaaggatcattgcaatgtgctgattgcatctgctaatattataatgtgtcttaattaagtttagcggtccttccgataggctcttacaattgttatcgtgcctttagcttctatgacctaggctatgtatgctcctgccctccatgcctttccttgatttcttccttgatgtctaatgaattgttcatgctttcacacatccatctacagctcaggccatgcatcaatggctgagaatagtaacaagaaccaattagttttgggtgggtgcatagtctgagcatcatgcctgagtgcagtccaatattatcgcaatctgcgtgctgagaggaatgatatcttgaactaattatgtgataattgcaagatgtaatacatctcaacatattgtacataatgtcttcttaaatttatactgtttgcacgaagaaatgatgtgcttatgtatttgttaggtctacacataagaaagtcagtggtctacattgcaaatggaaagctaatctttagaatcagccatatcatttattgagttcctatcaatacattagtagcttatatatggaattatttatcattgttgattcccgttctacactgtatttggtgtttatcatgcttcgctttgtcagttggcgacttgacatgattggaaatatttttgccttttgatttctctgtggatagaatgacattatttgtttatctgtttcttcaggaatcaagatttggcttaaatgggggaacgatataaattctttagtggaagtttcagctctaacactgacttggtatgatgttgctgtacttatctatttccctcgaagatcttccctggtcgcagcaagatccgcccaaatcccccaatctgtacaaggtatttggaagaaaattggactataagactcaacataaacttccaggtttaacaaattagttatgcctgttgttttttatcatggattataaaatgtagccgttctttcagattgctctgtacgtatgatgaggttggcatttaggattgttcttttatttgcttaatatactaacctcctaattagcaaatctgtaatagtaataaaaaggaaaccggtaaggatatgtgcttattctttctaggctgagcaacacatgtaacaaattagccgattggaatgagcttatatgtcgataacctgatggattagttagttgacctatgcagccaatgtgacgtcaactacagagcatccggtattgtgttgggagtatcgttgccatccactaaatgcatatgttaaccctgtaatttgacctcacaatttttagtgctcctgccgattagctcttcatgtggttaaccttcctggtaccttttacgcttacgcttttcctttcctccactcctttacttgctgtctctttagttattcatgctttcttaccatccatctaaatggtcaggtcatacaacaatggctaagaatagtgataacaaccagctgattttggatgggcgcattggattagtgtcatctctatgtcaagtcgaacctattcttcgcaatccagaacgtaagcggaaggccgttgtattggaccaacaattcaaaggtcagctaacaaccgatgtttcgtacactcgttatcttttatttcgatttcgtggtgttacttttctggctgtaccagaacctgaacttgcaattttggttcaggtgtcttttgtgctggacaatcaagccaatcaacaagccatgttccagatgtatgcgctggagactttatatcaacctttcacctaccatcaaggcgaacaattaggcgcaggctgagctttgcttctgataatgtgcctatcccaaccggtgacggtctctcatcgggtagcccaacacttcgtgccgttgagaccgtttgtggtgagctctccattagactatgtcctctttagttatctctcttttttttttacgaaaaatagcaagacagcctcctactgtgctaccatattagtatagatattaaaaagttacaatatttagttctctctctgagctcaatgaaattaacatgcctatcactttgcgattttggccattatcattatgaccttaccctctaggttagtcccagatttatattgttatattcatgcaatatattctgttggtcacaggtttaccgcatccacctcgatgtgttgctgccaagtcgcgtaaaaaacgcaaggtagctatgatttgcaggagagaagaaagtaagaaaagacattctacactaataaccttatagacaaatttgttttgttagatttgtgatcatttggctgttgttccagggttatatgctgatactctctccctttcatctcggtctgttcggcggcgcaaaatcccaaatgataatattgtacaccaaccacaccatacacaactacgtcaacataacccaacctcagctgctcagccaggtggcgatggtacctaatttatttcttttcaattttcaataatgtattgtgatgacaagaaatccttaattcttctggtctatctttttcttgcaccagatcataggcagccattccccggtcgacaccgccgtaagttctattactttttttcaatcttactgttgtcatattcattaactatttcttagcatatgagaaacatgcacgctatgtgtgtttcgaatatgcctaggagatatatctcctcatattgcctcagactcacgattagttttacacaccactcgcctacagatgtcatgctgctcgactccgcagttcatcttgctggttactctatgatcaatccattgcttgtcgatgaggtttcattacaacgataattactatgattctcgccgcagctgattcatggcagtgatgacttccatatggtaatgataacaaagcatattgtccattccgttgctctatattttctctgtcaaatgttttcttatttcctgtttgtcttttttaactcttaggcactatattttcacctttataccttggaggacctgatcagacttgccgatattgtggtgctctcttttggtatgaggagcgtgcccgtggtcaaggacaggtaacttcacctgtgtacaacaaatgttgtaggggaggaagtgttcgtttacctccatacagaccacctccagaaccattgcttagtttgttgactggacaaaaccatgcattgtctgcccatttctttgataacattagatgttacaactctatatttgctatgacatctatgggcgtcaacatcataaggtctattaacgatggtggaggaccttatgttttcaagattagtgggcagttgtgccatcggataggatctctaattccaagacatggtgcttggccagaatattgtcagctatacatttttgatactgaaaatgaagtccagaataggatgggggttgcttccgttcgtggtagttttcagccaaatgaagatgtcattagatcttttatgaggatgcttgatatgaataacccaattgtgcaagtgttccgaactgctcgggatagattggctaaccaatcagaagaccactactttgtcaggctatttgctgtgcctaatcaacatggtagtgtttatagtgcccctattgcatctgaggttgttgggttggtggtcaatgatctaggaaccactgatcaaggtcgtgatttaatagtacaagatcatgcttctcatctacagaggataaaagaatctcactgcaagtttatgactatgcagtaccctctcctgttcccatatggggaagatggcttccataaggatctcaagtactgtcaatgccagcgctcaggagccattaagagatattatgtcacgatggtagagttttttgcatatagactacatgatagagttggtgacttcaacactcctttacggtgcaagaaacttactcaatcctatgaggttgatggtttttgctgtgttgaggatggtcgcttgagccattacagaattgactcatttcagaagaaatatagagccagcccatacaactctttggttcaggctgttagcaccggcatgacacaaggatcaacagcaggtcaaaagatcgttttgccagcttcatttaccgggagcccacgttattactatcagaactaccaagattgtgtggcactttgtcgtcggtttgggtgcccacatctattcatcacttttacatgcaatgctttatggctagaaatagtagaagctttagcacccatttcaggacagtattcctctgatcgacctgatattgttgatcgtgtttttcatatgaagctaagaatctttatggatgacatagtaaaaaaccagttttttggtccaatatctggaggtaatttccatagctccttaattttgcgcactatgttctattacataatgtatttcccgttgatatttcccatctacatccaaatttttcggctattttttttggcctgattttccccttcgatacttctcaattagttttccattcccttttttgtagttgtctacacaattgagttccaaaaacgtggattgccccatgtccatataatcgtgtggctcaaaagggacggacctcttgatgctgattggatagatgcttttgtatctgcatagctaccagatccatctgttgatcgtgttggttatgaggccgtttcaaggttcatgatacatggcccttgtggcagctcaaacaaatcgtctgcttgcatgaacgatggaaaatgcagtaagttttaccctaaagaatttacagagaaaactatagttttgcccaatggacgtatcatatatgctcggccaaataacaaaattaccacaaacaaaagtggtgtggatgtcgacaacgggtatgttgtgccccataatgttgacctcttggttaagtaccaggcacacatcaatgttgaaattgttaatcgtgatgatatggagaagtacttattcaagtacacaaccaaaggaccagattgtgctaaggttggaatacgggatggaggcaacgaaatacaacaatgtcttgattgtaggtgtatagcacctaatgaagctgcatggcgcttgctacaatttgatatccaccacaccgatccatctgttgaacgtttacctgttcatctcccgctagaaaataatgtggtgttttttgaagatgactatcttgaccaagtcattgaaaatccactaagcactatcaccaaattgactgcatggtttgatgctaacaggatatacccacatgctcgccaacacacttatgtggaattccctgaattttggacatggcatggcgatggcaagtattggaaacaacgctctaagagtcataagggcaaggttggtcgcattgcaaatgttggacctaaccaaggtgagcgtttttacctacgcatattattgcatgttatcaagggtgctcaatccttttctggtgtacgcactatcggtgacattcaatatccaactttccaatctgcatgcgaagcattggggttacttggtgatggctatcactgatgcagcacaatgggcactcccataccaactccgacaattatttgtcatgatgcttctattttgccaagtatcaaacccaaccaaactatttgatagccatgttcaactaatgggtgaagactttgcatatcgtgtgtgctagcatacacctgggatacatcaaactatccttcaagaccatattagattatccaccttggatgaactagacaaattactgagagatgcaggatatagcttggatcatttccagttaccgcagctaagccatcatgcttttccaccattggagtataggcttataatggatgaacttgcttatggaacaaacagtgtgactgaactgcttaatcaattaaatccttatcagaggcatgtttacactgccatagaatcctcagttttaaataattctaggcaaacattttttgtttatggatatggtggcacagggaagacatttctatggaataccctattgaacagcattagaaatagagggaaaatagccttgacagttgcatcttctggtatagcatcattgttacttccaggtgggcgtacacctcattcacgctttaggattcctctagacatccaggaggactctatgtgtgctattaagatgaacacccagctagctgaattgattcagcagacatctctcattatatgagatgaagcacctgtcaaccataggcattgttttgaagcattcgattgaacccttcgggatatcatgtcatcagtcaaccatgattctgtgaacatgcagtttggtggtataacagttgtcttgggtggtgattttagacaaactctaccagttattcctaatgcaaggaaacaacagatcttgaatgcctcaatcacccgttctcgcctttggcaaaactgtgtggtgcttgaattaactgaaaatatgaggctcagctgtccaggcctttctcttcaagataaatctgagcttgaatagtttgctgcatggcttctatccttaggtaatggtaatgtccatgacagtgcacctgctgatcgaccggacaccacctgggtggaaattccatcatatcttttactaccggatgaagagaggaacctcacatgtttgatttcttttgtgtatggttcacggccgcatatatcgcagctaccagcttacttatgtgagcgtgcaattttggcaccaacaaatgagatcgctgctggtataaatgcacagattatcagccacatagccaccgaagaaatgtcgtactatagctttgatgatattgatgatgccacaccaaactattgcaatgtgcagtctctttatcctacagaatttctcaatacaatacacatgagtggtctgccggataatcatttacaacttaagattggtgtccccattatgcttcttatgaatttagatacaccaaagggattatgtaatggtacccgtctcatagttacacagctgactcatcgcataactgaggctgaaataataataggaaaatccagaggatcaaaaccatacataccaagaatagtcactacttcgactgactcaaaatggcctttcaaaataaagcgtcggcaattcccagtccgtgtttcatatgccatgacaatcaataaaagccaaggacagacactcagtaaggttggtgtgtacctaccaaaccctgtattctcacatggacaattatatgttgccttctcgcgtgttacatcacctcaaggtcttcgagtcctcattgagaatagcctacctgggtatgaatctaagacacataatgtcgtatattctgaaatattcagtgatattgcaaatcagcgtggttagctttaccaggtatttttatacgctctgtatctcaacatatatgtatatgtatgcctcggttttatacatcaatcgttctaacgtgtggactgtgcgtgcttccaatttcatctattcttattcttctgaatgaatgggtataactcagctagctatgccttttttttatatataaatgcagatttcactacccctatgttcacccatggtacccaaagtcattgaactagaagatatgaagttttatgattattccttggttcttttccctattgcaccatacagttattcaccaaaaaaacaaaggtaaatttctttaggactgtatgggttcagcttgccctcagtatacatggattcatcatttgtagatgccctcctgtcatgtttgatatgcacatggtagcaaatattgatgcatatatttatatttagcaaatgtaggttaaatatctattcgtattctttacatttccttcctatggaccgcttaccgaattctgttattacaagacaaaaaaaatgttccatacattccaactattgtgcctccacacgtgcaaaattagttcactcttattttacttacgcacgcttatagtgtgtagtacgtgctatttattctcattcaactttgtgattaactaaacgaattatggacagttctatatgtatactgagctcagtgtggtacacttcaaaacattatatgttgttttactctgcccagagttgtgaactcaatttaatcattttgcttactttttaaacttaacatgatacattatgctttgattatttgttatcatgacaatattctacctacttccctttttttcatatgcttacaggtttctcaggttgtccttatggtttggtgctttccgtatgggttgatcggtgcgaatgacaaccaaacgcgcaaaactgctgtcatttactatcatttgttttgttaccatgctatagctttttatatgtttgctattatccgaacttttctgcgcaatgcactaggcagaatatatgattatgttgtatacgctccaacatcaggcgctcatttggcatgatgtcaatgttcttatgcctatcatgggttggtgctgtatagcgtccagcttttgcaatttctatcaactgcaaatatttttgtcatgtgctatactgttaattaaactaataagctatcgctaatattcgagcacatataactttgttactcttgcatggtgatgtttaggttgtctccatacggttcatcttttatcaacatatttttttattgtatttaggtgtttgtttctcatttatgtttataacagtatccgcggctttgccgcgggggtacatcctagttagtatagagattagagagggggccttgatgaatggtagtactccgtattaaggatttggtactagatggttttaatcacggcttgggacgcgactcgcccgctgcgtgcttgtgctcccgtacgcgtggccgatgcagcaatgtgaaacttcgaacctgtgttgttgtgatggctacgacgaagggtccgtttagcggagatgcacttgattggtctagcttctgaaaatttaagttagattttttagattctggcttctaatttatttttttaattctataacatcatcttaaaatttagattaaaatctagactgtttgaaagagcttctaatcaacttccactatgtgcggctcgcggctagggctctccatgcgaggcgcaccccctgcctccttcttaaggtggatatcgccaaggcctttgacacggtcagttggccgttcttgcttgaggtgctcacccatctagggttcagttagcgctggcgtgattggatttctctcatccttggcgcctcctcttcccgggtgctgatcaatggggtgcaaggtcctcgtttccctcaccggagaggccttcggcaaggagatccgctctctcccatgctctttattctggtcatggatgtgcttaacgcgatgctccgcaaagcctctgactcaggctggttccttccgctcaacgatcgtgccttgcgacaccacgcctccctctatgctgatgacttggttctcttcctctccctggttcgtcaggatcttaagttcatccagggcatcctctctgtctttggtgcagtgtccgggcttcgcaccaactttgccaagtgttcggttactccgatgcgctgttcggctgaggacctggagctggttcagtcctgctttccctgctcgatctctgattttccttgttcttatctcggcattccgctatccgttcgcaagttgccgagggcggccctgcagctgcttgtggataaggtctcccatcgtcttcctccctggaagggacgactcaccactctgggcggccgctttgttttggtccagtctgttctcctccattccggtccatgtgtctatggcgatcggccttccagcctgggtgatcaaggccattgacaagaagcgccgcgccttcttgtggacgggcacggactcggctcacggtgggcagtgccgggtttcttcgatgaatgtctgtcatcccagagctttcggtgggttgggaatttctgaccttaggttggtagggtttttcctgtgtgttagctggctttggctccagcgctcagggcatccctactgggacggcctaaaggccccagccgagcgagccgtctctgacatgtttgaggcgtccaccttcttcgtaccaggtgatggtgagtcgattcttttctggtctgaccaatggatctgcggctactcagtagcttccttggcttcggatctcctcttcattgtgcccccgcatctacgtggttcgcacacggttgcttctggcctggcaaaacaacgcctggatttctaacatccgcggcaccctcactgtcccggtcatctcccaatttctccttgtttgggattgggtgctccacattcagcttacaccgggtgtcggggatcgtcttgtctggcattggacgagtgaccagcgctactcggcgcgttcggcgtaccaggcgttcttctttgaccagcactcctttgcttgtgccgatcttctctggcacgcgaagggccctgctaagtgcaaattcttcctctggtttgcatttcagcagcgctgttggacagctgatctcctccagaagcgcggcattgatagccactcggcctgccccttttgcgctcaagagcttgagacggcgaaccacatcctccttgactgcatgtttgctcgtcaggtctagttacgggtgttgtcttctcctggctgggctgccctctctcccctccgtggcagctggctgcaggattggtggccatcttctagggcatgtttacctgatcatctgtcacgaccggaattaacccaacgggcgttccttacgtgcgtgtattattccttgtcccaggaggcaaggtacaccaaaagttgatacatttcagagtttatcaagcggaagcgtaaatagttaatttattacatgggcggcgaaggcccagcacacacaaagacaaacgggaaacagcggaagactagggcgacgaccacaggcgcttgacggcaggcacgagctagacaccaaagccttcatcatccaggggctcctcttctgggtttgggaaaaattgagcaagactgagtacaaccaccgtactcaacaagacacacccacaagtgcaggataaatgcaagggagtacaagggggttataatataaaagggtagggtttacagtaaacagcattaaaagacacttagttgctcaaagctattttgtaaacacgattccagagctatacaatattattaatcaaggccgtgaacccacacgaacctgccttaacccaaggcctacgatgattcagaccgaactggcaacccgaccctgggtcccagctcgtcccaagccaacccaggccaaccattctacattttagttgttaagcaggttttaagaattaaaacactaacttgggtacattgctcggcttgcccataaccgcgggcgcggctattcgaatagattatactctgatcagaggtgtacatctttacccacaagacacattttcctcacgtgtaaccacgtgccacataccaccacggtatacggacggaagacgtgacatagtttgcaacccatcctagccatagacaagagtactgacccaaccccacatacggccggaacccccgggacaggtaggcaggactaagcccctagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacaaaggcccaaagaccggtctttatatggccgaggtgctactatcaaaaccatgcaccccgagcccaacctaaaaccattttgaggattttgaatagagggggaggtgtgaatccaattccacaataatccaaccattccatagtgtccaggtgatatgaatatcccaaagtctagagttgtaaaaccacctaatgttgcctaattaaccagcgaagcatctacctaaaatcatactagtggtaccatgagtagagtgtccactagttggggttttgtttattctagggtgaacaaggaaataataacaataacaataataaggtcataacaaaggtaaataggcatggctaaataaaacagtgataacgcgggaatttaaataaagcgataatgcaataatttaaatcaacataattttataaactgggattcaatatgttcaaggatgatgtgacttgccttgctcgctttcccaaacgtcggcttcaacttacacgaagagcggatcttccgaagctgcagcgtctacacgaccaacggaaaagaaaaggcttttactctaataaactccatataacaagcaggaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaattttaaaagggtttattgcgtcagccgagaggagggggcgcgcggaccgggtccacgggagtggggcccacgcggcagcctcatggtccacggtggaccgggtgcactcgggctcacaccggccggcgccgtgggtcccacacgtcagccgcacccgagggcgcgggcggctgacggccgggccccacgcagcagccgctcggtgcgcccgaaggcggccacgtcggcgcggccggcaggaggcggcgcgcccgcgcccctatggtcactggcggcggccatgggcacatcggagcggcggccgagagaggggagggaaagggggaaacgaggcggcggtcctcggctcaccctaggtcgaaggcgacaacgaaaaaggcggccggagcggagtaaagcggcagcgcggctcgggtcgacggggtcgacggtgttccggcggtccgcgggctcggcgagggggtggacggggtcgacggcggtgtggcgaagccggaggaggcgacgcaggggcgggagacggtcccggcgagcggagaaggccggccggaggtcgtcggcgagggaggagagagagagcgacggcgcgagctcgattccggcgaggaggaagggcggcgagaggcggaaacggacggaggaggtgcggggagggtttaaatagggttggaagggggagagagcggccggcggggaaggaataggcgcgggaggtccggccgccatcaatggcgccggcgagatttgcgggggcaaatccgcccgtttgaacgcgagagagagagggaaaaatgggggaaaagggagaggggatcacggggagtgatttccccctctttattgcacgcggggacggcgggaggcggcgggattcgcggcggcggcggcgctagggcgcgggcgaggcggcgggagcggcgggaggaaggggatgacgggtgggccccacccgtcagcgagggtggcgggtggacccgcccgtcaacggcgcgcgcgcgaggagaggccggatgggccgcggggagaggagagggagggggagggagatgggccttcgccgcccatgtaataaattaactatttacgcttccgcttgataaactctaaaatgtatcaacttttggtgtaccttgcctcctgggataaggaataatacacgcacgtaaggaacgcccgttgggttaattccggtcgtgacatcatctctgtgccagcttcgactccctagtcctcctagtctcatggcaactgtggaaggaacgtaactccagggtctttgactctgtgctctcttcggtcgcagtagtcctagagtccatcctttcagagggccggctgtggtcgttagcggccatcgcttcctttggggaattgttgggagcgtagagtggctctgctccctcccgctgtttggagtagagttaccgtcgtttcgagtttttttcctttcctttctttgttttttatctttgtttttcttccttcctaggcataagccggtctggctgagtgtgtcgtgtatcaatactctattcttctaatatattgacgtgcaattcttctgcgcgttcgcaaaagaaagagcttctaattctaggagaaaatagcatgagctagaagctccccaaaacagattcgaagatgcggtggcctcctctttgtgtaacggtggagaccaacttcagcccccgacgacgcacgcagagcaaagccaaggcacgacgaaaatgtaggtggtgggttacggggaagacgcggtggaggcagcttcgaatggcaaaggcagcagcatccgatggatattgcacggacgcatagcatgaatgtagaatggataggatgacaaaatgaattcgcatctcaatggtaaacttcaaaaattgagcgatatttttttaaaaaaatagtatggtaaatagtaagaatttttcaataattacttactatatatttctaataatataattacttagataccgtatgaacccgcagaagggatccacggtacccagcccattgatctgctaggcttcatcagtcatggtactgccaccagacctggccaccatcagaggcatggggcagcaagtttttttttcttcgaacgatcaggccgttgccgacgttttacataaagaagaagttgttttattttaaagagaaaacgagaccaaagcttacagtgcatagttaattagggaaaactatgcgaaaaccacaactattccctgttataattatgagcgcaaccagtgggattataagttatgtgattaatagtactaactataaaagtaaattacaactatcgacggggaatacccgtagaccggatatagagggtactggggtacgctggtacgaggatctacgtagtacgacatcaagcagacaaaaaaacaaagattatactggttcaggccccttgataggtaatagccctaatgtcacgtcctgataaattcatcccgaattaaaaatcattctctaaaaggaataatagaattaattaaaattcgaaaagaaattggcaaacactaaaatacgtacaagaaaaattcaaatgtgacccggagaatttttgttaaattctccttggtctaaaaggagccctcaaattttagtgggattttcagagcacaaataataattgagaagaaataaacaaagttgaaaaggttttataaaaagaaaaatcctaaaagaagttcttttcccccccccttccctcttgggccggctcggcccacttctccctccctctctctctctcctcccccgcggcccatctgtcttcccgcgcgcgcgcgccgttgacaggcgggccctcccgccgatctcgctggcgggtggggcccacct

SEQ ID NO: 36700 - DNA, 37281 bp, Oryza sativa
  unsure (1)..(37281): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtggggaagaagctagacacggtgcagtgcagcgacgaagagaaagtcatcttcgccgcccaccagctgcaggggcccgcatctctctggtgggaccacttccaggctacgcagccagaggggcagccgatcacttgggctcgcttcaccgccgctttccggagaacccatgtgcccgccggagtcgtggctctcaagaagagggaattccgagagttgaagcaaggcaaccgctccgtgatggagtatttgcacgagttcaacaacttggcccgttacgcccctgaggatgtgcgggaagatgaggagaagcaagagaagttcttggcaggaatggaccccgagctgtctgttcgtctagtctctggggactatccggattttcaacgactggtggacaagagcatccgcttggaggccaagcacaaggagctggaatcgcacaagcgccgcttggcgaacttccgcaatcagcagggtgctaaccagagggtccgctacaccaatccctatccagggggatcctcctcgcaacagcaacaacagcagcagcaacctcgcccagcgccccgacctcaattcgtggtgcgcgtcccacagccgcagcagcagaatcagcaagggactcgtgcatcccgtcctcctacgccagctgtgcagcccgttcaaggccgcagggacgcttcaggtccgcagcggctgtgcttcaactgcttcgagcccggacactttgcggataaatgcccaaagccaaggcgtcagcaaggccaagcgcctccccgctccaacaacggcgggaaggatgtcattcggggccgtgtgaatcatgtgacggccgaggacgtgctgacaactcccgacgtcaccgttggtacgttcctcgtccattccatccctgctacaattttgttcgactctggagcttcccactcgtttatatctgtgccattcgtggggaaaaatcagttgggggtagaaaggcttagaaaccctctgctcatcaccacccctggaggggttatgacagcaaagtattatagccctgccgtccctatagaaattcaggggattccttttccctcggatctgattctgctagacaccaagaacttggatgtgatccttgggatgaattggttggcccaattccaaggagtagtggattgcgcgaggcgcactgtcactctgtaccgaggaccagaacaaccggttgttttctttgcacccccaacctctgtcagaagttcaaaacttcatcagatagaactgtcagaaattcccatcgtcagagagttcggagacgtgtttccggaagaactacctggtatgccgcccaagcgagagattgagttccggatagatcttgctccaggaaccactcctctgtacaagcgaccctaccgtatggcagcaaatgaactggccgaagtaaagaaacagttggaagagttgaaagaaaaggggtacatacgtccgagtacttccccatggggtgctcctgtgatttttgtagagaagaaagacaagacgaagaggatgtgcgtcgactacagagctctcaatgaagtcaccatcaaaaacaagtaccctcttccccggatcgatgatctgttcgatcaactcaaaggtgccactgtattctccaagattgatctccgttccggatatcaccaattacgtattcgtgaagaagatattccgaagaccgcattcactacgcgatatggactgtatgaattcacggtgatgtcgttcggcttgaccaatgctcctgccttcttcatgaacttaatgaacaaagcgttcatggaatacttggataagttcgttgtggttttcatcgatgacattctgatatactcacaatcagaggaagaccatcagcaccatctccgtctggtgttgggaaagttgcgggaacatcaattgtatgccaagcttagcaagtgtgagttctggttgtccgaagtcaaattcttggggcacgtgatatctgctaaaggagttgctgtggaccccgaaacagtgaccgccgtcaccgattggaagcaacccaagacagtcactcagattcgcagtttcttgggtttggcaggatactaccggaggttcatcgagaacttctccaaaatcgctcgacccatgacacagttgttgaagaaagaagagaagtttgtgtggagcccgcaatgcgagaaggcgttccaaactctcaaagaaaagctggtttcctcgccagtgttaatcttgccggatactcgcaaggatttcatggtgtattgtgatgcttcgcgccaaggattggggtgcgtgctcatgcaggacggtcatgtggtagcctatgcttcacgtcagctacgacctcatgagggcaactaccctacgcatgacttggagttagcagcggtggttcatgctctaaaaatctggcggcactatctcattgggaaccgctgtgaaatatatactgatcacaagagcttgaaatacatattcacccagtcggatctgaatcttcggcaaaggagatggttagaactcatcaaggattatgacgtgggaatacactatcaccctggtaaggctaacgtggttgccgacgctctaagtcggaagagccattgcaatactctcaacgttcgaggcattccacccgagcttaatcaacagatggaagccctgaacctaaacatagttggtcgtggattcttggctgcgttagaagccaagcccaccttgctcgatcaaatccgcgaggctcagaagaatgatccggacatgcatggactcctcaagaatatgaaacagggtaaagccgctggtttcacagaggatgaacacggaaccttatggaacggaaagcgggtatgcgttccagatagcagagaacttaaacagctgatacttcaggaagctcacgaaagtccttattccattcacccgggcagtaccaagatgtacttagacttgaaggagaaatactggtgggtcagcatgaagcgggaaattgcagagtttgtggccctatgtgatgtgtgccagcgtgtcaaggcagagcactagcgaccggctggacttctccaacctctccaagtaccagaatggaaatgggatgaaattgggatggatttcatcaccggacttccaaaaacccaaggtggatatgattctatatgggtaatagtggatcgattaaccaaggtagctcgattcattcctgtgaagaccacctatggaggacacaagctagccgagctctacttcgctaggatcgtgagtctccatggcgttcccaagaaaatcgtatctgataggggaagccaattcacctctcacttttggaagaagctccaagaagagcttggtacccgactaaatttcagcaccgcgtatcacccgcagacagatggacagaccgagcgtctaaatcagatcttagaagatatgcttcgcgcatgtgtcctggacttcgggaagacttgggataagagtctcccctatgccgagttctcctacaataacagctatcaagccagcatacaaatggcaccttatgaagcgttgtatgggcgcaaatgccgaacaccgctattgtgggaccaagttggagaaagccaagtgttcgggactgatatcctgagagaagctgaagctaaagtcagaatcattcgggataatctaaaggtggcacagtctcggcagaaaagttatgcagataaccgtcgccgtgatctggaattcgcagtggatgattttgtgtaccttcgggtcacgccattgcgaggtgtgcacaggtttcagacaaaagggaagctcgcacctcggtatgtgggtccctttcgtatcactgctcgacgcggagaagtcgcttaccagctggagctgcccgcctccttgggcaacgtgcatgatgtgttccatgtgtcgcaactcaagaaatgtcttcgagtgccatccgagcaggccgactcagagcaaatcgaagttcgcgaagatttgacgtatgtggagaagccagtgaaaatcctggacaccatggagcgcaggaccaggaaccgggtaatccgtttttgcaaggtccagtggagcaaccacgccgaagaagaagctacttgggagcgtgaagacgagctgaaggcagcccatcccgatctcttcgccagttcttccgaatctcggggtcgagattccgtttaaggggggtaggtttgtcgcgtcccaaatcgactctaaaattcatcctcgaaattgtgcaaagaataattaaaattcatgtgaaagcctccaacaattaaaatgtgcaaagataaaagtcaaatgaggcttggaggatttttgtatatttcctaaaagcctaaaatgcttaaacaaattttagtggaattttcagagcacaaataataattgaaaagaaacaaacaaagttaaaaaggttttataaaaagaaaaccctaaaagaagtcctctttcccccccccccttccttcttgggccggctcggcccagtccctccctctctctctctcttcccccgcggcccatcggcctccccgcgcgcgcgcgccgctgacaggcgggcccgcccgccgctctcgctgacgggtgggacccacctgtcatcgccttcctcccgccgcgtcctccgccgcgcccgtgccctagcgccgccgccgccgcggattgcgccgcatcccgccgtccccgcgcgcattaaagagaggggaatcattccccgcgatcccctctcccgtttcccccgatttcccctctctctctccctcggatccgtccggattcatcccgtaatcctcgccggcgacatctatggagcccgagatccccgcgcccgtttccttcctctccggccgcgttctccccctctcggtgctatataattgctccccgagctccgctcttccgtttccgccgctcgccgctcgctctcgccgtcggcatcgtgctcgcgccgtgctcctctctctccgccgtcgccgccgagctccgttccgccgccgccgccgctccggtcttcctccttactcggcgacacctccatccgcttcgccgagtggttgccgaccccgtccgccgctccgcttcgcccgccgaccgccggagcaccgtcgtcatcgtcatcccgagccgcgccgccgctttcctccactccggccgccgttctcgtcgtcgtcgttgtcccggggtgagccgaggaccgccgttcgccttcccccttccctcctctctctcgggcgccgctccgccgcgccggtggtcgccggcggtgaccatcggggcgcgggcgcgccgctcccgtcggccgcgccggcgaggccgccctcgggcgcgccctcgcggctgccaagtggacccggccgtcagccgcccgcgcccgcgggtgcggctgacgcgcgggacccacggcgccgaccgccgccagccgcgtgcgcccggtccaccgtggaccgtggggctgacgcgtgggccccacttcccgtggacccggtccgcgcgcccgctccctcggctgacgcaataaataggatttttaattgaaaattaaatgaagaaattcgcaaatatccatttaaagagcatataaacttcaaatggccatatcttggccatttgaactcggaattggaccgttcaagtctctaatttttccttaagaagtcaagaacccttttttgtgctttgtttctgctgttatgtggagtttagtagagtaaaagcctttttcttttccgttggtcgtgtagacgctgcagcttcggaagatccgctcttcgtggaagtcgaagccgtcgtttgggaaagcgagcaaggcaagtcacatcatccttgagcatattgaatcccagtttgtaaaattatgttgatttaaattattgcattatcgctttatttaaattcccgcgttatcactgttttatctagccatgcctatttacctttgttatgaccttattattattgctattgatattaataccttgttcaccctagaataaacaaaaccctaactagtggacattatattcatggttccactagtataaatttaggtagatgcttcgctgattaattaggcaacattaggtggttttataactttagactttgggaattctcatatcatttggacaccatggaatggttggcttatgttggaattggacacacacctccccctcttttcaaaacccccaaaatggtttaggctgggctcgaggtgcgtggttgggttttgttagtcgtacctcgggtactataaggattaagctcgggcctctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcatatggcagagggttggtgccctgctgctagggggctcagtcctgcctgcctgtcccgggtgtcccggccgtagggggattgggtcggtactcttgtttatggctaggatgggttgggagctatgtcacgtcttccgtccgtataccgtggtggtatgtggcacgtggttgcacgcgaggaagatgtgtcttgtgggtaaagatgtacacctctgatcagagtataatctattcgaatagccgcgccctcggttatgggcaagccgagcaatgtacccaagtcagtgttataattcttaaaatttgctcgacaactaaaatgtggaatggttggcctgggttggcttgggacgagctgggacccagggtcgggttgccagttcggtctgaatcatcgtaggccttgggttaaggcaggttcgtgagggttcacggccgtgattaataatactgtatagctctaggatcgtctttataaaatggctttgggcaactaagtgacttttaaatgctgtttactgcaaaacttaacccctatattattatccccttgtacccccttgcattaatcatgcatctgccggtgtggcttgctgagtactgtggttgtactcattcttgctcaatctttcccctcttcagtaagagaagctttggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacacctaatccagttgatatgggattatatgatggaaaccacagattacaaagggaattgcggaactcgatgataccgacgagattgtaatcgaacaggttcaattagatctcccggcgacttggcttctgtaggcttcaactccgtaggctgtggtggatgtgctggctacgagattcgatgccttaggtccttccaaggggtcccttttatatcgcaggtcaaccggtctccaagtaggactcggagacatcggactcggcacgatacaatgacgacctagttctgtccgagtaggagtccttccatctgtgaacctcgtgatgaatttccttaacgtatgccggaaccgtccgtattcgcgcaggcatacaatatcgatatgtgacgtatatcgaagggtagagggtataccttacccataaccctgacagtagccccccgacttctgcttaaatgaacttgtgtaaccgatcatgacttctgatgtcgaggttgttgtcgttctcggtgtgaggactgagaaacgaagagtaatcgacaacgccaagtgaagctcaacggtcatgagtgaatttaaattaaagtccgacaaactgccgcacgtaacggacccagaaatttccggcggccatctcttcttttccttggaattcgcaccatcggaagtgtgactataaaagggagttttggggatcccttttgaagtccgcctgttgtgaaaaaactctccaacctccaagcattcctcgtcttctccgctcccgcaaaaaccctagctagctcatttcggtcccttctccggcgatctccagcggcaatggatctcgacaagtctacctccaccagcgcgtcgctgaagaagctacagaaggatggcgcccttcccggtcgcgggaccatggagagagaagtaggaggtactgaaccccagcctgtcctgggtcacatggttgcgatcgaggactatattctctgtggttttcttctccgccttctgaatttcttctcttggtcttgaatttctacggcctttccttgctccatttgaaccccaattccatcgccttcctcagtattttttcgcatcgttgtgatgactacattggggtacagccgtttcttggtcggtttccgactccgggatggcctgaagtcacgctatatccccttccagcgcccttcttctcgtagcaaatggcgggtgaggtggttctatcttcagatagaaaattctgatccagtcttcattgttcctgaggaacaaccagacaagattttcgtcttggaccgcaaaacctcccttgaccccttctcttcaatccttcatcgatgccatcgatgacctccgagtatgaggtttgtcgaggtatgaagtcgctgccgacttcattggtaggcggatccagccgctccaggctcgagcccacccagcctttgactattctgagtcggaggacgcgacccgggtttctcctcagggtatatttcttgtatttaaattgacttccttatgtgcgtgttcctcctgacttatcgaattctagttctcgatctacaggtttgaatagcgaaaccgtggagtgctgcgtcggccaattgatgatcagcggcccaacaacggcgagcaacgttcccgtcccctttgcgagaagggggcagccgaacgcgaaaccgccatcaatgtaagtgtactcggtagcccttttgcatttttcttccaagatcgcattgtgacttcatgaagtgtaggctctccctctgactgatatcatcgggccgctcgtggaccatcaggtggcggcatcgctgaaggagaaagtcgccaaggaggcatctgatgttgttgccgctgcggccacaacgagtggcggcaacgttccgtaaaagggaaggcaattctcctctgtgatcggacatcgtcggaggacgcccaccccctcggtaagttctcctggtccttcatcgcgtagtcgggaatcttccacctcatatcacgcccgttatactccaggcctcggatgcgtctcccccgcctccatgacggcagcggcttgtgacgcttggcgagaagtaagtggatgaactttgaggttttatcacttcatcgagctcttgcagcatgtctcaattctagcctttcacagggcggcgcgggcgaaagcggcgcaagacgggtccggagggacttccagcgcgtctcctgctatggcctcgacagatgtcgtggtcgtacccaggagccacgaggtgacgccgagcggcccagccagcgatctcgcggcaggtcggggtccgccgactgccgtcctcacatgggaggagctccaggtcgagatagggcgcctcctcgaggcttgtgctcgcggtgttagctgcgagatcgcggaggcgagggcggtggcggcgtcgtcggcgaatgagcgcgccgaccggctgacgcgtgtctggcggaggtacgcgaggacctccagaagatgagggaactggtggccggcaacgagcgacaatggcaggggctcgagcatcgcatgtcagagctcgagaacaacttgtcggaaatccgtggctcgttgcgggtcacctacactggtctgcaccagctcgccggggagtgcggtatcaagtccaccatcccggcgaatcccaatgagttctcgctgacgacttcgcttgcggagctagcgacggcgatggaggcgatcccctccaagcacgcggccaggatcggagaggagacatctaacgggatatataccggggcatgccatgtccttgcgtgtgtgaggttggcgcatcttgaactcgatctccagaagatcttggatcagggggcggccagcgacgcgcgcaaggatgtgatggaagaagtcggcgatctgggggagtccctcctcccgctttttgaagagtaggatttcgacccccttgtactctttagtcatgctttgtaaaaccctcattagttctaaccgcctttgtgcgtgcagtcatcaccttagttttctttagcattttgatctcgagtactttgttgtcgtttgtagaggtgttgatgtcgaggatgtccagcagcgcgggcagcctaagttgccagtgattgttccggcacttgcgttcgagccacatgtgccggagggcgatgtagatcaaaattcgcctgtggaaatgggcatggcgacgactcccttaggttagttatctttgttttcatctcctttactcttccgtctggatcgacttgatttgttgtattctcgggagagaagagcagtttgacttagtcgtttccatgcagagcagacctcgagagtgcgcttgctgaccagcatcgtcgcatccagtattggaggacgaagtttgaggtcgtggaactcgagaggactatgctggaagtgaagaaggaccaggccgtggagacactccgaggtcgtgaggtgtcattcaactcgtatctgaggagttgctgcacatccatgtcaagagtctgtagagagctccgagtaccccgtggggatcccgaggaatcggcggtcggatacatctcgtggctgaatggggcctgcgcccagctcgaaggcatcggccagcgtgtcgacgaggccctgaagcaggagtgtcatcgatcaagccgatatgccggggggcatgtattggcttgcatacaagatcatcgtccgtagctgcacctcgagttcctccacaaagggttttctcgttctcggagaactcctacggagatagacggcctggcgaagtcgatggcgccactggcggagaaggtcttccagtcatggactggcgttggtcttcctggtagtgtccgtatcctgtgacaaatgtcttagggaaaagtgtaatataattttggatttttatggaattgtaagaagtacttgtgaaatagaaaagaaatctatctaactaagctttcttactctggacgtagcgtgtaagagtgtcttctcactttacgacttcgatcagtcgtttgagttatacactctccctagcccccagccttgtcatcggagaattcttctcggaagatatggctctcggacctctgacctgcctcggttgaacaagcactgatcctagcccccagccgtgaggttggaaaattaatttccgattacacagcttggttaatacgtacggtgagaactcttacacgaccagatcttacatggtcttttgtcttatcttacatggatccgacaatgccttatcggctctaggcgtccccagccgaagttcctttaggttcctcggaggccttgtcaagacggcgtaaagggacatgaggataggtttcaacgctaggtgtcatctgggtaagggatcatcaggaaggaatactttgattgtaatatgtacctgaaaataggcttaattgaaactgtaagatgtcttacaagtatggatactattgacttatacatagaatttacataattgatcaatgttccaagaatatgccaactcacgaccatcgccgtctgcaatcttgaatgcgcctggccgcaaaacttgtgtgatcgtgtacggtccttcccatttgggtgagagcttgtttcgccctgcttggatttgaaccagtcggaggacgtaatcgccgatcgaaagcgtgcgtgctcggatgcgcttctcgtgataacggcgaagggcctgttggtagctggctgctccaacagcaactcgttcgcgatgttcctcgagtagattcacatcatcatttcgctgctcctcctgatcctcatcggagtacttctgtactcgtttactttgatgtcgtagcttggtggggagcatggcctctgaaccgtacacgaggaagaagggtgtctccttgttagacgttgtcggtgtggtacgcacggcccatagtactgatgggagttcttcgacccacttcttgtcatgtgacatgagcctgtcgtagacgcgggtcttgattccttgtagtactatgccgtttgctctctcgacctatccattgctctgagggtgagaaactgaggcgaagcagatcttgactcccagcctgatgtagtaatcctggaaatcggcactgatgaactgggagccgttgtccgttatgatacggtgaggcaatccgaatatgcaaaatatccctttgatgaatttgatggcgttgtcggccttgatttcccccgtgggtgtcgcttcaatccacttagtgaatttgtcgatcgccacgaataggaacctgtagccctatcctcgtgggaatggcctgagtatgtctagcccccagcacgagaacggccaagtaagagggatagtctggagtgcttgcactggtagctttgtgtgtttattgtggaactgacaagcttcatactgctggaccatgtcgcaggcgtctttgagggcggttggccagaaaaatccttgtcgaaaagcttttccgaccaatgtccgaccggcggcgtgtgacccacagatcccttcatgtatgtcgaggaggagatgtctactgtcgtcggacgagacgcattttaggagtaccccgtttggtgccttcttgtatagatcgttgccgatcatacagttgatttttgctttatgggttatttttttggcttctgcgtcgtcctcgggcaactcttcgctgcctatgaatttaatgagtggggtgcgccggtcgtctgtggtctcgatatcggcaatggcgcgctctacctctgtagcccccgagctgatgttgagggcgaccgggctatcttcgccgcttgcctctttcactgatgggcttgtcaggacgtccagaaaggtaccaggttcgagtggctctcgtctggacgcacgccgtgctagatcatccggctcgatgttatccttgcggtatagatgtcggacctcgatcccatcgaaccttttttccagcttcctgacttctgcgagatacttggataactcggggctagagcatttgtaatctttatgcaccttgttcgcgactagttcggaatcccctttcacaaccagtcgcttgactccaagtgcagctgcagctcttatcccggcgagtagtccttcgtactcggctgtgttattagtcgccctgaagttgaggtgaattgcatgcttgaattgatcttccgaaggtgatgtcaagatgaatcatgcccctgctccttggctgttgagcgcgccgtcgaacgccattatccacgtttcgttgtcgatttggttgtctgacctgttatcaggcatagtccaatcagctacgaagtcagcgagtacctgggacttgatggctgttcgtggcacaaagtggacatcaaactggcttagctcgactacccatttcgcaatgcggccaacaacgtctttgtttctcacgacttcaccgagagggaaggaggatacaactgtgaccctgtgggcttggaagtagtggcgtaactttcttgatgtcatgattaccgcgtagagcagtttttggatctatggatatcttgtgtttgcgtcgtggagggcttcgctgacgtagtagactgatcgttgcaccttctctctctcgacaacaatgacagtgctaacggaatatggcgtggcggcaatatagaggaataattcttcattaggttggggggcaacaagtacagggggatttgataggtagcgcttgagtgcaatgaatgcctcttcggcttcctgtgtccatacaaatttgtcttgcttcttcagcagagcgaagaaaggttgtcctcgctctcccatcctagcgacgaacctgcttggtgccgccatgcatccggttagtttctgtacttccttgagtcttgtaggcgacttcatgttctcgattgccttgatcttctcgggatttgcttctattcctctgccagagacgaggaaaccgagcagcttgcccgatggtactccgaacgtgcacttctctggattgagcatgaggcgatatcgtccgaggttgtcgaacgtttcctgcagatcgtcaatcaatgagtcacttgtcctggtcttgacaacaatgtcatcgacgttggcctcgacattgtttccgagttggtcgctaagtgcgccctggaccgtgcactggaaagtgtttcctgcggttattagtccgaacggcatcttaacgtagcagaataccccgaacggcgtaatgagtgccgtcttctcctcgtcctctttcgccatgctgatttggtggtagccggagtaagcgtcgagaaagctcagcaactcacaaccggctgttcagtccaccagttggtctattcgaggaagagggaagtgattcttgggacacgccttgttgaggtcggtaaaatagacacacattctccatttcccgttgaccttccgcaccatgactgggttggctagccactctggatggagtacctctctgataaaaccagctttgagaagcttgtcgagttcttctcgtatggcttgttttcgatctggtgcaaatctcacgcagtttttgctttactggcttggcgtccggtcgcaccatgagtttgtgctcaatcacctccctggatacccccagcatgtcggacggctgccaagcgaacacatcagcattgtcgcggaggaaggtgatgatcgcgagttcctatttctcgcctagtgatgccccgatcttgacggtcttgtcagggttggcactggagagtggaacgattttgattgcaccgtccggtttcgccgtcttgtttgttttgctcactttcttgggtggctcagctgtggtgggtgggctgggcgtgtgctcgaccatgtcgaggctccgcttgtcgcattgcactgccagcttagcattcccttgaatagtgattgttcccttcggtcccggcatcttgagcacttgatacgcgtagtgagatgcggccatgaacttcgcaagtgcaattctcccaatgatagcattgtatgctgtatcgaattcagcgacatcaaaggtgatctgctccgttcggaagttatttgcttggccaaaagtcataggcaacgtaattttgcccaatggtttggacgatgactgaggagtgattccatggaaaggttgatcggtgggtgtcaactcgcttcgtgggatccccatcgcgtccaaagtgctagcgaagagaaggttgattgagctgccgccgtcgatcagaactcgcgcgaccttgatattccgaatagtgggttcgaccacgatcggatatcgccctgggatgacagcagtcttggggtggtcctcttctgagaattctatcttctgctcagaccactttatcttgggcgcagctccctgccatgttgaacagacttcacgttccactttcttgtattctcgctttgaggagtatgctgtggaacctccgaagatgtgcgagacatggagatcagagtctgggtatgctgagtccgattcctgagtagccgccttagcgtccttctcggccacacgtactcgcttgcctttttccaatgccatgtgttttgcgagcgactttttgaagatgaggcaatcttctagagagtgtctgtccgacttgtgtatagggcaccatgttttcttcgtgtcgctgctttgtgggtctgggcgcttgggagggtccgcgtattctgttgcgagaacttccgcttgagctttccttttcccactcttgcgatttttcttcttgcttgactcaggtgcgtccttggctggtttcttctctcctccggtctttggtttgtcgttcttgcgtctcagtgcgtcgtccgcgtgagcacatcgatcgacaatttcgaataatctccgagtagtcgtgacacacctcgttgccaactcctgggtagtatagcgatctctgacaccggacttgaaggcgcagattacagaagcgtcggtgatttcggggattgtatttctgcactcattaaagcgttgaacataatccttcaaggattcacccgggttttgtgtcaacgcatataggtcgtcttcgatcgtatggcgcttgtaagttccttggaagttggcaacgaactgctgccataggtctgcccacgaagaaatcgagtagggcgggagatgcatcagccatgaacgcgcagagcctttcaatgcagttggcaaataattcaccaacacgttgtcgtccgctccggcagcgtagagtaccgtggagtaaacctggaggaattcttctgggtcggtactcccatcgtacttctctattgctcctggtcggaatctcttaggccatcggacatcacgtagcgaacaaccgaaagctctacacccagcgctgggggtggtgggttgtcggcgatcgtacgtccttcgtggatgtctatctgatgatgaggatgaggaagatgacgacgatggtgatgggtcgcttggttgcggtgtatgattacgaggacgtcggccgggttctcaagaatcctgtcgtcgtctcccattgttgtctcgacgccgatctccatcgtcgtcgtcattatggcggcgtcctcgaccagtatcgcctagcgcccgccgttcgcgatcgtcgtgatcgtggtggtggtggcggttatcacagtctcggtcttcgctcgaacggcctcctcgttcttcgttatcatgacgccgtgaagagacgcgatgtcgggaatggttctcgttgtctcgtgcgcgtcgcgcctctcggcggccattcaggtgatcgcggagatcgctggtgccgcgaggtggagggatggctcgatgaggcgattcccgctgttcagggttttcgccattagcaccgccagttggtggctgttccgggtgcgctgcagcagcggcctcttcgaacgcgttgctgaggttggtcactgattcccgtaaccgttctgtccaccgtgcgagatcgtcgttcagaacgggatcgtagggggtttccgtcagtattgtgttgacggccctgatgtgctgggccagtgtagtcacttgattctccacttccgcattagcgtgcgctgacgtgccgatctcatcgatagccaatacctcgcgcggcgtactcgttgacgatgagccatagtcttcgagcaggtgcaggactgacggttcgtggggatcgatgtcgattaccccaacgaatcggtctgaggttagcgtcgctccttgttccttgtcctcatcactgatggggatacgtgactgctagaccttaggaggtgacgtcttcacggcgctgagaaagaccttgcagcttgagaggtcgtgattctttgtctagtgaataggacagtagacatcacgagttggagaagtatgctgaattccacgctctttgcaggcacgaatttcagcgtggacattgagaaagacccagcaggcttgcaaggtgtgttttctggttttgtggataggacaccaggaccttgtcacctcggaagtgatcctcgtcggctcgtgattcttgtcagaaagacaaggtttggccgcactaggatccttctcgggctcggatgttgtcgacgttcagttctccgctttggcgggaggatccttcgacatggagtcgtcctgggttgtagccactgcgttctcgctttcgatcattgatggaccagccgagatcggcatcgtggcgtaaaccgggaagacgatttcgccgacttgattccacaccagcattgttgaagcaggaactccttggttgaggttggtgttgacgctgttgtcgacgaagctggatgacatagttgtagaaccctgagcaccaagtccccctacctggcgcgccactatcgatggggaatacccgtagaccggatatagagggtactagggtatgctggtacgaggatctatgtagtacgacatcaagcagataaaaaaacaaagattatactggttcaagccccttgataggtaatagccctaatccagttgatatgagattatatgatggaaaccacagattagaaagggaattgcggaactcgatgataccgacgagattgtaatcgaacaggttcaattagatctcacggcgacttggcttctgtaggcttcaactccgtaggctgtggtggatgtgttggctatgagattcgatgccttaggtcctcccgggggtcccttttatatcgcaggtcaaccggtctccaagtaggactcggagacatcgaacccgacacgatacaatgacgacccagttctgtccgagtatgactccttccatctgtgaactccgtgatgaattttcttaacgtatgccggaaccgtccgtattcgcgcaagcatacaatatcgatatgtgacgtatatcgaagggtagagggtataccttacctataaccctgataacaaccactatgcataaacttgtatggtagatgcaaatagatgcaatatctatttggccggatagatagagtaatatgaaataaagacatgtgaattgggtgaaaatttcttaaaaccctataaattggatgacaaattatcggtctgaatataggatacctcgtactcatactttgagtacaaatataccaaaatatacaagtacaagtatgagagatatcccatatccagaagacacaaatagtaaacaatgattacttactactatcttcgttttttaattagtttttactaatacatttaacggttggctttctcaagcaccaatattttgagcaaaagtctaagaaaagcattccgtagcgacaagagccgcagaaagtgaaaaactaccgtagtgaattaggagcgcaacaaattaaggggtaaactgacgacaaattaagggatctaaggtgaacttattccataccgtaggaggaacccgcggaagagatccagcccagtagagcccaacctggtacttagcagccctgaccatcatcagaagcatggggctgcaagttttccctgttataattaggagcgcaagctgcgcaacaaatgcgactgtaaattctgtgattaagtattaactagaaaatcagcatgtttgttggcgcaccgaccagttttacttttatataagtttaaggatcactgcagcatatgagttttcgtaaaattcgttaaaaaaatcattcaaacatctctatggattttaattcttcgtggaactaatcaaattacagtggggattgtctacagtgttacagctgtagtagcagccgctgacatgtgaaaccggcactgctactgcaaatacagtactgcagagcatccatatccatcaaattaggatagtaatatatggctgaggatggcctgtttaatttttacctagctgtgttcggtactcttcccaactctcctctctcgttttccgcgcgcacgtttttcaaactactaaacggtgtgtttttttgcaaaaagtttctatacgaaagttgcttaaaaaatcatattgatccatttttttaaaaaaattagctaatacttaattaatcacgcgctaatagaccgctccgtttccgtgcatgggagatgggttcccaacaccaacctccgaacacagctagagtacatttctctttacgcaatcttttattagatatttctctttaaccattctttagccaatatttttgttttcaaccagataattttacctttgttacactttggatcaccgtgactattcttaaccgtacggatctcaaatatactagccacttagagtcgcgcgtttgcgcgaccataaaaagccatctttgttaaagattaaggttgccttttttttcctgttgcaactaaaatgatcttggccctaaacattaatacgaagttgcccatatgttacatacatgaccaccgtagtatttctttttttttcacagaaacaatttatactacctatgtttttaataaatgacgccattaacttatattcacacggttgaccatttgtcttattaaaaaatttacatatttctaatttattttattgtgagttgtgttacaaactgaaagtacttcaagcatgatatatatcttatttatttaaaaaagaatttggaagacaaatagttaaatatgtatctaaaagtcaatgatgccatatattaaaagacaaagggagtattgttttacttggtccatgtgtcaaatttcaaaaaaacccaacttatgaaattgaagcccattaagtttcataagtgtctatctgtgttgcttgctctctttcatgctggcaagtacgtgaggagaggcactagaaggctccggagggataatgcagtacgtatttgatcggacggtcaacatttatccaatcatgcatctgatggcctttgttttttagcttacgtggcctaatgtgcttttgagaaagattagttccttcattactttagactagctcctacttgtcaatgaaatcccatagccgtatgtagataatttctttgacatatgacaaattaaaatcatatggataaaagacttgatagtggttcaaggtatcacaaatgtcaaattattcggttcaaattaagtgaaaattagtttaaaggtgatgcaaagcgaacattgataataaagagtagcctaaagtgaaattcactcttacaaattatacttgattttaatttcaacaacttatttttcgttatttttgttaatacattttttttattttcaagcaatatataggacataatagacacaggtaaactacatgcctcaatttttgatgaaacctattacattttgtatttggatgaagaaccatcctagcaaaatccattgtatttgaaaaggctaaaaatcataatattccttgtttttctctctctttttacttctttaactttcatctcctcttctcttttgtatatacatttttaatctttacaaatttttttaagcttctttcatctgtaaaatgtaagtaacttatctatatcttatcacttctatattttagagtttgtctacattattttttccacccctcgtaaggtgggcagggaccaagcccgagggaagcttcacgcctgtgcttgccccgtttcggccgagcaacgtgccgtcgtgccctcgtgaaagcgccgtactcttatcctagcaaataaaaggcacactgttttttttaacaaaaatttgtgtgtacataactatcttttgataaaaatggacatatgagatttagccatatcattaagagtacattttttactaatgatttaatctgtgagtaaaatttttcattggctgcaccctcatacacaggaaccatatattgataaaaaaagtaaatttcagccacatcaatgcctcagaaaatttgacattttgatccaatctcaacttacactatagatggtaagtcatccagccgcaagtttccagcagtgatagataggggtggaaacgagcctagccaagcctagctcggctcggcttgcagtggctcgcaacaaactaggcttggcttggctcggcttggttagggaaacaagcttaaaacttgagctcggctcggctcgtttcctggctcgagccagctcgagctggcttgtaagacttcctgttaaaacacatcttcatatatattttgtaattattaaaaaaagcaagaacaaattattaacatgtaaaattaaaataaatttatggtaaatttgaagttgacaaataataacgccatataaaatgaaataatcgatataaacacaaaatggcctaggctcgcgagccaaaataagcggctcgcgagctagctcggtttggctcattttagcaacgagctgaaaaggaggcttgggcttggctcgtttggcttacaagccgagccaagccaaccaagctcgacccaagcccgagctgagctcacgagcctgagctttttttccacgactagtgatagatatttggtttggtatgtactctaacattgtaagcgactagtaatttcgttgagctctaatggtcttagcagctaattactctctacactaatatgaccagagcaggattatacttttttaatttatttctgcttttggcttaagatggaaaaactaccccctataatccgctggatcagattatctcgcgacaacgtcaattcagtaaccacaccctcctttctttctgaacacacttgctgtcgataaccatccaagacccaactttatttagcccatctcaatcagcaacacaaatgaccctgacccacgatccactcacaagccattgctcgagatttgagcttgaactcttcttggcgggacccaaacagtgcacgaatttcagacgcattgcataatcaaacccccaaaaaggaaaaagccgtcgcctttcaccaagttcgaattatttttcgcctttggagacggcacaaaaggcaagaaaacggaggaggaaaactaggccacgcattgacaggatcttctcccttgtgttcttgctgcttttctgctccatgtcctgctcttggagatggccatggctctggctctgagctgtggcaggaggcagagagggaagaaaggcggcggcggcggcggcgactgcggcggccgccatttccatgtccactaccatcttcctcgccgggtctgcgcctcctcgtttgttcccaatttgctgcctcgttttttctcgctgctgtcagcttgcgtgctggttcctcctgtgctgttcttggctgtgcttgccttcctcgtcttgtttctctggttcaccttgctgtattttattcgctccctgtggaacaaagacatcaacggtgagaccttcgagaggagtagcaacgatcatggcagcgatgctgataaacgccttggagaaggcgttgcagaagaaggaaaggcagagaagaaaactctgaagatttcgtctgaagattgtgctagaaggtttgagatagaagaggtactacatgttaattctgatgattctcaaaacttgcctagtatggtgtcatctgatggttgcctgaactgtaagatgcatactgatgatgaaaaactcatcaaagaggtgactgtctttgagataaaaagaagggaatcgggagctgctattgtctgttctgatggtttgtcacaaaagcgtcagccacgagatatgtcagttgattggtttgaggaagaaactaaaagtggagatatcatcaaatcaggtgattcatctccaactgtactgtcaactttttcatctgaatttcatgatttctctgacaacaatgaagtggtagggttggccacggattttcttgatgtaaacaatcaaaataaagcagtattgctagatagttcatctcatcgtggtatcatggacaatcattgcaaatgtggtgaggaattttcttctgataaggaggctccagcttaccatttatttgaaaattatgattttgttgacaagcatgaaacaaaagaggtggtacttggtgatacagtagtcttgacctttgtagatgatttagccaatgatgactctgaatatagggaggatatttcagaacaaaaggatccaaataatttatcaggattgcttgataacgttgcagatattttttaccagcagcaagaaatacataaggtggttgtttctgacgacaacaagccacctgaagttttgttcctcagtggaaagcaaactgtcagcagttcaggtgaatttagttctcctaatgagaatggaacatcaggatttccttttgattctgtttgtgaagataaaaatggaacagtggcctatcccagcgtagcatcccattataatatcggtattgaagatgacaaatgtgaggatcatactgacaacaacatagaggaggcatcaagtatcgcatctacaaattgtggttctgctgataagcatcagactatacaggtgttgcctgtttgtttagcaaatggagataacattgatgatgttgcttcattggggagttcaatttgtgaagacgttgaagataaagacaacaaaagtaatgctaattgtatttcagaggtgagtacaaaaggaagtttcgcttaatttctgaaaattgtggctgttagcttgttatatatttctgaattttactgctattgtatgtttcaaatgaatttgaaagggagctccacatggaaacggaatgccacttgttaggtccccagcatcatggtggaatttatgtggagttattgatgtgtttgctggatgtaaagattgaattgaggtgagaagatagttcattccaattttcacaccgtgacatcgtttgaattttgaactgagggtactccttttaaaacaaaacaaaaggaatccagctgcatggccaattattttgttgatcatcatctgctgcaccgtgggttcgcacaattgttacttatttattttcttgtcaatattgtctaacacaagagagatttttcttcggtggtttttactaagtatgatactacagtaaaaaaactaaattgttgatttattggggtataatggtattttttttcctctctatatgatttgggttttttatttccctttttttccccaagagactggcgttactcgtgtggaccaccagcctatctcacttaaaacgaaatataccaattttactggaattttgccatcctgcaagtatcatttccttttctcacccaaccccgacatagttcttagatgattgcttgattacaaagaatgatctgtaattttattatcgtcaactctcttcgcagtatttggacatgacacattttctgttgtatgcagatgttggcaggtcatgggtggaactttgggacaacagaaaactttagatgctcatcctaatcctgtgttgacaatgaagaagtatttgacagtttggattgaggtattgaattgtttatagtgaggctgtttgttttgttggatgtatatatttttttgttagattgcctgattagtttttgacatgttgtggttcattggctttttctttaaaagctgagtgctattctttctcaagaaagaaagcttcaacttactgtaattgattttgaaagggaaatggaactggaaatgcttgttgacttgttgtatagtgtatactatatgctttgagaaatatgtcttctacagttgtctggatgtacagaaatctgcctgctacattaaagcctacgtatttttaacaagaaaaaataaggcattttctatcccaaactaatttactggatcacttaacccccctgaattatttaaaaaacaagaagaatttaaaaaaatgttgagatgtaagttacaatgcatataccattctacccaaaaaaaagagagagaaatagcgtcagggagtaaagtaaaatttttttagtagttgggagtgtaaaattagcaaaaacaactaatttaggggttgatgtgtctgaaatagttcctggcgagtaaaatgaactttgtttttctttttaacaagaactaggaaacctgccagatcaatattaatcgacggctgtttcgctgtaagaaaatgattattctatcttagtctaacaacataggcaacttgttctggagatgaataatttaataaccacagtaaaacttcacttatcgtttattggcatgtggtaaagtcaaaagaataaaatgagaaaaactgtagaatgcaagtatgcaacaattaatagtagcattgcatcgtatgtgtcagtagaaatattccccgaagtgattaatcctaaccctatatctgtaaagcaaattaacaacaacaatcatatctctactacttaaaataaaaaataagaggtgcttccatcatccataaaaaaaactggacgataaaaaccaaatataccaaatatgtccgtaaaaaaaaccgcgtggaaaaaaaaaggaaaaaaaccaaacctgtccaataaaaaagggcgaaaaaacgaaaaaccgggcgaaaaaaccaaatatatccgatctagaaaaaatatctgtaaaacaaattaacaacaacaattatatccctactacttaaaaaataagaggtgcttccatcgtccgtcaaaaaaactggaccgaaaaaccaaatatgtccgtaaaaaaaaccaggcggaaaaaaaaggaaaaaaaaccaaacctgtccgattaaaagggcgaaaaaacgaaaaaccgggcgaaaaaaccaaatctatcggatccagaaaaaaccgggtgaaaaaaaaacctaaacctatccgatcccaaaaaaaaaaggggtgaaagaaaagggaaaaaaaaaccggatctgtccatcaagaaaaacgaatccgactctgggtaaaaagaaggacggaaaaaaattaaaaaaaaaaagaatcaatccgattctctatctctaaacgaaaaaaatccaactctatatccgattcctccttaaaaacgaaaaataaaaggcacctctcctctaggaggattggagatctgtttgcaaaaacataacctacatgttaagagcataatatttttatatgttttaatttttgggtatgtacttttgcatttgagtccctgtaatttttatatttatatttaagtccctataatcttgcaataaggtatttgaggtcgttttttaaaaaaaataataaaagggagataacaaaggcagaaaggtgcatcaaaagaaaaagaaaagccgcaaaaaaaataaaggaaaaaagaaaaccaacaacaacaacaaaagtctgtttccctaagtggcaaaaaaaccatagatccgaaccaaaaaaatcctattcctataaaggcaaacaaaaagtggtgaaaaaaagctagatccaattcctttcaaaacgaaaaaaaaagtctgattcctataaaggcgaaaaaaatctgaaaaaaacatctaaaaaagttcgtccgactctctaagaaagtggcaaaaaaaatggtttgtaaaaaataaaaagctggttcgtataaattaaaaaatgaacgcgagaaaaaaatagaatgggtgaaacaaagtctcagtatatatctcttctctatttctaatctaatctaactatttaaaaagagaaaatgcatgagaaaataaaaacggttcaaaaaaacgcgtgagaaaaaagtgagaaaaaagcgaaaaaaacactctaaaaaggttttccatcttccataaaaaataaaaaaacatgtgagaaaagttatttccatcgtcgatttttttaaaaaaacttgcgaggaaaaaaactggcagaaaaacgtaaacctcgcaagaaaaaaacaccgtctattaaaaaaacaaatcgctttgaaaatactattagaaaaacgctaaattgatggacgcttgagtcggatagaatccatcaatccagcagcagccgccgccacgctcacccgccaccaccgcgctcgcctgccaccaccgcgctcgcccgccgcccctgcctgcttcgcccgccgcgcgctcgctcgacggggcggcgatggctttatggagacgtgacggcagcaggacggaatgtgagggaggcgccgagcgagacggtgttcacagactccgtcgacgggagcagctccagctctggcgccgcatccaccgacgagtggccggtgacgatgtcaccgcccaggcgcccatgaagacggtcagcagcgccgctgcgggttcatcagccactgcgtccttctgcaactggcgtccctagaaacgacgctggcgaggctcgaccgacaagtgatccaagcgagaacatcttgagctgaaggaatggccacccgaaccgtccacgtgggaatggctccggaacggtggggacgtagagcgtgagctcctcggtgaggttggacaggctcgtcatctcgttgacggcgtcgccggatttcctcggatagctcagcagcgaattggcgatgacaatgccgtagttgaaccgcttcgctggaggaactcgccgaccagcttgaccttggtgtagcggacgccaagctcagctgctcaccgccggagacgccgaaccagctccacagctcgatggggtgcaccgtccattggaatgtcagcggcggaaagcggcgctgccgccatcgccgtggggtgatctggcccatcatgatgctgccgtggtgccggggaaggtggtatgtgttaaataaatgaacttctgtcagttgggatttgatcttatactcttatttactttctgttagtttgttagctattttccctcctcccatggttttctgctcgctctgttttgagtcagcgtggccgcgatttgttcggtcaagtggtggagcttgacgagcgggagagtatcgagctgagaaaacgagcagcaccatgaactagcgtcggtgagcaccacctcccttctgctcgagctcggttgagggctgggagcttgacctccgtgcccaccgcccaccgcccaccgccggccgccgtcgcgccgccgtcctcctcctctcccgcctcgccccgtcgatgcccgcgttgttcgcgccttccagctgcccgcgacgcctgcacacgcccgcgcctccctgtcgacgcctgcgcaaggtcgctgcacgcccgcgtcgtggagctccgccgggctaccgtcgggcatccccactgtggccgccgccggcggccgccattgcggcgccgcgctcctcctttcccccctcgctccgccgaccgacctacaggcgcagagagagaggaggaaccaaggaagagaagaaggggaagatagatgactcagcggactcagcctgacatgtaggacccacgtgggtcccatgctaaatcagccgtcacgtaggacaaaactggtgtcaaaaccaccgaaggacctattgtaaccggtttttattagttaagagacgctgaatatctggtttatggttggaggacgattttgtaactccatcacaagttggggaaccttctgtgtactttttcctctttgcaatcaataggtgtcaaagtgtcaactgattttacgtgctgtttcaaaaaggttaggatcactttcattacttcattcatagtacatctctagtacggattattattaattattagattagtagattgaatcgggtgctgccaaataaaatggccgccgcaccattgccactgttcgccaaagctcaagagcatcggttcctctttcctcctggttagttcttctctctaccgcttcttccgtcctgattcttgctcgacatccccgttttgagatggccacgccgcatcagttgaacggcccaacaaaccgcgtggggtgccgctggcattggctgcgagccgtcgataggcaagcttcaacgctcttggagcgcgcgtgcagcgggcgacaatttagtcactggctcaccctctctcttccagtctggctttttagggcccatttgaatagcaggaatggaaaaacgaaggaatatgaccctctctcttctagtctggctttttagggcccatttgaatagcaggaatggaaaaacggaggaataggaaaaacgtaggattctgacatgaatgcaggggtaaaacagaggattggaaaatacagtaaaaaacaggaatgaccgtttgattggaccacagaaaaaacgtaggaatcggatgagatagatagactcaaaggaattttttcaagaggttagacctcttgctaactttcctctaaaatcactataggattagccatttcataggaattttaaaggatagtataggattcaatcctttgtttcaaaggcttttataggaattttttccataggattgaaatccttcaaattttctacacttttcctataaatcaaaggggaccttagtctacgtgtccaccttgttgtcggctaattgctctctattgtagctctcagtgctcatgccatggaagctgctaccggcggtcttctgcattatgctgccgctgttagtgatatgccctagaggcaatcatagagatgattgtatcacatactatgtttacatatttttccgattttgttccttgaaatagataaactcattattggttaatgaatatgtgattctttcataagactttttatgttatgtgttgctatttctaaaggatccctgatcaaatatcatatgtggaacaaatatgtttagatgatcaacacatgtattaattgatgatcatgtctcatggatcatggtatagagataccaaattaataatgtggacacatgttagtgaacatgttgttggatagacccaacatgagacactgcaagagccatatgtgttgtgtcatcagttatctcatttagtgttggtgttgaatccttagacctgagattatcatggttcccaacatgtgtagtagcttacttagggactgctaaacgctactccgtaattgggtagttataaaagtagttttcgggtatgttatgaaacatgtagtgggatatgaataatcaagatgggatttgcccatcctatagagagatatctctgggcccctcgatgttgtagattatggaaatgcatgaccatgccaaaggtgattgaggagtcaatcataagttatataatctatcaacaggttcgagtgaatgattgagctattagaggatggcacatatctagccttgagcttaatcgatatcatgaggcaaaagggttcatacaagtatacactagaggttcagccgatctgatctttatgtatgcccggtgggtcaatacgttctgctaggggccgctgttgacgcgtggaccgaaaatgagttttcgggttacagccgagtatatatgaacctacagggttgcacgcttaatgggccggaataagggaattggatagagatccaatatgagcttaatgtggataaggatccgaataggagtcctacgggccttggaggcccgagtgatggatcctatatattcgtgaggggtgtgacaggcggaggcattgcatcacgtgagaaaccctagccgtcacttccctccccgagcaaaaccctagccgcgcgcgggtgctagcacatctgtgcgtggcgttccgtccctgtacgtgtggataccagtaaaggctctgctggtttgcggtgctgatcggcataggagtacagcgaggagaacgcacgaggaggagaaggtcgagccggtgcgatcgactacttcctctacatcgacgcgcgctacttcgcgagagttccttcgacttctcagcgtcttcttccgctgcgcagtgcgtcgagtggtaacgatctatgatctaatacttgcatggttcctggtttacgcgatagaaaattttgatttatgctattgtagcctacgcgtatcccaacagccgcaacggcgcaaggtcacctcgcctccccacaacagtgcaacacttcgccacagctacggcccgatgaaagttcaagtgccattaatttggttttggtgattaatgataaatccaattatgaaactaatgttatatgagcatttatttgccttgcctcgtgtgaatatgaaagtggaatttgtgagaggtgattcctagacttcatatgagttgagatagaaacgttcattgatggtggatctaaataacaaggattgcatggagatcaagctatatgtatcactctttctctccatgcacatattgatatagttatatagaatattccatgtgattgacatatgcatgtgagtctaatgttttgtttgagtcttatctcttatttagtttatttacattgagaacgtggagatgatgaaggtatgcatttattttaatatctatatttgataaatgccttctattttttataggataagcttccaatgtttcatctctatttatgcatactcttgcttcacacaaatattccgtatgcatatatttaggggagcaaatcctataccttagttatgaatgtacttgatccatgttattcactttcgtttaattgggatctttacatttaagtatatgacacttggtattaattaatactcatcacttgttcatatcatttaatatacacgatcggttggtcaacatgtggaggttaacaaccggatcattaggactaataatttcattgagttgaatgagataattagatcccaaggattgtaaaggtgttgatgctcaagtgatatcattacacctaaagataccaatgatgacaaagtgaagatattgaagatgtaagatacaaagtggctactatgccaagacggtgaagggcaagtgatgctcggtcacgatggaccatgcggcggtgaagggcaagcaatgggcttggcgccgaagaaccaaatccagtggtaaagggcgggtgacagctttgtcattgttggaggtatgtcacgagggccctcggctgaacttgccaaaactatcaaatcagcgagacgccgactgagtccaggaggttcatctcaagcgaagccaaaagacgaagtcaagagggttcgccaccaagctcggagggctcaccaccaagtttcccctctaggcgaagcctcaagtcgaagcatgaagggtttgccgccaagcccgaagggctcaccgccaagtctcccctctggtcgaagcaggaagggttctccccatggaagaccggcttctccaaggagcccacctagcagcacggcccatgaaggccattcgccttttatgggtcgggccagggtcccgtcaaggggcccatagttagaatggacactgtatgccccttttaatgtcctatcataagggtatccatgtaaattcctctgaacatattgaaccatagagggtatgggtatgtactaagaatataaatagcccctagggacatataagggagcatccccaaaaattttcataaattaatacattatttactattcaaatcactccaccgagagaaccatgtccttcgacgtgaagctcttgttgtttcgacaacagccatgatggaccgtgcaagaccatttgaagctccaaataactgcatcaataatttgaagaatatatggtgaaatggttttggtgttggcgccccttaagataaaggaaggaagatgaaaagaagtcattcctattattatattcctcttcctatttaaatttgagtataggaatgttgtactatcaagagggatgcaacatcgatgtgtttgtgtatgtctcggtgctcaaagtgacctatcatagtgctaccttgggagaaacccaagatttaacctatcctttgattggttttataccttgtttttttgttgagttgggtagtcctctgagtgagctttctatagagtccaaaatcataaaaaacggactcccgagcgaaaagttatggtcgttttactctgtgcttttcgaaaattccgaaaaaaatctcaaaaagtccgaaaatattttggaaattctgaaaatggccacacttccacttctctaggggttgtgccacatcgacagttgaacaggcccacaaaccgcgtggggtgccgctggcatcggctgcgagccgtcgataggcaagctttaacactcttgaagtgcgtgtgcagcgggcgataatttagtcgctggctcggcctctctctcctcgtctctctcctccaacctagctttcgagtctacgtgtccaccttattgtcggctaatcgctgtgttgtactcgctcttaggttattgtgtgaaagttaggaaccacaatcttcccagcggtggtgtttgttggagtcgaacatagctggccaaatgggcggccggcctagcacggcacaggcccgctggtggcacggcccattaggcatgacaactgtagcgggctgtgccgtgacggcctacgtgccaaggcctcagcctaagaaaaaaattgaaatttgaggggaaaaagaaaaaaaggcagaaaatataatatgaaggaaaaaaaaggataaagataggacaaatgtgagggaaatttagaaaaaataggaaatatgaccgaaaatatacggtaaaaatataataaaatatggggaaaataaaaatatgagaaatataagggaaaattagaaaattgtaggaaaaataattgggccgtgctcgtgccgtcctgttgataggcgtgccgtgtcgtgccggcctatgggttaaggtgctgacccacaggccggagtgccgtgccgtgcctaggccggctacagtaaggtcgtgcctaggctggcccagcatagcacggcccatttggctagctatagagtcgaattgttgggcctttatgttcactgtagttgctgttggagtattgggtggcattgggggttcctagctggcgcttacgcgtcgctagcgcgcaccttccagccgcctaactatacttaacactaatgagtgtaattaggaaagattttttttaagtaaccgattgaaaaaaattttaagttagatttagaaactttcgatttaatatttaaattttgaagtcaaattttgaaaacattcaactcagatttgaaaactttcaactcgagatttgaaaactttcaactcagagtcaaaaactttaagtccagatttgaaaattttgaaaactttcaacttgagattggaaaactttcaactcgtatttaaaaactttcaagtcaagatttgaaaattttgaaaactttcaacttgagatttgaacattttcaactcgagatttaaaaactttcgactcgattcgaaaactttcaagtccagatttgaaaatattgaaaactttcaacttaagatttgaaaattttcaactcgagatttgaaaattttcatatccaaatatgaaaattttaaagttaagatttaaaaattactagtaaactaatcattagtaaaaattggaaactaatttaaactaattatcctatccgtacggcaggaacaacagatagaagaagaagaaaaaaacagcagcgtccaaaaaaagaaaaaagagagaagcgcgcgcttgcatgggcctcatgggctaaaacgcgcgccggcaacgcgcgcgcgcgtattagctgtcgcatgtggcattaggctacttatcgcattgaagaagattaactacccgtccagtaaaaaatagtgatgtttggaaatacatgcaatcaacgtgcttaaactttggtcatcaacgtcttcaaatattttgattcacattttggaagtgatatagtgtcacgaccggaaataacccaacgggctttcctgacgtgcgtgcattaatccttgtcccaggaggcaaggtacaccaaaagttgatacaaatcagagtttaacaagcggaagcgtaaatagttaacttattacatgggcaacgaaggcccagcacactcaaagacaacgaaaaacagcggaagactagggcgacgaccacaggcgcttgacggcaggcacgagctagacaccaaagccttcatcttccaggaactcctcatctgggcttgggaaaattaagcaagactgagtacaaccaccgtactcaacaagacacacccacaaatgcagaataaatgcaagggagtacaagggaattataatataaagggttagggttgcagtaaacagcatttaaagacatttagttgctcaaagctactttgtaaacgcgatcctagaacgctacaaagttattaatcaaggccgtgaacccacacgaacctgccttaacccaaggcctatgatgattcagaccgaactggcaacccgaccctgggtcccagctcgtcctaagccaacccaggccaaccattccgcattttagttgttaagcaggttttaagaattaaaacgctaacttgggtacattgctcggcttgcccataaccgagggctcggctattcgaatagattatactctgatcagaggtgtacatctttacccacaagacacatcttcctcacgtgtaaccacgtgccacataccaccacggtatacggacggaagacgtgacatagtttccaacccatcctagccttagacaagagtaccgacccaatcccacctacggccgggatacccgggacaggcaggcagaactgagcccctagcagcagggcaccaaccctctgccgtatgacatctcgactaccgggccgcagctcgtgtagccttcatttgccctggagaatgtccatcgacgcccgacttcatccatctccaatccgtgtacttttgtttatgactagactgagtcacaaactaagccttacccattagacatgtggaagtacggtagtgctttgcaacagaggcccgaagaccggtccttaaacggccgaggtgctaccatcaaaaccatgcaccccgagcccagcctaaaaccattttagggggttttgaatagagggggcggtgtgaagccaattccacaataatccaacaattccagagtgtccaagtgatatgaatatttcccaaagtctatagttgtaaaaccacctaaggttacctaattagattgcgaagcatctacctaaaattatactagggataccatgagtagagtgtccactagttgaggttttgtttgtctagggtgaacaaggtaataataataacaataacaataataatatggtcataacaaaggtaaataggcatggctaagtaaaacagtgataacgcgggaatttaaataaagcgataatgcaataatttaaatcaacataattttataaactgggattcaatatgatcaagatgatgtgtcttgccttgctcgttttcccactcgacggcttcgacttccacgaagagcggatcttccgaagctgcagcgtctacacgac

SEQ ID NO: 36701 - DNA, 700 bp, Oryza sativa
  unsure (1)..(700): unsure at all n locations
nnnnnnnnnnnnnnnnnnnnnnnnnnnnnnnnnnnnnnnnttagtacatatgaacaagacttattccccatataccctatttacatgttgttcgattaatccttttcacatggcaattggagggtattgggcaatcaattaatttcacatgagattaaggagattaatcccacaccccttcaatcgaataaacccttaagataggagggatgtgagctgggttggctaatcagattgtggtgttagccaatagaccctaggagaatcctatgaaaattctgttgagaacaagtagaattttggaagggattgattaaagaaattgaaggacttctacggtacaatacactagcaatatatatttttggcatatacaaagatacactaggaatttccatgtacaagttcgcgtgagcatggtggagagtggggagttgggcatcattgctgctgcctcctccaggtagaggaactagctagggttttgggtgggtcggaaattgagaagacgaaagaaaggcaattcgaattaatttacaggcaggcaggcacaatagcgtggtgcgcgtgaacttgcagtgcgtgtggcgtctctctatggcggtatggcccatgatggacgacaactacgggactggggaatgaaatcaagtgaggaacacgtctagcattgtgcatttatgtacaacagttgtcgggt

SEQ ID NO: 36702 - DNA, 625 bp, Oryza sativa
  unsure (1)..(625): unsure at all n locations
nnnnnnnnnnnnnnnnnnnnnnnnnnnnnnnnnnnnntaactggatgcaacagcaagcagactgtcatccctactgaaagacagagcagcgatgctggatgggtatctgggaaactgcaaccaaaagatgaaaaaaaaaagaactaaggcattctgatgtgaatttgtgatacagaatagagaattagagatcttcaaaaaatagttcgcgggactattacttgaaacagtttccttctgttagcgccatcccaaaggttcacaaatctatcacatccaccagtggcaaatgtgccgtgtctgcatatgttagatgaggccattaaagaaacggaaaataatcaaccgtttgtgagggatcagtggggatttcattacactgggtggaaggaaattgcgttgacaggatagactttggtctctccatcctcaggcactcgatgacacttgaaactatacctggatagaataaaggcatgtaactacgtatataaatggaacacagcagaatatgtagattaaaaagatgatctccggcaaagctaataatatcagcttaagtaaatagctatcaggaaagagttttccttcagcagcttaggtgcatacttcttatagggagggg

SEQ ID NO: 36703 - DNA, 481 bp, Oryza sativa
ctcagaatagttctcaccgtgctgacagtttgctcttctgataagcataaacctcttgtttctggaagatggtggtgaccctggtttccacaggaaacaaaatatttactaacattagtatagtgaaaaacaggagaatcatggattgccagctttggtcaacatacagtcttctctccttccatggcttcatttaaagcctgtctttctacaagaagcaagggaacttgttgttccactttcatatttaggccttcataaaattcctgtatttcaagataaagaggttggcactcgctcgtatccataactgcagaatcaaggcactccaggcagagtttgcgaccatcgtccagcaatacatatcttgattcccttggctgataagagcacaagccattttttgatgaactgatcaaaattttgcaacagcaacatatctgaccaagtatgctgaatcagatttattaattcaaacatg

SEQ ID NO: 36704 - DNA, 608 bp, Oryza sativa
  unsure (1)..(608): unsure at all n locations
nnnnnnnnnnnnnnnnnnnnnnnnnnnnnnnnnnnnnnnnnnnnnnnnnnnnnnncccatattttatttttatataattttcttgaatttaattagagttaattcttattccgacatttttcaatttaattgatacaaatatagtggtaataatattttactcatttctatcctcactaaatattattttaaattgtactttaattatttacttagtcaatttacttttcagggtttattcctaactaattatccattattcgcgatttataaactccgaaatcaaaattcaataaaataatcgaacaaaattggcatgatgcaactttatttaaaaagtttttgaagatccgtatttttagagtttagattttgtcgtcgaatttttagggtgttacaacaaccatactcttttttcttttttctatgttattaaatttacttgtatagaaatagaaagaccactaataaaaaccgttgtacgagtccttagtaccctataactgcgcgattatcggcggtttgaaaaactcttgtggggacaatgggccttggcacaaacgtggcatcggcgcatcgccaacattgtcaagctggcatgaaaattg

SEQ ID NO: 36705 - DNA, 1161 bp, Oryza sativa
acccaactaaagggaacaaaagctggagctccaccgcggtggcggccgctctagaactagtggatcccccgggctgcaggaattcggcacgaggttggcagtttaattaacggtagtaacagtgatttcacatctaggtttaccgctgagaaataaggcaagatgtaacttagtgtactgataaaatcactctcgtcattggtgtctagctgctcactcccaaagcctgacaagttgatgccactgctgtctgagggctcctctggctcaacaatcagctcagtgcttgtgtagttcttccgggcttgtaacaccttcatgaacgctccttctggattccctaccgatgcttcttcagctgtcaaaaaagaagagactgctttgatcatgaaagatgatgggatgggatgcatcagtccatagctgtacaccccagtcacacagagtaggagtcagcaaacattcgagtgccattcagagaggagaaacacacacccaatcctaaacctatgaaatggcaacaacaaaaggagaaaatacatcttttgaaaacacggccacctacttggaacattccatagtgtgacatagagtaactctgtttaggattatttcgttgatccccagaggccaattgcccagtgctcagtcaaagcccaaggtggaagacaagtgcttccctgatgagctggcctctctgcagactgctccgtaccctgtgctgtcctgcctcagatgcagagagagcacaaggctcctgctctcctcgtcctcggtgcacctgtgttcgtgctaccatcacagctgaatgcaatgaaaggcggtcctctaaaaggagcagggtggaaatgctaaagtggaggccccgtcccattgctgatagatcctcatttggcatgcgctccaccctccccattttttgctcccacgtatggtagccccatcacagaaaatgcgacatggaaaaacgccctgtgtcccccctagtttttaaatttgggcagggatttggggtgtatgttaaaagtttttcaaatttgccagattgcatgcctatgttgttaaatacccaatgaatccctggtaaaaaaaaaaaaaaaaaaaaaaaaaaaaaaaaaaaaaaaaaaaaaactcgagggggggcccggtacccaattcgcc

SEQ ID NO: 36706 - DNA, 681 bp, Oryza sativa
  unsure (1)..(681): unsure at all n locations
nnnnnnnnnnnnnnnnnnnnnnnnnnnnnnnnnnnnnnnnnnnnnnnnnnnnnnnnnatacaaaaaaaaacatgggaagggctattaaaattacataaatttgagaagagataaagacttaaaggaaacttcccataagattctacctcttaaatttcctccaaaacttacatgaaatgagacattgtatagaatttcttagaatttaatgttctgattcggagggctatataagaaaaaagtcttataggaataaattctctaaaatttctatgattttcctttaaatcaaaggggtctaaatgtcccattctattttaacatgggatggagggactaagggtccctttgaatcgcatgaatggaaaaacggaggaatagaaaaaacgtaggattttgacaggaatgcaagtgtaaaacagaggattgaaaaatacaggaaaaacacagaaataaccgtttgattggaccacaagaaaaacgcaggaatcggatgagagagatagactcaaaggaatttttccaagaggttggacctcttgttaactttcctccaaaatctctataggattagtcattctataggaactcttaaggatagtattggatccaatcctttatttcaaaggctttcataggaatttttttaataggattaaaatccttcaaatttcctacact

SEQ ID NO: 36707 - DNA, 732 bp, Oryza sativa
gatacaaagacctaacaatttctcaagacaggactgattgtgtatatagaggttctgaccattcttatactaccagagagaagtatttaggttgtgcttgcaaaaaaggactatgaagatgaccacacaactgaatgtactataagaatctcctagaaaaaagaatgtactacaaggcatacatgttccgttgtctaaatgaatatatcttcagccaacaatggaaaagtgattacgatagctcactaagaaagaaagaaatggatcacagcaagggttgcaattaaaccacaggatgaaggtacattgtttgataggtcaccattatgatggcctcaatgtcacttgaacaacttctacaagcatgagtgcatcaagctagaaagaaagtatgatcagcaaaacacctaaatggcatactgatcatatgtgtagtaaacacttatgtaaagcacacatgtcagtgttccccccaaagcaactaaacaactaaccatgcaagtaaaggaacaatgaaggcaatcttgccgaacaaaggatttaaacacaccaccaaccgctcagtccatgacaatgaaaacaatatgctttccataagctacagatcatggccaatgtggaccacaattgggtacacgtgcgacaactagtacgcgataaacaggtaaagtcgcagcagttacagtgtaaggcagttgtaagcatattgcaagtgcacacctcctggggtac

SEQ ID NO: 36708 - DNA, 612 bp, Oryza sativa
ccgttgagcgtcacctcgtaatgcagattgcactcgttgtcaatggacatccaggccatgccgacggcatgtggattctgtgcatccgtgtgctcctgtcgcttcagcagaatgggttccgccgagtcccgagcatcggccactggacggggcactaggcggccacggatcaggctcgtctcatgctcggtggccacattaacgcccagttcgccggcatacagcgactcgaggaccttgggacccaacttctccacactaccaatggcctggttgaagttgaagctcggcgtcagatcctccagcttggccttccgcttgccctgctcctcaatcaaactgatgttgggcctatcccgggtgttcacgtgctccgtttcgatgttgtaggccagagatccatcgggttcaagtagacccacgccaaaccgctgctcttggtcgaggattcggcactgtgcggcgccagcagggtctggaagatttcgcagctggctcgggtcacgatgtgtccctggatgcgcagatgtgggtacttcttggactccacggtcagcaggagtttgccacgcgacatcagtcgaagattctgtatggaaatgggcgacgaca

SEQ ID NO: 36709 - DNA, 404 bp, Oryza sativa
ggatgcggctggcggtgatgtagctcgggtcggcggtggcggtggggtttcggcaacggttaggggaagaaaggtgggggccggggtgcggtgtggagcggcgatgccggcggcgcaagcggcgcggagcggggacggcgggagcggcggctagaggcggcaggagctcgccggagtcggcggagagaggtagcaacgcggggagagcgggaaagggcacggggagctcgggcgaggagaggaaacggaagaggggagcacgggggtgctttatatagcgcgagggagcaacggggaggccggggagtggcgaatttggggcggtaacggccggcgacgtggaggtcaacatgcgcggagtggggactcgatttggctccgaaaattggggaaaagtgggggat

SEQ ID NO: 36710 - DNA, 4676 bp, Oryza sativa
  unsure (1)..(4676): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtttgaccttagcttgttgacaagtttcacaactcagaacatattgctggacatccttcttaagacccttccagctgaatagcccccttattctctgataagttgcatggattcctgagtgaccacccaagccactgtcatgaagagctaacatcactgcttgcttagcctccaggtgattacccagccaaatcttccccttatgcctaataattcctcgttgtaactgaaattccccaactccttcaggattcaaactgagctcagttaacaagtgtttggcttcttcatccttctcatatccttcttgtacaatttccagccattttggtacacaggtggatatagcttggctcttatcttcttcttttcttgacagtgcatctgctgctttattttcttgcccctttttgtatttcagtttgtactgcaaccccattaacttaataaatgctctttgttgcattcctgtgagcaactgctgctcacttaaatggataaggctcttgtgatcagtctgtatagtaaacacattgtgctgaagatactgtctccactttcccacagctagcaatatggccatgcattctttctcataggttgaaaacccctgtgatttaacccccaaagccttactgatataagccaaaggatgcccttcctgcattaatactacaccaatcccctttccactggcatcagtttctataacaaattccttctgaaagtctggtagtttcagaactggtgcctgagtcagagcctgtttgagtaacacaaaagcttgttgctcttcagtaccccagatgtagctgactcctttcttgagcaagttggtgagaggccttgccaaaaccccatagttcttaataaacttatccccttagctgtttgagagtttttggcactggccacttagacacagcttggattttggctggatcagttgccactcctgttactccaatgatgtggcccagatattcaaggtgttgttgagcaaaagagcatttgcttgccttgacatacagcccatgatcttgcaacaactcaaacacttgctgcaagtgttgaacatgttcctgcaatgaattgctgtacaccaagatgtcatcaacaaacaccaacacacattttctgagtaatggtgcaaacaccgtgttcattaatccctggaaagttgcaggggcgtttgtgagcccaaaaggcataactctaaactcatatagcccatggtgggttctaaatgcagtcttatattcatcctcctccaacagcctgatttggtggtaacctgacctgaggtcaagttttgtgaaccactgtgccccagccaactcatccagcagctcatcaactacaggcattgggaatttgttctttacagtcacctcattcaggcccctgtaatccacacaaaacctccatgtcccatccttcttcctgaccaacaacacaggggaggcaaaaggactagtactgggtttaatgatcccttgtttcagcatctgagacacttgtctctctatctcatccttctgtccaggggagtacctataaggtttcaggttgactagttttgtgcctggcatgagtggaattccatggtcaaactgtctatggggtggcaaagttctaggttcctgaaacctgtcctggaacctgttcagaacttcctgaacctctagggaaagtccttgctccaaccctttctcctctagtgcacacaactgcaccaactgagagattgctccagcctttgccatccctttgagttgccttgctgtcacaggcttacattggtaaacaattgttccttgaccccaactagagtgattctcttttcttcataagtgaatctcattttctttctcttccaatccacccacatgggactgaattcctccaaccactccataccaaggatcatgtcataaccacccagtggaagcaccttcagatcagttttgaaagtttttccctgacaccaccactccaaaccattcaccacttgattgcagagcattttacccccatcagctatggttacttgtgatggcacacactcctgggtagacaactgcaaccttgacaccaattgctctgacaagaaattgctggaactaccagaatcaaccaggacaagtatctcttgattctgtaacaagcccgcagtctaatggtccttttcccaactgtaccagagactgcacattcagagagtaccagttcctcatcacttgttccttccacatcatcagccttgttactgtcctcttcttgcgccaggaacacctctagcaattcttccagaacatgcagctgcaccgattttgggcacttgtgtccagggccatacttttccccgcacttgaaacactctcctcgagcccttctagctgcttttagtgaatcaaatctctcttcccacttgggcttttcctccaccttcttgttctcatcagggctagggcccagaattcctttaccaaggaatggggtcttgacagcaggcttgtactgctctttgtatgtagttctgccaacagtcttcactgtgatttctcccagcaagtcctcctgcgttttatcaagtgatagagcagcatcaacagttctaggcttgtgcagcttaatagctgctttaatctcacttttcaacccaccaacaaatttagtaacaaaaaaggtttcatcaaaagccttattataaactaagactttattcatgatctcttcaaatttggaatggtattcctccactccccctaattgcttaaaaccttcttgttcttccaaatgttgctcgtatttatctctaccaaacttgctatgaacttctaccactagttcaggccaactctctatgcaatgcaactcctcataggtttggagccgaagtgctgcagtgccagtgaaatgcaaggtggcaaaggaagcccatgtttcataaggaacatgatacatgctgaagtatttttcacaattagttttccagagcttaggattctctccatcaaacttagggaaatcagtcttaggcaatctagaccccccaaatttcccagagctttgagatccacagttttctctctcagaattttccctcaaatcaaactgcacaggtgagtgatggaacttgtgtttacccttgaccagggttcgctcctgggcaaagcttgccccggtagcatcaccctggtagttctcgtcgtcgccgggccctacgggcgtttgcttcgccattgctggcgtcgcttgtgcacgggtctcaagttgagcgacccgcgcgttgacttgatccacagcttgacgtagatccttcatgcccaaatccaccgtggggatccacttctccatgccttgaagtgatccgaggatggagttgatgctgctggtgagctcggtcaccctcgtcgtcaggaaaccgatttctccctccgccacctccatccgctccgtcagagttggattcgtcttcttcctcaccagcacgcccgcggatcggcggctctgataccaaaaatgtcacgaactcgcaattcggcaccggcgtctcgcctagtacgtggttgcaagcttctgagtttgagagattttggggatttgagaggaagaacagaggaggaagacaaggtaggtaggattagttttatatttcttctcatcgatgccttgactcaattggtcaggtctgtatttatacaccgacacatgggctctcacgggttcagcccaacatgatgaagtggcccaaagactcaatacacccaagagtactgtaacacaccacgacaacataagaacatgacaacaaggtcaatggaggcagctggcggaaaagagaacccggcggcgcctccgcacctgtatctgccatcgcttgcacagctccaactgtgtccaggctcggggtcgaaggggtggcgcggtggagggaggcacagggctgctggatttggccgcgccgtcgcctgccgtggccccatcatccgccaccctgtcgcccgcagccatcccatcgcccgtagccaccccgtggcccgccgctgagcccgtcgcccgctgcagcgccgttcgtagttgcctaaaccgccgtcgcctatcgcccctgtcgaccgccgctgccgtcgcccgtggctgcaactgcctctctgtttctcagatccgaaaaaatgggatggtgatggggttggttacggcacgtgagagcaacacaaggtgtgtgtgtatgtatatatatatacatatatagatacatatatatatatatatatatatatacatatatatatatatacatatatatatatatatatatatatatatatgtatatatgtatatatgtatatatatatgtatatatgtgtagagagacgctcatgtcgagtagtaaacaatttactggtagaagggggcgcagagagaggt

SEQ ID NO: 36711 - DNA, 6698 bp, Oryza sativa
cgccgctcttggccggccgtcacagccgccctgttcctgtggatgagaggaagtgagagagagagagagtagaaagtgtgtgtgagagagagaggagaggatgaatcaagaggataatgttgggggtgaaaaaaaatggtggattttttttaaatgtaaaaatcaatttttattttatatgtggctctttaaaacgaatttaaaggcactaaatcaactcatacgaaaaagttgttaaaaacaaagttgtataacttattgagatctatcaattttattttggtcatttctccatccgagtttgattaaactatataaaatttgaatttaaaaatataagaaattcaaataactttccgggtagtaaatgatttcaaataaaaaaattgtcaacaacaaagttgtataacacatcaacatctacaacttttattttggttatttttctatatgactttgtttgaaccgtttgaatttgaatttcaaaatatgacaacttcaaacaatattttgaaatactaaatgatttcaactgaaaaagtcatcaacaacaaagttatataattcatcaagatctataactttttattttggtcatttcttcatccgacaaagtgatagtaacattattcacaaaatttgcatctatctcatttggttctataaactataagagagatatgtaaactttgtgaacaatattattatcaatttatcggatgaagaaatgaccaaaataaaagttgtatgtcttgatgagctctacaactttcatgttcatgactttttcagctaaaattaattacatcttcaaaatattatttgaagttttgaaattcaaatttttaattgataaaacaaagtcacaataaaaaatggctaaaataatagcagcaagaacacaataacaatagagcatgattttagaaacatttaggaaaaagaatcatccaatttggagttcatatgagtgagataaattagtttcaaattaccaaattttatttttgcatacggcttcttaagtcacccatatggaaaaattgatttttttttcatgcgggtccttaaatggtccacacacaaacaaatgaaaaaattcaattatgaaaaataaccactcaaatgtttaaaaactttcaattgaaatgttcaacctaaaatttaaaatattcaaccaattttcaaaaatttcaatgtgcctacgaaaatttaagtgatacacattaatttatttgtttcatgataacataaatttgtatggaaagtaaacatagcattttctatctcccccttgcccttataaatagagataaaatttgaaaatattgatgttttgtttttgaaaactaatggctacatatcttcctcgttttaagaagcttattttgaggggtcttgatattttgataattattcgttaccgtattcgtttcgattcgtattcgctccgtatctgtattcgataatattcgattccgttttcgtatccgggtttccaattccgatttcgattccaagaaaaaaatatgaaaacgaatatgatagagctagtttcctaccgtattcgatccgttttcatccctagacggaggttaccgactgtgggaaaaaaaaaagggaaacgtgggggcgggggttaccgagggtggagacgggtgggggtagggtggagtggggtgggggggtaagggggttggggtaggttgcgaggggagcattttagctattacgcatcctgggtgcggtttagcgcttatatatatatatatatatgtcggtgacataggaccgggagtatcatgacttagagacttgaggcagacacgatcacccacgtggcctaaccccctcggggggggggggggtcgggcccgagggtgatacggccgcccttctctttgtctccccgagaggtcggaccgctcccgtctcggccccgagggccgaggcgccccgaccccttgtgggttttgcgccgcgtatatggggtaggtgagcatagcggggctcacctaaccgcatttattgcggtttggacgagcgcgttacgccacatgtagcgcagtatggcacgctcgtttatccggtctgtgaccggtcacagatcggtcagattgcgggttaggtggcaacaggcgatctgacacacgcctcgccccgtcccgtcaagatgagagtctctaggcactcgtccctagccggagccagcgtgctagctcctggagatggcacgttggtcctggtcagatatatgccaggctttatcccaaccattataagcaagacgttgtatgaagaagggcgaacatgcagattgctaaactgacacgtggtggacaaaggtgaccggtctgtgactggtctgacactggttatgtcgccggaagacaaccgtgttcccacattgcacctgcttccggcggagtggaggtaggtatgggccgtcccatcagaagggtcactcgggcagcagccgttgcaaatctccgcccatttatgaagagatgacagggtgatccccgaggtcagacgaacgaggacgcgtggccacactcaaaaacaggcagtgtttcagcttccaagagaaggcaagccaagttttactatagataggatgggcccccacccaaaaagagagagagggaaaagtggtgcatgtggtatccccttgagatataaaaggaggaccttgcccacttaagaggggaggggggaaggggggatgatctggagaggagatcccacgagagaaaaaaaaaggagaagagggtttttagaataagagctctctggctctccagctctttgtagcttcttcatacacagatccaccagaacacaggagtagggtattacgcttctcagcggcccgaacctgtatacatcgcccgtgtcttgtgctttttccattctcgcgaactttccacagactaggagcttagaatctcacctagggcccctggccgaaccggcaaaggggggcctgcgcggtctcccggtgaggagccccacgctccgtcaatatatatatatatatatatatatatatatatatatatatatatatatatatatatatatatatatatatatatgtatgtatgtatgtatgtatgtatgtatgtatgtatgtatgtatgtatgtatgtatgtatgtataggaaaatgcggatttgagctcgagctcacatgtacctataaaatctgccgttcgactgcgcagagattcgtgcgtgtgttgatctacgaggggagcgaccgaagttgttagggcgagggtacatatatggttaaggtagaaaaaacgacatattctctacatgccgatatacacttaatcatagtgaaagcccaaaatgccctttgctgctatcactagctttagacagggctaaagcaggctaggacactcaagagagactgagtcagacatggcatagcgaaagtgggttccacctgctcgcctgcttcacgccagctctgcacgcgaggccggttttctacagaaccgttgaaccgggcggttttgatggaacaagccggcttttgcgtttacactttacaccacgatgcctctcatttttctcgggatgtgtggggagtggggacaacctgcggggaggggaatttttttcccatctggttcttttgagcggcgacggcggctgctttaacagcggcggcggtcggctagatgccatggcggggtgagcaggcaagcagcccggcggcaccgcggtaggcgaatagggcggtggccggagagaccgccggcggcaagcgagtagccgagcagggactccgccggcggcgtctctagttcccatggtattgcagtgatgccccggcgttgctcctgttattctttgtgagcttgtagcggtgctcccgtctcctgctcgagtcatcgtccccactgcgtgcacaaggaggcaacgctagatttggtactgtgctactgtgtatgtttggtatttggattcgtatacaatatgctaatctgtctttatagatcaaatttttactgtcacttccgtgcattcttatgaacagatggatgcattcagatttgacaaggtataataagccaataaggtgtattttgttaaatgattgccatttgacctgtagtacagatttagcacttgccagtgacttgtgaacttgagatttgagaaactatgaagtagtacgagactatgaactgtatgagtcacatgttgaatattatatggttatatgattaagctgagttagttatgagcttgttttatttgtgatcaaaatatactggtatttatgaactgcatatgctccggttcgaagtatttttcaccggttcaattcaaccggtccaaaactattgaaccggtggttcaaccgatttttaacggttgaaccaatgaaccgacatcctcaccggttcgattgtcggtccggtcctaataactatgcccccgagcgagcgtgtggtgcgcgcgcagcgtgtctgttgggtcgttcccagacccgtttgggaaccattcccaggcctgttttgtttcgggctaacgtttggcccacgaaacaacaggcgcatccggttttctctcaggagcttcagcatttggaaaaagtacaccgaaggtccctgaacttgtcatcgagttaaaaaaacgtcccaaaccgcaaaaccagatatccggtgtcccttaactaatcaaaaccggtcacaatagatccttcggtggttttaatcccggttttgtcctacgtggctgctaaatcagcgttagatccttcggtggttttaatcccggttttgtcctacgtggctgctaagtcagcgtggctgctaagttagcgtggaacccacgtggaccccacatgtcagggtccacgtcatctctctctctcccttcccctctctctcttttctcctcgctcactcgctggctggcgcgcgcggccgctggggggcgcaaagagggcacccgccgcgtcgttgaagttgggccggagacggcgaggtaggccgcgacggcggcgggggagaccgggtcggcggcgaggcggcggaggaggcgaggggtggggaggggaagggaaggggatggagttgagggcgcggcggacggcggaggtggcgcggtgcccggcttggagcggcggtgtacgtgtcgcctggttgctgtcgccggcggtgcgggggagtgggaccgaccggagccgccatggcgcgcgtgcttccccatcgccggggaccgggtcggtggcgaggcggtgaagaagggaggcggggaggagacgaggactagctaaacctttgccggccgctctccgcgctatcggccgctccgcccaccgctcgcccggtcctccggcaggccagtgcggcggttggagctgccgccgtcgctccgccctcctcctctcccgcctcgccccggcgacctcctcccgcgtggtcgcgtggtcgttggcgagacggaggtgccggagatcgtcaaggcagcccaggacgcggtcagcatgcatgcaatccttatcttctgctgctgcttctgcatcatcgtttcagtttaagtttcagtttcagttagttgtgaggccattcctgtgcaatgtgcgtaaccgtgaccaccgttgtgtctaggcagtgggccaaagttgaggacaagtacgccgtcaccgccatcggcgtcgccgcgctcgtcggcctctggacggccataggcgccatcaaggtatacgacgcgacacatatgcttccatatatatatatatatatatatatatatatatatatatatatatatatatatatatatgatctcttactccttcaagttcagatacgatgcttaatttgattttcttggtaatctgcatatcggattaggccatcgacaggcgacaggcttccacttttgcccggcgtgcttgagctcgttggaatcgggtatacaggcattactgggtaagataaaggccttcagttgcaaatttcgttgtcacatagggagagaggtagtgtaagattgcttctcttacgagctccaattatcatgtttcgtccggaggatggcttcgtcgggacgccttctcccgcgtcgccgccgccgccctcatccgctcccgccgctccttcgatggttcccgcgacgacggtgccggttccaggaggttgtcgccgatggcggcggcggcgactacgacggagacgcacggacgcgctacagccgctgccgccgacggagccgctcctggtcagacgcgctaccgccgctgctgccgacgcgccgacacgctaccgccggtgccgtcgacggagccgacgacttgtctgggtgtgtgtaggagggaggaagagaggaggaagggagaggaggctgacgtggatagtctgacatgtggggtccacgtgggtcctacgctgactcagccgccacgtcggataaaaccagggtcaaaaccaccgaggaatctaaagcgaacggttttgttaattgagggatgtccagtatctggttttacgattgggggatgattttgtatctcgatgacaagttgagggaccttgggtgtactttttcctcggcattttggcctcttctttgtgtaaaacatgtctaacattttggccagttcatcttcacatgccctaatctttttttttcaaagaatttggtgctaatctgaatcaacgatgggct

SEQ ID NO: 36712 - DNA, 43514 bp, Oryza sativa
ttgtgaaacggagggagtagtaaagaaaacttggatacatatacacatctcttacaaaaacttagataatgccatcaccatatctctttactatccgatagcacaacacagttgggcttccccatgatcaggggaaaaaaaacaagtgtgtagattttcactatttccagtgaatgccaaaatgccatacccctcaataaaaatgccatcttcttttcaaattccacagccaagtacaaacctctgcttgatgaaattttctaattgaacaaaatcatgcaaacagaaaaaacaaaaccttcactgctgaaatttactccaatcatgaacgacctgaaaccaactttccaatcatgaacgacctgaaaccagtccccaacttttttagtatggctgacaaaactaattttcctttagtatgggatactacagaaatcaagtacgaattacattgtattggagcatgcagattagttatatttcctggtatttgctagcagaacaaacatgtacttagatcagtacatggacatttcagagtagtgatgtaaaatacacaaaactatgaaaatacttacaaaataaacaagtcatacaaaattctggtgtgaaatttagcttctctaccttccgctgagccttagccctttctaatcttgtttaactttatttcaaatttgcaaacaaaactatagaattaaaacaaaaaacatatttcataactagtagataaaaaactgcccatgtttagtagctgataaacctacagaattctggagtgatgcatgctaaacgctgacaaaactacatgtatgaattcagacaaaactaattgcagacaaaatttttaaaaaacaggtattaaatgataataaaactaatgatctacttacaaaactaaactgtatgaattcaggcaatattaactggtgacaaaactaacaaaaccaggtactaaaaatagctgacagaactagaaaaattcacattgttagaagacaaaatagtaagtagctgacaaaaacaaaacaaaactgacagaacccatgtcagtccttcatctgttgctacagaactaatctgcaaaaaagaagagattaataccgtgtaaaatagaagtttaaaaagatatttaaaataggatgttaattaaaaatatataatatatgaacatagataactgtactttaaaaaaaatcaaaaaataagaaaaatccaaaccaggacaacttcttccaggccatattcagaaaaaaaaaaactcaaggctgtaaataaagtagttataggtggcattcctcttcacaacgtcaggcatgttcttcagcaaacaaaatcaaggatcaatactattttcatctggcagcgagccatgcatcagatgtgatttaccagtttgtacatacttatttttgaccatatgtatgcaaacaattctaaattcacaaaactgaaacaatacagcaagaaagtcctcactcctcagcacaatgggatgcgggaagaggatgaaaatcatgaacaaatgcattcaggttgagcagaaaagaaaatatgtagttcttaattttattgctaagtgagacagacaaacagcgagacatgtgcatgctccacaaatccagagaggaagagtaagagagagaaagaagagaagctagtgcccaacacaacttcctctcttggcagtggttgataatatcaattaaaacagaacatgctcagtacatgagaactagtttctgttagttccctttaaccccctttgattcaaaggaaatttataggaattttagaggattttattcctatagaaatttttcctacaaagccctttaaatcaaagtaatgaaccctatggaatcatatgaaattcctatggaatgtctcttcccatataagttttggagaaattttaacaagaggtagaacctcatggaaaaaatcctttgagtctttatctctcctcaaattcctgtgtttttcttatggtccaatcaaacggtcattccaatgtttttcctgtgttttgcaatcctctgttttacacttacattcctgtcagaatcctatgtttttcctattcctccgttttttcattcctgttattcaaaagggcccttaagattataatgataaagtattctctgaatttttgtatacacaagtaaccaagttggtgcaatattacaactaattagatgcttgcttatgaaactagggcctgttcactttgatgaaaaaaaaactgtcggagatatgggcccgggggtatgcgaagtaaagggaagttatcttcccctccagccacgtggctctgcaagctggccccactctcacacctcgcgagttgcgaaagcgacggggggcctcggggtggagcgtcaccccctcgggctctccccctgcttcgctccgaggccctcgcccaactgccatgtggcggggggagagagagaaaaggggacccaggccgaacagccataaatacgcggcgccccaactgtccctcaccgcatttaatttaatgcggtgagggtagacgtgcggtgccacctaactgacccctgtcaatcggatgtgatcggcctgttgccggtcatgtccgattgaacgggcggccgtgcccccacgtcgcctctgtatccggtggagtaggggtaggtatgacccgtcccatcggagcgtcactcgaaggagggctaccacaagtctccactcatttatgaaggaatgatagggctgtccctcgtgtcaggcaggggcagcgctgggtcccactcaagggcgggcttctacttagcttccgggcgaaggcacggattgtggcccggtcaaagtaaagtggggtccccctcctatggaggggtaggtagaggcggcacatgtggtatctccttgagatataaaaagaggacattgcacaccaatacaaggggacgactctcagaaaacctgaactctaggaggagaaaggcgagagcactctccggagtaaaggaacccttgtaatactcatccataatcccaaacacaggaatagggtgttacgctccatagcggcccgaacctgtataatccgattgtgtgtaagctagccagcaatcttagaggcggatacgtgatttctaagaggcgagcctctgcccccggccgaactcacgaaaggggggtctcacgactccccactattgaggtcctttcctcgacgaaaaccttaccaaattttggcattaccaaaattttaacatggttgccaaaattttggcaacttgccaaaattttggtaggatttcttatatagttgccaaattttagcagcaaactaaatgtagccactttttttttcaactttaccaaaatttggtaaggttgaaaatggcatcaaagtgaatatgaatatgcccctaataaaattatttccattcatgcaactcccccttaatgtaactctaatctacatttcttggaaaagaatttctgcttatgaagattcctgatcttcacaacaaatctacacgcagataaagaaaaaaaatgtaaatgctctaaacacatgtcctctagtactgttgctcacaaaacctccccctcaccccactggaaatttcaggactgaaaaaactgcacttatacaatcaacagccacagatcaaagcatttatacagtcaacaaaataacagaccgagaacagcgttaatacattaaacagaaacagatcgggaggggtggtggggaggggcaatacgattgtgattgcatccaactaatatatgtgaaatcgaatcagcaaagcagcagcaacacaaaaaaaaaatttgctcaccatgagccgagttatacagatctcaacgcctgatatatttggattcaaatcagcagcaacagcagccgttttgcgattcgcatccccttgcctgatgaatgccaaaccgccatggatacctcaccgggcgcagccgagtaaggcatggagtcatggacgcctcgccccgaaccttggcgaacccgagcctgcctccgcagtggcaacggagggtgctgcactgcgctcgttggctgagccttgctgcggcaaaggcatcctgctcatggccttgctgcacgagcggcctcctcccgccggtgaggccgccgccggaatcgcctcctcccctcgacgacattgcctttgagcagtggagctggaggaggcaacactgtttcaaaaaaaaaaaaaacgtgttgtgtgagaaatatccagaagccctattcgatcgggcaccaatcttgatgtccatccgacagttaggaatttgagtgcgatttggagacaaaacacgctggtgatgtatagcaaaaaccataaatagaggggtttaataaaatttaaaagaaataaaactgagataaaagaagggttttataaaattaaaaagagatttaaaagagagctcttaactttgcaaacaaaatttaggtccaaagtaaaagagattaaaagaaaacaaggctgctccaatggaaaatcgagaagagtgcaactaaaaacttttcgcaaaaaatttttcttgaaaaattgagtatgttacaatatgtttgggagaggaaagaaatactcagttgcagtaacatagcaaatgcaagttcatatcactacttctgcgctaccagaggtataaagatgaaatcattgatctttacaaattagagcacatagcacaggatgtccatgaacctgcaaatgcgatcatcaaaatgctgccatctactttgtaaagtttaaaaggaacactaatcaaaagctgagtcctgtcaaatttacaacactgaaatttacattgttatcgtcctcgacatgctgtttgctctggttgtgttgctaaatttgcttcttattcagtgcttgagtaaatttatcacaaacaatattctgtatcgttctataattctattggttttcatttctaacaacagaatctcatttcatgataagtgttgaagctcatgtgttttcccctgtctaggattgacttatttgtgctcattgttcgttaaaaataccatttacactggtgagttaacaaatttttatcctatgtatatcactcgcagtggagctttgattttttctattataaacagtgtatggcttcttctttttttctgttgatgtacttttagctttagtaaaatttccatctattgactcatgataatttgatatatgcgataactgcatcttactgttccaaaaaattgtaccaaactcgaaggactatagctttctcttggcccctgtttgcctctttttgctgaggctatgtggcagcaattatatgaactagatactggggcgcgcctattgcacgcctcctgtacgtttttgttttgagtgtgtttatacctttgtgtttagttcacttatgtaatatcacaatgctttggtcagtttagggccatctgttgtgctgacccttgtgaacgttgagtggagcaacgaatcgtggattagtctgttctaccctgctataaaattagtgaacctaaaattgcaaggttgataagcaaaccaacagacagttaaggtagcatgtacattattgcaaccatttcagcagtaagctcacaagcttgtggaataatgatcgacgaaaaggtacaacgcatgtagaaaataataaaatgtgtggtacctggtttcacggttgtacagttgtattactacaacattgaattgtatgatacatttgaattttatctaacttgctatgcaaattcaatagcatagagttggcttagattaaatagaaatgaatatactctatattagactgaagagagaagattaagctaattagaatttgaagatcccttagttgtactaacagggaatagtactgaattcaacaactaaattttctgaagtatcatagaagaatgaaggcatttatacatgctgatctatccagcttatgtttaaaaggggatagtaaactgctgctcagacacaagtgaataacacttcaataacagaagttagactcataggtcatgtatatgtatgaataaactaacgccaaccagtttacaaaacaaatttcagaccacactgtacagatgccacatagatcaatgaaagtggcattgcacaagtatcccaccttccaagcacaacccatgggaatgataatgcacagtgtgcttacggttgggatcatcaggcatgcactggcctcatctactaaacatgggcaaggcaaagagagacattacgagcttagcaatttgcgatgccaacacgttgtagcaggttgttcaagatagtaaaaattatacctccctttaaactcaaaaacagaaactttagtatatactccctccttcccaaattgatcatcatataatggaattcaaaatttatcaaattaatcatcacataaccgcatagacacggatttcatcggaatacaattaatgcagtatggaagaatatgtgcatgctaaggtgtaattagcacggtgttttaattgatgcatgcattgtaggagaatgtgtgcatggtgatatgatttaaattattgatgcataaacatatatgatgatcaatttaggaaggagggagtacaaagttaaccccacataacagcttacaaatatgagccgtaatatttggtttttgttttgcaaaatcacatgaatttataaataattagttggaactatagaccctgatgaacctatgcttccagctaaaggtttgatactatgttcaggattaattttcaatttctggtagaattgaatttgatgaataattagtttctcatgatcgctaataactttgagttaaacatacataatacagtgatagaataatttacagccaaatactaagttcagtaaccatatagaaagtttgaacatgcagacttagtaagtcaaatagctgcttaagatcttagattcctgagttgtttttatcatgtactcacatgtgctcacagaacaacttgatgcttggttgatcacagtagtatagcctcccatctgctgaccatggaaaaacaaatcaagttagacggaggttgatagtttatttgttgaagaagagtcaattcttcaggattgatcatctcgagtcctctgttgaggatggagatttcataataaataagtcttaaccaaacttgtttattccttttttcgaactatatttcgttcatatgatagaatatgtgtttaaataagttggatctttatggagtctttcccaataaatacttaaattcttttattcatatttctcggaagttcgaacagatccagcagtcaggaccccagaacggagcatggcagcagggaaatcctaattcattaggatagcgttggtcacaaacgaaaatattaatatcaaccaaacaaataaggggggagggttagggagggaaaataacattaaacaaacggaaaacaaaataaagacctcaacgtccaaacaacgaagcaatcagcaaatggattgagtgaaaaactgcaagaaatagcagcagacatatatttagtacaagtatactacttcacttgagagggaaaaaaatacgtgtgcggcaaggacaaccgatcccagagaagccgaacgatgaggagtaacatcgagctagcatcttatttctaggaccaaagaatgaaagagagggatatgaaacaagtaagccacaacagtgcacatagaagaagcaacataatagagacgtagcagctgtctccgattgtgtctaataattggcgccaccgaggtgaccgctaattaatatgcgtccatggtcagttgaaaataattagcatccatctagcacgatattgttttagatatcatagtatgtaaatgtatttgcaagaccggagccggccggaccagaaccaattcacacagcaagcaaacggacactaaacatgcaccaaaacaacaagaaggaagtaataaatgttgttggccaccggatggtgccaatgactgcatcagcccaagaatgcatccgcaaacaagcatcaattgggcaacatctttgtgacacacaaacataaaataaacaacactagcaaatcgacacgccattaaatcaagaggagataattttttttttgaaaaaacagagaaaaatgaacccaccgatcttagggaattttatgatttagaacaaggatattactccactcgagagggtaaaaaaataagcatagagcaaggacaactaatcacagtggagccgactgatgaggagtatgctgaagctagcatcttatttataggagccaagaatgagagaaagggcaagaactgaattgaatcctcgtgaatgaaacaagcaaccaacaattgagcacacataggaagcaacctaactgacgcgtgacttaggtcctgtttgtttcagtttaagattattgtaatctagattattaaatcagattactttaagctagattataataagctgacagagaataaactgtgagttgtttgtttctctggattattagaggtatctaagggtagtgggtctttagccactcaataatatggaaaaagctcatctagaagagattattgggttatactagtctagcttatagattataataatctacttgtttgttccagtttactcataataatctatattataataattctaagctgaatcaaacatagccttaataaggagccatctagacgacacgacacgtagcaaaacacagggggaatgaaacatgcacacccatatataacaactcttacagaaccaattttatttttaaaaagataatcaccgagttcatcattggtttataatcattttttttcatgtctatctttctactatttatttttttttggcagagaacacatttgatcctttcaacaattttaataactaatccaatttaaatctagtttccaaccacaaaccacttttgtttttgcataattcagactacccctgatttttttattttagcctactttttcgtatctcctctgttttcccagacagggctacgaatttcaaaccaacttgaaaccgtgtcgaccatccatatcataaaataaacaaatctatccactaacaatttgacatgatattaaatcaaaaggagagaaaacaactcgaaaaaacagggaataaggaaccccaccgatattagggaattttatgatttgcattggtgctgaggtcaaacccatacaacctttgtggttgcatctgacaggccgaatcctctccggatcccggtccatctccaccgtccattctctcccatcgctccacgctccctgcgcggctgcgcctcctctcctttcctctcctcgccgccaccgccggggcgccgccgccggcctagactcccccccccctctctctctccctctccctctctctcccatctcctctccggtcgagcgcgcgtgcggcctcccaatcccgacgccgccaccagcccaaacgcacacgcagacacctcgtccggctcggagactcagccccggctctcgcatcaggcggaggcgggtgttgcggagcttgatccgttgcttttggctattccgctcctcacccggtgccgggaaatcggcgagttgtcccccccttgttcttcttgctatccgggtccgtgtgatgaacggcggcaagaagttcggcggcggccgcccgccgacggggactccgtcgctggcctggtcttccgtcgtcgtggtcgtctccctgcttgctggagcgtccatcgtgcacaacatctacaagcccaacatggtatgccttttgtctacacctcctggccatgcgcgcaacctgtttgacgtaatgcctgctctgttctgctaccggcgtgctcattgtttctgctcttgtagaccattccaccggtggagagcacggatgggggcaagcagagctagacaagttcaaaggttcgtgctcagagtgttagaggtttcgtttctttctcggtatatgcatcctcttgtgagatgaggccgacggtagtcttattctgtcagaattttgagagccaaattaagcctgcagtattgctcgctaagtatttttttaacagactgctgcactgcattttatttattctagtacttggttaattggtgattgtctcccaaaacattatgatcccagtcttgaaggaatgcaactagagaaaggggatgaggcaattttatccattgctttatggaggagaatgcagttgtttgcttttcttttcaacgtgctcattaattcaatgtggaataagtccatttgactctagttggaaatataggacaaaaagttgaactgacaatcaacttggccaggctactggttcggtgatttaggcatttagctgcccgaccggcagttcatcggttcaaccagtggtttttatagatcaatattttatttgtttatattttatgttaaaaatacaagtaaatgttgctgaatattataattaatatatatctctataattctagagggaaaaaaagatgaatttctgataaaataatgaggcataaataaatatatattttttgccgggagagtatttaaatccagatctgataataaaagagaaaccaaacaaattgtttcaatgtaggcaatctcacagatgtacagatgaagcagctcctctgggcataggctcaagtacagccagtgtgcagccctaaccactgggagctttggacctaagcaaaccagtagtcatttcgacatatcggtagaagctgcggcacctcaccttggctgaaattaattttgacaaattgaccctttagaaaaaatatatgaaaaatggacctaggccagaacttattttaaaaatgatacatgaaactctgcctagcttggtgctgacctcccaatctcagcaccaggctcgttggagttgaactaggggacttaacgtcgagttcatttttaaaataggttttctgaaagagtcaaatttgtcaaaatttcggtcaccttggactgagaggtcacaaatgagtgaacggtgggagaggaaccgatgaggtccggaacctcgctggtcgtgctagctgcctcgctgtgacggccatcgcttgggacggtgatctaggccctgtttgggggagcttaagattatgagaatctgctagttggtatccagcttccgagaatctggagaagttaggtttttcagtttttgggttctagttcattttctggagaagctcggcatgtagcttgtcgtggcctcgccaagaagcctgtcaggtgtcagcaatcagcatcttaccagacaagcccatctccactctctacactatgacactctagagcagtgttttggggctctaaaggcaaaaggaaactctaggcaattggcacttatagccctaataactcaaactagatgttacacaaacgcagtcaaaatttacatgggggtaaacggtccgaacctttgtaccttttcaatattatccactgtgcaattagccaattctctggtaatgcatgtgtacattaaaaaacatgtttattcttgaaaaagatcggatggctatttactctgttggcagaactgagaggcatcaagcatgttgcttgctattttcatgaccagaacagggtctaaacatacctgagtaacctcgtttttttttatttcaagtacataaacaatatcgtttatttgcagaactggtaccttttcttccataagacaatggttattgtactcaaaaggttaattttgtagtttgaaatatcactttattaccttgtgaaactacgagaggtagaaccaatgcattattcaagatggcgacatggcgtacctctattaagctaaactgaatggaagttaacatctagagcaaccaaaaataataattatgcactgcaaaaactgttaaatggttcggtatgcagtatcaacagtaacaaggcaactgaatcgaaggactaaataatattgtacattgcatggattgttgggatggtgttacgaaccgactaccgagagagtagtttgggatttgtgggcagaacgagccaaggagaaggaagaacagaggaagaactcgagagagatagttcgggagaggagatagatttcagagatagttgttgtgattacaaattcaatgattctctcttctccccttcgatgcttatatatttgcatcgggtacagctggaactcccacccattcagagccagctaagcgaacatttgcctttgtcacgcgcgtggaacgcagcctctctctgacgggattatccgttgccggatggtgtacagtagccgtaacactcccccgttctttagagccggcttgtccccaagccggggcactgcgtcttcctaagtagcttcagctaggattgtcctgtccacctgaccaagagttgtttaaccgtgccagcgcctttcttggaaactcgccgcgccaaaacttgaactggaccaattgttcctgattggctagaggtacgaacaggatttgatggagttggaggcaatgccttgcggagctgtgacacatgtacaacaggatagatagcacaaccagtaggcaactccaattgatacgccacagtaccgactttgctcacaacctgaaaggggccaaagtaatgaaaagctaacttatgattagctcatgatgccaaggaagtttgcgcataaggttgagccttcaaaaacacccaatctccaacactgaaaccctgtcagagcgatgtatgtcatcttgccatttcatacgttgttgtgctcgcagcaaatgctaacgaagaaggcctgtaatcattcccttctcctgccgccattcctctagatctgaaactgcacaagtagctccatccaacgcaccgaaatgtcgtggaggatgaccatacaatacctcaaacggagatgtccccaaagctgagtgatgtgtagtgttgtaccagaattctgccaaagctagcctccgtgaccatttggaaggacaagcatggacaaagcatcgcaaaaaggtctcaaggcactggttgatatgctcagtttgcccatccgtatgtgggtgataagccgaactcattttcaactgagtatcagcaagccgaaatagttcagtccataatgtgctggtaaagatgcgatcacgatctgaaattattgcttggggcaatccatgaagcttgtagatattgttgagatataccagcgccacatccaaagctgtaaatggatgagctaaagccacaaaatgagcataacgactgaatttatccaccacaaccaaaattcagtcaaatgtagaagatttcggcaaaccttcaataaaatctgagagagaccgtttgccaagcatgatcaggcaccggtaatggttgtaattaacctggatacttcactcgttctgcctttgcttgagaacaaacagcacattcagtcacaaacgtatgcaccgctttcttcaatcccggccaagcaaacaaacgcttgattctgctgtatgtgacctgaattcctgaatggcctccaataacgctagaatgcaaagccatcagaattttatgctgcaattcagagtgaacacctatccaaattcgacccttgtaacgcaaaataccattcaccagagtataattgggatatttgtcaggtgccaacagtatctgcgcaagcaattgttgagtagcaacatccttttttttttgaaaggaacgacgacagaagacctgccggaatttaattaaggaaaaaaaggaaaagtttacaatcccagaaatgggatgtcaagtccaaagacagaagagaacaataagggggcctaaaggccgatcttctaaggtctagatcttccatgacaagatgggctacctgatttactgtacaggaatgattattgaaaattctcctatttctttctagccaaatattccactaagtagttaacagtgctcctctaacgtcctgcttttgatttgtcgatccatcttgatttacttggtcccaccaaatagagatgttcgccggctatagggtagggactaatagatttcgccaggaatgaacgagagtccaaacttcactgacaaacacagtcacagaaaagatgatttgtatcctcgaatgcagacgtgcaaagacaacaaatccagttgcacggccagtgacgccttagcaggttttgggctgttagggttttgtgatggaggatcaaccacccgaaggatcacatttttggctcagctggtgacttccatagggcatcgaaatccaatcgtgcaaaagatcctgcaaattgataggagtaagcttctttactagagtaaaccccagaaggattccagttccatgtaatttcatccggttgctgggagaagtttgatatcttgggtcattccccccaattgcactaggtcgtgcagctcttctactgtcgtgaattgtcgaaaagaaacaatccaattgtttgacgagatttcaacttggacacatcgttgctttagtttgtctaagcgaaaacagagaggggcaacatcctttggacataatccgttaagccagtgatcgttccggaaacttgttcttgccccatctcctaacgtgatcttagttgctgcttggaatagtctcttgtcagaatcgtcgcacggcagagtcattccggcccaaggtttatcagattatttccagttgaaccacaacaagcggaggcaaagggtcctcgagaatttctcgagatcggggatgccaagtcccccaagtgattttggtctgcacactgattgctaattaaccaagcagcttcctgggttggtgtggtcaggatcctctcccttccaaagaaaagatctcctaaaatgatcaatcctcttgaatacccattttggcgtttgtagaactgagagatgatgaattggcatcgaactgagaactgtcttaactaaagtttctcggcctgccgaagtgaaaaaatgtcctttccaggtggggagccttgcaccaattttttcaatcaagggaagaaaatcaatttttctcagtttacggaaatgaaggggtagaccgagataccgacaggggaaggactttgatcgtgccaggaaacatttgtagtagaggagcgaaatcaaagttgtcacacttgattgggtaaatttctgttttactgatgtttgtgtgcaaacctgatacttcagcggagaattttagtaaaagatttaaggcagtgaagctccgaagggtcgggtttggcaaaaaccgctacatcatcagcatataacgaacaacagaacctgttgcgattcccatccattggtggaagaatagatgcattttcggctgctttgatgatgtgatgaaaaggttccatagcaaggatgaacaacatcggagatagcgggtctccctaacgaaggcctctagcgtgaaagatttcttgaccaggcgagccgttaaggagaacccgagagaggatgttgcaaaaagattcgaaatccaatttagccaacgattaccgaaaccgaaatgccgaaggacatcaattaggtgcggccaacataccgtgtcaaaagctttggcaatatccactttgatgaacaaactttccttttttgttctgtgcagcatttgaaccatgttttggacgaaaaggaaattatcatggatcgctcttttacgaataaaagcactttgattatgtgaaaccatctcatttagcctcggggcaagacgatttgccaagaccttagtgattatctttgtgaagctgtgcacaaggcttatagggtgaaaatgttctgcgcctgaggcatcatctttcttcggtatcaggcaaacaaacgcagaattcaagtcctccagttgcaaaatattcatgttgaaaaaatatgatactgctgaaaggagatcctccttgataattccccaggccgccttgaagaaagccccaatgaaaccatccggacctggagccttttcggatggcatggcaaatattgtgtttttgagttcctcttctgagatatcttcttcaagctctgacaagtcgaaaatcgggaattgaaggtttgtccagtttataaccgaagatcttgggaagaaggttcccagcttctcatggaagaaacgaaacaaatcattttctttatcttgagccgagacagcaattcccgtaggggtttgaagagagtgaataaagttctttcttttccttgaattggcttttaagtggaaaaattttgaattgacatcaccttctttaatccatgttagtcttgatcactgtctgatcttgattttattgagaactgacaaacctaacacacgagatttcagattggaaagaagctgccgttcttcatcagataagattcttgattcctgagcaacatcaagctggaagattacttcagtggcgacagcaaattgtagcttaatatcacccacttgagagcggctccatctctttagatcacgagccaatatgcagagtttaagtctgaaaatggcaagtgggttggaggctaggatttgtctttgccaagagtcctgcacaacatctaggaaacctaggatttgtagccagaaagcttcaaaacagaattgcgggggttttgctcgactttcatttccaactagaaaaagaggcgcatggttagaacatgctgaggataaagggtacagatttgagccactaaacaaaacatcccagtcagttgagacaaaggctcgatctattttcgtttgcgtcagggcttcaccatcatcagtccaagtgaaacgtcgtcctgacaaatgaagttccttcacttggatcttatctaacagaccaccaaaacgttgcatcattcttctgtttaggcggtcgttgtttttgtccgaagatttatagatgagattgaaatccctaataatcatccaagccggcttcatagacggtctgagagcttcaatttcagcaagaaaatcaattttgtctccctcaagctgtggaccatacacaacagtaatggaccactgcaggttctcttcacgcatggtgatggtcgctgagacagaatactggccgagagagatgtcagagagagagaagaaattttcatcacaggctaacagtactccaccccttgtagagtaaccattctgaacttcttccacccaagaatgaatacaaacagataatgccgacaattgtagttccccaacatgattacagcaagataaagcatcagccgctttattctccaatccttttctatagaccaagcgataattcaatcccaatagttttgtcatcgcttgttgctgccactgagtagccaatcgctgatcaccaataattttgtcatcgctcgttgctaccactgtgtagccaaacgttgatcaccaagattaattaaactcctttgatccgtctgataacaaattccccaaactgcaaataagaacgccattgatcgactgctaaaagaattgccaagcactccttctcgtatgtggataacctgcgattacgaggccccagtgctttacttaaaaatgccaagggatgtccagcctgcaagagaactgcgccagtctcgatctcgaatgtcttagaaaaatccggtaatgcaagcaccggagctgaggtcagagctgctttgagtgcctcaaaggctgcctgatggtctgacgtccacacaaacactgaatgtttcttaagtaaaccagtcagtggacgcactgattgtaccaaaatgacgcacaaatttgcgataatatcacgctaatcccagaaaaccatgcacttccttgacattggttggtactgcccatcgctgcactgctaaaatattcttgggatcagtcgaaactctagcctcactaatgacatgccccaaataagttgagctggactgagaaaacaagcacttggtttaaccttcaactgatgactatccaatagctgaaacacatgtcgaagcaaagaaacatgctctgccagagtactgctgtagatcaaaatatcatcgatgaacacaagcacaccgtgacgaagtaaaggagccaaaatcatattcatcaatccttggaatatggccggtgctcctgttaacccataggacattacacgaaactcatagtggccattgtgagttttaaacgctgtgttttttgttcatcctctggcctcatttgaatatgatgatacctagcacacaaatcaaaacaggtgaaaataatggtgccggcaagcttgtccagtaattcatcaattattggcaaaggataacgacttttcacagtaatggcattaagatggcgataatcgatgcaaaagcgccatgtcagatccttcttaagaacaagcagcacttgagaagagaacgggctagagttgtgctgaataataccttgctgttgcatttcaaccacttgtcgttcaatttcacccttctgagcaggattatatctatagggtcgaaggttcacaggttttgccccaggtaataatggtatcgagtgctcaaactgttgagcaggaggcaatcctttaggctcatcaaagactgaacagaattcttgcagaagttcagagataggtgctggcaattctgtctgttctacagactcttctagtaaacacaactcaattacttgcatcattgaatcacgatgaaccattcctttaacttgacttgctgacactccagggcactgagaagtatcaccagtttaaacacaccagttgattctgatactgaaactgcaatgttttaccttgccaatccacttgcataggactgaatctttccagccaatccataccaataattacatcataagtacccagagataaaatctttagattagactgaaaagacacaccctgaacccatcatagacaatccacaaattcctgatcacactgcaagattccaccatcagctactttaaccttaactgtcggcattgtctgatagactccggttaactgattagctaaagtggcagagacaaaactatgggtgctccctgagtccaccaacatcagcacttcatgattctgaatcaatccctgaagtctcagagtatgaggagaatcaatgctgcctaacactgcctcccgagaaataacacaaagctcactgtcatgttcagaaacttcagctgactgctcaatctcaggttcagaagacccttcctccagtaaatcccagagctcctcaattacatgcaactgaactgtgggaccacatttatgttctcgattccatcgttcaccacaagtatgacataatcccttagctcgacgataggctcgaagtgccacaagttttgtcctccacaggtgcagctcgagggtcatcagggtgtcctgatgcaccaccgccttgccgagctattatttaccgcttaaaaaatatggtttaggatatggtatgacgactatccatctgaatccgctccgttttcacccctaattactggtatgccagctcgtatgccaccgcgagcaccaccagcaaatgccccacgacgcacttctcgttgattagtctccaaaacttcttcctgcaagcaagcaagcaagctaagtccagggcagtatccaaatcgggatgacaatgtaaaatcactacagatcttatttttgccttcaacccatctacgaactgagtaacaaagaacaccgaattccatgacgggtgatgtgcaccatcgatttaggtatttttttcaccatctcaattaccaactagaaaatttctacatggtaaaatttgtttgacctttaattactagaatgacaaaaaaaatatgcttgtacaaatctacataagtatattatcaactgagtacggaaaaactgagtacatatagccaaaaatactcaaaataattaagtttttacaccacttctcacgttattgtaccaaaatcatacccacctttcaagtagttgtaccattaagctgatttattaagtttttgttctaggttgcgcccacttggcaagttgttgtcctagcatgctcatttctcaagttcctacgctaaattgcaccaacttgctaagttctaagttgatgtaccatgaatgcaatttactcttatttaagaaaaggaaacatcgactttatagcaggtaaccttcatattcctctcagaaatagagagcaacattataagaaacatgttccatgctatcctttatagcaacactgacactgctgcaacctgcaagcacatgcgtcggttgtagcttttcaccttggaaaatactcaaaggttcatattgctacccttagaatatacttgtaggtgaaaagctacgaccgacatgtcttcagattagctccccgtctttaactattccatgtctcaagagagaggccatgatgcaaactctttataatcacactgttggtgtaaatattatgccttcaaactttgcattaaattgcttacagggacaaaccgttggcaccaataaggcaccaataaacaaaaccctccagagcccatctggtcctatcattgaaggttatgggattcttcacagagagctgatccaactcaatggtgtcgaggctatcctggacttccatgttttcgaagtctctgactttgatcttctcataggccatcccatagagaaacttctccttgatgcgccgcatatcggagtcctagacatcaaactcaggaaaatgacgtttttcgtcctgatattgcaataaaaaaaattctttgatggaacccattcccaattccgagccaattaaaaaagtgttggctatctctccttttgagtcccacgaatccctcttcgaagatgatgccagtgcattaggaggaggacgatcttggagaggtgatcgagttacacaaaactgatccaccttcatgacctccaattgagctcaaacctcttccttcaagcctttgctatgccttcttgcacggtgatacagagtcgcccgtcatcataagcgacaagcttttcgatgacaagaccttcaaactcacagctgtgttagaaaagcatcactatgttctaggctagtctcttcaagaccttaagtggatttgtttggccttttgtactcatcatgttcctttagatccttcttgtgcaccctctcgagagctgccatgaagactaaataatgtcatgagggaggtcgtgaaaaaagtggtcttgaaacttctacatgttgggataatttatcccctcctatatagtgagtgggtccaaaggggtgagacaagaagtccctttatctccattactttttaatttagcagtggaagccttaacaaccatgatccaaaggctgagagagagcagttaatacaagggttgggagctaatgctgatagtaacattgtaattcttcaatatgctgatgacacaattttcctgattcaggagaatctagattatgcaagaaatttaaaaaagtgctctgcatttttgagcagttatcaggtcttaaaattaatttcaacaaaagtgaggttttcttcatgggagaagcagcctgaaaacaaaacctatatagttagatctttacctgcaacattggggattttcccatgaggtatttgggctttccaattgaccagaagagactgttgaataaagattggaaacaggcagaagaaaaaattgaaaaaaataggatgctggcaaggaaaccttcagtcaattggggggagggtgactctaatcaatgcatgtcttagtaacaccccctatacatgttatccttctttagagtgcctattggggttagagagaaaatgaatttgtttagaagaagatttctgtggcaggaagatcaggggatcagaaaataccatttggttaattggaacagtttgttcccctagagaaacagggggcttgagcatcctagatttagaattcatgaatattgctttgttggggaagtggatttggaatcttgaaaatactgatggcttgtggcaacagatgatcagacaaaaatatttatccaaaaacatcttggctgccacagaattaagatcaggagcctctcacttctggcaagggataatggaagacctggaggataggatgaatgggaccttctttcttatcctgtgccgatgatagatgtttcttgcttggctcaatgtaatagatgttgggggacaattagaaaaaactagcttgtgcatcaggcatcctgtcattttgttttctgtttcttggtgagcaccagggggggtatcctcttaggttcaagactctgtttttgtaagaatctatacatttctttaatggaaattgagggctttgccctttgctcaaaaaaaatagtgagtgggtcaacctagtccagtttgtgcctaaaaagggagatatgacagtcgttgaaaacacgaaaaacgagttaaccccacaacgtactgtcacgagtaagagaatgtgcatagactacaaaaagctcaacaaggctactagaaaggaccacttcctgctgcccttcattgatgaaatgcttgagcggctggcaaatcactcattttttctatttccttgatggctattctggctatcatcaaattcccatccatcccgacggtcaaagcaagataacgttcacgtgtccttacggaatgtatgcttatcgacggatgtcattcgggctgtataacacacccacgtcattccaactgtgcatgatgtctattttttctgacatgttcgaggaaatcatgttagttttcatggacgacttttccgtcattggaaaaacctttgatcattgtctagaaaactcagtgtttgcctagaccatagtctggacggtctagaccgcatctagatgctagacgatgagttatcatctagtttaggacctaaaccgtgaattagaccgtttgaccgcctagacggtcaaagatggttctagactgtctagaccacacaattaaacaatgagacaagtgtagaccataaaactgttgtttagactattgtctaagtaatggaccaatgcatttttttgtggtaggaactaaaacttcatgtcccaaccaaggtccaattgtcttagggttttgacaccattccaaacccttctcctctgctctaaacttcacactgccatgaagtcgcgtcacctcttctctgctagttgccgctatggaccttgcttcctcctctctctggtccgcgaccctatgtgagtagttgcacctatcccagtgccaacagttctccaatattatatgaaatatgttaagtgtatttacatgtgtgccaaatatgatcatcatggctaaatatgtttacaatggacagtccttcatggaaaagtttcttttaggggcttggaatatttggaaataaaggaattgtttcattttttagaataggttacctttgttttcttcctggaagcaagtccttaaaggagacttccttcttatgttgtttcggctgaatgtgcatgatcaaagtcagggattggattcttttgctgtaattttctctttttttactttctttccttttattaataaagttttttttatagcggggccttcctgttgtgtacctttcttatgtgtgccaaagctaacatgcatgctgtgtatctttcttatgtgtgccaaagctaacatgcatgctgcaagcaagtagcaagttgctaactctaatcaacaaaacccaattgttcttagcagcggctaaaagtaaaagaagagggggagaacgaccataggaatgtgagggtcgtgctctaaccctaggacacgtccctaatggacccaacttgatacacagccgattgggtccaaataaggtgacgcaataccgtggacagaatagatatggacataaggacggatggatttgaaagtagacttgataagctttccataaagtacttgcatgcccaaatcggagttcacatgaagtcgtggcggtcgtcacaagttgacgctgttctgtagtccgaatccagcttccgcgaatcctctcccattttgatcctctctatcattcctaagtaaaacaagagtacatacgtctccagggtataaataatatgaacatgaactcaaaaatgaactcacctgatagttaactcaaaaatatgcaggcaggtcaatcttatatgcattttcattaatctttgccaacaatttaaatggtccatcagctctaggcatcattttagattttctcaagtcaggaaatctatcctttcttaaatgcaaccaaacaaaatctccatgttcaaaacttagctcccttctacctttgtcaccagcaagcttatatttagcattcatgcgctctatgttttctttagttgtttcatgtagttttcacatcaattcagcacgttgtttagcatcaaaatttagtttttcaaaagatggcaaaggcattaaatcataggagcatggggcaataacccataaacaatctcaaaagggcacatctttatagtagaatccagctaatgattataaacaaattcaatatgagacaaacattctttccatatcttaatatttttctttaaaacaacccttaacatagtatacaaggttcgattcacaacttcagtttgaccatcaatttggggataggtaataaaaaataaaagcttagtcctcaatttagcccactacgttctccaaaatggctaagatatttagtgtcacgatcagaaacaattatgtttggtacaccatgcaaacgaacaatttctcgaaagaacaaaacaacaatatgtgaagcatcattagctttatgaaatggtaagaaatgtgtcatttttgaaaatctatccacaataaaaacaaatgctatcacggcccctcttggtccgagacaatcccaaaaccaaatctattgaaatatcttcccaaggaacactaggaacaactagaggcatatacaaaccatgtggatttaagtgggacttagccttttgacatgtagtacagcgaccaataaatctctccacatctctcctcatctttggccaaaagaaatgaccaacaagtatgtcctccgtctttttgatccaaaatgccccaatcaactcacctccgagcgctttcaacgataacaacaaaggaacagagctggctagaatgcatagcttgttagctctaaaaacaaacccatcgttgaagacaaatttgttccatgtatttccatccttacaatgcagcaatacatctttaaaattatcatcatacatatattggtctttaattgtttctaagctagagattttgtagtcaagttgtgttaacaaagtatatctcctagacaatgcatcaacaatggtattatccttccctttcttttgtttgataacataaggaaaagattcaatgaattcaacccatttagtatgtctgcagttcagtttgccttgactacgaatatgcttcaaagattcatggtcagaatgtatgacaaattccttgggccacaaataatgttgccatgtttataaagttcgcacaagagcatacaattctttatcataagtagaataattcagaacagactcactcaatttttcactgaaatatgcaacaggttttccctcttgaaacaaaacatcacccaatccaatcccactagcatcacattcaagttcaaaagtcttataaaaatctggaagttggaggagaggtgcatgtgtcaacttatctttcaacatgttgaaggtgttctcttgtgtggtgccccaagtgaaaagcacaccgttcttagtaaactcattcaatggagcaacaatggtgctgaaatccttcacaaagcggcggtaaaatctagcaaggcctaaaaacttcacacttgtgtgatagtcttcgggacatgccatccttgtatagcttctaccttaacttgatcaacctcaattccctacggagtgactttatagccaagaaaataagctctatctgtgcaaaaggttcacttctcaaggttaccaaataaacgtgcatcacgaagagcattaaaaacaacacggaaatgatcaagatgttcacccatagacttgctgtaaatcaatatatcatcaaagtatatcaccataaatttaccaatgaaagcacacaaaacctcattcatcaatctcatgaaagtatcaggtgcattatttaatccaaagggcatgactaaccactcatataacccaaacttagttttgaaagcagttttccattcatcccctagtttcatgcgaatgtggtggtatccactacgcaaatcaactttcgaaaacacaacaacagcactcaactcatcaagcataccatccagacgtggaatagggtgacaatatcgaatggtgatatcgttaatagctccacaatcaacacacatacgccatgatccatatttcttaggcactagaattaccggaagagcacaaggactaagagactcacgtacataacctttatagagtagtttttgcacttcgcattaaatctccttagtttcttccggattcgtcttatatggcgcacggttgggcaatgaagcaccagggatgaggtcaatctggtgctcaatccctcaaagtggtggcagccccggtggtaacgcacttggaaaaatattagagttctcctagcagcaggaggaggcaaataatattgcatatcgtgaagtaaaatcagagcatccttgcataccaaagcataagcaacaaaggtgatgcaatcaattcattaatatcagatatagtagcaagtaagcattttcctttcaaaatgatctcatttttcttatcagcaacagattgggcatttttattattctcacttttggatttggcagctttagcaacatcaacatagaccgacagattgccaaggtctatgttgatatttcttaacgacataactagtaatataattcctagcaatggcgcctgaaacattattcggtatttcttatggttacagatgtaaatccgcaagcgcacagatatacgttgtagcatttcacctgggagtattccaaggtatcgtatttctttaatcccaagggaagatatggtaagagaatactttgttattaatacgcatcacacttatgtagatcaaagtctataaggtaaatggtaggttgacacacagaaggaacaatataagaatactctcactaaataataaatctaggctacatggagaggagtaaagaaaagcctcatttccatacttctagtatataatcattttagtatacacttgctagtgtacaactatatggctataactccctaactatgccctcttagtatatcgagaaaccacccttgattgtcgagttctttacgacaatccggcatgaccatccaaccagttatagataaggagtacctgcaccaggaaccttacttagccctatatacgcacgtggaggaatacccatactgggctgtcaccaccagcggcctatctttacagtttcgtggcatatagtaccacttcatgatattcaataatctaagcaccgcgcttacattactaaatattactctatatctctgcagatgacataaagcaatcatacgaatgaacactaagccaataccactacatatctccagtaagctagccatataactaatactaagcaagtataaaccaaaggtggtactcgaataatggtgcaaataaagtaaaggaccaaaactatataaagaagaatatttcattatagaataaagtcttacaagagggatagaagctactagaaccatatctgaattctccggaagacttgaagaactcaagagctattctatttctaactccactagcacttgaacaaaatataaaccactaaggagatcttcttctttttattccttcttggtgtgttgtgaatgaaggagaagaggagtatttatagggcgaggttgcttggaaggatagagatgctccatggaatccaaagggcatatttcttcccctcttgtcaaatgtcctcctaatgatggttggagcgcaggaaatggtaacaaccatcattggaggtcggtaattaccaacctggagaatttctgggccaactgggctgggcctcggtcggccgagtttcattgggtttgtgtgcccttccgtacatttattcgccacttgttaacctctggctgattgaacgggtgttttccaccatttctcctccatttatatggtgatctcctgtaagcaaatataatgccaagtataagtggtcagctgcaagcaaagcaagtgtatcttcatcgaaatcactagccgacgaatactcgccatctttttttaccaccaaaacatgcttgctagggcagtcacatatgcttgttgcttgtgaacacatatctataggaacacatgttatctaaataattgataaatgagagattacctggtaaaacaaacctttgctcttctctgttgagtccttgggaaattttatgaaagaaaatgtggtgtaactttacatactccgaatcgatgctatattcctaccaaaactatatgtcgatcatattgataaaccttatacatatgatgcttgttattactttgagtttggtcaaattgttgtgacccttgttagattcttttcatacattcatgatcaagatctcacacacacaaacacaggattttgctcaccctctacaccaaaccagaggttagtaaaaatatttcttctaccaattatgctatacttctcactggaagccagtatacatcatccacccattaaataagggttaattggatccatgccattataacttttgcggttttgaaatatgccattgatatttgtctatttgaaaccatgccaatataatttcacacctatctattatatgccattgcttacccattcagcacattttctaaacttataggaccaaattgtccctgccttcttcctcatcctcttcctctctatcctgttcatcttccatctccttctcttgctaaggtcgaggtgtggggaagtgagaaagggaggaagacgagagaacctgacatgtgggcccatagatgttttaaataaaagttggttgactggactgtcacgtgtatgccacgtaggaccaaaattgcactggattaagttagggaggtaattatttcggcataaaaagtttagggtgtaaaatatctgattttgtagttttaggggataaatcggaccgacacaatagttcaggggtaattcagactttttcctaaaaataagtaacaatatgttcacaaattattgttattagagatcatgataccttcaggcacctcactcattgcttgcacacatagcatgtatttgttttgggggaccaagtgggaaggattagacttatctatatttttagtacgagatggtcgcatccatatgggatggatgcatccgtttggtatgagggatgtaatggtcttaaaaactttttaagaaatggcccacacatcattgagaaagaaaagtaggtgggatttgtccgccagtttttgagggtacaaggttaaagtgaatcttagaaaagtattcttttttaggaacatctcatcccactgtctcaaaccaaacaccttaaaaaataggttcaacctaatccgaatccatccaatcccttgaacacatatagtggattctccgtgcacaagttaggaacatctacatctatataggatacttcatgagatttcctcacatggcaccttttccacatgatccaagagtcctgcagtacctctgctgcctgctggtgggcagtcaacatcaacattgctgaattatgacttgactgcaggtcatttgccaaggccatgggtgggtgagaatgtaaacacaccataagagtggtttggaatataggaatgactagtattttaacacaatttgtaacactagaactataataaataacttataaaataaagggagtactgttcggccggcttaaaataatatataagagtgtcgtttgcaatgccatcgatcaaggagagattttagtgctttccagcctgcctaatctacagctttgagatgtggaaaagcacaaccaggaatcatgttccgaaggctgatttgtgagcatgatcactcagggctcaatcgtgagatcagatcagatcagaagcatataatgtcgatcgtctgatctgggtgctgctttgcacaaccaagtccaaccaccgagctagcaagcatggggctggtgacaggggcgatggggagcctgctcccaaagatggggaagcatataatgtcgatcgtctgatctgggtgctgctttgcacaaccaagtccaaccgccgagctagcaagcatggggctggtaacaggggcgatggggagcctgctcccaaagatggttcagctgctcaaggaggagtacaacctgcagataggtgtgaggaagaagatcgagtctctcttgcgggagctcgacagtgtatacgcggtccttcgagttgttggcgaggtgccaccagagtagctcgatgtgctagtcaagctctgggcgcgcgatctcagagaggcatcctatgaaatggaggacatcgtcgacatctttcttgtacatgttgagtccatggaacctgccagcccacacatgctccggcgcctcagaaagaagattggcaaattgttcaagaaagtcaaggttcgccgcaagatcgctggagccatccaagacatcgataagaagctcaaggaggtggctgcaaggtgtggacggtatacggtagatgacattgtcgtcgcaaaacctgagtaccaagcaaccatcgatcctcgactcctgaatctattcagaatggccacagagcttgttggaattgatgggccaatggatgagctcattgagatgttggcccttggggatgatattcatccatctatgaacaaaccaaaggttgtttctatctttggatttggaggtctagggaagacaacccttgccaaagcagtctacaacaagtttaaaccggggtttgattctggagcttttgtgccgattggtcagcatcctgacatgaagaaagtccttagggatattctcattgatcttgacaagcaaaggtacatgcattcgattatgatgttgctggatgaaaggcagctcatgaatgaactccaggaattcatccagaagaagaggtatgtctttcgtcttggcagctgtaccacatatattttttgaagtgctttaatttacggtggactctattagtagtatcaccagtacaaattaaacgatgttagccgttaatttttatattctactaccagtatttgagatgcaagtataaatagatacaaaccgctagattagaaagaaaaatactttacataccaccaatagagaccccataaatagcatatactttttatataccactttatgcagctatgcgcacttcgaccggcgattgtaccacatatattgctcttagtgttaaagctaatattaaccattaatatgatatcaaatccaaaattccggtggcaaaaccattagcaaaaatatcatgtaaaccattttatagtgcttcaggtataagatgccctagggcgtctttgtaaaaggaaaaaaaaactaaagctgttgatcaaagtattctcaaccattatacatataaaactcaactccttgttcttctctgattcagtagctcacctttgcatgtgttaaattcagaaatatacgcaaaccttgtgagagtgtagtcggcaacggaagtcaagtatgatattgagctccccgcctatacattggcaatttcttgaatggtcccatacatgatagtgagcagtactccagctctccaaatctatacttaggatataggactagcaaaaattcaaatcacaagtttaagtactgccaagtggtctattattcttatgatcctgccatcccttgtatgctttgtctcctcttgagtccatgtagagttgattccatctccaatagtagtagttaattttaattcctataacccccaggtgtgaagtgacgctaggcctaacacaactcgtggataggccacaccaacaaccttttgcttccatcgtcgttttgtggaaaaagtttgaaccggagttattaaacattaggaatctcccggcgaaaaaaacattagaaatcaaatcagtccaactctcatatatacaactgttagtgtggtactaaacttgggatgctatatggttccatttgcaatataaatcagtaaatcacatgtgtatatttggttgcccttaaaactctaggctggactatatgatcgaaccatccaggatgactactttggtcttgctgagtggatatagtggacttgtttggtaggtcgcattgtttggatatgtatataaaacagttgagagcagcagcagcagcagcagcagcagcaccaataataataataggctataagcaatgtggagaagatagaaaaaaaagaggagtgttgcctcttgtgcaagagctagatttacacgtgcttgaaatgcattaaataatataagtgagagaaagagacctaaacaaaaaaaaatgaaggcagccttatagctaatgcttcaatatggccatataggcatagctagtaattagctctgtgattaaacttggagatggtatttggttagttgcatggtcagtaggatcatttgtctggctgagttatcatgatggtcctttcgctttatcatagtttttcatcaataatcacatttaatcttttaggataaagagatagcttaatttattaatgacgaaaatactgattacttttctagttattagataagtccacaattcttacataagcacacaacatccactccacacaaggccttacactcatggtccattgggcaaagagtacttgctaacaacagaaagtcctttacagtctgtgataataattcataaaatatttgtggatgaaagtggggagcgagatttagagagcccactgaagtgcgcagtgaaaatagggagtcggtttggaaaggtggctccctattcccattggagatactctatccttgaatttaacaacaaatgaagcaaggtgattaaaagctacagtggtaaaacatggtcatctttgattgcaatttaagttaacccagtggttatatattggtgctatcaaactaaaagtgtgatctttcggtgctacataactagttttgctaattaaatataccatatctgtttgatacatgtttctgattcctagcacgactgttcttcatccttccatgttatgtgtaaatataagaataaacactaatgttttttttttttttgctgtttgacagtttttcatattgatgtgcttctttcttttgtatgttcgtcaattaattttagtcactaacttgttttcactgtcgtgtgggtatatatacaggtgttttatcattattgatgacatatgggataaaaaatcatgggagttaatcagatgtgttctgcaaaatagtaattgcggaagtagagtagtcgcaactactcacatttttgaagttgcagcatatgtcagtgacgtttacaaaatgaaagtgacgtttacaaaatgaagccactttcacatgaagactccaaaaagttattgtatacgagaatagttggtggtgaagataagtgtttggatagtgatccatcagttgatgcatgtgagaaaattttgaagaaatgttgcggtgttccattagctatcattacaatggctagtttgttagccaataaaccaatggaggactggcccgtagtatacaaatctattgtctggggcatggaggcaatgacaatgtagataatactagaaatatattatctttgagctattatgatctacctttgcatctgaaaccttgcttattgtatctaagtatatttccagaggattactatattgagaaaaatatgttaatatggaaatggataaccgagggtttcgtacacgaagagaaagcagctgggatagggttatttgaactcggcgagggatacttcaacgagttgattaacagaagcttgatcctgccagctgaggctgaagacaaagggtacatagatggttgccatgttcatgatatggtgcttgatctagtccgtttgttgtcagctgaagaaaactttgtcactgtattggatggcaatgaggaactggtacttctatcgagaaattcccgcagactagctctgcagtgtaagagttctgagccaaacgttgaatgtcccctgttagctaataagggtgtggagcaactgaggtcctttgttgtgactgagtgctgtgatataagcatggcatccacaggctctcatgttatacgtgtattggctctacaaaattgccttattctggaccattgcagtaaacacagtctgcagcatgtttggagtttacttcacctgaggtaccttggactacagtacattgattctattgagatccctgaggatgtaggacatctgaagtttctacaagtacttgatctgttgggaactcaaataaaagagctgccagagtcaatgggcctgctgacaaagctggtgtgtctacgtgccaataggatttacaaggtatcagctggtttgattggagagctgacctctcttgaagagatatggatagaggctgaaaatgatgacagaatacagtttatgaaggcactaggcaagctgagtaaactaagggtgctgtggattaggctttctacttacgaaccagatgagaggccgaacagagatttgttggattgcctacacaatctgcacagcatccagactgtggatatttatgcctcatccggaaagaagagcgtaatgtgggaagaagggcacgcttcccctcaatgcctccggcacttgtgcttgcaaaccttgaaattctgcaggtttccgatgtggttgaactcatcatttcttccaaacctctgttatctagaattgcaggtgatggctttgaaggaacaggacatagaaacacttggaaggttaccagagctcaactacctcaaactggattccaattacactgcgacaataagcatgggggggacatctggtgatgtttactttcagaaattgagaatttttaaggcaccccgttcactcgtgtggtttgatctacataacatcatttgcaacgagaaggctattatgccaagcctcgaatcccttaagttcactgtccatgtacggttcctaaaagataccaacctactttgtttcgagaaccaacttggtttcaggaaccttggaagaacatcgcttcaaagagttgaagctgacatctattgtgctggtgctcataccaaagaggtggaggaagcggaggcggcactggcgcaagctgccgccgtccatcccaaccatcctacacttaaaatagtaagaatatctgaggataggttgctctcaccttacaaagaggtatgtgcacacaaacttctcctcctccactaatctagctaagctagaacgagcttgttttagtccaatccaatgtgttttaatatgtttgaggacattctcaccccaattcttttaagatccactcctcctccactaatctaactagaacgggcttgtttctcttggctttaataagggtccaatgataataatagccacctcaaacacctataactcatgacgatgatgtgacacatgtttcaagcactaaatattccaattttatacttcatcaagaaaacataaacatcattgcatgtcaggggtggagctagagtattgaggggggtgcccagtaacccgatcaaaaaaaatttgtagctatacctgacctcttttcaccatgtgtgtaccccccccccctcaatacaaatttagacaccctagcttaaacttgatataaagcaaagtaaattaaataagtggcacccccctacatctcgctctaactccgcccctttgcatcaggacgcactaatgttcataagcttaaacaaagtgctgcaaccattgcagttgtcggttgctaataagctcctcttaatctcatataactctagccggccacgattgatagtgaggaataatagctcttctgttgtggatagagatcaccggccacgatatgaatgagtaaagcataatacagttgacaccttttacaatgatgtgtaaaatgtgtggcattaagtgaaaagtggtaatagcattgctttattgtgcaactttagtctatatagattatacatagttcaaaatgatatctaatctttatttaatgccatttctagttcgaaggcctcattataggtttaacattggggcctttaatttgtagatatagttttatgttaaggcttctttatcaaattaagctagtgtattgtgtatgttaacttttatttgatagctagtagaagatgttgataagattgaatgtagcaatcacctctctattaaagagttaaatgggtcgttggtatcacaacttgcaagacgtgtgcaatttagtcatttatcttataaattgctcaaattgatcactcaatttgtttgggagtgcaaatctagtcaaaacagcagccactcatattgtttatgccgagttggacgctgcgttggcaaacatggcaatgagttagcgaaagcaatatatattttgtagaaaaaccgttctactcttcattctcttcgctaatttagttagtatatttagatcgatttgttatgctcatgtgctatgccacgatcttaagtttgatggcatgtctgaccgaacggtgctggatctagcgagtcacaatcatcaacgcttgccacaaccgcaagggctctgtttgttgtcatctttgttgctttcatagtctaggaagctaacgtggcattcaccttgacataaataatacgcatggcatatttttttatagatttgtatcctaaataaattgagtaatcaatttgatcgatatataagatgactgactaaatttcatctagctcacaagttgtgatacctacggcatattttactcattattaaatctactgttgatacttaccagttcattcgttcgtaatttctcatttcgcagcccgatagaaacatcacttataaaactgctttcaaaaatgtcaaagcgcgggtggtgaaggatgatgttggttactttgacttccactggctgctgcataatccaaacatcagaaaattcgaggtctacatcgactgtgaggatgctacgcttgaggaagtggaggaagcagaggcagctgcgtggtgtgcagccaatgaccatcccaacagacccgcccttgaaatcataagacgtgatgaagataagatgatgctgtttgacatacatcaagaggtatatctcttctctgcgaagtctgataacaaagccattcggtgaatttaagcctcttcttagcgcaagtttaataatatagtcaaccactaacgtcaaatcacttgtaatcaatttaagttttaatagcatagccgactactagctttaaatcatctatattcaatctaatagccaatcttggaatctgcgttaccattgactatatggatctatagcccacttcttctctctctaggcactagccggacggttacccccggtctagagtctagccagtctatacgatacgccatacttatactaccggcatattttttttacatatatgtaaatacacttagcaagtcaaaagttctagagaatatttgagagcaacaaaagatggtatttaatgtttaccttattttgcaagaatgaatcttcaattagcttcaaattcaaaccttgcacatcctcaaactcatcctaacattttaaattgtgttcccgaaacaagaaaatgtcacatgttactaactttgtattgcgggtggtgtggttgtggcggttgttggtggaatgggggaaaaatgagatttactccatccaaaccctaacctaaaccatctgagccttggcgggccagaaaatttgagctcctgcacgtcaaatgttttgggtccatcgcctagaccatggtctacacgtcatttttttggtctagactcagctaggcgtggtctaattacttggtctagacgatcttcgaccgtttttgactgtctagacaagaaaatggtctagagcacagtttaggccctaaacgagacgaaaacctgtagtagtctcgcgtctagacgtggtctagacggtctagaccatggtctaggctttatttgaccaatgggagaaagagaaagatcgttcctacagcttttggttgagaagaaccaactgagaaatgccccgaaatctagcctcccacacacgaaatcacccccatgtggatcgatattaaccgtgctttgaggtctctacccgctacacgagagctcatcctcaacaggtcaattcttaacacgtgtttttatgagggaccagtgaccgactatttttaaccaagcctcaattcacctacatgaggagtcgaaccagaacctaaaggcacaacttaagcttgaaatatcagacaaaagttgaagaaattatggtaatttttcgctaaattcaagaaaaaatgagcattttgaccagaagaaactcctacatgtccaccggtaagcccgatatcagaaattccaaaccaaaattgtaaaccttgtatacacatcgcatataggtatttaaacatatattgatgttcaagtttttaagtttgacttgaaacttatcccaaatggcatgttctcatgatcgggtggaatagtttacgtacaagataacacacgtacgcaattctagctttattcttcttttcatctatatattcatggtgtttcttcgtgtaaatcttatattgattttctcattctcagcctgaagttgttcatcgtgatgtcaatgtgcgcaagacaaaggattctcttggctgtattggaatctatatattcagaagttcagcgtctcgatcaactatgagaatgctagtcttgaagaggtggaggaggcagaggcagctgcaagatatgcagtcgacgtccatcttaaccgtccaacactagaactaaagagatacggtgaaaaaaagatggcgttatctgaccaagaccaaacagagcagaagccttgtaccactctgtaatatctacacggttaaggacagtctatagattttaactggatattggcaaggggtatttaaattagaattggccattaacttttaatatcatgttgaatcactagttttattaaaaaaatagagtaagtatgaaaaatataagttagacttaaagttttcttaaatgataaaacaaatcataataaaataaataatactatattataccatctattaaaatatggtggaagtaaaggatgcgagtccctaacaaacgagattcacactcataagacaacacgttaaagcctcgtcggaagagacattatacttgaacccagggtgctcctgccaccacgcttcgtctaagtacactgaaatattttcatgggccaatttaccattccaggtgaaaatcgtctcacttgatatctggggtgacactttttagtacataccaaaacatacaaattcttaattggatgtgcatattaataaaatgcatttcttttgtgtgctaatttattatgtgtgtttctggatttttcttgtatggcatatttgtgttatggcaacaagcaacgttgcataacaatgatcacatgttatatcaattcatccatttaatttaattccaacttcatattcaacaaacgaagggtcggcagaatagagctcagcagatacggatcaattctcgactggagtcaatcggaaaatatcatacctttgattcaaaggatgaacaaacatgatgctttgtatcaagtgcgtagttaataggctgttgtattagtgggagcgtgttttcccatgttcaaaagcaagaacatgaaagctaaggaacgacaaattgttgtttactacacatcttatcatgaccgatttcatcggtagaatgtcatcttacagagactacatatacaaactctggtgtcaagcagaataatggaagaaaaggtgcactgaggttatatctttgatgttgcgtctttgatctcctccaaggttatagcctgcaatatgcatagagtatatataaggaaaaataaaattactttgaggaatttgtagaaatgacgttcatgcaatgacaacggagagctagatggtatctgtgaagaaaacattgtgaaaaaggagcatgcctggtcttgtccagcaaagtcattgtcgggggtaagaaaaagcatgcaatggcattccttcctgcaaaagttgatcaaccaattgaaaacagatgggtccaacagctcatcatattcattatttcatttatatctatgtccattataacaaaaaaataagggccagaagagactatgttcctaagtcatcggtatatatgtaggacacatggtttcaaaagtcatgatgatattactgaggaacgtctttatcaaaacatctatgcttctcactttgggcaatcagcaataatctacagcagattcgtttgtgctctcttagaaatgcatatgcctccacaaatactatgaaatcggaacaaagaaacagtgaaacctcaccatgttccgcgcctataactaaaccacaaatagcatcacaacattatttatgcactatcatagttgttaaaacaagagttataaagaactggacctctcacgcatgggaacacaagggcagttccaaaatccttgtgctacctcagcagctttgtcatcataatgcctgatttaaatttacaccgtgaaaagcaggaacagtaagtaactgtcgtaatcaacccgaagaagaattagagagtggacacagcacgtaagataaattacctacaagggcatagaggagctccaagttgatccttgtgatcagcaagtccctgcaaaaatatttttagttgctattcagaatcaagaagacacagaaggcaatccttaattttatactttttaccaagaaagggctggaacaatgacaacagtccacagtttatattaaaataaaaacaagatgacttctctcctgtgattaaaccagagtagaggagctgattgtcaagctgatggagttttatcagttggtatcaaggaatggccccagtggttccaagagttagctaaagggattgtgaatagtggtagattgtgattcccttttattatcatttgcgctcatttaccatgtcctttatacattggcttgctggtttacaacattgatggatcatttgttcccctcaattgacactatggccacaatgcaagagcttaatcatgccctctaagcattcaccagtttactaaccccttggagtgtcactgacaagaaaatcctacataacactcataacttttttgaccttctcgcccatacccaaacactgtctgatgatcggctgtgtctttgaccaagttacaggtatgatttccatggtcaacacacaactacttagtcttgttagtgactcagtgtccgcaatgtaccaaatcagtcactgcaatgaaagcgaaaagaaattatgtgccaacggataacaacagttcaagaatatcaaggtctcagtccacagagaggcacatgaggcaataaatcaatgtaatattgttttctcgatgctagctgtatgagattagaagaaaagctctaatgtgagaacaaatttcctttttggttaaccttgatacatcttagcaaaatatgacttaaatactccattgagattgtaggcaaatcaaaagtaacaggtacatgaggactcctagtctagacaaaaactacatggtcataaaactcattctagtaatactcataggatcccaccagaacagatcccaggtatgaccttaatcatccaatagcccaaatactatgcagaaaagttaaaacacgatttttgagttacatatgatcctacaatacgaactgtcaactcaaaaggcataaagagatccactatgcaaccaacaaaaagattatccatgatttaaaatgcatgtatcccaccttcaaacaacggaacgaaccatatcatctattcatatatagaccttgatcataccaatcgccttgatctgttttctactcacggatttgtcaccatctgaggtaattattcctcgctgcttgagatccacgatttcggactatcaattggagtactcttttcttactcatgtttgggcaattgttgatttcttctcctttggcagttatcagaggaaataccatttgctattatttatgtctctattctagcaatgtaatttaacagggagatgctgtcaaactttacctgggaatggtaaactattttgagatttgggcacttagacaatgcagtaatatgattgattatctagaggatggggctcaaatatatgccttttattatgttggacttgggttttctattttttttcatgaagagattgctgtgaatacactcttcatatacattttagttcagtaatcagcattcagctggcatgcttcactgtttctgctctagttgtttcatatcccaaacagcactgggaaagaaatacatgttgcattcaaagttccttttgtgctctgaaaatctcaggcagtacgcagcactcaccttctacatcaatgcaacctaggatacttaaaactgtgtgttaacttagcgtgttgaaccaatgaggtgtatggaaggccttgctaaccaatggaaaatcaggggcatactggcaggttctcttctacctaagattgaagcctactgcatcaactttcaacagcagcaatagggcgtaataatcttcttatcaagctgcaggtacagaacacatgaaatagcagcatagaagaatttgtttgtggctaagatgatttttgctagtatttgatttgtatgtgcacgcagtgagatttttttaaaagtaaagtttaacgaggattcaagagagaagtagaaaatagatttggttccattaccttgataacaacggcggtgacggacttctcggaacagaagaaggtgttggagcggcgggcgtactgctcagagaatttgcgcataatctcgagcgacttatcagatgcatccgctccggcagctccagctgtgtacccccaaattaagcaaaagaaatcagaaatcgatcagattacagagtactgcatagattgagtagacggataccttgaactcgaactgtgcatttgcgtcctctgggcatgggtgaagggcaaaaggggctggcggtggtggaggccatcgacatcattgctggacagcagcccaccgatctgcgagatgacaaaggtgtatgttgtaaaaaactaatgttgctcattgatcactcttaagaaacatcttgtagttgcaaaaatgggggatcca

SEQ ID NO: 36713 - DNA, 14377 bp, Oryza sativa
  unsure (1)..(14377): unsure at all n locations
aacgccgccggaccgccgtcaccgttgcctccccgaggagcccgtcgccggaccgcgcgtcaccgttgcctccccgaggagcccgtcccgctggcttccccgttgtcgtctcgccgtcgccgccttggtgagcatccctcctctcctccctgctcccttccgccgcttgccgtgccgccgctcaccgcgccgccgctcgccgtcagtggccgatggccgtgcgctgccgctgccggtggccgtccggccggttcgtcgccgctgcgctccgcgcccgcaccactgccggctgccgcctccctttggtcccagccgcagtcgatctgggccgtcggatcggcctcagtctccacccgggccgcccgtgtgtccgcacacgtggccgccacgtcggtgctccgtcggcgccacgtggtgcgctagcccgtgtctccgtggacttggtccacggtaggccaaagcccttgagtcaccgacgggtgggtcccgtttgtcggcgccaccccttccctctcggtgacatcataaatcgagtttaattgcgcaataattcgttaataattctagaaattcatttaaatggctcaaaacttctaaaattcatatctaattcattcgaactcagaattgagccattcaacttgcaaaattcatctaaaattgagctctacatgtttgtttactttttatgtattgtttcccttgtttttattagagtttttcctcgttttgcatgctagcatgtagaatccgtcgtttcggaagttcgcgttcgcaaggataagagttcggaagattgtttgaagaagcaaggcaagtcacacattccccttgagcatgttgatcctaatttataactgttttaccgtttgcaaataaatatgcatgttttgctaattacatgggatctgggtattacctatctgctcgtttgtgccatgtttacttaatatctgtcctttgtcaaccctgggtaataaataaactagctcatgttacttatgtgacctagctagaactatattcttagccatgcttaattactactagcttagttgacgggataattacagtattagacctttttagtattagaatgagctgcgtgctcgagacatctggccatacttaatggtcgtaattatccaactaaaatgcgactgaatggtggactgtgggtgcatggttttgctagtcgcacccatggcagttaaggaccggttcgcgggaaaccctggaagaattcctcgtactttccacaagccagcgtgggcaacggctgggcttgtagtgtagctttcctctagctgacgcatctagacaagggtgggcgtgatggagtttggatgggccctgcgatggcctatgcggctttcggattcacctaggcacgagaggggactgcccgctgccttgcgaggattgagggtgaaacctaaggtgtggtgtgcttggttagagggggttatgcgaagggtcctgtcacggcctctttccggtatgtcgtggtggcatttcggcgcacggaaacatgtcgtggggctatgtcttgtgggtacagttgtacacctctggccagagtaaaactattcgaatagccgtgcccgcggttatgggcggtcgaccagattcaccgtgattagtcccaccttaataaatcgacccaatgcattgtagtttaggtgggttggttgggcctgttcaacgtggtgtagcgttgatcagtggagatttaatgttactttaattactcaactgttttactgtttgctcaataaaatgttttacaaccgccttaatgcaaatagccacaaaccgtccttgtgttccccttgcacgttagcatcgttggtgtgtgttgctgagtacggtggttgtactcagccttgctattatttccccttttcagaagtgtagtgcttctgagctgaaggcgaagttagaagaccaaggctcagaccccagttgagttttgcctgtggagtggagctgaagcctcgctaggatcgcctgtttccgctgctgctgctttcgtttcggtgtgaggactaagtgcctcttctgtaagtattttacgctttatttacgtttggaactgtatattacttgtcgttttgtgtaccctggctggtcctggacacggatttaatacacaaaatagtctggaaatttgggctaaatttctgggcgtgacaacctaggattaaaataggaaaggttgccaaaatttggaagtctaccggtttcctttgagtgggccggtcagaccgtcgtgtgttgggcggtcagatcaccgattgagtgccgatcagaccggcggtgtgtgtggccggtctgactggcaggtccgagtccgactgtgtttcattgggtttcgaggtttccttgctcgggaaggcatgtttcgggtttcctttagtttctaccccgagttggacgtggaggagggcctgtagagggcaagaccaacccctatataagggacatggccggttcatcgtaaaaatccaatctacaatcaatcaattgaatcgttttttcatattgcttttagttttctcttagtttgtccatctttgtcggtttgcgtcgtaaaccgtctgccgccgctgcgagagtgtgacatctctttgtaggtttgtcctgaaaaccttccgttttgcccacgagacgggtagttatcttaaatcggctccgctagccggtttatttgtcaaaacccatctaggtttagctctttgctagatcgagatggttggcgactctaagatcactgcaagacagaaggtgctgcaatcgttgttgtcaacttgtcacaaaaagttgccaacatgattttggcgactcagctggggaaatccgttcagcgtcaactcaacttcgacttcgccatgacgaagccgccatccaagacggaggtagagccatctaatgtgatacctatcacattggatgatttcaaaggagaagaccgcaagtccatggaggagtacatcaaggagatcacacaggaggcgctgatgagagcatgcactaggactcatcaaggcgtgatcatcaagcccaggccacgtactaagctcgcttctgatttggtaagcaatgaagaggtaacacaatctatccaacaacaagtagcatctacaatagattcatctatgactgtttttaaagataagttagatgcaacttttgagggtaaatttgatgagtttttaaggtttaaattcggccctcttatggccgattacatgtcaaaagataaagcctctaccactgctaaccaagctcctatagatcaaacgagtagcggaaccaatggagcggcgcatacggccggtccgaccgggcttgacggccggtccgaccgggcttgacggccggtccgaccgggcttgacggccggtcagaccgcaacttcgccgtcggtccaaccggccaaacggccagtccgaccgggtattatcccggtggtcagaccgggactcaagccggtctaaccgcgcctctggatgtcggttagaccgggccctggaccggtcagaccggcgcaattataccgatataggggatagatccaatgactaatgctagttatttgtatcatcctaaaacatttgatcctcctgtatctactgctgtaaataatccccaagttcccccacatgttcctaatgcttataatgatgttgctagggggtatcctcccgatactagacaaggccaatataatcatattgcgccacaaacacaacctattaggccaccaaatccaccgctaaatcaacataggcctgataatatggaggaaataagactattagggataaattagagattgaaactaggaatcgtggtagggtttacaaaaagccgtatcctgactattatgataatgtgtcgtttccccgtaattgtcacgcccggaaattcactagtaatttctgaacttatttgtgcataaaatccttgtccaggaatcagccgaggtacacaaactgacaatttaatatacaaatccatcataataataacgttacatacttacaaaagaaaagaaaaacagcagcggaattacggtctagcgaagctccgactccactcccacaggcagctcaactggggtataagccaaacgtcttctccttcgcaacttgtcttcaactgaggtttgattgattattgcaaggtgagtatatgacatactcagtaagccacacagcaaatatgcaagtgcacaggaataccaaagaatggcataatatagggttcatttgcgaaagcagcatttagcaaacatttaggaattgtaaaacagtagagtaattaatcattaatattaatcaacgctgaatagcacacccatgctgcacagacctatctccaaaccaggaatgtaccattccaaaccaggagctaatcaaattattaccagttatagcatcatttattatggtgtgaagtgtgagactaatcacaaaagacattgttcgacccgcccataaccgcgggcacggctattcgaatagttttactctagccagaggtgtaccactgtacccacaaaacacagccccacaacatgtcaccatgtgcctcgatactaccacagtacctcagaaaggagctgtgacagtacccctcgcacaacacaactcaaagcagtgtaccgttcctggatcataatcacccccttataaaacaaggcatggactccccagcgacccccgtgagcttatctccgccacttcttagtctagtgctccgcaatgaaccatgctatacaaaaggtaaagccgttgcccatgctggcttgtggttggcacggttaatgtttcacaaccgaaactcgtgaaccggtccttaattgtcatgcgcacgaccatcaaaactatgtgttcacaacccaccattatcaagttttagttggcacattaattaattaaccaatcacgattgaccatcgtgagcttccattaaatatccataagtgatagtgaagcatgatttatcccattagtgagctattgtttctaagcatggctaagcatctattataagtatctagctgaaccaaactaatatataaggttctagctaatcaaattataacccataaaaaaataaagtcatcttcggccataattaaatgggaaaggctcaccacccggtgacattcgaacataaatgcacagttgaaataaatagagaatttaaatataggattaacatgctcaaaggaattgtgtttgggatctgtgtgacttgccttgcaatattcggtcttcaataagtcttctggaacacttccgacgcactttcgaaccttcgaaacgacggaaacgacaagctaacacgcaaaaacgaggagaaagactaataaaaaccaaataaacagtacataaaagtaaacaaacatgtagatcatgattttacataaatttagagacttgaacggtctcattccgatttcatatgaattaattacaaattttacaagatttaattccaattaaacctattaaagaaaagactattccaaattaattaaaccatttacaaatgatttataactgagacaaaagattaaagcaacctccagaaaagattagatcatatttggtagatgacatatattaaaaaggaataatatgccattgaaaagaggagaggatttatatcgattttggacgactgagattaatcttgaccgagagttgaccaagatcagatggcttggattgatctggcaagcgagcctcacgagataccgactcaacgagtcaattctacatgacacgggatcgcctaaatgattagccgaaaccggcgaacggagccggcagctctgacggctctaaactaaaggacgactccacacggatgaatgaacgaaacacggggaacacctcgttcgaacgaacgagcgaacaactcaacaacggctgtggctaaaccggtggactagaaacgattcacggtaaagccccggtacggcaaacgataggccggtaggaacctagggatgtacctacggctagacaactcgactaccgagcaacgagctaaagcggtggctaggtttaaacggcacacagctgcgacacgacacaacagcgacggcacggcacgacagcaagtggctcggtagctgcggtagcgggacggcggccacttggcatgcacaagtagcggcccaacgacagctagcggcaagcggcaatgcacagcagaagcggcaatgcacagcagcagcagcacggctgtggcagggagcggcatggcggcggctaggcagctagtgcagcggtgacgctaaggcagcagctagcggcacagcgatacgataggcgttgcgcacggcaacggcacaaccgcggttgcggtggcacacatgcagcagcagcgcgacggcgacgtacagcggctaaacagcgacgcggcggcaacaaggagccggcggtagtggcggtgcacagggcagccagcaagcgacacggcagcggctgcgctaaggttagagcaacaacggcgacgacacgaccgagggattgaaacctaacccgaggggacacggatagaagtctcaccgaaccaaagcgatcggagagggagggtcgacgtttacgatccggcggcaacacacggagacgacgacgacgctagacaaacaacggattagattagattggattaagaccctaggaaaaaatctacaccggtgaacggcatgggagcggcggttgccggtgaaccatggcacaataatgcaaacgggggcaccgggaggtagagaaggcgacggcgattcttaccaacacttacgcgacgacagacggcgacggaagatggccggtgacgagcttcgaagggcggcaaggtactgtccacggcggcgacgattttccggcgacgaacgacggcaacagaggggtggacggggttcacttcgcagctgcgatgccgagggaggctgcggcgaagcttggcgatgacgggaggagcagcaaggcctcaccggagatcaaaacgcgatggcgaacttcggcttgacggcgacgatggagctccggtggatttcggcttcggggaaccggctgccgggcttcatcttgctcctgcgaacccaatggagtcgatggcgacggaaagcggcggctaaggcggctgctagctgcggctggaggcgccgcaaaggccgaaaccttctggttcgcgtcggcaagcggcttccggctggatttggcacgaaggaaccaaaggccagggtagagctcgactttgcggagccgagggaagtggcggcgctgaccgacgacggccggggcgacggcgcacggcggctggagcggcggccggaggtggagagagagggagctcgcggggagagtgcttccggcaacggcggagagagggagaggtggcggccgaaagaggagaaggagggggctctatatatagccatgggagcccagggatcgagcccacgacgacgggaaaaactcgggaaagtttaggatttcgccggaaaaaggaaagattgaaccacgaaattggaaaggatttccatagaaacttttggggatttcttggggaaaaggaagaggagattgagaggattccattcccgcaactaatttggaaaaaggagcaacgaggtggccggatttcggaaggggatcggcgacactgtgcacggcacgggagacagtcggctggaggaggaagatggagtactgtagcgccaggaaggtcaaacagacttttttgcgggctgagaggaagggagggaatgggctgaattcggcccaactgatgaggaggacttttattacttttccaaataaattaaccaatgagatgatctttcaattattaaaaatacttccaatgctcaaataattccaagaaaaatcttgaacatacttggacactcaaagtatttaatataataatatccagatcatttaatgattaatttattatttaaataattgctaaactgttctttgtattattaaaattaagaattgagctctgaaaaatccgagaaaattccaaagagtatagttaatcatggagaatttaataaaaattaaatccaaccatgctttatatttaggaaattttatttcccacatttaacttcacttgtaaattaatgaacttttaatataaattctattaataatttattaaataatttataaatcctgaaacggaaattcaggctatggcagtaattatagagttcccgaatttaccaagtttagtggtgaagatggtaggaccacatgggagcatgtaggtcaatttttagcgcaatgtggtgaggctaatagtgatacttttaaattgcgcttgttttctttatctttgtccggtaccgcttttacatggtttacttctttactggcaaattctattcatacttgggctcaattagaggagagatttcatgattatttttatactggagaaaccgatcttaggttatgtgatttaacatcggttaagcaaaaatataatgagcctgtcgttgattatattaagagatttagggatgttggaaaccgatgttatagcttaaatataactgatagagatttggttggtcttgcttttaatggtttaattgctcctcttagagaaagactagatggccaacaatttcttgatgttagtcaacttatgcaaagggctctggctcaagaaagccgggttaaggataataaaaaaattgttagaccatatgagaaaaagcctaatgttaatgtgattgattaccctgaggctagtgatagtgaagatgagggtgatcatgatatgtatgctgctgaatggtcatggactaacaaaaaaaagccttttgtttgttctaacttaatgccgactcctcgcaaagatcggcaaagtgaggttaaatatagttttgatgtggccaagtgtgataagatatttgattatcttttacaagaaaaaaaattagattacctaaaggccatatcgtaccatctcaagaagaattgaaacgtcgagcttattgtaaatggcatgattctcattctcattccactaataattgcaatgtgtttcaacgacaggttcaatcggccatagatgaaggacgattgaagttcaccgatggctccaagatgaagcttgatcatgatccttttccggtgaatacaattaatttcaatgacaagaaggtgttgatttggccggagcaagccgaatctactaaaggaaaaggagtaatcattggtgaaccaaggccaaagatgatagtaccaaagaagccggaggttggtgtttggaaagagaataaaagtgaagcttcaacttctaaagctcctaggaagactaaagtgacccttgatatgcttttggagaaatatgaaaagcagggtggtgagagagctcacaacaaggggaaaagaccaagatcacctctttgggagcgatttgttcactcgctaagacggtcgcattcacctccatatcatcatccacaagacatgtcatggggttcttattcaatgccgccgccgagttatacttatccttattatatgccatggggggcaacatcgccaatgttcaaccatatgcctccaatgcaattcaaccaagggtggggaggaccaagaaggccaattcatgagcgtttttcttcaccaaacaatggccagttttatggtaggaaccgggccaatgaagaaaggagggaaggaaagcgcattaaggtggaggcaaggacttcggaagtgattaccatcaaagtagggtctcatgatgtgccaataccttctggagatgaagttggagagtcctcaagcaaaaaatccgaagctggtaccagctcatcgcagttggccagtctgaccaggtcttctggccggttgaccgcagccatacggccggtctgaccgcagccatacggtcggtctgactgggccatcaggctggtttgaccgccgaactgacaatggtccgaccgacgcctcaggccggtctgaccgcccaccgaatgtcggtctgacctgcgcatctggctggtctgatcggtagtctacgtctggtctgaccgggctccagcaccggtttgataggaggtttgcaaagggcgatgtgagggcttcatcgtcatcaactaaacctaatagggggcattatttacctcctggaacagagccgaaacctaggtggatacctaaggatttgacggctactcaaaggagaaggttgcaacgtcttcgggcccaagaaataagagagaaaaaggccaaagagtaaagggataaaaggttcaatgagttgcgaccaccaccggtatggaggcgtaaaaccatagagaaggaagaaccggttgttgtagaggagagggaagaacaatcggttgctaaagatgagtcatctccaaaagaagacatggatatcaacatggtatgtatgttgcctatggagttttgtgctatggatgaagccgaggttgctcaattttcactaggccctaaagatgcggtttttgagaagcccgatgaatcaaaccgtcacatgaagcatctctatctcaaaggtcatattgatggaaaactggtctctaggatgcttgtggatggaggtgccgctgtgaatttgatgccatactcattgttcaagaagttgaggcatggagatgatgagttgaagaagactaacatgattctcaatggcttcaatggtgaaccaacggaggcgaagggtatcttttcagcggagcttaccgtggggaacaagacgttaccaaccgctttcttcatcgtcgatgtgcaaggtaactacaatgttattttgggtcgttgttggatccatgccaattgttgtgtgccttctaccttgcatcaatgtttaattcaatgggacggcgatgatgttgaaattgttcaagcggatacatcagccgaggttgcaatggccgatgctacttttgagtggcgtcatgggaatattcaatgcttatcggggaggaatctttctagctatgattttattagtatctccgatggaaaatttgtacctatctctgtaaagctggctagtgtagcacggctaagccatataaatttgtataatgagtaaagaggctaatttagagtggttacaaaagagggtgcaaaaatatcggtctacaaagaacgatattggtgaaactattgaagattttgatgaagtggagaagcttggacaagggtttacatcggccgatccgttggaggcagtagacataggtgatggaaccaaaccaaggccgacttttgtaaacaaaaatatgagagtcgattataaggttaagataatcgagctacttaaagagtatgttgattgctttgcatgggagtatcatgagatgccgggtcttagccgtgagcttcttgagcatcggcttccaattaaaccaggttttaggccttataagcaatcacctcgtcgttttaatcctttgctatatgaccgagtcaaagaggagattgatcggttgttgaaggcggggtttattaggccatgtcgttatgcggagtgggttttagcatagtcccggtggagaaaaagggaagtggtaagattagagtttgcatagattttagagatttaaataaagccactcccaaagatgaatatcctatgcctatagccgacatgatgatcaatgatgcttcgggtcataaggtgattagctttttagatggtaatgccggctacaatcaaatctttatggcggaggaagatatgtacaaaacggcttttaggtgcccgggatttgttggtttgtttgagtgggttgtcatgacttttgggctgaagaatgccggtgctacatatcaaagggcaatgaatttgatctttcatgatttgctaggtattatcttagagatctacattgatgatattattgtcaaatcagatagtatggaaggacgcatagccgatttgaggttagcttttgagaggatgcgccggtatggtttgaagatgaacccacttaagtgtgcttttggtgtgtcggcggggaaattcttaggattcatggtgcatgagagaggggtttagattgatcctaagaagatagaaaaaattcgtaatttcaaagcgccgacatgcaagaaggaggtccaaaagttgctaggtaaggtgaattatttgaaaaggtttatttctaacctagcgggtaaaatcgatgcttttgttcctatacttcgcataaaaaagaagccgattttacttggggagcaaaacaataagaggtgtttgaggagttgaagaggtatttgtctactccacccgttgtgcgagcgcctaaagccggaaaaccttttcggttatatattgcctccgaagacaaagtcattggtgtcgttttgacgcaagaggaagatggcaaggaatatattattacatatttgagccgccgtcttttggatacggagacgaggtatgtctttatagagaggctttgtttatgcttatactatgcttgtaccaaattgaggcattatttgttatctagtacatgcatagttgcttgtcaagccgatgttattaaacacatgttgcaaaggccaattctaagtgggagaattggcaagtgggcatatgctttgatagaatatgatttggcttatgaaccattgaaatctatgaaaggccaaattgtatgtgattttatagtggaccatcatgtagatattgcttatgaggaagagatttgcctagttgaagttataccttggaggatttattttgatggttcttcttgcaaagaaggtcaaggcataggggtagttttgttttcacctaatggcatgtgttatgaagcatcggttcgtttagaatattattgtacaaataatcaagccgaatacaatgctttgttattcggcttacaagtcatggagatggttggagctaagtacgtggaagcttttggtgattcggaattggtgctgcaacaagtcgccggagtttacaaatgcttggacggatcactaaataggtacctcgattcatgtttggatattattgccaattttgataattttgctattagacatattgctaggcatgataattctagagcaaatgacttggcacaacaagcatctggttataatgtgaagaaatgattatttctgatattagaagagtcggtgcttgattttaaatctttgtgcgatattggcaaaactgaagaccaggagcggtctgaccggcattacacggccggtctgaccggtgaccaggggcggtctgaccggccacatgccgtcggtcagaccagcgaccccgagcggtctaaccggcctggtgtcacgcccagaaattcccgaatagaattccaagcagaatgtgcattaaaatccccgtccaggaccggccggggtacacaaacgacaatattgacattcagatccacgtcttacaaacatcataaaagtcttacataaatgcagcggaaaaacgaaagacaacaggagctaagccttgactagaactgcagcgggaaacaccacttccacaaggcatcctttgacggcacggacgaagcctactcctcggagaaacctccatctgacacatactcgtactctggggttgggaaaaatagagcaagactgagtactacccnctgtacttagcaagtcataccggaataggggtatgatgcagggaattatcaaggagagctagagtggttcatttgcataaagcgagcatttataaacagaagtttaaagaagaaaacagtcgtaataattaatcaatattaatcatccactgtccaacgctataccacgttgcgacaggcccaaccatccacctatactatccaatttcaatagactaaactagggtgagactaatcacggtgaatctggttgaccgcccataaccgcgggcatggctattcgaatagttttactctgattagaggtgtacaactgtacccacaagacatagccccacgacacatttccgtgtgccgacatgccaccacgacataccggaaagaggccgtgacaggacccttcgcataaccccctataaccaagcacaccacacctcaggtttcacccccagtcctcgcaaggtagcgggcagtcccctctcgtgcctaggtgaatccggaagcgacagaggccgtcgcagggcccgccccgctccatcacgcccacccttgcctggatgcgtcagctagaggaaagctacactacaagcccagccgttgcccaggctggcttgtggtaagtacgataagttcttccagggcatcccgcgaaccggtccttaactgccaagggtgcgatcagcaaaaccatgcacccacagcccacca

SEQ ID NO: 36714 - DNA, 536 bp, Oryza sativa
gttcttacatgttttctcatggtcaacttattccctgatcaatctcccgaaagattactgtttggattccatgacgtctccatgaccaatctcaccattgccatgctcgtgatcgttgccctcgacgacgaagagatcgcctaactgctcgtcgttgatcagagaatcaagaaacgaggagaagtcgtcgtcacccaccatggcggaagcggaacccatgtcgaagccaccatgaactgcatcctcggcacagaactgatcgccaaatcctccttcgaatccctcggcatcggcggcgctcaccatcgctgcgaagtcaccgccaccgtcggccggtcgggcacgatcgtcgctgcactcaatgccagcggccggcgaggatgccgtcctcggcggcttggccggcaccgccttctgtaagaagtggcggcgacggcagcggcggcgtttgagtgatcggcggcggccgtcagcggcttgtgcgtccgcgggtcgatgccctgcgcgatgagcttcttgctgagatgcgagttcca

SEQ ID NO: 36715 - DNA, 662 bp, Oryza sativa
tgaaagaaaacattagaacatttgcaatataggatcaacatgatcaagtgacaagcatgacttgccttgctctgctgctagaggaacctcggcgactatttcgaagtacactggagcgatggaagaaccggaatctagcgacatacaaggcaaacattgcaaacaggctacaagactactgaaacagagaacaaaaccatttttaatggattctacacatttttcttgatttactgagacttgaatgggcttaaacggagctcggatgaattagttatgaattttagaagattcactgtgtttattactataacaaaaagtccttaaataatttattgcacaataactcccagggctgacgtcatcaaggggggtggcgccgacaggagggtcccactggtcagcggctcaaaggggggccggtgcaccgtggaccgggaccacgcgggtggtccaccgccggtccacgggaccgacggcccagatcggccccttagccgatcgggcggtggcgatagaggcagccgccgggctcggctcggcatcaaagccggccggccggccagggctagcggcgacggcacgcggccgacggcgatggcgaccggcggcacgggaggcggaggcggcggccaaaggcgacggcgcatgacttgaagcgg

SEQ ID NO: 36716 - DNA, 14491 bp, Oryza sativa
gaaaaaagagaaaagaaaagaaagaaaaaggaaaaagaaggaaaaatgatttttcctgggattaaaattgcatgtgctcaattttaattggttaaaattatttcgagagctctgaaaattccactaaaaatcttgttagcgtatttcgacatgtagaactcaagaaaaattccacatgccaattccgattattatttgcattagtttattaaggttttgtcttgatttgcaccggcattttcttaggctggtttataaattcaattttaggcttaggaggagaacttcagggtgtgacacctggtatggccggtctgaccggttctaggcagagcgctggagggcacgtttcaatcaattttaaggccgaattaattgtgaattcggacatttgtgcccaagaaacagaagaagattggaggattcctttgattcgatatttgaaagatcccacgcttaaggttgatcggaaaattcgacggcaagcattcaagtacacattgcttgatgaagatttatatcgccgaaatatagatggtgtcttgttgaagtgcttagatgaagatcaatctaaagtggctatgggagaggtacatgaaggaatttgtgggactcatcaatcggcccacaagatgaattggttgcttaggagagcggggttctattggccgaggatgattgatgattgcttcaaatattatagaggatgtgaaacttgtcaacggttcggcaatgttcaattggcgcccgccgccgtgttgaatcctataatcaaaccatggccattccgaggttgggctttagatttcattggtcaaatttatccttcgtcatcaaaggggcataggttcgtgctagttgctacggattacttcaccaagtgggccgaagatgtgccgttgaagaatatgactcatacggaggtaattgactttattttgaagcatattatctatagatttggtattccacaaacattaactacggatcaaggtgcttcttttatatctaaggaagtgaagaattttgccgaatcttatggtattaaattgttgagttcttctctttactacgctcaggctaatggacaagccgagtcgagtaataagacattgttgaaattagtgaaaaagaagattgaggaacacccaaagaggtggcatgaagtgcttttcgaagcattgtgggcgcataggatatctaaacatggtgccactaaagtcactccttttgagttggtttatggtcaagaagtcattttaccggttgaggtaaatcttggttatcttcgttacatcaggcaagatgatttgtcaagtaaagattacaagacgttgatgggagacaaccttgatgaagtcatcgacaagcgcctgaaggctttggaagagatagagaaagaaaagaagagggtggccaaggcgtacaacaagagggtgaaagcaaagttgtttcaagttggagacttggtttggaagacaattttgcctttgggtactcgatccagggagttcggtaagtggtcccctagttgggagggtcccgagtatgcggcattgttcgacgaaacgcatatttcttggagacacttcaagggagcgttttcagcgagcaatcaatgggaaatacttgaagaaatacttcccgagtgtgtggcaagacgcttaggaggtactatggccggtaattagattatcgccctaagaccaaaacatgttctatgcttttagattcacgttgttcatcaaaaaggcagggggcatgtgtttacacccaaatttggcacctaggattaaaataggaaaggttgccaaaatttggaagtctaccggttttctttgagtgggccagtctgaccgccgtgtgttgggcggtcagaccgccgattgagggccggtcagacctgcggtgtgtggccggtctaaccggcaggtccaagtctgactgtgtttcgtcgggtttcgaggtttccttgctcgtgaaggcatgtttcgggtttcctttagtttctaccccgagttggacgtggaggagggcctgtagagggcaagaccaacccctatataagggacatggctggattattgtaaaaatccaatctacaatcaatcaattgaatcgttttttcatattgcttttagttttctcttagtttgtccatctttgtcggtttgcgccgtaaaccgtccgccgccgctgcgagagtgcgacatctctttgtaggtttgtcctgaaaaccttccgttttgcccacgagacgggtagttatcttaaattggctccgctagccggtttatttgtcaaaacccatctaggtttagctctttgctagatggaggtggttggcgactctaagatcaccgcaagacataaggtgctgcaatcgttgttgtcaacttgtcacaaaaagttgccaacaacagcataaaaatttttgttttgggaactaaatagggccttaatctatgtcatgattctgctcttaccattttacatattctagctggtaagctgctgccaaaatttaaattataaaatttacttgtgaagttgatttcgagttttttttttcatcgcactttatttttggagtgaattgtactttagggcagattttattacctaagttgcaaattggaccagttatcagcacatctttacacttttgaccaagttttattaccaaactttgcttttttaaccggtggcccacacgtcagcatcaaatagtgttcttcctctcctctagggatggcaatttgacccgtttgcccgtttatccgtgggtaaaaaccctaatagagttggatttattctccatttattacccttgggttttttattgggtcaaaacctgtactcaacaggcaaacgggcgcaaaaacttcgcttgtttactcgcgagaaccaattgacatgtgggccctcggtcaacttaatataaaaaccacatctaagactatggggttttcttccttctcttcccctttccttcatagccccactccagtttcctcctccacagtcgccactccaggccgacatgggacaggaggggcgcgtgaatcgccaccacctcccacctctggtcacagccgctggccccaccctccagccgacgactttcacagccgccacgggaggggcaaccgacgaagctgcgaccaccgccgcctcctatcccgtctgcgccgagctcccacctccggccatcgacgtcctccagccgtcggccgtgacaccttcctctagtcgctcctccttcatccgcctggctgcctcccacctccggtcgccgccgcctcttacctccactgcgccgtgctcccctccaaccatcggcgtcctacttgtggtctgtggagaattgtgatgggtaaacaggcaggcctgcaggcacatggcgcccacaggcgatgggcatgggcagtgctccttgcccgtcatgtagtaatgggaatgcctgcggcaggtagcactacccatgcccgtcgtgccctactgccctctcctccgtaatcacggccagctacttgcggtcgactaggaagcagagatgagagcggactcaacggatgaaggagatgagaaggacatacgcacaaaaaaaagttcaagaacgcaggcctccacattctatgtattgccgtctacgtattgccactcgagcttgatttccgttggtgccgtacgcgctctactcgacctacacattctgccatgccctgcatatcgtgaagcattggagcaagcatagttgatgccttggtgaactgcatcggggaatattgtcccaatttgtggaggctacggcgagcgcctattgctcatcgccaaggagcatctcctccgggccgtgccctctacctgacgtgaagctcgaggatctcctaggctcccagttcccaaaatcaacgcaagaagcgagcacctagctatagcagatccttgattggtagtagttgactcctgctcatgctgatctgatgcattgaggatttgaggggccgcatgctgctgccttcatgagctcaccaagtttcctagatggcagagaagaaagtgatgagagagcagtagagggaagtggtacaaagtgaattattttgcaaacttatctagtccaaagtgaaaatctttttttctcccctagtccaagatgcaaccttggtaaacataagcggcccattgtgtaattaactcttttatttaacatcaacttttttttaacattaacttctgaatcactaagaacataggggttgttcagattgatgtcatttcaaatcatacttttttaaaaaaaaagttgctaaagatgtgcatacatttagttttttttaatcaaattttagtaaatacataaggaatcatactaaaacttagcaatattgccaacttaccaaattttggtaaggtttattttggctacaatgtaaacaaccatgtatataaaagtcctcccataatttttttcttataagcctttcaacttataatcaacattaggttaactgatggttaaaaaaaatcattgagaaatagatttttttttttactttgattactttgccactcactatcataacacatacgagctctagcggtagaaaaaaaaagatgttggcacatgaaccattgtgatggcatagaagaaagataaaattggttctacagcatcgttaattcatgttttagtcatataacatcaaattcgtatattattttagtaagaccaaagttatatcttttactccttttaacattccatcaaaaccaaaacgaaaaacctctcccaccacaaaactattgttatctttctctaccatacattttgccttcttccttcatttaccatcttccatatgccacgaactcaccatagcaggcctcttggggagcttgtgcgcatcacgataaatacgaaccagcggatgagttcaaatgcactgcatcgggggctaggttggaggtagcgtgcatacaagctcgatggcggcacatctcgtgagatggagggcagcataataacaaccagacatgcatgattcttgagatagtagtcgggagcctaggtgacaatggatttgaggagagctcaactagcgtgctgtagggtgttattcaatttaaggagagctcaaggacaatgaaatccacctaagggcgataatgagagcgatggtgaacaagctcaagaagtgtggtgttagagcaagcttgagcacaacagtggtaatggacatatttctatactagatgatgtcccgcgctttgctgcgggatatatgttagatattggagaaatgataaaataatttggattgaaatattatgaaaatgatttgaaaatatgatgatttagcatgtgtatgtttagttttagaatgaaataaattgtagatataattactatatacttgcatgttgagctttgtgtgcttaatgtgttgatgtggcatgcttacatgtaggttttaggagtgttaataaatactatgtttacatgttgagttttatgtgtttagtgagcattagctctatagaaagaaggaatcaggggagtgatggtgaatgcccaagaagcgtagtgttagggaaagcttgagcacaacaatgataatagacaagttttggttgagtttgagctttccaatgagaagtgtttataactgtataggatgagcaatgcaccatggggaaatttaactactgccactcttgggatatggcaattaattatttgccactcactgtatatgacatgtgaccctcatgacatctagtggcaaatcattaagtaccactcgtaagagtggcaaatagttaaaagcccttggtccatgacgagttcagaaacagaggtatggctaagtgccggtccaggggaagtttgagaatggaggttatacaagttcaggctaagtttaggaatggtgatttagggcatccacgatgtgacataagaccttataacaagtcatatacattgtggatattagccataaagcattaaatgctaaaaatggccataagcttatggctcaaccttaagaaataaaataatgagataaaacacacatgcacactagaaagggtgagaatgactctatgacatggtggaacctatttttatgtaggacttttttacatagttgtgggaccaacttaccatcactttatgtcttaagcattgtgaccatagtcagagggtgtggtgggacccaccttatttccaccaaagacatactagtatgtccctgggtttgatttttttttttggacggagggggtaagcattgctcttgcccttagagataaaggactaaaggaagaaaaaagaaggtagcggtagtgtttatatcatattttgtcaggaagataataaaaagaaaagaaaacaaatagaggtttggatggaatgctaaattaaagagtggagataacttttggtgctacaaaattagaaatgggagctcttaatgttgtataaccatttttttcctaaaaggaaatattcacatgatgcttgtattcaaataatacatgacaataacaaatgtatttcttttttttagggaaaacaaaagaatcttgcttcttactcatataaagtagggacaaggaaagatgatcagtaaacgattctaagataggcatgcacaatttgtcgagcttttgtttcacaaatcatatattacaatggaatgtcacattttagattgaataagttaaacaagcaaaaattgttttcaaacatatgctcaacagatcgtgcttatttcagggagatggccaaggtggattttttttaaccttttgtattggatggatattatatgtagcttgtagattagtagtaaagcaatatatttttagaagaaaaatacaataatattctcttcaaccaaaaatataaggcacaacaactagtaacgcaatgaaaaaaaatattataaccttctcattttttggctctaataaattatccataagtcgctttgacttctttcttagccaattttgttttatgtttggaaaagtttataaaaaatataggaacattttcaacataaaacaaacatagtatcaaaatatattcaatgttatatttaatgaaactaatttgatgttgtagatattactatctttttctataaacttagttaaatctaaagaagtttgattttaaaaagtcaagatgacttacataataaatgatagagtaaaatgcatgcactcaataagattaaatatttttagggtagagaattaaaaaatgaattaaacatgaaggtgctactagttaattctatatatacataataaacgcgttatattatagaacattaaatctctactacttaaaaaataagaggtgcttctatcgtccgtcaaaaaaaccgtgggaaaaaaaaccgtgtgaaaaaaaccgggcaaaaaaagaaaaaaaaagactctgtccgataaaaaaacagacgaaacaaacgaaaaaaatctgcgagcgaaaaaaaaaaccaaacctgtccgatccaaaaaggcgaaagaagggaaaaaaccggccaaaaaaaagaaaaaaaatatgtccgatccagaaaaagtaggggcgaaaaaaaggaaaaaaatagaagattctgactccgtctacacggtaaaaaagggcgaaaaaaggaaaaaagtctaaacgaatccaactctgtcgacgcggtaaagaaaatggcgaaaaaaaataaaaaaaagtatctgtccgattccaaagaaaatcgaatcctattatatgtgacacagcgtggtaaaaaaacaaatcgaatctgattccatcaacgcggtaaaaaacaagcgtaaaatttttttctgtccgattccaaaaaaaaggttgcgaaaaaagttttccgtttctctttctctatctcaatctgtatctctatctttatctctactacttaaaaattaaaaagtgtttccatcgtccatctgtgaaaaaaagcgtgaaaaagaaatcgggcgaaaaaaatcgaatccgattatatgtgacgcggtaaaaataaataaagacgtttctgacatccgtagtaacgaaaaaagggcgaaaaaaaatgaaaaaaaaggaaagtccgattcaatatctatatatacctaattaaaaaaatttgtatggcttatgggttatagtttttgtccataaaaaaaattttccatcgcacgtgcaatcgatcccgcttcaatccctctccgatggcaaaaaataaaaaaagaaaagaaagaaaataaatgagagaccgcatcaaatttggacctaaatcctaaagaaaacactactacaaaaatacaagatcagattcaagaacactaagaaaatgccgacgccagaaggggagggtgtcgtcgtcgctgccgaaccaccaccgccgtcgcagggatgtcggtatgccgggccgccgccacgttgttttgagagagagagggggaggggaaatgattttagggttagggtttgggctgttgaacttttatataggtcgggatgaccgtctatcagatcggacggctttggcttctcccgcgtcaggtcgaacgccattcccaagccgcccacacggaataagttcactttaggtcgcttaagttgttcctccccgattctattcccaggccgcccacactattgggccgcctcatggaccacgtgtacgcgctccgtatggaacaagttcactttaggtcacttcagctgaactttttttatttcattataaatatattttcttaaagagctcatatcatataaaactaaaccttaatcttataaaatttttatatttgttataattttaattagccgtcgcaacgcatgggcattttttctatgtcaaaaaaaagaccacgacatacaagtgagagatatataccacacacacccgcaggctcatgtttaaatgaactggcaacatattttcaattataggtctaattgttttatttaggtgattaaatttgttttcatttatataattagtttgctctatttaagctttttaaaaattgctaaaaatttgagaataacttttcctacttcgtattatattatttttagctaatggaattaatggaaaattaattatatattttttatcttttttatcaaaggttactgcaattttatttcattattattattattattattattattattattattattattattattattattcctttatatttttttcccatctgtataaatgattaaaattacctttacccgttgcaacgcacgggcacagtaaaaaacaaaatcactctggacaaggtccggcacggcccggcccggcccattgctatcttccgttccacccgctcccgttgagctcaattatctctctccgatccccttccttccgcatccatcacccccaccactacatcacccatccccatccatctctcccccctccctttcctcctaaacttcagcggcgacacccctcgcgagccgctcctcctcatcctcctccgccgccgccgccgcgtcccctcggtgcccccctctccgccggccgccgatccggccccgcgaggtgaggatccgcccgtcgctcgccttccccttcgctccccgcgcgttagatctgcgccgccgaccccacctcgactggcccgcggcgcccccgatcggcacccccaccgtcgaggatgaggcgcgggggttaggtttccggtggccgccgtgcggtgcgcggttcgcggctgcttttttttttgggttaatttatgttgccgtgtggttcatctgctttagatctgcgccattttggttggggggaaacgttggttttgacgcggttggtacgaatcctgcgtgttctccttcggggctgtgattttgggggcggattgggagggcttattatttgccgtatgtgtgggtgcttctagtgggatgttacgtttgtgcgttggtggtggtggtattggtctcttgtggttcgatttggttcttctgttaccctgatgtgatgaatcactcgccgcacatcaaatttattcttctgcgttgctattttgtggttcaatttgtgcctggaaaggttgcaatttgtggttttgaaaatgtgcctggaaaggtgaaaaattatgttaacgatataccataaaaagctgagagggtggtccttgatctaattcgaattaagttgtctgagcttcattcaccagctgaaattcttctgttttaggtatcttgtttttagatctgttgacgacacaaggatctcttttcttccattgtgcttgatatgtctgagaatgtttagatgagattgttttctgacttttctccggaaaccatgtgtagataatagacgacatctctgttttacatctaatgagagtcaacaaatattgtatttgggcaagtcgtatattgtatgcttggtttgattgaaccatatattaattagtgatatagtttaggcttgattttgtgagttatatgcgtggttcactcttgaccttttagatttacatggatttgtttctctaatggaaccgtgcctaagatgagaaatatatgattataggttttgctagattccaatgaccatagagcactaatcttctttctttacagttgtaggaatccttgataaggctgatggcttcgatggatgagcctctttatcccatcgctatactgatagatgagctcaaaaacgaagatattcaattgcgtctgaactccattaggaggctctccacaattgcacgagcacttggagaagaaagaacccggaaggagttaattccttttctcagtgaaaataatgacgatgaagatgaggtgcttcttgctatggctgaagaattgggcgtgttcattccttacgttgggggtgtagaacatgctcatgttttgctaccaccattggagacattgtgtacagtggaggaaacctgtgtccgagacaaggcagttgaatctctgtgccgtattggagcacagatgaaggaaagtgacattgtagactggttcgttccagtagtaaaggtaagaagtttattaatatttaattgttttttttctgtagagttgccagatttatcagttcgctgccaacttcactatgtaggtttcttgttactttggcatacaattgtgtgatatttgtgtttgtttcttgcctgtcaattgcaattttgttatatattgttgattgttctccatagaagctattttaacacattgcaattgttgactggaaacagtgccacaatggcattagttatcatgctttcattttccttttccttagtccattccatctagcaccactaatgaatactttatggacagactattttacactacatcgtgttgtattcagctaaccatgcattactcttttcagaggctagcagctggtgagtggtttacagctcgagtatcgtcttgtggacttttccatatagcatatccaagtgctcctgatcaattgaaggcagaattgaggaccatttatggtcagctatgccaagatgacatgcctatggtccgaagggcagctgcatcaaatcttggaaagtttgcagccacagttgaacagaactatctaaagacagaagtcatgtcgatatttgatgatctaacccaagatggtaccatgcacctctcacataatattttgtgctatttcatacttctttacattcatgacataatagtctttaataatcctattagtaactaataaaaaactgtacccatttactgcattgctgattctaattctgttgaatttaccactcccagttcatttgctgcttcagttttgtaccaagaactagcataaagagctatttgtatgcatccattattcaatttgtacaactgtttatgctagtccaatgttagtccattagtgcctgaagataacaaatatcaacacaaactctcagaaatcatagtactagcctttcaatggaattctgtcatggagcaaatagtgcatgattgagccagttgggacaattctgtcatggagcaaatagtgcatgattgagccagttgggacatttactatacatgttctgcagcctaaataatgcatctaacaatattgctggccttttattaccagatcaagattccgtacgcttgttggcagttgaaggctgtgctgctcttgggaaattgttggaaccacaagattgtgtagcacatatccttccagttattgtcaatttctcccaggtaaattacacccctacttggtacctcagtgtcatctacttgatatcacatataatatttatttgcagacattcattagttgctagaggttcctgatgctccgagttgcttctgttgtatgtgttaccataattatgacatcttttactctctgtaactcattaaataggacaaatcatggcgagttcgttatatggttgccaatcaattgtatgagctctgcgaggcagttggtcctgaacattctaggtattatgcgccttatgtcctaaatcttttctgtcaaaaccaatcataaatactttggtccttaaatggtgcaagttattatttatttcttatctaaatacataattttgtaatctgattccaatattcatctatggtatgttcatgtgtttggtaatagggagcagttggtgccggcatatgttcgtctccttcgtgacaatgaggcggaagtgcggatagcggctgcagggaaagttactaagttctgtaggattttaagtcctcagcttgcaattcagcatattcttccttgtgtcaaggtgggccaacgcttaaccaaatattattaactggttttctgctgctgtttattcccagcaaactaacttgccaactgcatctgcaggaattgtcatcagattcatctcagcatgttcgttcagctttggcttcagttattatgggaatggccccggtcttgggaaaggtcacaagcaaaatatcttcataaaattttacttgaaataattcaaattatttgtttgcaacagctttactgttcagttgtttactaccattgcttcacgattgttggaaacctgacttgctttgtttctggcattctgtaggaggctacaatcgaacaacttcttcctattttcctttctttgctcaaggatgaatttcctgatgttcggctcaatataatcagcaagctcgatcaagttaatcaggtgatgttcatgtttttttcttattgaaatgaatttatcttatcttttgtgatgttcatgctgtttttattagcgtgaagtctaatttactccacctcaacaattattttagtctagaaatcaaccctcaactatgacaccagacattttatacacacttcgactatcaaaactggctagaatacccctcaagggcaaacctggttatttttttaaaggattctcactctctaccagcctaaccttgaggtattgactacctgcagtgtttagaaaacatcagtcccacagctcaatataacatttcaattttgcttccctaatgactgataaattccttggtcatagaaaattcattactgagtccttttgatctttcaggttattggaattgatttgctgtcacaatcactgttaccggcgatcgtagaacttgcagaggataggcactggagggttcggcttgcaataattgagtacattcctttattggctagtcaattaggcgttggatttttcgatgacaagctgggggcactttgcatgcaatggttggaagataaggtatttaccaggctgtcattctaagtctctcgatcatctatatattgtgcacaaaggcactctaatattatcaacatacgtgagtgtagcaactgttttttgcaagcaaatgacctgaattcacttctattgtggcaccagcagtccagcacaatacagcctgaaagactaacattcagacatgtccaatattttttctcaaactattaacagaaaatttgggcacaccgatatttttcgctactaacgaaaaatgctgtgacaattatggtagttgcaaacgtcagtaggcacacatttgaatatctccgacatttatgacttactaaaataggtttgtcattgttctgaaagacaagttttgttattgttcatttagttcatagaaactatatcatgcttttgtgttcagtgattatatagtttttttttaatgcagaatggacaagtggtatttataacctgctatttaagatgtttttaactggatctttaattttaggtcttctcaatcagagatgctgctgcaaacaacttgaagcgcctagctgaggagtttggtccagaatgggcgatgcagcatataatccctcaggttatttataaaatatttgaaccctagtcagtatttgcatttgtgaaatccttaagcaagctgacttttttgtgatgtagctctactggaagtttggaactcaactgtatt

SEQ ID NO: 36717 - DNA, 4526 bp, Oryza sativa
  unsure (1)..(4526): unsure at all n locations
acccccctggtttttatataatgtctgaaccatagtgtatttgcatctatgaaatccttatcgcaacaagcaagccacctgattcttttttttttaatgtagcctagtggaagccagtttgtcgttgttatttcatggaaggtagaaaatcatgtctaaatatttagaggtcaactatgaaactaatctactgtgggcgtgttgactgatgataaatctaatgcaatggtgctgataacatattgtcaagttaatgtggtttgttaatttaaggttaacttgttggttcagaaagtacaggataatctgttcaaacaaagcttgttattccaaagtttacttttgcttgagtctagttctgtccaaattaatacagtgaagtactgcatatatatgcttgttgtaatagcttgtaatttctagtcttgttaacttaacatgtttcattttctaggtgctggagaagataaacaacccgcattatctctaccgcatgaccatcctgcaagctatttcattgctggcccctgtcatgggtgccgaaatcacttgtcaacagctgctccctgttgtgattaattcctcaaaggacaggtgaaaaatttgtaatttgtaaatgtatagtttacccatctgatcaaggccttattaacaaatatttttctaaatttcagagtgccaaacatcaaattcaatgttgcgaaggttctgcaggcacttataccgatccttgatcaatctgtgagttgcagtattttttttgccttgattcctttcttcgtaatgctataggacatttacaggttattggggtatattatgaatacttactttgtaggttgtggagaagaacgtgaaaccatgcctcgttgaactcagtgaggaccctgatgtggatgtaagatactatgcaaaccaggcccttcaggcatgcgatcaaatcatgatgtcaagctaactgtcttcctgtccagtatttagaacttgattctcttagtccaaattttggaatatttgtaatttgcactttagtttgaagagttcctttctagccccagtaacagaccaaacacttcccaagatgataatgtatggctccgacccctcgttctctgtgtttgatgttgatgatgtttgtaattgagcaagatcggacacattattatgtttgtttacatggtagttttgggccttggtttctgtgattttaatggatgccaacactgcaatgtgatttttgactgtagctattggtaacggtgtagtacttgcatcgtacgagttggctcttgatgtggacaccgatatgttgatatctagaagatcaaattggctttattaaatttaacattaaatatattttgataccatgttttctactccttctgttttataatgtaagactttctagcattgtctacattcatatagatattaaagaatctagacacaaaatgaagggagtatgaactttatcaaagttaaaatttgacttagaaaaaaaaggtaaaacgtctttgatatgaatgaagttctaatataaaatggagggggtactgcctggttcgttcttcattccaactctgtggagtccttgcgtgaatggcctgttcttaatagtctgatggtcttttgtcgtgcacctgtcgtctatggattcaagtgtcggcttatagttactcgttgaatcaagctagtagtactccagctgaatggtctgcatcaaagggtacccatacgggggcaaacatgacaaaattggaggcggggcagatgtatccaagtcataactgaatacaagtatatgggggcatattaatttcttttctatacagaaagaaaacaaaatgtggaatcaaaatagtgtaagtacgtgtgctaccttatagatgatcataaatatgtgaagaacactacaatattgggtcatcatttttgcaggtagatcagttgcgcctaggatttctcttgaaaaacatctagctaaaataaattctgatgactaatgcaacatgtctaaccatttttaagcttnctggctaaagagtgtaaatttgaataggccactaagccagctagtggcgccgttgaatcgggacgacggtaacgttttctgatgattaactattttttataggtattgatggctatctgtagtgaagacaatagcaccagagattggggatcgggcggcgtggccgatcacattatatatgcttaagcaagcattggaaccgacaaagtggcaaagagtgacaaactcaatagtttttttttttttgcctagtattgatatataatttcttaaccaaggatagcatttaatctttttaccaacataaaatgcatttttattcatacaatttgattatataatatttatactatataattattaatttcctagtattttcacttatagttttggacatcaataacgcacacgattttgccaatttttatttctaatttcccaaaaaaatggttactcttggattcaaatttattctgcaaagattatcatgccatatttaaatttctccccattctatcctcatacatcctcccctcaaccatttctcacattctaccatcaacaatcatttcctctcaaccaggagtaataaatcatttaatgcattgcatgtttttttccttgaacattaatccttgcttctaagagaaacctagaataacaatctcttaagaaaggtgatagtagcaataaaattattgaaaatataatgttaattgtcaaaaacttcattttgctattacaaacgaagggactaccttaccttaggctgcgttcggctccttggcacggaaaacggagcaacgattagcacgtgattaattaagtatttgttattttttatttaaaaatggattaatattttttaaagcaactttcgtaaagatttttttttcaaaaaacgcaccgtttagcagtttgaaaagcgtgcgcgcgaaaaacgggtgagggaaggtgggaacctttggtattgaacacagccttaatcagttcccaacatgattatattttgagacttcaaaatcttgtttgagatgcttctaactagcttctatctagacgatatcatgcaacttgaaggtatttaaatatgatttttgatacacgtagcaatttaattatggtcattatgatgaattttgctacaggacatccaaaaaacatgtaattagccgggggacactgtaataacacgtttatgctacagggcactgtaaaaaggtggtaattagttgttggacattcacgatattattttattatacttggaggaattaaagagagaaacagatatgaaaatacagttttacccttcgaacccaataaagtctcactcccactctaggacctacatgtcaaggaatatttcttttcttttatttttctttttctctctccttctctaccccttcccttcttcctgctttcttcttccggttttcgaaagttagcattatattttcaataattttattgctactatcacctttcttaagagattgttattctaggtttctcttaaaagcaaagattaaggttcatgaaaaaaatgcaatgcgttaaatgatttactcctggttgagaggaaatgattgttgatagtagaatgtgagaaatggttgagaggggaggatgtttgagggtagaacggaaagaaatttaaatatggcatgataatctttgtggaataaatttgaatccaagagtaaccatttttttaggatattagaaataaaaaaaatggtaaaatcgtgtgaattatcgatgtccaaaactataagtggaaaaactggaacattaataattatatggtataaatgttatataatcaaattgtatgaataaaaatgccttttatgttggtaatccaaaagattaaatgctatccttggttaagaaattatagtcaataaatacagcaaaagaaatagaaattatcgagtctgtcactctttgtcagttctaaagcctgcttagagcatgtataatagcagactataaacaagctataaacacatattaagaagttagaagaagagagagatgagcagcgggctatagctacagcatgagcatggattttaagacatattgtgtgtatgataggtgagaccagatattaatagtgtagtatatatttatcggtaactattatataaattgactattaaattgattacagatgatttggaatagttagctgtaatcttaaacttgctcttaagcatatgtaaagtgatcggccacgcccgcagatcccaatctcgctgggcttttcgcccctcccaatctcccatagtagccacctcgacgcaaaccctaatcccatcgtctccgcctctccctctccctcctccccgcctccatggatcgcgaccgctcctcccgccgccccgcgacgacgacgaccgccaccaccgctcccgcgacgaccaccaccgccgccgccacgacgccgacgacgaccaccgccgccacaagcgcggcggcg

SEQ ID NO: 36718 - DNA, 8215 bp, Oryza sativa
  unsure (1)..(8215): unsure at all n locations
gacgacgaggaggagagccgctcccgccgccacggccaccattgcgacggcgggcggctgtccctctccccgtcggagtcccccccgccgcccgccgcgaagcgggagcggtcgtcganccgcgctcccagggactccgtggagcgccgggactcggccgaccgagaggcaccgccgccttcttcgcggaagcggaagggccacgagggtggtggcaacgagtccgacccggaaggggggaagcgggcgagggcttccgtggagccgcctccgccgaaggaggagaggccgaggcgggagcgacggaggtttgaggacgccgatgcgaatgggaagcatggcgatgagaggggtaagggtgataaggataactcaaaccatggcgctgtaaatggagattcccggagtggtctggtgcccaatgtaagtgttgctactgtctccatatttttcttttctagtgatgaagtcaagaattatctaagaaatgattgctttattttgttttggataacttattaactggatagattacatcttagtcacatttctgtagtttatatggtattatgttggtgaataatctgccaattctttagtaaatatatgggagtgaagggtttttatcaggagtccaggagggttagttctgttcttacgaaatgtttctgttgatagattgatcgttagtgcttttgtccaatttgttcaagttgcacaatactttcaagggataagcttgtattgttggttgacatgagcgatactactggttactaggtggatttttagccttgattaagagagtaatgcagctatggcaatactgcctcctgctttattaggaaaacttgatccaacattaggagccaactagccattagatcttttccttgcattgatgatgaactttggaagtacctgttcagtgtctctgctgatttactgataagaacatgctcaattgtttcagtattgtttgagatgtataagaagttaatatccttcctgtatattctcattggatgcaccttctgtgtttttcaggctggtgctcagcaaccgctcaatgctgcacctgttgtggtgccatcatctgttcctatgccttcaaaggtatcttcgattactaccaccaatgaaaatgagggagttagtattagatctgatgaggttactggaaaatctagtacagatggaagtacaagttcagccgctggcaaaagtagtaatctatctcttgatgctttagccaaagctaaaaaagcattgcaactgaagaaggaactatcagaaaaactcaagaagctacctgtggtaagaaatcacagttgttggtagtcccttgcttctatatttctattttacctttctaacttattgtgttttttggcacagcttaataataaacttggtgttactagtactgatacacaaattcctaagaaagaaacacagcctgtttctagctctggtgcatctgaaatggctgtgggtgcagctcttactgagaagatggcagctacagcaggtgcagttggtattccaggccttgctaacattcccaatttggatgctgtgaagcgagcacaggaacttgctgctaagatgggattcagacaggatccacaatttgcgcctctcatcaatttgtttcctggtacatcctctgaactaactgtgcctcaaaaacctgcgaaggcacctgttctccgtcttgatgctcagggtagggaaattgatgaacatgggaatgttatcaacatgaccaagccaaccaatttgagcactctaaaagtaaatctcttattttactagcatgaatactatgaaatgttatcagtaactcttctgtgcaatgactgtcacttttggttataccttgtaggttaacataaataagcaaaagaaggaagctttccaaataatcaaaccagacttggattcccttgcaaaatcaagtgcacactttgatgaaaggatgggcatcaaccaaaacaagctcctccgccctagaaggcctggatttcagtttattgaggagggaaaactttcaaggcaagctgagctgcagagaattaaggtctgtaaggatcaacttttaagattagttttcaaaatgtatttacttatcatatttccttttacttaccctaataatttgaccttctagaatcaatttggtgaagcacaagctaaagaacttaaagtaaaacaagctcaacttgcaaaggcaaaggcagaagtagtcatgaacccgaacttgattgaagttgctcctgggaggcctccaaagcaaaagcagaaggaagagattcctgaaattgagccatggtttgctgctacaccctttatctaattttatattccatcattaaaatataactactaatgtatgctctttacagggatgcaaaaattttaccttctacaacatacgacgatttctccatggagaaggttaatatggaaaaaatcactatatatgtagagcatccagagccactggagccaccagctgagcctgcaccaccaccgcctcagccacttaagctgactaagaaggagcagaagaaactcagaacacaaaggcgccttgctaaagagaaagacaggcaagaaatgatcaggcaaggcctcttggagccaccaaagcccaaggtcaagatgagcaatcttatgaaagtactaggagctgaagctacacaggatccaacacgtatggagttggaaatacggactgctgctgcagagcgtgagcaggctcatgtagatcgcaacattgctcgcaagctcactccatcagagcgccgtgaaaagaaagagaggaagctttttgaagatcctaacacattggagactatagtttgtgtgtacagaatcagagacctgtcacatccgcagacacgttttaaggtggatgtaaatgcacaagagaaccgtcttactggtgctgcagtcattgcggatgggatcagtgttgttgtcgttgaaggagggaagaagtcaatcaaaaggtacaataagctgatgctgaaccgtattgactgggctgctgcggttgatgatgatgatgatgctgatgaggaatcagacaagcctgtgaatagctgtgcattggtctggcaggggagtgtggcaaaaccctgctttaccaggttcagtgtacacaattgccgtagtgaggctgctgccaagaaggtgtttgcagatgcttcagttccacactactgggacctggctgtcaatttctcagaagattcatcttgagctgagcttctgttcagaacatggaggcgcctgctgttgaaacccctgcctagggattacgatgttcaattctcatgcagtaagtgatgagtagtagctaatttctcaccgtgggtaagtgtcctcttcaagttacgtacaagccttattacttgctctggaagcatttgtggactgagtaatacttcgtactgtcatgaacatacccttgtaagggactgctgatcttttcgttgcgggatttactcatgtgagctagaaactgaatgcatggaggaactgttgaaatttttgcagtataagcttccaactatatctggactgctcaggccttgaatattgttatgggaattgtgttaatgaaagtatgtatgcattttcgtagggttgcagtgctcttgagacggatttcatattttcatttcaatccaacaatatttgaccgattttttccatgattggaaatgttagtagttgcacgtttcagtttgcaactgctgctccggatgtttatccatactcgattcggcatctaatttagaattaaaacaacatattctgaatttattttaccaatgaggcggccagaattttgaagtttgacatatccaaagtagtgtaaaaccaaacttgtggcatttctgttttgtgaattatataagaagaaagattctcgaggtttttacctgtgtgccattaaaaaagatgacccctgtctctgtgccactaaaaagttcgagcctccctctatgccatcgtcgaactttatcgtgtctgtcctccacaccattccgtccgtttttgatcctaacggtgagtaacggcgcagccaaatgacgctcttgcccttagccatgtttcatctagccaaatggcgctgcggcatcatcatcagcatccgccgccgccgcctgagctgcagctcctcccggcatccaccacggcgccgttggccgccgcgtttttgtccaactccaccggttcctcctcccacgagcaacacgtgacgacgctgcgacgacgacggggcggcgccgcgacgacgacgacggggcggcgctgcgcgacgacgacgacggggtggtgctgcgcgacgacgacaacagcggcggcgctgcgacgatggcggcgacggcggcgttgcgatgacgacgatgatgggagcagcgctgcgacgacgatgacgaggcgttcctccgcatgccccctcctcctcctctccgcctagacctcgccgctgtccttccgccgcgggcccagctccgcgtctctcagcgccgcgagcgccgccgccgcctcgtcgaatgcctccttccctccgcctacgccgccggccatcacggccgtcgcctcctcgggcgccgccgccacgggggtcgacttggccatggggttagctgctggtggtggtcgcggtcggccgtcgtgaggatcgaagggcatggacggagagaggggaatcgagggaggagagagagagagagagagcgactgaaagtgaaagggcaatagtgacatttttcctacttgggcccacatgtcagagctgccaaatggttaaacccaaacagaatagcgacggaatggtgtggaggacgcgataaagttcgacaatagcatagagagagactcaaactttttagtggcatagaggcaagggtcatcttttttaatagcacacaggtaaaaaccttaagattctctagcctcaacatgaatgtatctaagggtgtaaatggctaacccatgaaatccacttgtaggttaaaataagttaaaataaacggacttgtaggttaaaataagttaaaataaacgggtttgcggctgatccacttatacccctaaatgcatctagccagtggcaatttcgtttgcttcacaatttttgattttgttccaagcaagagtatgatcggaatgaagtgtcaacattttgtgtattcaaactgaatttatcaaggacgaaaaatgagccgcaaaaaattcatactaaaattacaccgcaaaagttaccaagtaatcagagtccaattccaatctgctgagtgctgaacgcaattcatttgaaaccgcatctaattctccaaaacccaaaatttttcagtagttgacacttgaacagtttgcacaatccatatccaagcctgcatcacgtgatcaccatttttctccatctcatacggtatggtgtggctcaggaagagatatggccaatacctctttcaaatttcgtcagagtgaacttcaccaaacatgaaggtgcaacacggcccttcattttcgatgctatatacatacccttgaccttaatacagaagatttctaggtgacaacattacttggctccattactgttctcatgatctgcccgacttttgtcaaataaactctttccaaaccaaagattggtgagccaagcagataatacctactcagaatgatttggatgcttcctcattaacagaaatctaaaatctaaatgtctcaagcagagtacatttgatggaatcctgatggttagcacaacatgacagcgataatgatacgattcaaagcgaagctagtaaccaaaacatggaaacagctgatgtagctatgaacgaccatgtgatgaatgccaagataactgaaagctcgtaacgaccacacgaaagctgcgggtacatcctacagaagtgcacgtctctctcaaaaagaatagtgacaccagcagaagcagaagctgctgcaaacgaaagaatcgctgtaacctgcaatacatccaaatataatgttctttaatgtccctcttgctaaattatgttagcacttcaagaaagaagggtcaaacaagtgatcaaacagggaaatgaaaaccttggcatactaccccatctagctacaagtgccacatggatattgacatggcaccggaaatgcagctgattactaatttacggtaatatttcaagaatgaaagggaacaccgaagttataatataatgaaagaagttatcgacagaaacctacacatatgttttgtgtatccattctaaaaaatgtattttactgcacaattctagaccattagttattttttactgaaagggtataaaattgatcgcaaactgacagaaaacaacccatattgccagtgtttcatctctgattccctaaaagatctaatacaatcgcaatttttttcatgtcatactctcatttatgtctgattccctatgtctgattccctatgtctggattggacatgattcatgtagttttcatgtcatattctcgtctagattgcacttcttttctctcatttagattgaattatgactggattggacatttaacaatatgaaaagttcaaactgttcccctaagcatgaaatttaagaattcttgaacaaaaacatatgtactactcccctgttatttttcctttttgatgacttcatttccaaattgaaaaggaaattcatgttgctttttacaaattgaaaagcaattactagagtaatatatgagaaatgaatcacttacccaatcaccaacaacaaacaggcttacaagcactgggttatgaagatctcttttagtttgtaatgaatagatatccagacaagcaagtccaaaactccaaagaagctgtagacccatggaagcaatcaagtagctgaaaatagggagatcacaatatcgtcaattatgtatatagattatatcacgtatgcactgttgagctcctgctcaagcaattctgaatagtagtaaacaattttcatactttgcccaacttggtctcaaaacattaagttaaaaatggcacccatacaataatcaaaggatgtaacatgttgaatgttgacacattcatacacaacatctaatggaaaaattctcataagatgttaagttaaactttaatagtcacaaagaagagaacagataagcacaccaaatcattgggcagtcctgcctttttggtttaagacagataaataaattgtttttggtcccttcctggcatggaactgaattatatcaggaaaaaggccagtaaagaaactgtgagaaaagatcaaaacatcataacatgatacccagaaagctacatgagccaataactggaataaatctactacttgtttctttttagatggaaagaatgcaaaaacactgccacatatcatgcccctcgattcaaatggaatattccagaatgaatgcatttattactcgtgaggaggtaatggtgctcaggaagagaggagagagacttaggacctttttattttttaattttattaagagacctttccaaaaagtatttctgaaaactgaaccttttagcgttgtcttgccacaccagccacggtggcgtggcagaacagcactgccacgccagcctcgcgtggcgtgacaaagttatttggccatgccaggcgggctggcgtggccaaaaggttcagatttggaaatacttttgggaaggtctatcaataaaattaaaaaataaaaaggtctaaaaaataaaaaaaaatccagagggtggggaaggttgatgataaccagtgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 36719 - DNA, 879 bp, Oryza sativa
aatgttctttaagcatgatataagtatttttatatttgcataaaatttttaaataagacgagttgtcaaacgttggttaaaaagtcaatggcgttatacattaaaatatggagggagtattaattatatattgagttctacaagtatcttgtttaatactccgtacattttaggagctaattaaacatgtcgaaacagcggctacggggaggtttcccttgagactagtcacgatcagctttgtttatttccattccccttttcctttcagcaactgttatctatcatatcaactgcgtccatgcatgcacgtgggttttgacaagtaagtaagcgaaagtaatttcattttatgcatatcatataaatagttaaaaaaaatttaaaaacatttgataacattgattaatacgaaatatatcactccacaaacatacgaacttaaattcaattaatttctataagttctaaaaaaatacagtaacaaatatagctgcgaatgtacgataattattttcagtttaattttttttacaacttgtagaagttgaatttggttttacatatttgtggagtgatatattttatattagtatatgttgtcaatttttttagaaaaatttaataactatttacttcagatgacatataaacaactagagtaagtaacggggttcagtgaattcagtctgacctgtggtggggccatcgcatgccaagttggccacttgcccagagctgtcacatccaaaatgatacgcattccagctcaaaaactcaaaacgaatgctgtgccattgctacatcgatcgagcttactagctttccatcatcccaccactgcctctgctaaactactctgaccggccggcgccatgc

SEQ ID NO: 36720 - DNA, 688 bp, Oryza sativa
  unsure (1)..(688): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataaacggcaccgaatcccccctcaccaatcttattgctttcgtggaagttatccgttgccacttgcagtgatgccagagataacagggttgacttgacactttcaaagtcctcatttgtatcagctggcaagtttgcataattttgactaaactgttaatggatgctcgtggtataagaatgtttaacaagaatttatgcctaattgtgtgcagaggactcacttccggggtgacgctctgcttttgccaatcttctcttcttacgtgcattccagatacagagggaaattacagctatgatgattgcaactgacactatcggcaagataattactagaattttgcttcctgaattattcttacctgcgtgagctcgtcggccttgaccggcaaccgcaccatcggattaccggtgtagaaggg

SEQ ID NO: 36721 - DNA, 686 bp, Oryza sativa
  unsure (1)..(686): unsure at all n locations
nnnnnnnnnnnnnnnnnnnnnnnnnnnnnnnnntgacctcatgagtttctgttaacggtgaaatttggcaacagtttcttgatttacctcattggtgtcaccttgtttataactaatcatgactataaattaacagcaaaatcatgacatccgccattgtaggtcgatctactgggttctgctggacacacaggaggccgatgttgacacatttcagcacctcggcttcagggtagtttctgtccaaggaatagtctaccatctctacaatatttccctctgtccagtgcctccatacctagcattagttatatatagatctccagttatcagtaatatagatggtacatatgagtggttttctggaaacataagcaatattagtgtattgatttgtaggaattagaagggatactcactaggcttactaaatcttcgttttgctctgcaaaatagggcccactgtttctttgccctgtcacaatctctaagatgagaatgccaaaactaaacacgtctgatttcgtagagtattgcccgcgaatcacatactcaggagccatgtatccactgcatgcagtaagaatgaaattgcatgttagtacgtagtttttaagtgaaatnnnnnnnnnnnnnnnnnnnnnnnnnnnnnnnnnnnnnnnnnnnnnnnnnnnnnnnnnnnnnnn

SEQ ID NO: 36722 - DNA, 585 bp, Oryza sativa
  unsure (1)..(585): unsure at all n locations
nnnnnnnnnnnnnnnnnnnnnnnnnnnnnnnnnnnnnnnnnnnnnnnnnnnnnnnnnttgaaaataaaaaataaaaacatcgaaagaacacaatacggtattaactaaattttttttaaaaaattctgaaattagaaaaaaaaagattttaattaggaatgcaatttataaataactaaaatttgtgataaaaataaagattattgaaataaaagactatctaaaacacgtgacgagataaattaagtaacatgcctataaagaagtagagtggaggcggttgatacgacatataaaaattgttaataaaacaccaaatagaatcctaatgacgattaaaaggaggaacatcaggtaggccgtgaatcaaacgagtaaggcggttgtcgagacttctataaagtaaaaaaaaaacacattgatcatcatattcgatttttaaaatctcagtgacaataaaaaggagaagcagcgggcagggtgtataagagtatagttgcagagcccgcgacggttgacaggacttctagaaaataaaaaaatgaatttcaataataggtatgtttgatttttagaatcataatg

SEQ ID NO: 36723 - DNA, 755 bp, Oryza sativa
tggaggcccaaggactaaggtctcgtcctgctttattattatttcctctaattattctgggacgtcacattttttttttatctaaaaccaagggctggagcagtagtgcaccaaccctctgcgatatacttcaagaagagaagtacaccacaatttgtgattaattaacaattgagcagtagtgcaatcgtacttctagccatctagaatttatatttttgaccatattctgggttcacaccatcaaatcacacaactttttctcaaagaaatcaacaatgatacaaaagttaaaaagttaagagtactcatgccataccttataaacggcaccgaatcccccctcaccaatcttattgctttcgtggaagttatccgttgccacttgcagtgatgccagagataacagggttgacttgacactttcaaagtcctcatttgtatcagctggcaagtttgcataattttgactaaactgttaatggatgctcgtggtataagaatgtttaacaagaatttatgcctaattgtgtgcagaggactcacttccggggtgacgctctgcttttgccaatcttctcttcttacgtgcattccagatacagagggaaattacagctatgatgattgcaactgacactatcggcaagataattactagaattttgcttcctgaattattcttacctgcgtgagctcgtcggccttgaccgccaaccgaccatcggattaccgtgtagaaggggcccagctcg

SEQ ID NO: 36724 - DNA, 443 bp, Oryza sativa
caaaaataaggatttatagaataaaatttatatagggaataggctaaattagggttaaataggagctagcactgttcattgcgcagtaggtgctcgacgaggtttcctagccatgccccctcctctgccgcgcgcgcctcgcgccccgagccgccgcgcgccgtcgccatcgccgctgccgcgccgcgccgccgtcccgtcgcgcgcctgccgcctcgcgccccgcgcccctgccgcatgcccgtcgccctcgcgccccgcgcaccgctcgccgtcgcatcgacggccttcgccctcgcgcctacgcgccgccgcgcggccgtctcgtcgccgtcgcactcgcgccgctgccgggccacacgtcccgtcgcgccgagccccgtgccaccgcgcgcgtcgcatcgttgctgccgaccgcccatcgcgtcgccggcccgagcccc

SEQ ID NO: 36725 - DNA, 1960 bp, Oryza sativa
  unsure (1)..(1960): unsure at all n locations
nnnnnnnnnnnnnnnnnnnnnnnnnnnnnnnnnnnnnnnnnnnnnnnnnnnnnnnnnnnnnnnnnnncatcttcgacctctgattaagtttgtatattgcaagggtgagtaccaaccgtactcagcaagccaccacagcaacaatgcacatgatagggggtattcaagggatggctatggttcttttgcgcaaagtaagttttgtaattcttttcacaagcctaagacctagcatgactgatcaaatttttagtaccagtgttcatatcaaagaacgacggttctgtccaccatccattgtgatcccaaggatagcttcccgccattgagtcgtcatggttttctgaggacgaccaccttccctcctctcaggaagtggctccatcagcataaaaatcatcatgcaatattccatcccacacaaattaagaatttagagtctagccaagtgtaatacatgtctcggtgctcaataaccgcgagcacggctattcgaatagatttggtttactcacactgcagtggatgtacactttatccgcactccgcgactgcccaacacatgagcctcgtcccaacacatgagacgcgtcacggcaaagctttttgataacctcgcattggcagtacccactccataaactttacatcctcatgcactctaggcggaatacgatttctagcagtgagaggagttctggcgcacccgggaaaggaagactcacacatgcattaaggtataattatgtttagattctcacatggcagtcctaccgatggcgacaccactgtaggcacccgcctcgcggtcctaccaaaggctgccccaccgtagagcccctgcctcacatatcaagaaaccactatgcatggatactgcctccgctcatctatctactccgctaggtctatacccatacgagaagtgtggttgtacgggggtcgtttcatgcttaacctcatggctcggtccttaactgaccagggacggcactagccttttccagacaccacccaaatcctacatccgccccagttgaaaatagttgtttcattttattttcctttcaccaaatcatgtcatcactatcatggcaatgtggcgctcatgtctccatatgccgcatctcaattaccttcccaaaggtaattgcccaggcatatagcatttgataaatatgagtatgcatgattctagaatagcatttctaagcaattgtcataattgactagggactcatacataaacatggttacaaatatttaagggtaaacaataatcaaggcatggcataatcacaagtgggatgttcatcattgcatgcaattttatttgtaaacaaaataatttcgcaattgggatcaacatgttcaaagaatagtgatgacttgccttgctcgtagtcttgcgggtcttgatccttgctcggatccacaactccctcgggctctaaaattacgtacgaagaaatgatttgaattcaattagaattcaaataaaatccaaataaactcaaataaaagtcgaacgcgaatcgattactcctaagaatctccaaaataatctacgattatataaaactttgcaattctacggctaacaataatctacaattaaattctaattattttaaattttctaaacctccttaatctctctctaattttttatttatttttccttttctttttctctcttcttttctttatttttttctctctttttccctcttcttctttctttctttttctctccctcccggcttctcccttccctctcggttctctgcctacccgagcggcaacagcgaccaaacaggggggggagcggcggcttactgacgacggcggcggcaacggcgacgcaaggcggggcgacgcatggcgcggcgcggcggcaccgagggcggcggcgcagtggagaggaagagaggagaaaagaggggaatggggtgggggt

SEQ ID NO: 36726 - DNA, 32768 bp, Oryza sativa
  unsure (1)..(32768): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcggcgcggcatcgtcgatgaggacggcgcacgacggctcggggcgctaggcgcgcacggcagagcagggggcatggctaggaaacctcgtcgagcacgtactgcgcaatgaacagtgctagctcctatttaaccctaattaagcctattccctatataaattttattctataaatcctaatttttgcacaaattaagtttactcaatatttgtgttatttcaaccaatggattcaccctggattaatattacccatattttatttttatataatttatttgaattttaattagggctaattcttattccatcgcacttaaatttaattattaccaatatggtcgcggtaatattctatttatttctatctcgcctaatctttattttaaattatatttcaattatttattttgccaatttatttttagggtttattcctaattgattattctttactcacgatcaatgaactccgaaatcaaatccaaataaaataggcgaataaaaccggcatgatgcaatttatttaaaaagtttttaaagatccgtatttttagggtttcgattttgtcggtcgaattttcagggtgttacagttactctatatttatcagaatcacacaagtacaatatttgggattgtctatctagccgtcgtcgatatggtggcacgaacaccaacacgtagtcgacgacggggtagtcttcctccttgaatataaactcgtcacgatgagagattgcactagatccctcttgttggtcttcacaggcaccagattggatctgtctaggctaatctctgatgtcgatatctggctttgtcttggcttgtgttggtctcctcccccttctttagggggtcttgtatttatacccatagatgtcccattgtccaaacataactacaaataccaatatggatacaatttgagtagtccatatagttttcatatagaactctacttgtccttacttatctggaactccttctatatacgagtaataattccatataagactgtatataatgggccccgccgagtttagtcgattactattgggtatgtggtatccataaccatgatatatacactgtttaacaaaatgaatagaccactaaaaaagttatagaagtaatttgcgaggactgtaaataaaataaaaaaatttgctccatgacactttgaggcatttgctctataaaacctactttttacagctttaccctaagatactctggttatacggttatctgtcaaaagacactccgataattaatttatatagagagataaaatcttttaaaaaaggttttacctttggacaacttgcaagctttaaatttcaaaattttggctgactttaaacattttatgcaaattaaaaattttcccaaataccggaaataaaaaacagttatttaaatccagaaaatattggtataaattttattttatctttttttttttgcaattgtcatttagacaatttgggacaacttttgaatttgcaaaaaaatttaaatattagctattatttgtttgaattcaattcatacgaatagtcaatctttttttcaaagttatatatgtctctattggaagatggtattggaatagggtctctttttttttaaacaatagcgtgcttgacaatacaccacaaccgaataatgttatagcaaataccatgaatctagagtatcctgaagtcaagagacctcaatcgtggttcctctcgtgcgtaaactctgctaatcccataggatcaatagccttgataaggacagattgagcatatataaggctatgtttagctcttagggttgggcattaatcccttgtacatgtaaaataaagcgacttgaacaacttttttatagaaaaaaaattgtaaaatacacaccgtttaacagtttataaaacgtgcttgcgggagagtggaggttacgaaaaataagaaacacacacagcctaatacatcatttaataataggcaacaactaggagctacaaatatcatgctcccttcagcttttaatatttgacgtagttgacttttgaatgtacctttaactattcatgtaatcgtgttatttaataattttgtgcaaatatgtaaaaatacgagtcatacttaaaagtacatttagtgaaaaaacaaatcacaacgaaaataatattacacatatattttaaaatttaatgacgttaaatattaaacataagagggagtactatatactccctccttatttcttattttaatgtatgacgacgttgactttttaaccaacgtttaaccattcgtcttattcaattttttttgtgcaaatataaaaatacttatgtcatacttaaaaaatatttgatgataaatgaagtcacaataaaataaatgataattacataaattttttgaataagacgaaaggtcaaacgtttatcaaaaagtcaacagcgtcatacattaaaatacggacggagtattatgtagtgtgtgcaaggcacatttctttacgtagaaacaaatcttgtttttcttatttcactcatcatcaatgtcaggcaaaattcacccccattatttacctttgtacatggcctaatacgattgttttgaatcgaaagaggttcaaataattacacttgactaaatgctagtagtagctatcatgttgatccagggatcgtggcttggggtggtttccatgagaatactctcgaccaacttgcattattcctcctttttcctctttcagacgattcagacaatgaaacggacgctacctacgggctatggcagcattgcatgcatgttgccaacttgccaaggaggcttgtactacttccgcagtatcttatcctaaaatgagttacttttttacctaccatattttctcaactaatcattaatattcttcaattaatttattcaacaatttttttctcaatcaaccataatctttccttcaattatttatacctatttccttaaaatttatgttcatattaaaaatacttacaattttgaaggaggaagcatccttttttagcccgattcccgaagctagctaccgtgttaattcgagctactccactatttagagcaggcacaataatagactataaatcagttataaacatattttaaagagataaaaaaaagagaaaagagcagcagactatagatatgtaaccagctgcagcacggattccaagacgtaatgtgtatatgccagttgggattatgtattaatagtgtagtaaacaattattatatgaattggctattatattggctatagatgatttagagctagtagttagctatactattaaacttatactattaaacttgctcttagcttcattccatcccactgcccccaaactgctgcatctacggcaaaaaatgctgcgacgctctttggtcgcccatgccgttctcctcttcgcggcggtcgcgctcccgctcgccgccgcccagccatggcctgtctgcggcaccagcggcggcaactacacggcggggagcacctacgagtccaacctcctgcgcctcgcgagcaccctccgcgcgaacgcctccgcctcccccaccctcttcgcctccggcgtccgcggcgtcggcccggacgccgtctacggcctcctgctctgccgcggcgacatgaacccctccgactgcttcgactgcggcaccaacgtctggagggacgcggggccaacctgcaaccgcaccaaggacgccatcctcgtctacaaccaatgctacgcccagttctccgacaggggcgacttcctcgccgccaccaacaactccggcgaggtgagcctcctcataagcggcaccaacatcaccagcaccgacgtcgccggctacgaccgcgcggtcaccgagctcctcaacgccaccgtgcggtacgcggtggagaactccacgaagctgttcgccacgggccagcgggtggggaacgacacggggttcagcaacatctactccatggcgcagtgctcgccggacctgtcgccggcgcagtgccggagctgcctcgacggcctcgtgggccagtggtggaagacgttcccgctcaacgggaagggggcgagggtcgccggcccgcgctgctacctgaggtccgagctgggccccttctacaccggtaatccgatggtgcggttgccggtcaaggccgacgagctcacgcaggtaagaataattcaggaagcaaaattctagtaattatcttgccgatagtgtcagttgcaatcatcatagctgtaatttccctctgtatctggaatgcacgtaagaagagaagattggcaaaagcagagcgtcaccccggaagtgagtcctctgcacacaattaggcataaattcttgttaaacattcttataccacgagcatccattaacagtttagtcaaaattatgcaaacttgccagctgatacaaatgaggactttgaaagtgtcaagtcaaccctgttatctctggcatcactgcaagtggcaacggataacttccacgaaagcaataagattggtgaggggggattcggtgccgtttataaggtatggcatgagtactcttaactttttaacttttgtatcattgttgatttctttgagaaaaagttgtgtgatttgatggtgtgaacccagaatatggtcaaaaatataaattctagatggctagaagtacgattgcactactgctcaattgttaattaatcacaaattgtggtgtacttctcttcttgaagtatatcgcagaggtttggtgcactactgctccagcccttggttttagataaaaaaaaaatgtgacgtcccagaataattagaggaaataataataaagcaggacgagaccttagtccttgggcctccagcagtagtagagcaattggcccggttgaccttgggccttcttgacccccaggacgagcagcggcagttgggctaggcaagctagctagctagctggcagatcacacgcagcagcaagccagcaacagcacatcagaaatgttccatatgctgccaaataggattaaatgatcagccaccctaaatctaaatcaaaagacaacatccacgcaaactccaagtaaaacgtgagagtattatagatattactatttgaacattatatgtgatatagtggatatgttgccaataaaagacataaataaaattagaagtagtagtcacatctattataacacttgctcttagtttcaacttaggagtttaagctgatccatgactataatattggtttaaacttattgcgtgaagcgagaacgtaaaacatgatagtgttacagtgtagggtgtattccatttagatgagtcgggtctaaaatcgtttttatctagtcgggcctagaattattttgggctataagcgttatatagtaaaatatatgcatgtgtgtagtctaactaaataagttgagcctagctataaccttttttttttcataatggacgttacaaaaagcaagaaaatatgaatgtctggttgttaaacttattaaaaagtcatctgagtccataaaattacaaaatacacatctctatccataactcttggtttaacgtatcacatgggttccaaagcgcacctataaatatttaagaccaaatttggtcaaaatttcaaattttgtatcatcaataattccttaaatgattaattagtttaaaggattggtatatattgatttgccttaaaattactactctcgtgatattataaatttactagtactaatataaaataaatggtccaaaatacaaaagttgatcgaaacttatcctaaatatcaaatatttatatccaggaggagtaagatactaagccaagtagttaaattattcagggaattcttcatggacaagaagtggctgtgaagaggatggccaagggctccaaccaggggctggaagagctgaaaaacgagctagttcttgtcgccaaacttcatcacagaaatcttgttcgtcttgttggtttttgccttgacgagggggagagattactcatctatgagtacatgtccaataaaagcctagacacctttctttttggtactattagcattaccctttttaacctacatattttgtcttttcactccatcaataacaatttttttcttttggtaattagatgcagagcaaaagagaaaactagactgggcggtaagatttaagataatagaaggcattgcccgggggctacaatatcttcatcaggactcccaaaagaagatcgtccaccgtgatatgaaggcgagcaacattttactagacgcagacatgaaccccaagattggggactttggccttgctaggctctttgggcaggatcagactcgagaagtcacaagccgtatcgccgggacattgtaattaagtcgaaggaacactcattatttttcgctcatatatagataacaaactaaaatgcaattcttctttgatgcagcggttacatgcctcctgagtacgtgctgcgcggacagtactctacgaaatcagacgtgttcagctttggcattcttgtcatagagatcgtgacaggccggagaaggaatagcgggccatatttgtctgagcagaacgatgaagatatattgagcatagtgagcatccctactaattcattgaggaatacatgcctattgtaattactgctgactaaacacatatgtgtgactaatgttgctaggtacggaggcactgggaagagggagcaattgcagagatgattgatcattccttaggaagaaactacagtgagaccgaggtgctgaaatgtgtcaatattggactcttgtgcgtccagcaaaaccctgtagatcgacctacaatggcggatgtcatgattttactcaatagtgacactacttgcactatgccagctcttgcacctaggccagcatatttgatcgatgggacctctggttactcccagaccgtaacacaatggtccggcaggtagcagggggccgaagcagatctagcaccgttgttggcttgttgctgcttgctttgttttatattgtaagtgtatcagttctcaatttgtattccatgataaccaagttcaactaataaagagtaaatatataccattgaccagtttgtctcgctcaatgtttatcatcgagtttgtgtccatccatgacatattccaattacatgctactagttattactccctccattcctaaatgtttgacgccgttgacttttttaaacatatttgaccgttcgtcttatttaaaaaaattaagtaattattaattctttttatatcatttgattcattgttaaatatatttttatgtatacatatagttttacatatttcacaaaagtttttaaataagacgaatggtcaaacatgtttaaaaaagtcaacggtgtcaaacatttagggaagtagggagtacaatataattacgttatactccttataaaatatagtagtggtggtgatgattttgtcaccacctacttttgcgggaagaaaaaaaaaagtggagctaagagcatcactaatagaatgtgtaaattcaatcttcaaaattctgaatttgggaatcctaaatgaaatttgataagttacagaagtgatccttccaatagattgtgtaaaattgactctctaaaatagaaaagtggaccgcatagtaaactatcaactaaaaaaaatcagttatatattcctcctccttccgcgacggcgaaggcaccatcacatcgattgttgtttacaaatacacgagtaatccaggtcgagcatgtttaactcaaaagaatcagttaattacgcacatcaatttacggagagatgggcatgatcatcagatcatggaggaagaaagaagtctagactctacgacgcaacgacgtgttcgtcgaggcccccgatctgtttctctcatacacgatcgggtgctacttcggcgcctcgatcaccttgattaattgtgcgctagctgccgcttcgcgtcctctgcttcttgatacacttcgcggagcttgcgctttgcagcgatcatggccttctcgtcggtactgcacgacgacgtggcactctcgcggcggctcatgttggccgtcctcttgggcggcgatggctgcaggattttggcgtgatggtcgtcggtctcatcgggttccagcacctgagagagcttctccatgacggctgcagacttgaggagctcgtccttcacggatgccctccacccacggacaaaaacatttcgcccctcgcccgggaacgggaggagagaggcgggagcgtgagattgggagtggtagaggcgagatcgtgcgccctcatatcaaccgagctaggatttgggagatggaactccagaactggatttttcaccttttagttcttttgaaaaaaaacttattctacaaataaatccttaaaataacttattttagaaatggtgcttttcgcggcgccaatgtagttggtgccgtggtccaacatgacagcaccaaggacgttggcgccgtcctctccaccctcgggtgaaagctaagtcactaatgtgaaggagaacggcaccaccaacattggtgtcgaggaaatttgcaaaaaagaaaagaaaagaaaaaggacctagttgtaataaaaagtgactcatttgtaaataaaaagaactcggaaacttcggcaggagagtagcggatccgttggagctgtgttttggactaaaatctctcaaattcaattttcgaaatgaaatactctctccgtcccataatataagggattttgactttttgcttgcattgtttaaccattcgtcttattcaaaaaattttagaattattatttattttatttgtgatttactttattatccaaagtactttaagcataactttttgttttttatatttacacaaattttttgaataagacgagtggtcaaacagtacaagcagaaagtcaaaatcctttattatataggataataagacggagggagtaggtggatagttggtgatgctctaacaagattcacatataagtaacaaatacgtacaacaattaagagataataataacatattaataaaaattttctttaattggaaacccgttgccatgcacaggcaatatgctagtatactagagtaatatttgaaagattttaacaaaaactgtcggaatgttatatagtttctcccttccacaggcaccatgcaggcaggccggcggttggtgatcatatactcatatcatgtcatgtccttttgctcctcaccgtgctcgtacgtacgtgctgcccgacgctgatcacaccggccgagccgaacgtgctgggatgcgcgcgcggaggacaccggcacatacgtgccatcgcctcaccgcgcgctcatgtaggagttatatgttgggtgccggccggcccgcatcgacgagagaggcggccatgcatgcgtgcgtgcgcgcgcgtgtgccgcgcgcgacccgcgaccttgctgcctctctccagtccaaatatagtccagtgactgattcgtcgcgctgcgcgtgctctcctgactgaaaataggcgtatattggcaaatcctaccctttattagccgaaaacctggcacggggtcatagttgaatcacgacgtacagcgcgcgtggttacacgcctccaagtttgaacgtatacgtacggtaaaaagtggaacggtttacacatagccatgcaccgatttttctcgatatcattccatacgcgaccgcaacagtcattttgagttagaaatgggtcaagtttcatttgactaattaagcgatatatagcatgcgtgttccttttttaaggcagggtgcaaacagctgctacagagaggtttccgtgatgtcgacgaatatataattagtccctgtcccacgtgccatttgacatccaccagacgggttcactgaattcagtctgacctgtcggcctcggccaatcggccatcgcatggcaattgccaagttgacaacttgtcaagagccatcacttccaaaagtataggtagtactgtactaaaagcttgtaaaaaagagaaaaaaaacaagaagatatgatacggagatggattctaatagctcgagtggacgtccacccgtttattgcatgtcaattagatggttacgaaaaattttcaaaaaaactaacaagacagatcaatatataatatattactccaacgaacatgcaaattcaaattcaacttctacaagttgtaacaaaaataacaaatttaattgtaaacatacctataataatttgagttttttttgttatttttattacaatttgtaaaagttaaattttaatttgcatgtttgtggattgatatattacatattgatctatcttattcatatttttttaatttttttatattcatctagataacatgcaataaatgggtggacgtccactggctattaaaacagtttaccgatatgatactgcagtagtggagtaggtaccattagcagaggattgcaaatttgcaattgcaatgcaaagcccgacgatcgaacaagcttgctctgacggcgccatgcggcggcgctcctctgtcctccatgccgttctcctcctcctcctcgtcgcggcggtcgcgctcccgctcgccgccgcccagccatggcctgtctgcggcaccagcggcggcaactacacggcggggagcacctacgagtccaacctcctgcgcctcgcgagcaccctccgcgcgaacgccttcggcttccccaccctcttcgcctccggcgttcgcggcgccggcccggacgccgtctacggcctcctgctctgccgcggcgacatgaacccctccgactgcttcgactgcggcaccagggtcggcgacgacgtcgcccaggcctgcaaccgcaccaaggacgccatcctcgtctacaaccagtgctacgcccagttctcggacaccggcgactttctcgccggcaccaacaacttccggcgcgtacagcctcctcataagcggcaccaacatcagcagcgccgacgtcgccggctacgaccgcgcggtcaccgagctcctcaacgccaccgtgcggtacgcggtggagaactccacgaggctgttcgccacgggccagcgggtgggcgccgacccggggttccgtaacatctactccatggcgcagtgctcgccggacctgtcgccggcgcagtgccggagctgcctcgacggcctcgtgggccagtggtggacggggttcttgttcccgcggaacggcgagggcgcgagggtcgccggcccccggtgctacctgaggtccgagctcggctccgggttctacaccggagctccgatggttctgctgcgagccgacgggctctcaccggcgtcggcgccggcgccggatgttgttccggccactacgttaggtgagcagcataccaattactctacccatcaaagtgatcacgtcacgtctcttcagtcttcacgtcatctgcacctaatgtttactcatctccgatgcttgaactgattatttttcactgaaatatgcagttaagaagaattcagcaagcaaaattctgctaattgtcttgccgatagtagcagttgcaatcgtagctgcaatttctgtctgcatgtggactgttcggaagaagagcagagcgacaaaagcagagcatttgtccgaacgtgagtcctctgcacaaatacaatatggcatcggattgtttacaaaccccacttaaaattcttaatcatcagtatgaattgattgttctatcgaatccatgcaaatttttgcagttgatgcatctgaggaccttgaaagtgtcaagtcaaccttgctaactctgggatcactgcaagtagcaacggataacttcgacgaaagcaagaaactcggcgaaggaggatttggtgcagtgtataaggtatgccagtagtctttatgtgtaacttttgagtcattgctgacttctttttcaaaaataattgttgatttgatggtgcgagtcaagcatggtcaaaagctcaaaatatgaatatctaaaagtttttctccattgatgatgatgatgatttttattttctacaaaagatctttcgatctttctttattagaaacaccaataattgtaaactattttacagcactcaggtttttaaaccattacaaaatacagtatatcaatgaaaagtaaaaaatatgcaggggcatctttttggacaagaagtagcagtgaaaaggatggcaaaaggttcaaatcaggggctagaagagctgaaaaatgagctagttcttgtcaccaaacttcatcacaaaaatcttgttcgtcttgtgggtttttgcctggaagatggagagaggttgcttgtctatgagtatatgcccaataaaagtctcgacacatttcttttcggtaatattaacacctcctttcagtatatatggtcatgcacttctttctcatgtgatggtgtgcaacaattacaatgatgtcttcatttggggctaattagacgtggagcaacgaagacaactagattgggcaacacgatttaggatcatagaaggcgtcgctcgtggattgcagtatcttcatcaagactcccagaagaagattgttcaccgcgacatgaaggcaagcaacgtcttgctagatgcagacttgaaccccaagattggggactttggccttgctaggctcttcgggcaagaccaaactcgggacgtcacgaaccgtatcgttgggacattgtaattaagcagaacacttgaagcttatgtgccaatatttcacttaaaaactacgtactaacatgcaatttcattcttactgcatgcagtggatacatggctcctgagtatgtgattcgcgggcaatactctacgaaatcagacgtgtttagttttggcattctcatcttagagattgtgacagggcaaagaaacagtgggccctattttgcagagcaaaacgaagatttagtaagcctagtgagtatcccttctaattcctacaaatcaatacactaatattgcttatgtttccagaaaaccactcatatgtaccatctatattactgataactggagatctatatataactaatgctaggtatggaggcactggacagagggaaatattgtagagatggtagactattccttggacagaaactaccctgaagccgaggtgctgaaatgtgtcaacatcggcctcctgtgtgtccagcagaacccagtagatcgacctacaatggcggatgtcatgattttgctgttaatttatagtcatgattagttataaacaaggtgacaccaatgaggtaaatcaagaaactgttgccaaatttcaccgttaacagaaactcatgaggtcaaacccgtctattcaaaagctattattaggccttgttaaatgggcttcaatccagctcaccaacatttgtaggccggtaatttgaactaaagttcaatgcatgcaccagaatctgtcaagattatgacccatccaatagaggtttaacatgatggattgagaaattatcctctgaaacaagaccatcaatgggaacacaaaatgggcttatggcgttgtatgacacattttcacgcagctgcgcaaggcatgagtctatagtgtgacttaacgagaacgaaaaacctatcgagcgatcgatcgcgaggggcgatcggttcccctcccccccacgcagtttccatttttggcaccgctttactttcctcttttagtaagtttatacacctaaagtttacacatctaaaatttatccacctaaagtttgtagagcgaatatttatgcgtcaaaagtttatatacccgattcaaatttaaattcggattcaaatattttatatatagaatatttctatacgtaaagtttatgtgtgcattatttttctcttttagtaagtttatacacctaaagtttacacatctaaaatttatccatctaaagtttgtagagcgaatgtttataagttaaaagtttatatacccaatccaaattcaaattcggattcaaatattttatatatagaatatttctatatataaaatttatgcgtgcaaagtttacggtataaagtctatgcacatgaatgagagtattaattttttttctattttttttactaactttgtttttttaaaaaaatatatgatgaaaagagagaagggagaggagtataggggaggggcgggtcccattaggggcgcccgagaaggaagaccagacaagcaattatattgttaaacagtaacctcgagattagggtaggtaccagtcttccaagctaacatattgtttttctttgtaaatacttgtttagcttaaaaaagtgcatgcacgcctattacaacctgctaatcattaattgcgaatttcaaacttaagttagtgaagtagttaagtgaagatttgcatatgttacatatttatatttggattcgtagtactaggcatgtatattttgagatgggtggagtaatttataatttaattattattaaattagggatttgctacccatctacctgctattgtttttggttttgtaagccgaatttgtggccgctagatcactccaagatttgtgttgatttggctcaccaagataacctttgatgtaccttgttcatacgcctacattactcgcgagggggggggggggggggacacgcaccaatccccccttcctatttaaaactctactttccttttcccttgctgctgctaacctttttttttctttggctaagaacattccataacttcgtttcccgagaccaatcgattgagcttgatgttaactgcatgaaaaaggtttctaggttgtagaggagtagcgtgagggtgaggaggttgtggatgaggtaggcattgtgacggggagggtggagctgaagcggatcgagaacaagatcaacagacaggtgaccttttccaagcacaagaatggtctggtcaagaaggcgtacgagctcgtcgtgctctacgatgccgaggtcatgctccaccttctacatccgaggcaagctcaacgattttgctggttggggtcctagtatgtgcggctatgcgtgcgaacatgttgacaataatcccattctaaaatgttttgtagccatgcatgtagatgcatattgagtcaatgttgttatgctagcttttttccaaactttaaatgtggctagatatattatgtcgtcaataaataacaccagaattttgtggactagttttgttaggacctgaacataataaacaagaatagtcactagacgggaaactatatattttaatccctcgaggggacatcgttatttgcatgttactcaaatggttacgaaaaaaattggaaaaaattaagaagatgtattaacatgtgatataacactccacaaacatataagttcaaattcaacttttatatctcgtaacgaaaaaaacaaattaaacaacatctagttaacgtatatttacagtcaaatttgttttttcgcctattttgttagctaaaccaaatatcttaatgtcagttttgtcagtgcttggtggtcagttttgttaaagttttagtttcgactgaatttgtataagccaaggagcaatttggtcaacagttagttttgtcagcaattagtacctgattttgttagttttgtctgaattcatatataactaaatgcagttttgttagcagctagtttaatcaataattaattagttcatggtgttgttagttttgttggctactaaatatgacttgatctaattttgtcagcagttagttttgtgaatttaaaacttggttcagcttggttcaacttgaccaacttgaccttggaaggggtccccttgggatccttttgtaaccttgcttgtacaagctcggtttccctctcttctccttttatgaaataggcagagctcctgcttttacccctcaaaaaaaaacttggttcagctagctctagtaatttcatggaagctagttaattgacttcttgatttgattatatttttgtgagcaatcggtatctagttttgttagtttgtcagctagctagttttgtctgaattctactaatagtaattaggtcaataagccatttcaatcaaatacaagttgtcaagctgatctgcccatttcactagttcaaattcctgcagttgatttgtattccctgctttagtatatagatttatcagttacatatatatgtcaacatttcatacacgtaggtagtatagatttattttattttattttagtgtagggttgtaatcttgtaattttttttcctgctatatcaatatgaactttgcactgtctagtgcgagctgtaaaaaataaaagaaatagcggctatgagttcgttcccaagatactgttaatctcgacgaccaacttgaataattccatttccctttttcttcgttcaaacgatgaaacacgtctgcatgcacataagtacacacgtacctaatggtgatcagagaattcagtctatatggactatgcatggcatgcccaacttgccaaagacgagatcaatatccttctttttttttgacgcgatcgaatatcctttttaaggggatgcaccccgtgttagttttatactgccatctatcccacgcccctagctagctgcatcctagctctatcggcgcaatgttgcgacgccgacgctcgtctgtcgtccatgccgttctcttcttcgcggcggtcgcgctcctcgagtcgctggccgcccagccgtggccgaaatgcggcaacggcggcacgttcacagcagggagcacctacgaaaccaacctcaagaacctcgcgctcatcctccgcacgaacgcctcctcggggtcctcgcccaccctcttcgcctccggcgccctcggctccgccccggacaccgtctacggcctcttgctctgccgcggcgacctgagctcctccgactgcgccggctgtggcaccaacgtctcgagggacgcggtcgcggggccgacctgcaaccgcaccaaggacgccatcctcgtctacaacgaatgctacgcccagttctccgacaagggcgacttcctcgccgccaccgacaactccggcgagtacagcgccctccaaagcggcaccaacatcagcagcaccgacgtcgcgggctacgaccgcgcggtcaccgagctcctcaacgccaccgtgcagtacgcggtggagaactccacgaggctgttcgccacgggccagcgggtgggcaccgacccggggttccgtaacatctactccatggcgcagtgctcgccggacctgtcgccggggcagtgccggagctgcctcgacggcctcgtggaccagtggtggaaggggttcttgttcccgcggaacggcgaaggcgcgagggtctccggcccgcgctgctccctgaggtccgagctggggccgggccccttctataccggcagaccgatggtgctgttgccggtcaaggccgacgggctcacgccggcgccggatgttgtgcctgccattacgggaggtgattaattaaactacagtattatacttcctcgtctcgctcatgctgtcccatatttttcccgggtaattttgcacggggcttgattttaactgttaacttaaatttgatttatactcctcttagtttatgttacatatataaagggagaatagccaatatgatccctaaaattttgctcctagatcattttagtccttaatatttcatagtgtccaaacaagtcctttaaatttgtcacgtgggctaatattgttcttggtcctaccaaaatcactatatggacatgccatgtcaccctcctatgtaaaatctatatgatttgtctaatttactcttacgtatatcatagaaaaattagaaaaaaggaaaaaagttaaaaatatatatatggtatatgtaagagtaaaaatatacgtaaaagggtgaaaaaaatgggaaaagtatttgttcctatggttatgtctaattcacccttacattctttttctatgatatacgtaaaagtaaattgggtaattcatcatagattttgcatgaatgatgacatggcatatccatataatgattttttggacccaaggattattctaagccttatgaaaaagtttaagggttttttagaccattaaaaggttagggactaaactaatcctacattgaaactttatggactatagtagctattctcccttacataaatatgattatattacatatgcaactagcgtacagtctgtgtgttgcaacggttttcttttaaaaaaagagcaattttacggtacttgagaaggtaccatgaggtacccttttttctattgtaaatttggattctctcggtacctaggtactatgaggtaccatgaggtaccaaattttacactaaatttttggtacctcatggtacctcctcaaagaccgtagtgtattgtatatatttttaaagccttaaaaaactatttctaccgtgtaatatatcaaggagcgatgaaaattttatattgaaggaattcgattattttttaggttttctctcactttttgcgtgcacatattgttgttggtggtgggtatcttttactttatgtttttgtatatacaaattaatttatatacaactattgtcgatccatttataccatttatagtcaaaattcttttcttttcttttcttttctcatgagatagatagatagattgatggattattatcaagcgaaaaaataactaaaatttgttcactgagcagcagctagaagcatagaactgtattattgtgtaatccgtttcatatttagttcttcacgtacttgaactcattatttttcactgcaaaaatgcaggtaagaataattcagcaagcaaaattctggtaattaccttgccgacagtgacagttgccatcgtagctgcaatttccctttgtatctggaatgtgcgtaagaagagaagattggcaaaagcagactccagacgtgagtccctgcacataattttggcataaatattaacattcttatacactggcgtccgttaacatttcgtcaaattcatgcaaatttggcagctgatagaaccgaggattttgaaagtgtcaagtcagcactgttatctctgacatcactgcaagtggcaaccgataacttccacaaaagcaagaagattggtgaggggggattcggtgaagtttataaggtaataggccagtagtctttacgtctacttctgaatcattgttgatttcttttgagaaaaatgtgtcgatttgatggtgtgaattgactatggtcaaaatataaattctaaattaaagttgtgtttagttgagcacaaagtttggattttggttgaaattgaaaatgatgtgactgaaaagttgtgtatgtatgacaggttgatgtgatggaaaaggactgaagtttggatccaaactttggatctaaacacagcctaatactcccttcgtccctaaatatttgatgacattgattttttttaaacatgttggaccgttcgtcttattcaaaaacttctatgaatattattaaaaacttaagtagtagtagtatatgtaacaatgaatcaaatgataggaaaataattaataattacctaaattttttgagtaagacgaatccggtcaaataacggcgtcaaatatttatggacgaagggagtacctagaagtatgaatgcactactgctcaattgtgagtgagtcgcaaattttgtgttctcttgaaacaaatggcgaagctcctgcctcttgtttagaaaaactattagtgcaggttagttattgtattttattaatagtgaaaatatattacatcctcgactttagccatataatacataggtaacaagttaacttgaaaaagacataggtgatgggacaaatcctcaaatacctttggaagaaaaccaattgatagacttaaaaagacacataaattctagcaaaaagtaagcctatatgtattacgccacccatagaaagtaaaagacctttggtaactaactctaagaatatagcataatatactgctcctcccatcgtaataacatagaccaacatttggatcagttggacgataagaagataacctgcattgcagagttagacatcatttttctgttataaaaatcttttatcattttttttcaatgccaaattgatgaatttcaagtgtctaggcactccccgaagcgagttactatttttttttgggcacctcaggaggaggcatattgtaaggaaaagaacacattgtcgtgcaaaatgagcaacatggcaataaaaataggtcttgaattgtttcttgcacattgtagacactatattgcttgtctcctctccaattccttttatgaaggttatctttcattaagattgctttttctataaagaaatcacatagaaactttgattttttatagtaacctttaaaattagttatgttatattattatatttttaacccattacaaaattttgtatttctgttcatgtctccatgtataagttagtaagaaagtaagatactaagctaaattatttagggagttctttccgggcaagaagtggccgtgaagaggatggccaaggactctcaccaggggctacaagagctgaaaaatgagctaattcttgttgccaaacttcatcacaagaatcttgttcgtctcattggtttttgcctcgaaaaaggggagagactgctcgtctatgagtatatgccaaacaaaagcctcgacacccatctttttggtactattagcattatctttgatcatttgttactcctgtaatcatttcactccaccaataatagtgacattttttttacatttggtgaaaaaagacacagagcaaaggaaacagctagactgggccacacgatttaagatcatagaaggtaccgctcggggactccaatatcttcacgaggactctcagaagaagatcatccaccgtgatatgaaggcaagcaatattttgctggacgctgacatgaaccctaagattggggactttggcctcgctaagctcttcgcgcaggaccagactcgagaagtcacgagccgcattgctgggacattgtaattaagttgatggaatacttcatatttttgtgcttatattaactaacaaactaatgaaatacaatcctccttgctgatgcagcggttacatatctcctgaatacgtgatgtgcgggcagtactctacgaaatcagacgtgttcagcttcggcattctcgtaatagagatcgtgacaggccaaagaaggaacagtgggccatatttctctgagcaaaatggtgtagatatattgagcatagtgagtatccccggtagttcacataggaattcatgatattgctttgcattgcaatatttgcatatttgtggatagctgcacatgtctatcgtaattactgctgactgctgaagacatacatatttgtgactattgctaggtatggaggcactgggaagaggggacaacagcagagatgatcgaccattccttgggaagaaactacaatgaggctgaggtggtaaaatgcatcaacatcggactcctatgtgcccagcaaaaccctgtagatagacctacaatggtggatgtcatggttttgcttaacagcgacgctacttgccctctaccggttcctgcacctaggccaacatcttcgattgatggaagctctggttactcaacaggttactcaacataatggtctggttggtagctgggagctagatttgtcaccgatgttgttgctttctgttgtttcatattgaaactattcattctcgatttgcaatccgtagcatccaacttcaattaatgaagagtttcgggggactattactcctcaggggttatatatagtttaactagttgataccccgtgctttgttgcgggatatgtgaatgaatgcatgttatacattataaaaatggtaaatgtatatgtttaaataatgtgaaaatgatgagtagataataatttgccattgcttgtatattgagttctaataatacagcaaaattgtaaatgatacgtaatgtttgcatgatatttaaaatactctagataataattgctagtgtgggtgatgatgtcgcacacttgcatgatgagttttaggagttaatgggcatcaattttatagtaagaaaggattaatgaaaagtgtccacattgggagattcctatcccattcaatctctcaggcagctcgctccatgcttttcgtctcaactccttctctcctctttatgtgttaaagattgggttcagagatagccctttccattgtgaaatcaagttgttagattcaacctatatgatgaacaaatagtcaaaagtgagtgttttagaaattatggtgaatactgttttcgcgggtaaacagtgcagggtggcactaggttgccggtcagatcggcagattccgtggggagttggtttcggattgttttcgtggaatttctatgttacttcatgtttatgacttctagattgtttctatatgtatgtaatattgtttgtgtgttgatgtcagtcaatttagtgtgaacttgtactcaaatatggtatttctttgttagttcatgtgcaaatattgcttgaggccataggagtatagccagtgatagattaggactaggcttgggagaagctgagatccaaacaatcaaggatatcacgcgggatgtctaggctagagaacaatgcacgtggagatgaaagtttccatatatcatacacgaggtgttgtgcaagtatagaaagagtagtcaaatttggattggaatccaagtttggaaagattagagtgtggagttgtacggggatgttgtttctctggtttcttagatttcctatgtgattagaagtctagttctagttggattcctagttaggggcattcacgttatggtataaataaatagggcatatttgtcacttgtttgatccagtattgtgaatttcctattatgggttaattggatcatagcattacaaatttgtctgtttggaaatatgctattataattcatctaattgaaaagatgccattgcaatacttctaaaatctggttcatgccattttatacgcttgagatgggttttgaattgtttttatatattgtattttcgtatggaccaaactaccgttggtcttcagtcttcacagcttaaaatcatccccaaatgtagctccaaaccctagccgagcgagcgagcagtggcgatagcagagcaagcggcggtggcggcggaggctccggcaccggcaccgagggctttcgctgtggcgacgcaacaagctgcagcggtgaagcaagcaacggcgacgacggagccagcagggcctcggcatcacgcacaaagcaagtggcagcggcgctggcagcggagcaagcagcggcggggcaccgagggcttcggcagtggcgacgcaccacaagcagcggcagcggtgaaggaaacggcggcggcggagacggcggcagcggcaacgctggccgcggagaaagcagcaacggtcgcatcgacgacgaagcaaacagaaggtggcggaggcgagctagtcctagtcgcagcgcgacaagttcttggagacaacggcgagctccagtggcattttcctttcctttttcccttttttttctcctctctgtatttttttcaggatcaaatactgcatatcgattctgaatttttttttaacatcagcgatttcagtttatttatttgaaatattgtggttcaaatctgtttttttcattgcactggcacgagcgatttcaatcttgatttgaaatgctgtgggtcgtatggtgatttatttttacggtgcttgagtggtaggataaggggtagtttggtctgtacgaaaatacaatagacaaaaaccgattcaaaacccatctcaaacgtatagaatggcatgtatccgattttagaagtattgcaatggcatccttccaattagataaattataatggtatattttaaaacagataaatttataatggtataaatctaattaacccttataaaatatgtaactaacaaattagactaacaccgttagaaggctggttttcagaaagaataggataaggatacccctgcacacaaaaattcaagattgacatcatatttgccataaaaagcttacatattgatttgccctccaaaactgatatggtcaaatgagattcaactctaacaataattgtcaagaagccgaaccattcctacaacataagcaaaataaataaataaataacggtattgctaaaaatatgtcgccacaaattacgatagatttcagttggttgtttcaaccgtcggatgcagaaatcgcacgtgtacacatatccctccgattttgttctcttctgatctcttctgttgctttaatgttagtatttgctaagtaggattactaattaatcttaaaaactaaatattggtgtcatcacaaatttatagttttgggaattacatcaacttacacatgtaattttgagaattacatatgtaattttaggacttacatatgtaattttggaatttacattgtaaatacactaaaattacatatgtaatttagtgacttacaatgtaaatacatagcgactattttttaataaaaaatatggcgccataaatatagctactcccataaataaatgttctagctagtagatcaagaaggatcggttcagaacccacataaaaatgcataataaactagctagggggtcgcaagcattttcgatgtggagtatgtaatgttccatgttgctcctgctgttgccttgttgctcctgacgcgtgctgctgctgccgccgcccggctgttgctcttaacgccgccggcagctgctgctcccttgccgccgccacctcctgccgcctgctgctatactgccctgccgccgctgttgagggggtttggggacccattttttgggttgatttgctcttgatgtggagaaagtgacgaggggatttggggattagggttcctagagagaggagctgattcttcacggtggagtgaagagcactgatcagaacagatgggcagtgagggggatcatgttttttctttgttatgaattattttcgtccgtttatttgaactaaatcaaacggcagtggcaaatcgaaggagcacaaaccaagtgttttagatgcactttctaaacacatattgatgcatataaagtcaatatactttcaagagtttcgccgttttgtttttttcttgatcctgacggtctaactggagtacaacggacggttggactggcggcggtagcaacaacatcatcaagcagacaaggagatcgacaggcggtctgaccgacgacgtcatcacaacgatctgaccggtgcaacttcgtaaagtttgagggtaatcttttaattttgcaagaagaattgattttggtgtttctaccatacaaccgcctccggttggcttggttcttatattcgaaccaaccaatattttgctaacattttgtccggttgtcccagtaaagagcaaatatctattccttaccattgtattattttgatttgttcaaaaaattttcatccagttcgtctccaagttacaatgtactactgatttatcaattgcttctactccatgacatattgacaatggattggatagtttttaaaagggttaattggatccatgttactgcaactttgcgaaattaaaaaaatgccactactattcatcatatcggccacatgccactggaaatttctataattaaaactatgccactcccgtccctttttccgtctcctctctcacgccgtctccgttgccgtcctcatcccctccctccttcctcatttccgttcctgacttcatccccctctccggcgagcggtagagcttgaggagggagttggtaacgacagggtcccgttcctgcgcacgccttccctttccctctccgtcgccgacacggtctcctcctccccgccactacatattcctcttgctggtgaacttccattgcacgcgcacaagcacagtcatcacagacttcggcgatctccatggctccatcaggtggggtgcgcgagcgcatcgcacttgaatgcatgctcgtgggcgaggcgcgcaaagcctgtggatggggaaggggcgggaaagacgacgacgcgagggcggcgaggaggagggagaaggtgaacggggtgggcggcgaggcctcgcggatgcggtagtagagggcgagggaggcgaccgcgggcgcacagcgctgggacagcgcggcgtggagcgggcagcctcgggagggggccgacgagaaggcaccggcagaggaggaggaaggtgggctccggagccaaaggagcaggcagcggaggcggtgtgggagctcgggcatggcgggagggagccgccaccgtcgttgtcctctatccgtgacaggaggtctcgggagctgccgccgtcgccgtcctcgacaccatccacggcgggagtgctcgggagccactgccaccactgccgtcatcaccgctgtcctctttgcagtcgcagggatggaggaatagatggtgaagaaagaggagggagatggaaacgattaaacatgggggaacgagatagtgaaaaagtgatgggagtggcatgtttttaaaataaaaggaaaataaaaccgctccctttgccgtatgtgggagttcaaaaaaacttccactaattaaaaacatgccactcccagtatccttttattttgtttttggctctaattaattcaccctaaggtagcactatctttctttttctaatatacgacaccattgactttttgtttacatttgatcatttgttttattaaaagaatttataaatataaaaatatttaagtcatgtttaaagaatatttgatggtaaatcaagttataatgaaataaatgataattatatattttttaggagtagttttttttaaaaagacaaatgatcaaacgtatatcaataaatcgatggcgttatatattaaaaacggaggaagtataaaaagaatctatccatcagacgcacgatgcccaaataatcggacggtcaaatattccagttgaccaacgagcgaaacatcaagttataatgatgaaaaaaccatcaattggaacatttaaaagttatatgaaacttggtaaagatatacgttgaaacatgtcgctgtcacatatgaaacaactagtattaacggattgaagcatacgtttttctttcattaaaatataatcatgtgatatcttattgtaaagatttaattacaacgaatacaacggtgtaatcagatcgtagattggataattagtttaggagaaaaatcattttgaagctcaatagaatgtgcatgtatggataagatggagagagagtagtggtaggtagtttcgggaattttgtaaaatacactgaagacacatacgggtatatatcactatcacgtataaaacattaggttctgacaattttaaatatatatattttttattataatataataatgcgatatcttgttataaagatttaattacaacaatacaatgatataatcggataagcggttaatgagaaaaaaacattttaaatcttgagtagtacactggtcagtctgagcgttcgataaaattttgtgaaatcggtagaccgatcagtagattttcgggaagtatatgatcgacattcttcatgcaagttgccgcgcgactgcctttttcatggggcccgaccgcgcgaaggtgcaagcactcccgtgaccaataatccattgctcctaaattttactccctccgtatttcaatgacaatgttgactttttgacaaacgtttaacctttcgtcttattcaaaaactttatataattataatttattttattgtgacttgatttatcatcaaatgttctttaagcatgatataagtatttttatatttgcataaaatttttaaataagacgagttgtcaaacgttggttaaaaagtcaatggcgttatacattaaaatatggagggagtattaattatatattgagttctacaagtatcttgtttaatactccgtacattttaggagctaattaaacatgtcgaaacagcggctacggggaggtttcccttgagactagtcacgatcagctttgtttatttccattccccttttcctttcagcaactgttatctatcatatcaactgcgtccatgcatgcacgtgggttttgacaagtaagtaagcgaaagtaatttcattttatgcatatcatataaatagttaaaaaaaatttaaaaacatttgataacattgattaatacgaaatatatcactccacaaacatacgaacttaaattcaattaatttctataagttctaaaaaaatacagtaacaaatatagctgcgaatgtacgataattattttcagtttaattttttttacaacttgtagaagttgaatttggttttacatatttgtggagtgatatattttatattagtatatgttgtcaatttttttagaaaaatttaataactatttacttcagatgacatataaacaactagagtaagtaacggggttcagtgaattcagtctgacctgtggtggggccatcgcatgccaagttggccacttgcccagagctgtcacatccaaaatgatacgcattccagctcaaaaactcaaaacgaatgctgtgccattgctacatcgatcgagcttactagctttccatcatcccaccactgcctctgctaagctactctgaccggccggcgccatgcggcggcgctcgtcgctcgtccacgccgtcctcctcgcggtcgcggcggtcgcgctgccgctcgccgccggccagccgtggccgagctgcggcaccggcggcacgtacgcggcgaacagcacctacgaaaccaacctcctggacctcatcagcgccctccaggggaacgcctcctcctcccccaccctctacgcctccggcgccgtcggctccggcggccgcgacgccgtctacggcgtcatgctctgccgcggcgacctgagcacctccgactgcaacgactgcggcaccagggccggccaggacgtggggcgagtctgcaaccgcaccagggacgccgccctcgtctacaaccagtgctacgtccgcgtctccgacgccgacttcctcgccgctgccaccaacaactccggcgaggtcgccctcatgagctccaccaacatcacccgcgccgccgacgtcagggcgtacgacgccgcggtggtcagcctcctgaacgccaccgtgcggtacgcggtggagaactcgacgaggatgttcgcgacggggcagcgggtggggagcgacccggggttcagcgacatctactccatggcgcagtgctcgccggcgctgtcgcggccgctgtgccggagctgcctcgacggcctcgtggggcagtggtgggacacgttcccggtgaacgtggagggcgcgaggatcgccggcacgcggtgtaacctgaggtcggagctgaaccagggcacgttctacactggccaaccgatggtggtgctgcgggccgacggactcgcgccggcgcaagggccggcgccggcggctacgacgggaggtgagcatacaacatactccctccgtttcgaaatgtttgacgccattaactttttagtacatgtttgaccgttcgtcttattaaaaaattttaagtaactattaattctttttctattatttaattcattgttaaatatattttcatgtaggcatataattttacatatttcataaaagtttttgaataagacgaacggtcaaacatatgctaaaaagtcaacggtgtcaaacatttcaaaacggagagagtatttagttggagatgtattttcaatcctcgcggagaactggagatatccgctcatttcttacatatgccatccaaataatctatttaaattaatatgaaaaatatcagtccacaaaaatacatggttaaattcaacttctacaaaatccaataaaaaaaacaaattaaattgaaaatagttaacgtgcattcacaattatattttgtttgttgagaagcagctagcagcctagcactgtgttgttgtaatgaggtgctacatagaagaaaaggtacagtactttggatacttgaactgatcattttctatgcaaaagtgcaggtaagaataattcagcaagcaaagttctggtaatcgtcgtgccgatagtggccgttgcaatcgtagctgcaacttccttttgtatatggaatgtgcgtaggaaaagaagatcaagaaaagcagaacatttctctgaacgtgagtcctctacaaaatttagcgtagaattcttcaaaaattccatctaacattcgaatatcaattaactatatcaaattcatgtaaattttccagttgacgcatctgaggaccttgaaagtgtcaagtcgaccttgataactctagcgtcattgcaagtagcaacagataacttccacgaaagcaagaaactcggtgaagggggatttggtgcagtttataaggtaaactagcatgctggcccgcgcagattgcgcggctagcatcattatattttctctcatataatagcatatttgctttctcattatatttttcaaatatattaaaatgaaacataattttaaattttacaataactttatgaaactactaatgtgtaatattcatattgtatttttatatacgtgttagttattaattatttttaatatcaaattttagttatttgtaaattatatatattcctatatgtactatagacctgtcttttaatatttctttttttattccgaattttctgtaaattgtatttctatatagactctaagctcttcttccaatattatttatttttatttctgaatttttattatttctaattgtatttctatgtggactctaaactcatctttcaatattctttaatttttaatttcgaattttagttacttctaaatcgtattcctatattgactttaaactcttcttcccgtgtttttcttaatttcgaattttagttacttgtaaattgtatttttatacggactctaaactctacttttaattttattatgtgtattctgaattttagttagttttaaattcctatatggactctgtactctacttctaatattccttatttttttatttccgaatttctattctttttcttaattgtatttttatatggactctatactctacttctaatattccttatttttaattccgaatttcagttattttctaattatatttctatatggactctatgctctacttctaatattccttatttttaattccgaatttcagttacttcctaattgtatttctatatggactctagtctcctcttctaatattccttatttttaattctgaatttcagttatttcttaattgtatttctttatggactctagtctcctcttctaatattccttattttttaattccgaatttcagttatttctaaattgtatttctatatggactgtactctcctattctaatattccttattttttaattctgaatttcagctttgctttttctttttcttcgattaatgtgagaatttctatgccatgagagcggactgtactctcctattctaatatttcttattttttaattccaaatttcagctttgctttttctttttttccgattaatgtgagaatttctaggccatgagagcgaacgtggaggctactttttctattcctttaataatataatagatggtactccctccatcccaaaatataaaaaatttaagtgaatataatacattccagtactacgaatctgaacaggctaaaatatatcacatccacccataattctttatattttgggacgggagagtagtagttcacaggtaacttttgaacaattgctgatttccttttagaaaagaattattgatttgaaggtatgaatcgagaacggtaaaaatatgaaattctaaatatgtcttgattcctgagcgcactagtactccattgctaatttgttatagtttatttttacaaaagatctttgatctggctttattggaaaaaccaaatattgtaaattagtagcatatgcatgttagagtcttaagtcattacaaaattcaccatttctgtccatatctccatgtataaagcaaattagctaataaactaagaattattcagggacttctttttggacaagaggtagccgtgaagaggctggcaaagggttcaaaccaagggctagaagagcttaagaacgagctagttctagtggccaaactgcatcacaagaatcttgttcgt

SEQ ID NO: 36727 - DNA, 16760 bp, Oryza sativa
  unsure (1)..(16760): unsure at all n locations
nnnnnnnnnnnnnnnnnnnnnnnnnnnnnnnnnnnnnnnnnnnnnnnnnnnnnnnnnnnnnnnnttatttttacaaaagatctttgatctggctttattggaaaaaccaaatattgtaaattagtagcatatgcatgttagagtcttaagtcattacaaaattcaccatttctgtccatatctccatgtataaagcaaattagctaataaactaagaattattcagggacttctttttggacaagaggtagccgtgaagaggctggcaaagggttcaaaccaagggctagaagagcttaagaacgagctagttctagtggccaaactgcatcacaagaatcttgttcgtcttgtggggttttgcctagaggagggagagaggttgcttgtctacaagtacataccgaataaaagccttgacatatttcttttcggtacaattataattaccttttaatctacatatatatacccctttcgtttgctgacatgcaataattacaataatctcttcatcacgtgtcaattagactcggagcaaagcagacaacttgattgggcaacacgattcaagatcatcgaaggcattgctagaggactacaatatcttcaccaggactcacagaagaagatcatccaccgtgacatgaaggcgagcaacgtcttgctagatgcagacatgaacccaaagatcggcgacttcggcctcgctaggctctttgggcaggatcagactagagatgtcaccaatcgcatcgttggaacattgtaacgaagtcaaacactttatctgtttgtgcttatatgtagctaacaaactaacatgtacatttttttcttgttgttgcatgcagtgggtacatgtctcctgaatacgtgatccgtgggcagtactctacaaagtcagacgtgtttagctttggcattctcgtcatagagatcgtgacgggacggagaaacagcggcccccatttcttagaacaaaacgaagatttaataagcatagtgagtatcctgctaactcatagacaaatacggagtatattgataccgcttacattttaatatttgcatttgaagataaccatgcaatatatgatctgcaatattaacatataactcacaatatgtaactgattctaggtacggaggcactgggaagagggaaatattgtagagatgactgaccactccttgggaagaaactaccctgaagctgagctgctgaaatgtgtaagcatcggtctcctgtgcgtgcagcaaaaccctgtagatcggcctacaatggcagatgtcatggttttgcttaacagcgatgctaccagcactctgccggcttttgcaactcatagcccaacaatttccatcgaggggaactctggttactctcaaaccgttacacaattgtctcctagatagcagggggctaaaacatagttggtactagaaaataccccgcgagttgctgcgggatataatgtatctaaacaaaatgaagtgaaattctaagagaacaattgatccatcacatttagacatagtgcataccaataaaagaaagcgaaattctatgaagacatttgatccatcacatttaacatactatatgggttggataggtccaagtactccttagcagagcttcatcctgtttcatcgattataggaaaatgaattttcttgactacaaattttggaaataatacaaactcatcttatgaggagattgtgaaacttgcgtaatatatgtgtaaggacaggaaaggtgtataacaatcaaagacctgtttattgcgctatgctacaaattaaatgaggattagttgtactattctttttagcaatatatgacagactgatagagatatataagagatggcgttatattatttgattggaataaataatattacaataataaataaaataatagagtgggctaagctgatgaaacaaaatggagaagcaaagacggagttattgaaatggatgatcctgggagctgcaacttctttctgtgaaccaaagaaatggagtcgactgaaggtgataatcttgaactttgttttgtccttttccccctactcaagaagagttacatctaagttcgcatgttttctttctcgtctgctacctactatttgtgttgggccaaagtattggctgaaaacgctcctttcttgtttgagctggtctccccagcctgtggatgtaaaaactctctttatataaaagctgggccatctggccttctatcaaaaaaaaaaagttccagaaatcattctcgttgaatcgtagtatagctcaaatatgaatagaggtagaaattaatgaccagaatttactttcccaattagctagtaagagcatctatgataaaatccatcagcatgatataacatgaatggaggggaaatgtgacattaaattttatgaaggataaaaaagtgatatcatgcagatctagccaatggctaggcagatgaagacaaacaggagcattgcctttttctatacaggaggaatgagtacaaccaataaactcatcccaaagccatctgtttcaaccttgtgagccaatgagctgatcagctgaacatgggaaaatgagggaagagaagcacctgattcagcaagaagaccccatgggaacagaaaaaaggtataggccaggaagacacgaatgaatgggctgcttgtgtgcaatgaaacaatctcactgaaggagaaacaattgtgtcggtttgtgtccaataaatcaatatgaagattggcgaatccagctgttgtgctgcaacaatttgtttcatagcaaaaggggaggctaaaatgcctgctaaaatgctgcatcgaaccgaagccaccagatgagttggacatgattacatgagcccttttacagatggaaaccgcgctaacaggggaaatggatttgatggatctttgtatctggaccaggaagaaacgttttcgtgggtatggatgaacaacttgttagtgccattgctaccaggtatacatgtatcctgtaggatagtagttggacgtgggtgtagctgcgtaggcgaacagattgattcgttgtgttgttgcttgtttgtgggagctcagcatgcaagaagatcctttaatagctacccttccagttcttttcctcttatattccttgagaagtggaagaggctgttggtttcgcagagggagagaccgtgggatggtggaaccatggaagatgaaccaaatgacagtttttgatcgagccatcaaggaggaggcgaatcgatgaggggaagaggactcgacaacgcacgatggagaggcctggtgatgcgccgcctacgacactagtcggaaggaggaagaggaaaggttcactggctggcccaggtgggaaaattgggctggcctcagcgagcaagagaaaaggcctcgaggaagcaatttgcaccgttaagaacgtgaatccaacggatggaaataagtggtgacgtggctcaacctcaaagcaggaaattgctaataactacactaagtggggatgatttgtataggtatataggatttgctcgttgatgcttgttttgttttccgttgaaattgtatcttttatcagtttgtaatcaagaattgtaaagttaaattataaacatggagatacgaggaaaaccagtagtatgtcactttctttttcccttttgacttcaattaattagtttctcataagatacttttagcgtaggagtaatggatatccatctgaccatccatgcaagttgttgcagctaccgcggctggttttttccacgggggcgccaggtgcacgcactccacacccaaccatttgattatttctagttaagaatgggtcaagtgttccaatcgattaagtgcgtgctaattactactagtactcgcatgttgaaacagctgctgcgtggtggtttccgctcacctttattttcgacaacgaatgatcgatgaaacgtcccccctgaatgaacgtactttacgacgtaagcatctgtctaaaaaaacacgaataatagaaaatgacctaatatcaaataattagaagagtgacttcgaattcaggtcgtctacctcaccaccttgtgaagctagctggaagactctgggtgtttctcatgaacatctgcctaacgttgtgtggtgacctcagtctctgtgggctatcgccatggcaacttgccaacaccatcgtacgtacgtgcacgagaaaaaaacatttcaatgccgcgcgaaaattctatcctcttttgctagcttccatcccactgtgcatcctgctgactgtgacagctgcgtccacgggcgccatgcggcggcgctccacgttcgccgttctcctcttcgcggccgccgcgctcccgctcgccgccggccagccgtggcagctctgcggccgccgcggaggcggcggcggcggcacgtacacggcgaacagcacctacgacaccaacctccagagcctcatcgccgccctccagcagaacgcctccacgtcgcccactctcttcgccgccggcgcgctcggcgccgccccggacgccgtctacggcctcatcctctgccgcggcgacgtgagctcctccgactgctacgactgcggcaccagggccggccaggacgtcgccccggcgtgcaaccgcaccagggacgccatcctcgtctacaaccagtgctacacccgcttctcggcggccggcgacttcctcgcctccgccaacaactccggccaggcgccgctcatgaacagcgacaacgtcaccaccgccgacgtcgccggctacgaccgcgccgtcacggaactcctcagcgccaccctgatgtacgcggtagtgaacaccacgaggctgttcgccacggggcagcgggtgggcgccgacccggggttcccgaacatctactcggcggcgcagtgcacgccggacctgtcgccggcgctgtgccggagctgcctcgaggacctcgtcgccaggtggtggaagacgttcccgcggaccacggtgggggcgaggatcgtcggcacgaggtgcagcttgaggtcggaggtatcccaggacaagttctacaccggagccccgatgctgaagctgtgggccgacggcctctcgccggcggcggcggcggcgtcgccggatgctgcgccgggcactacgggaggtgacaataccgcgtcatttcgataacatatactccctccatttttaaatataagatatcgttaatttttaaacatgatatttgaaaatttgctgggttcaaatttactgcaaatatgagaaaatataagtcattatacttttttatggttcatggatttctgcattgtttatgttataccggattacttttgaactgataagtctgacttttgttactcgtcacattcttggtgttatgtcagataatcaccgcgcagacagtcaagacccatagtttagcatggcaaatgctgtattacatcatgtcacgtatatatattagtagtatgtcaattaacgatgactatcttcatagctcattgttttcattgagtcttagaaaaatcataaattggcacacgaagagacagagacggatccagaaagaattaatatgagggtctgaacaaactatacaaaaattataaacccatcttctaattaatgtatgataaaaaattttagtggggtcttcgtgggggctcctatggttacgacacgggtaatggagggctcgagacccccatagacccatgaaggatccgccactgcgaagagaaagtcaattttgttcgttgagcagctggtagctcaataatcagctgctcagacaagaaaacaggtgctctgttttgaatacttgaactgattattttccctccaaaatgcagtcaagaataattcagcaaacaaaattctggaaatcgtcttgccgatagtggcagttgcaatcgtagctgcagtttccatcctcttgtggaatatacgcaagaagagaagacgagggaaagcagagcatttcaccggacgtgagtgatccttctcatcattggcataaaattcttatcaaattccactatacattgttaatcatccgtattcattaacagtttatcaaattcatgaaaatttgacagctgatgcagctgaggacttcgaaagtgtcaagtcaaccctgctatctctggcatcactgcaagtagcgacggataatttcaatgaaagcatgaaactcggcgaagggggattcggtgctgtttataaggtatggaagtaaccttttatgtgttcttttgaggaaataattttttatttcacggggcgaattaagcatggtaaaaatatgaaatgataactttttactatgagtgtactgatccttaattgttactttgataatttaattaattaatactatttggcaaatatcattcaagatcgcctaatattgtaaattagttacagcaccaagcttttaagccattcaaaattcagttttttctatccatatctccatgtaagaaggtattaaaccaaatttttcaggggcttcttttcagacaagacgtagcagtgaagaggctagcgaagggttcaaaccaagggttggaagaggtgaaaaacgagctagttttggtggccaaacttcatcacaagaatcttgtgcagcttgtggggttttgcctagaagagggagagaggatgctcgtctacgagtacatgcccaacaaaagtctcgacacctttctttttggtactactgatatcacccctgaatttagatatgttaccatcttttcatgtttctgcaatgaacatgattcatgctaattagatgaagagaaaaggagacagctagattggactacacgatttaggatcattgaaggcattgctcggggccttcaatatctccatcaggactcccagaaaaagatcgtacaccgagacatgaaggcgagcaacatcttgctagacgcagacatgaacccaaagattggggactttggacttgctaggctcttcggacaagaccagactcgagagattacaaaccgcatcgttgggacattgtaattagttcataaatatatatgtaataaaataattaactatgcaattctcattctaaccatgtgattattcttgttggatgttgatgcagtgggtacatgtctcctgagtacgtgacgcatgggcagtactccacgaaatcagatgtgttcagcttcggcattctcgtcatagagatcgtgacgggccggagaaggaacaacgggccctatttctttgagccaaacgaagatataataagcatagtaagtatatactacctccattttctaaatagatgacgtaacttagtgtaaatgtgctgaagtataagtcttacgtaaagcttttttaatgataaaacatgtcacaacagaacaaatgatatttatataatttttaaatatgacgaataatcaaacattatgtcaaaagttaacaatattatttattaataaaagagggagtatatattttgctaattcaccaagactaatgcaccattgattgccacttgcacttttagtactttctaacatataaccatgcatactgattactgaagatatttatgtatctaatactaggtatggaggcactgggcagagggaaacattaaggagatcatagatcactccttgggaagaaactaccctgaaggcgaggtgctaaaatgtgttaacattggtctcctgtgtgtccagcagaaccctatagatcgtccaacaatggccgatgtcatggttttacttaatagcgatgctactagcactctgccggcccctgtagttcatattccagtagcatctttctccgatggaagctctggttattctcaaaccgtgacacaattgtctcccaggtagcagggcctaaagcagagcttgccatcgctagtgtagttggcttgttgcttgtttttgtttcgagttggaacttgaaactgtatatattgtcattttgtgataagtggtcaagagcttggccacacgagcccaatgctacagaatcacctacagaagcgtaggacacatcactgtatattgggattccaaaaatctgcttatctgagaaattactgcagtacacacagctcgctagtgctgtagaatgcagattgctctggaccgttaacttaaaagaaagtttccattacagagtgtaatttgtgaccaagtcagtagcagattgagcgaaaatgagcgaaaatgggcaaatggccggcacaaaagcttgggtaaaacggaggaaaaagttcactcgaggtccctcgtcgcatcgccgagttacaaaatcgttcctgaacccaaaaaccatatacaacgtatgccccaacttccaacttccaaaaccagtttaaaacgagatcccttgacagtattgtcccccgattttggctgacatggcacccacgcaggggtagatctacccattaagcagggtgagtcgaccgacccagctacaacctgtaaagccccacacccaccaagaccccctaccccttatagtaatcatgggctaacaaggtgtgaacgcccaacagattagtccgtttcttcacaatgcacgcccgctacaaacaatgattcagacagttatgcgattgaactataaatacgatatgtgttgttttcgattgtttttatcgagtgaatatctctgttctccgccccatctataatttaaagtcgtgtctaccaaacatggctcctttgacaaggtcttcgtcctaggtggcatcttcctctctttgttgcgtcaggcagggaggaaaggtagaggaggaggcacggctccggccgttgtgggtgatctcaacggcggcaggaggtggtcccagctgcgacggcattgggaattggaggcagccaacagtctagttgcagcgggaagagttttaggggagagagaaagagtggaggaagctcggcaaagaaagcgggtggcacgtcgactccatgccggtctccagtgtcgccactggctgcgcccaggacaacgaagggctcttcgtcggtgtcattgggctgctctcctttccctcccagatcttcgccccctctactccggctctactaagctctcatcgacaccgcccctgcccgacctcctccgtgagcggtgctcgcgggtcactgccagggcgccccctctgctggcgccagattccatagaccccatcgccgccagggggatgggttgggcaccttgcccctgggctacttctactgaccattgtcagcctcatctttcaccaccactcccggtgctccgcctgcctcgtcgccaactagggggttgggcccctcctcaagctacccatggcgcggccaccaccctcgctgactccgtccgatgggacgccggccttgacatcctcctccgggtcctgctcctgctttctcaaccgctagcctcagtgttcttcaccgcgaagaccccttatcccgtcggcctccatgcgtggaccgacgcacctccaccagcttgagtgagaacggggggagagcaacagagggagaagaatgagagtttgtgtcattgatatgtgggtcccacgttgactcagtcatcatgttggacaaaatgggggtcaatagcgtgtaagaacctagagtggtctggttttgtaaagttgagagctgacatatatctggtttttcagttcagggacgattttataactcggtgacaaggtgagggatctcatgtgaactttttcctaaaacgtgagagggccaggagtccagcacgacagaaatgaggccaggcgacccagcgatttcacttcaggttgggggctcggcctgctggctctggtgaaacagaagcaggcccatttctttcaggatatgggcttatgctaaacgatcgtcctcgtgtagcaggccaatttttcaggacgtacaaaaccaacatccggcctgcaaggggagtatccagcttgatgtaagttggatttataggaacacaaatcttgatgtaagatcccatagataaaaagttgaaagacaggagcatccaaaaatctatcgcaagtaaaataatgaattcgaagaaaaaatgattgcctgcaaaattaaggggaaggaacatgcgaaaatcgtttctccagtggtgaccaatctcgcacagattttgacttggttgctatccagctggcaagtgcatcaggggtccagtcacacagtgaaattaatcatgtttagacacaatgcaagttttcttgtactgtcctatctgcatgctaattaagttgccaagtgtgaagccaagaacagttgtctccagtaacgatcgattggcaacaaaatcaaagtccaagtcaatcaacgagtcttccaattttaatcggtactagtatctatccctatctcttaagaatttctttaattaggaagatctggtcgttgatttagatggtatcattatgaccgtatagagaactcatattgaacgaaacatgctattgtatagctgaactgtgcgtgagtgatgcgagagaaaactgatggatgatctacaaacaatagggacaaaaaaatagtatgcatactataaagttagcaaactgcttggaaaaaattatctaaaccatgctaatggagaaagttttggacaaattgtacctttcgaagcgtgacacaaataataggtcgaaattgtaccttattagtctttttaaatgttattctaaaattaggaaacaataattatcaagcgttaccattttttactcttaatttactgttttgttattataattgtaaaatccaaatgtgatattagttagttgtaaatgcggtggaatcaacttctagtttaagcctgtattgctaagaaaataacagtggtcaatatatgattaaattcaaatagatgtgatatcaacaacaatagaaatctccgttcaagtaaggtttggttactagtaatttcaatccaaatttcaaattaaaaattaattgttcttcaaataatcctcatggtgagatcaatccacacattggagaagcacaagaggtgttatgcaatccaccgttagggtttaaatcctggttcacaaaaaaattatatatgtgtgggtgtattttattaaagaatacattacaattatataaaaataacttggcaacaacttaataggtcagtgccatctaatataagaacttgataattgaacatccaagtacaatactgtgacatgtgggtccattataatataaagaacttgacaatttagtattttggcgtaaaaacttagctaggtatgtgctgttttgatttatgagtgcttgataagttaattatttcacgatatcagtatgccataacatagccatactgcagatattatcttatgttgttcatcccaatttagcacgactggtatagattttttcttcaccttattgatctcaactgaaatacaaaacattctactagtaaaatttaactgacttttaattactaaaatgaaaaaaataagtatgcttatacaatatagacaagtatatatgttgacaaaataagaacttaaaaattgaatgtgtataaaaaaatgctcgaaataattcagttgttatattaactcttaagttattataccaaaacatacccatcatgcaagttgatgtaattgtatacttattaagttcctgtactagattgtatacttactaagtaagttcttgtactaaatttcactcacccattaagttattgtattaaaatgctcatttctcaggttattgcactaaattacacccgtctgctaagttaatataccatgattgtttattaaaagtttagtgagatcatgtcttgatggcgcattcgtatgtgatgcgtatatatgtttcgcatgtagtgaaacatgaaaaatgttaaaccgcatgttgggttaataactaaaaggagatcaacaaggagaatattttggcgtccagatctctaaaaaacgtttcaatcatttaatcatgcgcgtgtacgtgaattacgtccaattttgttatatattgtgaacaattttttaaaaaaatttaacagatgtaattacattgtaacttgcatataactataatataacttttacataattttgaaccgttagatttgtttcaagatttgtgcaatcaatgatgggaaaaaaatcacaacacacacaagtgaaaggatttagtccatgacctccgtttcacgcaaatagcatgccacgaaaagatttttaaatgttacatacaattaagtcacattatagctaatataattacaccacgattacactataattgtatttgtcaaatttttaaaagaaaaagttattgaaaatgtataggtgatcccattacgtcggctggtggaaggcggactcagcacgtactgcagcaggcgctcccgattcttcatgcggttggatacgctggatgccatgtcagatggggagaacagtggattttcttcaacttgaaagattaatcgacgttaaataaacatttaatcttaatgcattgggtgaaagatcttgagctggttgctatatatccaggcgacatgcatgcatcacggtccagtcgctatacctactataccatagactgaaaaataaatatgaacagatacaaagtaacaaacataaagtaagttttcctttctgaatctgttgattctagttttcctttttgggtctgtttattctaccctgttagtttctgacagagaaacgactggttatttcactgagaaacgactggttatttaacttataagaatatggagaagttgaaaaacccagtttactaatttatataagaaaatacaaactagttgtaaatcagtgatgtttggaaaagttacagctttttctacacaaaaacagaatatatatcttgttgctagaagttttccaaataaacatagcccacatgcctttagctgagtcgtgacttataagacaatgaatagttgaatagttcctcaattgataggtcaagtgatcaagcccacttatgaggccatgaatagttgcctcaattgattggtcacaggctcaaccacaagtcaatcgaccagagtttctactagtttctttcttcattattatataacactgttaacttccgtaccattcgttctatctaggggttttataaatataaaaaaaatataaatcaggtttaaaagtcatttaatgagaaaacaaatccaacaaaataaataataagtacataatttatttagtaaaacaaactgtacaacatcgtatattaaaagaaataaaagtagttatcttggcaggataggtgaagaaacgccaacggaggaaagagggcaaacatggggatgtggattttcatcgaatttgtagttacatgtttgtgtaataacttatattatcacaacacatcgtaccaaatgttttcacatttttatttaactatttatatcatatgcatgttatagaaaatactttcccgctaaataggttactggttacaaatacacaacaacataccgttgttgagagagagtatgctaaactctcaagggggtgtcacatcgtctcttgcatgactgtgaatatacacatatactaattagagtttaatttatcttttttttacaacttgtagaagtcatatttaagcataattatttgtgaagtcacatattaatccatcttactattttttttagtttttccgataactgtttagatgacatgtgatagacgatgaaatattccttgaagaatttagaatcctagatgatgcaacagtctgaatgccacaataattaagagggccgacagagcatgggaaaaactgaaaaagaaaaagacctactaaggcccggtctagttccaaaaaattttctcagaaatatcacgtcgaatctttggacacatacatgatgcattaaatatagattaaaaactaattgcacagttaggggggaaatcgcgagacgaatcttttgagcctaattagtccataattagccataagtgctacagtaacctacatgtgtgctcaaaagatttgtctcgcggtttccaggcaagttatgaaattagttttttcattcgtgtccgaaaacccttccgacatcaagttaaatatccgatgtgacacacgaaaaattttcttttcacgaacgccgtatgtacaaacacaacaatatggcgctagctctccctactagacctgccaacttcgtccaagctcgcccacccttcgtcaagctagctacatgcaccacctacatggcgtacttctacctcgccgccgcagcatgcctcgtcggcgtgttcctcaacgcgcctcacgccaccgacgcgcagcccatgccatggcatcgctgcaacacgagcagcggcaactacacggcgaacagcacgtaccaatccaacatacagtacctggccacctccctcccggcgtacgcctcttcctccccctccctcttcgcctccggctcctcgggcgcaccccccgacgccatctacgccctcgcgctctgccgcggcgacaccaccaacgcctcctcttgcgccacctgcgtcgccgcggccatccaggccgcccagaagcactgcgcgctcgtcaagaccgtcgccatctacgacgacccctgcatcgtccgcttctccaacctggtgttcccggtcagccctccctataacaaaggaatgttcgtcgcgtgggacgacaacaatgtcagcgcggcggcggcggccgcgttcgacgccgccttcgcccggctggcgaacgccaccgccgagcacgcggcggcggactcggtcaggcgattcgccacgggggaggaggcggcgctcgccgtcgccggcgaggtctatcccaagatctactcgctggcgcagtgcacgccggacatgtcggcggatgcctgccggagctgcctcgaggatatactcgtgaggatggtgcccacgtatttagccgggaggaagggcgggcgcgtgttgggcgtgcggtgcaacttccggttcgagacgtatcctttcttcttcggccagccgctgttgcaactcccgggctcgccggcgtcgtcttctgctccggtgaacggaggtatgttggatgaacacgagtgaagcttgcagtgttaatttcttttccactctttctatttattattagttgtatgatatttgctcttggggttatgggtaaaatcgtttttacccaactatttattctttcccatcacctaaatttgcataacacactatcactacctctgttattttttacttcacgttttggacatcgccatatatagtctctagggcacgtgtttcattcatattttttttctaactatattttatataaattattaaaaaatattgttatatgaaagtatttttcataacaaatctactaatattgcatattagatcataatattttttatcaatgaattatttaaaaaggtttgagtatacatccagcaaaaaagaaagatttgactatgtgtatttctaggaaataatctatttgcagtaagaggtaaacactactattcgcatgtgttttggaatcattcccacgatatatttatttccaagcagcgcctggccctccctttcactgactaccaagtctaccactaccaatgagttggggacacaacccctgtgtacaaggtcctgtttggtttcatgggctaattattagcccccaccttttagccctgaattagctctcaaggatccaaacatgtgggctaatttgaggttaaagtgcattagcccccctcaaaacattagcccctttaagtggtgctaatggagctaattttgggtggggacaatcaaaaagcagctctctctctctctcctctctttctactctctctccaccatttagccttcaattagcccatggatccaaacataccaccttaggctaatgtttagcctaccaattcatgactaaatattagctctcaagattagtcttgggctaatcttccaaacagggcccaagttaaccttttctcaaagctccatgatattattttgagtaaaatatgttattgttaatccgtccgtttcaattacttttcgttttacctttgtcgtaaatcaaacattcttaactttaatcattgattttggaaaattgtatagttgaatatcataagatttatgtttttagagcaattttcacaaaaccgcaagttttgggccatccgtaacgcataaccctaggttttggggcaaagtgtttcataaaaccccagctacaagcttatatcttctatttgactaatatattgtaaaaattgtatgtgatatttttagtacatatacacattagctgcttttcaataatcgttgttcatcgcggtctgatcatttatgtgtatatttaaccaattattatgacattatcacttaggattatgtccatttttttatatagtgacaaattgagaaaaaaatataaactagacaagaggaatgtgtactttgagtcaacaaatgtaaatttatgcaaaaaaaaaacataatcatatgtaatatgagtattttacataaatatactacatgaaagattttcatggacgccggatccttttgtttccaggcggaccgtatgtggaacagcacaggaaaatggagggaccggcgctaagccatcgtccgtataagaaaatcattttttgtgtgcg

SEQ ID NO: 36728 - DNA, 38781 bp, Oryza sativa
ggttgtgggcgggaagaagggcggtgacagcaagctagggcggcagcgggcgaccacggcggcacgcgacccctcccctccctcgccttgcagatccggccgaggggaggcatgggggcggcgatgcttggcccctccctccctctccctcgacagcgggcgggaagaagggcggcaacaacagcagcggcgggcgaccacggcggcgcgcggtccctcccctctctccccttgcagatccggcgaaggggaggcatgggggcggcggtgggaggcggtgggaggtggtgggacggagatggcccgcgccggatctggatcgatgtgagttgatgcccctcccctcccctgccctccccctgcagatccagtgaaggggaggggcgtcttcggccggcgacgggagcgggcagcggatccgtaggcggcgaccgtgggggtgacagcgacgggccacggctagggcagcggcggaggcggtggattggggttagggttttgtttttctttttttttgtttcgattttttattttctcgtgcgggtgaggcacccgcatgcgaaaatcgcgattttcccagacccttgggtgcgtgcgggccgaccatccgcacggaaaaattgaaatcgactgcacacaaaaatctttcctgtattgaaatggggtttctttaaacattttatcccaaaacatggggttccttgaaacaaatcacaataactggggttttgtgttatcgatgccccaatacccggggttttatgaaatttactctaaataattacattccccacgagaaatatgtaattcgcatgttgttaaacaatatgaaattttagaaattaataatcaaattagcaatgtttagcttagaacaaagctaaaacatgtaatttgaaacagagagagtatttggaaataaatgtaattgtgacaatgagtgtttagtactaaagaaacaacaaaacctaagccatgttgttttcaattgtttctacatacatatagtaaatttagttgggacttcatatatgtattctgtaacttacaatgttggtttgcagaaagatcgaaacacaagagaagtacaatgatcggcattctggtgcctgcaattgctttatcttccatcgtagcatggttttgttcttggaggtggaggagaagactagcagcaagaaccttagagctaagtaaatattcttagccattttattaaaaacgcagcacgggaactaatgaactatcctgatggcagttggctaaattcattataaactaggggatagccccattcagttttgcacggagctagataattcacctataatatataactctgaaattttatttctatatagataccattatatgtaaaagtacatttggattttatatacagcgcttagcttctatttttataaggtcccatatacaactcctcgattatgtttctataggcttaatttcatatgcaactctttacttctatttctatgaatatattgtattttgtttacaactatatcaatcaatctatatcgttataatccggaccgaccatgatctaactgtttagatatttttctttttctttgattaatgtgagaatttctagcctctagagcgaacattgggtctccttttaaggatgtcttaataatacaatagattttgtttagtcaaattctatcatctttttttttctaaaaataagtcacttgtcttaacattaaaggcagttacttctcttaacataatgcttcattgtttacttttctcttcctagttccaacggagtctagtacagatgacatgcaaagtatcggctcgctcattcttgatctgtcaacactaagagttgctacagatgacttttctgagcacaaaaggcttggtgaaggtggcttcggtgtagtgtacaaggtaccacttggatgtaattgtctgggttttctctcaatttataaagagaaattttactcttgttaaatagctaagtaccgacaggtaccgtacttttttctataaaattgatgtttttttatacggtatcttctggtaactatcaagggctataaaatcatgaggccataacttctcttcacctgcttgcagggagacctacctaaaggtcaagaaatagcagtgaagaggctcgcgaagacttccaaacaaggaatagaagagctgaaaactgaactacttttggttgctaagctgaaccacaacaatcttgtcaagcttattggcgtctgcttggaagaaaatgagaagatacttgtatatgaatatatgcctaatagaagccttgataccattctttttggtactatttctcacagctccctgttttccaaaaaaaagatctctcatcatggtaatgcaaaacatgatcaagtcacacttatatatatcgaattggtgttttcttgtgtgagtggtagatgcgcagaaaatcaaagagctcaattggggacagaggttcaagatcataaatggaatagctagagggttgcaatatcttcatgaagattctcaactgaagatagttcatcgtgacctcaaagcaagcaatgttctgttggattctgcttataatcctaagatttctgattttgggttagctaagatattcgaaagggatcaatcaaaagttatcacccatcgtatagctggtacttagtaagtatatgtccagtcctttaaaatgacaattttattagttatctggtaatgcagtaaaaataatgttattcttacagtggatacatgtcaccagagtatgcaatgcgtggacaatattcaatcaagtcagacgtgtttagctttggtgtcctggttttagagatcatcacagggagaagaaactttggctcctatggttctgatcaacaagattatgatctcataaatgctgtgagtacacgaacactatattaattaatttatttattctgggaaaaatatgtagtacaaacttcataaatctgaaactaccgtaggatgtacaaatggacgtctgaaaattactcatggtgacgtggataaatcttagagatgtccatttgtgcattctatagtagctccttggtttgcactacatatgaagtttgcagtacatattttccttctatactaggctatacttctcctagttagagttaattttatcgtacattaacccattgatttgatgtagacatgggagcactggactagcgataaagccctcgagttgatcgatccatcattgggaaatcactatccagttgacaaggtgctcaagtgcatccaaattgggctgctctgtgttcagccgaaacctgctgataggccattgatgtctgctgttaatgtcatgcttactggtacaatccgtctcccttccttgtccagacctgccttttggtttcaggagattggtgctagctcagatgtaaattcagagcagaacctgcttgacccacacaactcaacgaaaatgtatcaaagtgaagcaccgatcacagagcttgagcctagataaatcttgtaagatgagttgaaagaatatccgcttcttctttcatacagttaccgatatttgtacaacggactcttattaatctggctatctaggtgttgtgttttcggctcaacaaagtcaagtggaaattattagatgttaataatgtatcctgctgtcatcctgtttaaatcaacaggagcatgtttgcattgttgcacaaagatactgtagcaaatacgacacatgcttgatacactggtttttcttttgaaagaattgatgcactgattctttatgttattcttggttcccagttggcacttcaatatgcaaatcatcattacttaaaaaaaaactattttcgtaggtaagggttcatttttttacagccaaacagaaaaatatcccgcctgtaataatagtcgaggagctcatgcaggataaacccacatgtgaaaatcaacttttataggctgccattaaagaggaccgcttgtgaaaatatgtttatttttgctggtggtcctcctaattcactgcatgtgaaaatcgattttcacaaataataagtaaagagaaccacctacgaaaatcttcggccacattaaaaggccgatcgacccagcactgaggagagttcatctctccctcgcattcttactccctctcctagctaggcgagcttctccctccatccatccaagcctcctacctctactccctctcccaggcagcgataggcatgcatcagcagtggcagttcttgggatggcaagatctagcggtagcgggcaaggggacggtgtccggcggtggcaacatcatccacggtgtcctcagcccctccacggtgagctcgttcgcgacagcggtaagcatgcatcggcggcggcaaatgggacgtacggcatccggcagaagcagtgtcgtccacgatccacggtgtaattcgtccctcccaggcaagtttgtctctgtggcaactgtaggcatgaatcagcggcggtgacaagaacatccacatataagtggtgaggtgtcacgaattatgacaatctattggtgttgcgccaaatttggtacatgttgcggtagaaatcgatctagagatttggaggtttggggaagattgcgcagagatcagcaacttgaagtaggagttggtcatttgactttatgtattttcatcaacgatgaggtctccgatggtttttctatttcgcgaacgcgctaaaggattatacgccaatatattagaagaagaaaacagagtttagttacacaatgcaaaccggcagaaggtcgttggcagggaacaaggaaaaaagaaacgaaaaccagaaaaaacacaattaaaaagatttgctgggagggtggggtggggattagtccctaaactcaaaaaaggcccccaaaagcgtggcaccactaaaaccgaaggatggactctagcactactaaaatcaaagagagagagtagtcgaaaaccctagagttccgctccttctacgattgccaggagaccagaaagacaaaggagtctaataggtctccagtggtaaggcagctgcttatgtaccgcagtgtctccaacggcgtctgtggcacaagtgcacaacacgccggctcatcagcgaccaaacacacgcgctacaggctacagctgtgaccggaacatactggcccagcggggaagtatcgtgtgcaatcgcacttcccagtgggagaatgcaatcagcaaggtggatcaccagatgcgaaatgtgcggcttggattgaagcaggtcatgagctaggatcactttaaaatatatgcagatgcccccccaagtgtcagtgcgcattttgcacgcaacaccccataattcactctcttctactccatagtccccacgaaattcccctttcatctcatcgaatcaaacacaatagagatggaggcgaaatgtacgcgatgccgaacgactccctcgtcggcgccgccacggagtgggacaggcggcgggcgagatccaacgggtggctccgccgcgcggtctacagctccgcccgtgacctcgacgacgcgcgggccagccccatggccgcgcacgcgccgctccgcttctctgttgcgccaacggcagccgccaagcccaaggtcgtcggtacattttttaaactttcaagtttcaatgttccatagatctagaacaactacctttccttttgtaaaaaaatttttcagggattttttcgttatgtctaccgttggtgttgatatgatttttattacttggccgaggaggattcgaacatttttatccattcttcacacgaggtagaagcagatctcggtttactgctccagattcttgtgaaccaacggttaagcgagtgtaggttacagaatgagttatgtttgtaaatgcacttttttttgttcttatatatgatttagtttctttcgaccttgtcctgaaactttctgtaatgttccactctcaggaaagcttccactgaaaggagagaagttttctttgaggctatgtctgagaaagtagcagatagttcttctgagagaacgactagtcctttagaatcagacagcgacgcattttataaaaatcttgatcccctcttttctgtattacatttttgtaagctgttaagttcaaaaaaaattaagaagaagagttaaaagattaaattgaattctgcagggtaaaccagattaaaccagaagatgtggttgcccagcgaggatgaggctgctgaaatgtgctactggtggttattatgtcaaaacattagttgattatgctgtaaataacattagatgtgctactggtggatagatattaacgtttacataacattcttcttctttttgatcaaattgatagggaaaaatggtgcaaaacgacgtacagtgtgattcttcataacacatgtcagagttaaacgtgcgagtgtggtttgagtgagtactttggcattctctgatgtcatgcgataagtgtcagttatttaccataatttttagtaaaacatcttgcctcacttgcaagtagaattaacttgactttcatcggaatggcaaaatgtatttttgcaggttatgctacatctgggcgtgcgtactattcctcaatgccatattaatgatgcgatggaccaagaaagctcgtgactctatcccagcacaccttgggacctttccagatgatgttgggatggcccaggcaagagtattcaggcataatgttttgcaaagcactgcgaatgagatagttaggctcggtgatcaggataacccatcttttgagattcttcttcgttatcttggggaagcaaaggaggagattgccaaagccgcttccaagatgtctggtgctgcggccagttttcatttcatttcatttcagatgttttcatttcagatgtttcagtctcttaatggaatccatgcaactgtacctttcgagcttttctaatctaattaatgtgaaatttgcaaattcattaatttctgtagctttcgagcttttcataatattatgttgaactctttttcgtccatctaatctttagtttaaccacttacatccaggatgcaattgaggttgcaggggttgctcttgttttaatcggaccaggtactgttgaaaaaacagtggcagtggcggcgacgacgacgacggcgaggaagagaaagggttatcactacgcttgcaaaaatggcgtctcctatgccaccactgactctgatgtgttgttgaacccctttttttttctagctgatctacaaagtgtgcagtacagatgcatctcttattcattgccatggtagtagccgtgtctggtgctgttgttcttcatctctctagcaaagtatatcttgttaatgaatttgggctcatcatgacaatacgatgaaagtaacatttatgatccacaaaatttatagaatgctattttaatatcactgctgcacacaaagatttttctggtgaagggcacattcagatcagtattgtgcacaaggacttctctgataatgagcacattcagatttaaggagaagaatgcaacagacaggcagatgaggcagcttacgtctttgtagtgaacgatatttatcttctgaaatgtttgagcagaacttatgacacagatgtattggatagttttccacatggtcatggatgacacatttgcacaatctgcttaaacttataaaacatttttgcaatcttgggaatcgaacatacaagaaaccatatgtatctgtgtgtggcgaacaaactatgcattcatttaagtttagatgccaaggctccaaatattttcagcttgcatgacaaggagagaacaacataatagttttgagtagcaggagccaggaagccaaatgcaagttaaaaagaaaaaaccatgctgacatgctaccaacattttgctatgtaacacaactagttcagtaggtcacagaatgaatcttagtacatgacataggactaatcgacatatcaaattgttgatacatcacacatttgattagagaacaaagaccaccctatataaactaggtagcaaaataatgaaattggaagtatggtccccgatgtttgatcctaacaaacttgtaaatgacagatcttgaaattgcagatcaccatcgccatgctccataacagcaaattgtaaaccaagataggctccaaggaaacctgccaccaaacgcaagtagttaaatgtttagaagcaaaccatgataggtttagataaatccacccacacacaccagcacctccataatacatagcagcaaattgtaaaccagggttgtatggggaaccaccatcaaatgtaaatagtgaaatgtttagaaaaaaataacatgacagattcagatagagttgttcaattataaacatattcacctgtagtgtttgcttggttgccaaaattaaattgccataaattgccaaaataatgcttctatcaatatggcaaatacaccaagataatcccagacaaccaaaagaagaggttacccaaaatgaatcatcataaacttgctccaaaatgacaaacttactccaagctaacacctgccatcaatttgaatagattaactacaccgtttaatcaaaggcaacaaaaacagaaaaacaaaaaaaagatggagcaagggcactaacttgattcatggatctagtggctttttagagccatttgccttccttttcttcttgttgttttgctgcacttccccttccttatcatcattactagccttttttcttgccttgcccttatccaaatgtcccaacaatctattgcacttccccttggcacgcacatcgttaggtgggtgaatgtcaatttgcgtaggaatgctacaaccaagaaattcctcgatctcgctaactctagtcctttgagtggctggcaccatctgtcttacttgttttgcaatgtcaagtacaccatttttcaagagttgcatgctatcaatggactgcttagctagatggattgtttcttccattgtgttgaatacatcaaacactaattttttcatcatagggtcagttgaggtgctctcactttcttccaacaaggtaccctcactatcaaacacaggttcctttttgcacatctttgtccaccttctgaggactaaatgttctggaagttgatttagcctagcacttctaaggacaagaatcacatggcggcaaggaattccaagagattcaaataacatacaagtgcatgaaatatccttggttgatgtgttgtataagacttttctttcccttagtgaactatcacttaccgtagtgattttcacatccccctcgatttcgatgttctcaactatgcatttctccataacagctacaacctctttctgaaaagtgtcaaatatctcatgggtgaacacctcccttccatgcttctcaaacccccattctgtttttagtttttggttagaatgaactgtaacattgtcattttctagctctttgtgacgttgttcttctagagctgtatcaaacctgagccaaaactccaccaaagcaagtttgaagcctataaaatgacagaaaaaggagttggtactctcagatcttgaagtcgttcgaagaatgccccaagagaaatgtccttgaagtaaactggtatccatgattcccggatacgatacctcgttgtcaaccactcatggtcttctagaccatagtcagaaataatggaagtccattgtgcctcaaattcctcatcagtttcagtacaccatacacatttgttaaaccgatcaaggaactctttgtcctctcttaggggatagcctaccttatcctttaatttcctcataatatgccacatgcataacctgtgggtgctcgtagggaaatcaacactaattgctgccttcatactagcacattcgtcagttattattagcctaggttcaacacctcccattgctcgcaagaatgtctgcagcaaccatctatacgactctatcttttcattacttagcagtgcggcaccaaataatacacaagaccgaatcgatccacttacctttccttctatctctgtcccagacctcgccgccaacaagctagcggcccctcaccccgccgcataccggccagaaacacgacggcgacgaggtgcactagcgcccaacctgagactgcgccgccgctcagtgcgacgagctgaatccacagtgtactagaaaccctagccctcaatggggaaagctgaaatgttttggagagagaggagagtcaaatgttcagccttggcttctgctataatagagggactggaagcattttggcacataacatagagacatttttgcataaacaaccaacaatgtgggaagtgcttcgatctgagcagtacacttttcatccgacggtccacattgaagattgaatttctcccaccgaatagtagtattgcactggatacttccccctggcccagcaacatatacgcacacttgcaagtttagaagttgtcctgccgtctcagacatggcacacatgacaattaggctaggaaaatttgcctcgtttgattggtcacatgcatggaaagagactcacatccaagacctggaagtccactgtccacgcatacatgggccacggctctacggcactccagccggcgtctccgtacgtatccggccccttctgatctcttcctcagtcacaaaccatcatgtccatggcctgctactacctcgccgccgcagccgccggcctcgccttgctgctgctccacgcgcccctcaccgatgcgcagacgctggtgcctttgtgtggtgacagcggcaactacacggagcacggcacgtatcacgcaaacatacagtacttagccacctccctgccatcgtacgcctcctcctccccctccctcttcgcctccggctcctcgggcacagttcccgatgccatctacgccctcgcgctctgtcgtggcgataccaactcttcctcctgcgctacctgcgttgccgcggccattcagagcgcccaggaactctgcccgctcgtcaagaccgtaatcgtctacgacgacacctgcatcctccgcttcgccaacgacgccttcccgatcagccctacctccaatagccaagggatggtcgttgcttggaaagcccaaaatgtcagcgcggcagtggctccggcttttgaggccgccgtcgtccgactcatcaacaccaccgccgactacgcagcaacggactccgtcaggcggttcggcacgggggaggaggcgttcgacgagacaacttttcccaagatctactcgctggcgcagtgcacgccagacatggcggcgactgcttgccggagctgcctcgaggatatagttgggaggatggtatctgggaatttgattgggaggatgggagggcgagttttgggcgtgcgatgcaacttatggtttgaggtataccctttcttctctggccgctctctgttgcaactcccggggccgtcgccttcaccggcgccaccggtgaccgcagccggaggtatgttggacatactttttttctccttttcttttatttatcacttgcctgatattttcctgtgtgcaaagtgtgttttcttcgataacttataaggctggttaaattatatttgcagaaagatcgaaaaacaagagaagtgcaatactagccatttcaatgcctacaattgctctagtattagctactattgcagcatggttctgttcgacgagttggaggaggcggagactagcaagaaaaacattacgaccaagtaaattcatcttatccattttgttagaatggaatatcacggaaactaattaatgaacctgtcttgttatttttatgaaaagttggctcaattcaagtgattcattagaaatttcgtttaatcaaattccattctctctttctcacacaaaaaaaaaatcagtatctaatattgaaggcagttatttctagttgccgtgttggaccacttttcaaagatgcttatatttagtctatagatcttctctatatatggtacttctcaattgtccgcacaataaaattataacttggagctaccaaatatttggacaaggcatcaatcaacatcccaagttatagttcggcgaaatctcctggtagctccaaagttagtagaaagacttttagtcatattagtgtcattaattaagatagtacttccatccttacgttctaattttttttctagtcaaacctatttaagcttaaccaaatttatatcaaacaaattagcaaaatatagtcaacgtttgatttaattagactaatttgatatcgtggatattgttaaattattctataaaccactataaatttttgttagaaaagatcaaagcatcttaatcttataacataaaatggagggggtacaaggactctttccatctgttagtcatatactgcgtaattaattatttacttctctcttccaatagagtctagcgaagatgagatgcagagttttgcttcactcgttcttgatctacaaacactacgaactgctacagataacttttctgaacacaaaaggcttggtgaaggtggcttcggtgtagtttacaaggtaccactcacaccatgtgtaacagtgtgggttttctctctcaatatatgatgaggccgcaacttcttttttcacctgccgcagggagatctaccagaaggtcaggaaatagcggtgaaaaggctcgcacagacttccagacaaggaattgaagagctgaaaactgaactacttttggttgctaagctgaaccacaacaatcttgtcaggcttattggcgtttgcttagaagaaaatgagaaaatacttgcatatgaatatatgcccaatagaagcctcgataccattctttttggtactatttctctcatctccctgtttcccaaaaagaaattaaatttcatgatgatagtgcaaatacgcctaactcatacctacatgtcataattggtgttttcttgcttgagtggcagatgcagagagaatcaaagagcttgattggggccagaggttcaagatcataaatggcatagctagaggattgcaatatcttcacgaagattctcaactgaagatagttcatcgtgacctcaaagcaagcaatgttctcttggattctgcttataatcctaagatttctgactttggtctagctaagatattcgaaagggatcaatcacaagttatcactcaccgtatcgctgggacttagtaagtatggccaatcctttaaaataatgaagtcaatagatcatgcagtaaaagttatgttcttgctacagtggatacatgtctccagagtatgcgatgcgcggacaatattcaatgaagttagacgtgtatagtttcggtgtcctggttttagagatcatcacaggaagaagaaactttggctcctacggttctgaccatgtggttgatctcatatatgttgtgagtacatggacccaattattctataccgagctaacttcttctcccaattataacttaaatcgaacactaacccattgatttgatgcagacatgggagcactggactagcgataaagccatcgagttgatcgatccatcattgggaaaccactatccagttgataaggtgctgaagtgcatccacattgggctactctgtgttcaaccgaaacctgctgataggccattgatgtcagctgttaatgccatgcttagtagtactggtacagtccgtctcccatgcttgtccaggccttcattttgggtccaggagattggtgctactgctagctaaggtgcaaattcagagcagaacccacacaactcaagaaaaatgtcgcaaaatgaagcgccgatcacagaacttgagcccagatgagtattgtaggatgagaattgaaagaacctcggcctcctcttccttgcatttaccgggaattgtacaacaaactcttattaagctgcgctagctaggtaccgagtttttggctcaataaaatcaatttgaaattgttagagcttaataatatctcctgttatcagcctgtttaaatcaacggaagtcatgtttgtactgttgcacactgatactgtagcaaataagacacatgcttgatacaatggtttttcttttgaaagaattgacatattgattctttctgttactcttgattcgcacttcaatattcaaatcatatcctaatctgttgcaactccacagccataaatgtgacaatatcttgagtcttgtgctgcagtaattcatctgttattttcatagtacagaatacggatcattttgaacggacgtaaagacacatttccctacaagcaagatcctgaccttgtttgagcgcattcgttcaaccacgtcacgtgatgccaagcttactaggattcgttcaatgttggttcaagcacttaatgctaaacattggagccatttactgagtttgtttggctgcttgctgtaatggtttcagtttccacccacaatgtttggatcgggggacgtaatttgaatgtaggcaggggattaaaaattgggtctaattcgacaaaccaaaacaagattgcatcaagcaaaaaaaaaaaaaaaagaagcaggaaattgtgagagcaacaggaacgtaaatcagcaagaggttgaacataaatcggatcaaaatcacccgaccaacatggtacaacgaaagaagcttcccctcgagatcttcctcaccggaacgtagcctgtaatccgggagttggaggtggtcgacggtgtcgttccgcggatgccggttactcgtgaagataacagcggtcgccgcctcgtcggcggcggtcggtggcggcggtttgaggtggcggtaggcggcgttgggtctcgtggaatcgagcggccgtgcggcgccatcgcgaggatcgaagcggcggcgttcgttggaggaggcggcgccgccttgccgggaacgcgattcctctccgtatcagtgttgtgttgcttagcaattgggccggtattggatcccacagtaccagataacggcccatcgtaagcaaacaattgtaacggttcctatcagcgctgggaccagatacgggccgaatttggcccaaccaaacacgtcccagagacactgccttgtctagaaatgaaaagcctatacgtactaaagtttctattactaaactcttattactaacactaggaaggtagcccgcgcagatgcgctggcaatttatttattgtttacaaatttaattggtaaattttgagatagatctaatggtttagaaaatttgaagatttttttcccaagagagaggaaaggaaagaggagatgaggagagtacgtccgtaccatggaagggtgtggagaatgtgggagcacatactttttttattcgatctaatggttaaaaatattggacccaccaatttaaaacaaaatcaatggatagattttagagtgtcacttggcttaatccaaacaaattaaaattaaatcagatctacttgaaaaaacacaactaaattgttttatttttttcgcaattacgtagtacatttatcaagtgatatttgacatcctaaaatatgatacgaaattatttaaaattaccgtaacattaattattatatatttgcccaagatgtggtgatgtatttagaaccgcaatataaattttataagacacaaatattttatttaattaaagaaatacaacgggatcacaaattggttatataatttaaaagatgaacgtttagaaataattgatttgacattttttatttatattatagatctagtttatatttgcacatatttgtggagtaatatatttttatatggtaaaaagttatattttaaagaccattgattttgttctgatggtaatatgtattatcgattttaatttattttgaatcttaaattgttggtttaattatgtatagagcaacagttagattagatatgatatgtgtagcttaaaataactgtggttgtttgtctttatcaaagctactcaaaaaatatagagagaagtggagggggcagaaagtgttttgcgtatctaatggtgagggtgaggtagaggggactttgtttttctattttttctaaatcatttaggtcaaaaaccaattatcatgtattttgttttttaaaatcttttttaattttaaagtcatcataatgacttaaaaaggtaatattagatacacctatttaagctggacgatttaactggagatggcttggttcgaattagctacgtaatatcacggtaaagccatgcaaactgatttaattagctgtatatgttatattaccgttaacctccttccacaaatcatgtataatacactaactaatttaatttgctatgtataatcttcttgttaatctcctagcttccttatatatatatattgccgtgcatataataaatatagctatgattagtagtaacacaatatgacagctaattaatctcaacttctaacaaccatagttactaatccttccggcaaaccatacatatgtacgggagaaaggtagatttaattcattggtataaaatagcgggtccaccaatttaagtgaaaatcaacggcaggtaaagatctaatctaacggtataaaataatgggtccaccaatttaagtgaaaatcgacggtgagattatattgtgccacatggcggcctaagagtatttgtaggagctccacgtggcggcttgagagcgtttgtaggaagtttaatggacttttagtatataatagatagaagatagatagatagattacgatgtcatgctgtaagcccatctagattgtctataatttatatctattaagatcaaactattgatatcattaagagttctgtaaaaaaaaagttagtacatgtagctgtgctcgtctagaaaacactaccgtcccaaccaactagtcttgaggtatgtgtgcatgatgtcccaacgagcgcaacgcgtccctttttaattataaataggcctagcccgttaatatatgagcttccagtctatccttaattatataggatctgacttgttcaacgtacgagtatgtaactttctctactatcttaaaagcggaattgtcttactcctgtctcctccttccaccgcatggaccgtgctcgcatacctagagtaagtaggtaaccactagattaaatattttatttcaaatcaatcttatagactatcgatatttatatggatatgacctgttacaacttagggatatgttactaagtcattttaaaagcacaataccaatgtgtgagtgtgacttccctctcacagtgatcatcgacggttgtgcgtcggtgggtttttttttttcaaaggtttgtgcgttaaaaagttcaaagtcgtatctccggttattaaacatctatcatttgcctatcattttctaacataatctattagcccaagtgcggaagtgccccgttgctgcgggcagttctcgcaagacctatcgacagaaaactccggtccaaaatgtcattctcatagtttatcagtggttgaatgtattagaagcaaacaagtttttcaatgtatttaatagttcaacggaaaaaatcagagctttccacatcactccgtaggtctaataacagcataattgacaacagtgacaattcatcatgccatacatcgtgatcactcctgacttttattatccactccggtcagtttcaatttctaagaaataccatcttattaattctaattacagccacaatggtggattcaataaataataatatactgacgtgatgcagtagggcatccccacgcatcaacctcatatgtaatatctagaagcattgtacacgactgaactaaaaattcaggattcatctcggcacaagctctgtgattgacaaatcattcgaagacaccactgttgaattatcagaatacccggaatgtcttggtcttggatagcgttctgaatacggattagagctgtcactggcactaacctcctggatgcagaacgccggcctggatagagaagggagacgaacagtgttgctgctaagcatgatgtttactgacgaaatcgtcggcctgcttgcaggttttttctgaacacacaacaacccgatgtggatgcacttcaacatctgctcgattggaggatggtcgcccatggatggatcaatcagctctacaacgtttccccttgtccagtgctcccacacctgcaccaaattggttgatctattcaagtaatatatatgttgagaagtttggttaattattcatgaacaaacttgaagtactcactaggtttaagagatcaacatcttgcccactatcatatgagccagtgtttcttcttccggtgataatctctaataccaaaacgccgaagctgaacacgtccgatttgattgaataattaccacgcatagcgtattctggtgccatgtatccactgcgacaaagaacattacattacaacctagtattatatttgttaccttaattttgataaatgttgaccatgatcatgcttactatgttccggcgattcgattagtgacatcttctgattgatcccctccaaatatctttgctaagccaaaatcagaaatcttagggctgtaatcaaagtccaataggatgttgcttgctttgaggtcccggtgcactatcttcaattgagaatcttcatgaaggtattgcaagcctcgagcaatcccatttataatcttgaatcttttcccccaatctagctccctgttcttgtcggtatctgaggctcaaacaagaaaaaccatagcattgtaatgtaactaataactctggcggcatttggcactagtataattgttcttttttttcttttggaaaaactactagtgagaaaaccgtaccgaaaagaacgatatcaaggcttccatttggcatatattcatagacaagtattttctcttgctgctccaagcaaacaccaataagccttactagattcttgtggtaaagcttagcaaccaaaatcagctcacttttcagctctcctattccttgtctggaactctggcaaagcctcttcacggctatttcttggccatcaggtaggactccctatccaagtaaagatacttactatataaccaacaaaaatataactgataaaggtacatgtggtatgattttctaccttgtaaaccataccaaatcctccttggccgatcattttagtatcagcaaaatcatctgtagcaactcgtattgttggtagatcaagtataagcgaatcaatgctctgaatatcgtctgaactaactgaatctgttgggacaaagatgataaacaagattaagcttatcaagaagtctggtttcattcattcaggaaaaaaaaaaaagggaaatatgatttcactagaagccggggacacagcttggcattaagattcaagataatgaaaataaataaaagcaaactattttcaattcaaccaccaattccctgccggtcaacaaaacttatccatttcttgctgtgctaacataccataatttttagcagacttacaggacagaaacgtctgttcttctggtcgtctcttcttgatcctcttccagcaacaaaagcatgctacaaccatgagcagtattgcagctattgcaggcataactatcgctagaactgtaccaatcctatttttcgttttctctgcaaataaatacaatccgattcagaatttcagaaagtgtgaactgcacttagagactgtatattttgccgtggaatttccacgaatttccacgaaagagtcatagttggtctttttgcaagattatctgcaattaattaatctgtgtgcctttcacacccaaaagagaaaagtggtttgtgttgctcacctccactggtcgccgatggcgaaggcggcggcggcggcgtctccacgaacgccggaagctgcagcagcgggcggccggagaagaaagggaacacctcgtaccggaagttgcaccacaccccgaacatgccccctcccgtcctcccgctgaattctttgggcagttgcccgatcaccgtcgagaggcaggtccggcagacttcgggcgtcttgtccggcgtgcactgcgccagcgcgtagatcttggggcggtcgctgtcgccgtcgacgccctcctcctcccccgtgccgtaccgcctcgacgagtccgccgccgcgtagtccgcggtggcgttgacgagcactgcgacggccgcgtcgaacgctgccgccgccgcggcgcccacgcggcgggagcgctggagggtgtaggtggtgacgaagtagtcatcgtcgaggaagaagtcgcggttggagtagcggagctggcagaggtcgtagaagacgagcacgtccttgacgagcgggcacctccgcggcgcgtcgcggagggcggccgcgacgcagcgctcgcaggcggaggcgttggcgtcgccgcggcacagcgcgaggccgtacaccttgtcggggacgtcgccgacggtgcccgtggcgtacatggccggagacgaggaggtgttcttggggagggtggtggagaggaggtcgaggttgacctggtacgtgccgttcttcgagtagttgccgctgggagggtacggcccgcacaggacccatggcggaggctcgtcctctccggcggcgagcggcgcgtggaggaggacggcgaggaggaaggttgcggcggcggcggcgacgccgtcgaggtagggacggtggcggcgcattgtgctggcgatggtaatggtaagttgtcacgaggcggctagtgtagaggaggttcgggaattcgactagtcgagtgataggtggggacggagtgtttgaccggagaaagtggtttaggcacatcatttgttttatataaaatcaacctctattaatatttaaattttataacttaattttaaatttgactttaattagtttcttcgatgtttatttttagtattagcttttaaattaccccacgcatatatagaactacaacatgacatcctacatggagaaatttgcatatagaccatccataagaattggtttcgttataatatcatcgtcaaaatgggattagatcaaatgccactctcaagcaaggggtattcgctaaaatatcattttcatcgtttcttgcatttccaaattatttttcctcaaatttattttctctcggacatttatgcccctagatgaataggttgaaccagaccacatttcatccctccattgtgtgttctagaaccgagtaagcgcgagaggagaccaatgtaacgtgtcgtgatagaagcacccatcggagtaggccgagaccatgatcgcccaggtgattccgctcttgtctgacatttcgttgaacacctggcacgctgcctccgtgtccccaaacaccgcataggcgagcaccagccggttggtgagaggcaaagggaggccagagacggcgaagttgccggtgcaatccttgaggaaagagacataggagtcctcatcgggcaggagccgagcgcttactcggtgaagccgttgtgctagtagttagtttccttctttcgtcttcgccacgcgcggtagaggaaatgacaaggccgttgttgttggaggtggtgggacggggaaactcagacgcaggtgtaggggcggtggcggtggcggtggcggtggtggtttggtcggttttcgcagagtcggcaaccgcaacgctcccctagcggtggcattagtggagagatggcggcaacgaggagagaggtgcagagccacagcggtggtaacgccgaatggcttggcgatggaccaatgtgccatggatgtgtgggttgaggcggtgaggctaccagcgagcaggtggtgggcgacaccggtgaggttgtgcggttgcaattgcaaactctcctctcgagcttgcttggttctagaactgagaatagggagatgaaatgtgatctaattcgacctattcatccaggggcatacacattcgagaaaaaaatcgaggaaatataatttggaaatgtaagaaacagagcaatggcattataacgaatgcccttcgtttgagagtggcatttgatcaaattctattttaatgatggtattctagcgaatctaatttttttagatggcagatatacaaatttctcaaggtgcggagagtgaaagggagagaaaaaagatgaggaggagacattcaatgttttctgatgcgacaaatttatggagccttttaactttacagagcataagcccctcaactccgtgacaaacaagcaagttttgtggaaaagaaaatgatcaacacatgatgacaaaaaaaaaagatccaagtgtaatctctaacgaaaatgggccttaaaaagactaggtaagtggcttggagaaaatctcatttcggaatttgccaaaatatcgctcagctcatctctcaaccagtgtgtcatctgctgctctcttcgttctaaaataagtacaccttattagttcaaatttaaattggagtgtgtatttattttagaacagatggagtattattttttttcgaattgatcttaaatcttaaatcttgcgtagccgccagtcccgccaaacaaaaactactctatctactcctgagcatcttcaaataatacaattacaatagtactgcagggaagcctcgtagtctctgttttttcctccttgatcttgacatctctgcagccctttcagatgctacatcgaagacaacgattggtcatcgagtctggttggcgtatatttttcatttttatcaccgtgcgccagggttcaccaccctcggtaacgagcgatattttgtgattctgcagaagccgttggtaaaccaataaaaaccgacaaaatctaaaaatttcttatcaaacaattaaattttagtttgattttttctcccctataaaaactgagctatttgtattttgacccggtccagaaatccggatttcctagttatcctttgcttttgtaaatcgtgaggacgcctactccctccgtcccataaaaaaccaagctagtattgggtgtgacacattttagtactacgaatctggacatatctatgtcaagattcattgaactagaatatgtcacatccagtcctaattctttttttcgggacgaagggagtaatggcctaggtatgttaaagctcagccgttggtgcgattttgaagaggtttttttttttcatgcgcaacttacgacctagttgacacaccttcaactctagctccgtctcttttggagcatgagtttaaccaaacggtttcaactttcaactctaaaaaaagaagtgaatcaagttgaagtggtctcacaaaatgaataagtagagttaagtttagacagcttcacaactacagtctacacttaaaatctagagttatattagccataccaaacgggccattagtccatcaaatttcatctgagattcaatttaatatccaatgtttcaatatataaatttatccttttcgaatacatctaaattcacttgtgccacctcgcgaatcatggttagttattattgccccttattcgcatcaattatgaaaggagaaatgaagaataatatgtgtgacctgggcaacggggatcaggtttattcagtttttcaaaatattgtttccttttgctacgttaatgaacaagggatacaatacaagagacctatattcattaatggagtgttgactagaattggtcaggtgacatctcagtttcgtcccaggatgatcttaaaccagaattaatactttctcttttaaaaaaagaattaatatttgtgagactcaaaataaacaaatcaaaatgtcgactaaattactctcttaagagagtctcatgaggaactcctaaatttaatagtggtgctcgtatttacggctaatttttatttcagtggtagacgatcgtgataaatcttaagatatattatctcggtcttctgaagatgctcctacaaataagttgtgcgtttgttcatatggacgagtgcacgtgcattgtgggtcactgtgtttgttctgtgttaaaaaaaaatttactactctctcaagagagtctcgctggctgacgggcacgtgtctctctctagtcaacacacaattctagttagtcaactccctagccccaccgctcttctatttcctctgcaactgcgacctttcctcgagcagctagaccaccatggcgacggcggtggcggcgacggccatgcgacgcgggcaacaccttcctctctctctttctctctgctacaacctcgccgcagtcgccctgctcgtggcggtgttcctccacgcgcctccgcgcgcgggagcgcagccgctgccgtggcaactgtgcaacgccaccgccggcaactacacggaggggagcacctaccaggccaacgtgcgcgcgctcgccagcgccctccccgggaacgcgtcgtcttccccggccctcttcgccgagggcgccgccggcacggcgccggacgtggtgtacgccatcgcgctctgccgcggcgacaccaacgcctcctcctgcgccgcctgcgtcgccaccgccttcgacaccgcgcagcagctctgcgcgttcaacaagcgcgccaccctgttcaacgacccctgcatcctccgctactccgacctggacatcctcgccaacgtcaccgacaacagcgggaggttcgtggcctggaactacaacaacgtcagcgcggcgaaggcggcggcgtacgacgccgcctccggccggctcgtcaacgccacggcggactacgcggcggcggacccggtgaggcggttcggcacgggggaggtcgggtccgacgacgcgacgtacccgaggatcttctcgctggcgcagtgcacgccggacatgtcggaggccgactgccggagctgcctcggggacataatcaggaaggcgacgcccaagtacttcgtcgggaagcccggcggcagggtgttcggcgtacggtgcaacttccggttcgaggcgtacgagttcttctccggccggccgctgctgcagctgtcggggccgccgccgccgccggctaacatgacaccaccggtgaccagtgaaggtgagttgccgaaacagaaaccacacatgatcgctcgtcggatactcggatgtcgctttctgcttttctcttttttttcctagtttcgctttaaggactggtttagttcctaactttttattcaaacttttaactcttttatcacatcaaaacttttctacacacacaaacttccaacttttccgtcacatcatttcaatttcaatcaaacttctaattttagcgtgaactaaacacaccctaaattttactacctccgtcccagaataagtgcaaccatgagtttccgcgtccaactttgatcgttcgttttatttgaaatttttttataattagaagttttgttgttataagatgataaaacatgaatggtactttactcgtgacttatgttttttttttcaaaatttttttaaatatgacgaatggttaaagttgggcgcaaaaaaccatggttgtacttattttgggacggagggagtataatggaatcgctgagcacgaggcgcatcaattttgggtagacattaagtggaatcgcctccaacttaggacttaataatttggagttgaaatttagtccttgtttagatcccaactttttttctcaaactttcaatttttccatcacattaaaacttaactttcctacacagataaactttcaattttttttttaaactttcaattttagcgtgaaactaaacacacagtaagtagtaacgaattgaccatcaaatcgccggcaaaattcctgcttattatcgtttatctccggtgaggcggggaagaactactactggaaaatctcgtgtaatcgctggggtcctgcttctgatatttgtcacctagttatatatcatgaccaagatgaaagcagcctttcttgaacgtacagtactcaactgctaataaagcggaaggttggggaagaagccaagaaggtgagattggtcaagatcgaggactaattttcaaggttggctacgaagcaggggtaggtggctcaggcggccatctgtgctacgggggcggtagagacagctgatgtcacaaacgcgatgatccacaggaggggtattgatggccaaaaggcccaggcccgtcagcctggctcagggcacggagttttggctcggcccaggcatggcccgacctgactgatgtcgagcctatatggccggcccaaccgttgggtcgtactttggcctctgtcccggcacagtacagtccaataatggggaggaaaaatagacttatttagtcatataagatatagcccaaagaaataagggatgcaaaatagacttatttcagctataaaggacacggcccaaagaaataaggacaaatagacttattcagaggaatacagtgggcttccgtgcctccgggctagcccaagccttattgagccgttagtgcaacccgtgggcaggcccggcctagcccgtcatgtaggtcgggtcgtgttggcctgactgctctcgggcccaggcctagttgtgcccgggcccatttggccatctataggtggggtaaggttgttgggcaattgaagatgaaacttagacttcgattagaagttctgcattatagtatgcatttgtttgaccaggcttcaggtacttgatcattgtttgatggagttagagccaaaccaaacactactaatcctcaatgtttttaagagtatagtaggtgattagcttcacaaaatagatagcaagggtagggctcagcttcacaactccagctcaatattagatttagaaccctaccgaacatgccttatgtatctaacacaattactactttaagattcgttttattaagccccgatggtgcaatggttgagttgcaggggtttatatctttgtgccccacaaatatcatgtacatgcgagtgcgtttttaataggaattctatcgggttagagatgtctcgctgattcccgtttcttaaaacatgtgttaggagtacactgatgggtgtgtgagtcagtgtgacgtgcgtgacggtgtgtttgtatcttccgtaaaaccgagaaaaatgtttactacattcttttaaaaagaaagagaaacattaagcataaccaatcttagtcgtactaactggtttcaaactaattcaacgatctctattgtaggaaaaaaaactttttttgaattactgtacttcctccatttacgttttaggatgttttggtctctttatatatctctcgtctatattcaacacctatatagtaatgtggaagagagaagataaggaaaaacttttacggtgtagacgaaacagttatttgcactttgctgtggtccatgactataacaccatccatggatacatttacattttattgaagttctcattttgaaactagccaataacccgtgtgttcagagtactttgtttatatatgcttatttcacttataaataatttagttttattaatactttcaaatttaaaactggtacttacaaaactgtacatgcggaggccatatggattagtaaattaaagttgtacatgtcttgtattctaaatttaattagtatctcattaattcgattatgaaaatcaaaataaataattaaggaacaaaactgacatggagtcatggactactttttataatctaagttattataattcatttccacctagatgatagccagattttactaagactatctaataattataagatttacttcggtctaacaaaaaataccttgagatatcggtacctcataataccaaatcgtttccgatcgttagatttaagaatgcctatcatggctagctagatccaacgatcggaaacaatttagtaccgtgaggtactagtacctcgaggtactttttcttggaccgaagcgaatcctaataattatacgcatgatttgtttgcactttgcaggaagaacaagccatagaacaggacggatcttggccattactctgcctattgctggagcagcattagccttcattgccttgacatgcttttgtttccggagaaagagaacaccagcaaataaggcctcatcactgccatgtaagtcctcttgcttcaggatattgtacttgtaacctgcaataatacagttcctagaatgtgttctttttccaaatcctgtgagaactttaagtgttcttttcagttaaatccctatgctcatctaaggccttacttggtctggttacccttggaggtagggaaatggccctttacttgataaaacatttttttagagaaaatctcattaggcaaagttgattatttcatttagcgaagttcgtagtgtactaaagttaaacaatcgatggcatttagtttaactaaattcgttgcaaagcaagctagctttttttttttttttttttttttggcgggggcaaagcaagctagctttgcaatatgagtcatcgttcacctgttatcttgctacagtctcaactaatccggatgatattcaaagcatcgactcgctccttctggacctatcaacgctacgggctgcaacagacaacttcgctgacagaaataagcttggcgaaggagggtttggtgccgtttacaaggtacaaatcaaaccatatgtaacccttgttcatctttttattagaaagtgaatacattcgtgttcattattaacaagtttatctatatattcatgggagtggattataatccctcaaggggatatcccctcgtatacctttttctttcaaattcgatgcaaatagttgtgaaaaattctgaaaaaaattgacaatgtagagtataatgatacctactagtccaccaaaattcatgttcaaattcaatctacacatcgagaaacaaaaagacaaatttagatataaacagtgcactactattcatacgctgaatttgtcttttttatatctcgacgtgtgagttgagtttggataagattttgtgaagttgtatatatatgttgtatgaatgttatcaaatttttccagaatttttcataaccgtttagatggtttttgagcaaacgaggaaaatcccctcgagggattagaatagtttcccatatattcatctgtacacagggagttctttctgaaggtcaagaaatagcagtgaaaaggctctcacaaagttcaagacaagggatagaagaactgaaaactgagctagttttagtcgcaaaacttcggcacaagaaccttgtgagccttgttggtgtttgcttggaaggagatgagaaactacttgtgtacgaatacatgccgaataagagcctcgacaccattcttttcggtacaatcccctcactgcctttgcgaaatcgaagcgttcctctttttcatacatgaaagagatacatgcatacataccattacactataggacttgatgctgatttcctttgtgtttgaatggaagattatgagaaaagcaaagatcttgattgggggaagaggctcaagattgtaagcggagtcgctcgaggcttgcaatatctccacgaagattctcaactgagggtagttcatcgggacctcaaagcaagcaacgtgctgctggacttcgatcacaacccaaagatctcggactttgggttagcgaaactgtttgagtgggatcaaacgcaagacgtcaccagtcacattgctggaacatagtaagtatatatatatcccctgcaattccatggcacggtattatgaaagtaggtacaggttcattacaagatcatctcctattattttcagcggatacatggcgccggagtacgccatgcgtgggcagtattcagtcaagtcggacgcgttcagtttcggagttatgatcctagagattgtcacgggaaggagaaacagcagcttctccaactcggagcaatccattgacctcttgagtcttgtgagcatcattaatctctgctcctcctcattaccatgagacctgatcaatcaaacatgatacgaaaaccatcttcttaattgaaaatcatcctgacaaatttatcctgattatgcatgcaggtctgggagcactggacaacggggacgatcgaggagctgctggatccggcgatgcgcggccgttcagctgacgatctgctgaagctgatcaacatcgggctgctctgcgtccaggacaacccggcggacaggccgacgatgtcggcggtgagcgtgatgctcagcagcgagacgttctccatccaggccccgtcgaggccaacgttctgcatccaggagacggacagcgccgccgacacggatctctactcgagcgcgcttcggtccaccggcgacagcaagacgagagcagtggcgtcgccgaatgaggtgtcgctcaccgagctggagccaagatgagtgtttgttggagcgatttgtgcagatgagtagatgactgcatgatcttcttctcaataactaaagaatcaactcatgggtcatggcctctgcactcgtttgtctataataaagaatagataaaaggaagtgtcatagtggttatgcagaatgtaactcagtttgatactggttgtaactctgcaaagattgttcccacctgtatattattatagttacaccgtccatgtcgattacagcaatcagaataattacacctgtatatggaatgccgcatgttagagattgtaccgaatacgtgtatatgacccgtccctcgagacgtgcaagataaacgaccgtttggaccctagatattagggccttcaaaaaacccgtatgtttcactctatgctaatgtgttatggcatatttaaaatctcttcactctacttttaaaatagagattttttatcgtccagcagaatgtaccgagtggtactggtatcggtcggtacggaaattcatccaaccattgaatctgggaagggtaggatcgggagagaaaataagctagggtgcgctcggtcgatgactatccttccacacgcgccacagtctttgttccccacgcgcgtgtgcaccgccgcctccttcatcgcgcctcacccgtggcctactccggcaccagctagtcctcctctactctgccgccaccggagcggcttctcggtcgccgcaaccacatactccgtcgccggctcatccgcctctgcctccactgtcgctgatggtgcggaggccgatcttgcaacactgaaggagaaacacgacagcggcagggcggaagaggaacacggtggcggcgtggaaaagggacatggtggcagctgatcggaagagaaaggcggcgacgcggaagaggaattctagggttcccgtccattcctcccattcattgcacgcgaaattacatttttttcccttccacctctgttctccacgaggtactgcaccaaggacagaattggtacctcgcggtaccaaactctaccagcttttggatcgggccagatccaacggccaggattttggtatcgaccgctgaaccgtaaagatgctctttaaagtaacaacattgtgaatgtgtgttccaagcagtaaggattcctaataagtgcataaaatttttcttatatttggccaggtcgtcacctcaagtagttaggtgagtatttttagcatagctctagcacatcgtcgacattatatataaggtctcactttatatttagcccaggccccagattcttaaagacaacactgtgtagcaattgtatggggtagttatgccttcactaaaagatcgagccacgtgagatagtgtcgtaggatcaagataggtttagtaatatgtcaagtgcactattgttaatgccatattacgagatggatggagtaatttatctatagatgagaatggccttccggcaattctcaattcctggtgcttgaaggttgcgtgtagagtagatttttttttcgggcagtgtagagtagatgttgtcaagttaggaattggctttagctcagattaggagtttggttttgtgatcttgttagtgaaaaacatcatgcaccccctctctctcttagtcctgttagggtggctcaagtgccctcgggggtggttgtgttcctgtcgtgtttctcttccttgtctttcctatgtttttttctcttattctccagggtttctgcgcttgcgtagtttgaagctttgtcttgtgtaaaatcgtttgacgtaatatattcagaaggacattttaccccccgtgacccgcctaaaaaaaacaatcttgcaactatatgcagagctccaaccaaccatcaacgagggcatttatttattattatcgacaaacaagtgcagaggccacacgtgttgattctttcgttattgaagaaaaaccctgcggtcatccgcacaaatcgctccaaattcgaaacgctcatcttggttccagctccgagagcgacaactcattcggcgacgccgccgccgctgctctcgtgttgccgtcgccggtgggctggaacgcgctccgggggtacgctcccgactcgtagagatccgtgtcggcggcgccgtccatctcctgaatggagaacgttggcctcgacggggcctggagggagaccgtgtcgctgctgagcatcacgttcaccgccgacatcgccggcctgtccgccgggttgtcctggacgcagagcagcccgatgttgatcagcttcagcagaacgttcactgcacggctgcctatcgccggatccagcagctcctcgatcgtccccgttgtccagtgctcccatacctacatgcgtaatcaggataaattcttcaggatgatgtctcgattaagaagatggttttcgtgattgatcaggtcatggtgatgatgatgaggagcagagattaatgatgctcacaagactcaagaggtcaatggattgctccgagttggagaagctgctgtttctccttcccgtgacaatctctatgatcagaacaccaaaactgaacgcgtccgacttgactgaatactgcccacgcatggcgtattccggtgccatgtatccactgaaaaataaggagatgatcgttaattatactttcatactaccgtgcgatggaattgcaggtccacttagtacttactatgttccagcgatgtgactggtgacgtcttgcgtctgatcccactcaaacagtttcgctaacccaaagtctgaaatctttgggttgtgatcgaagtccagcagcacgttgcttgctttgaggtctcgatgaactaccctcagttgagagtcttcgtggagatattgcaagcctcgagcgactccgcttacaatattgagcctcttcccccagtcaagatctttgcttttctcataatcttccattcaaacaaagaaatcagcattcgaatctatagtgtagttgtgcgtgcagatttttcatgtaatggaaaaaaaaatgttccattttcgcaaactgttagggcagtgagagaactgaactgtaccgaaaagaatggtgtcgaggctcttatttggcaggtactcgtacaccagtagtttctcgccttcttccaagcaaacaccaacaaggctcacaaggttcttgtgccgaagtttagcaactaaaactagctcagttttcagctcttctatcccctgtctggagctttgtgagagcctttttacagctatttctcgaccttcgggaagaactccctgtgcaagtggatgtatatgtagtattaataatggaattatggatatgtattcatcatgaaatctctattagtgaaaagcgaacctcagaatgcaactagtatgagccacattcatctgattaatattagccgtcagattcacaaagtgacaaaatagataaaataaatgatagccttagatgaaagagggtattttagaattttccgacgctccttcaatgtagcaaagagataggaatagtagacactagagagcaaagaaataaagaaaaagagaaaaaaaagttgaaccacatgctacagcaccgagcttgggcctatgcccagttaattgagttagctgactgactgacgggtgtaaaatttatatgagatttgttttttatggtccataaatgtatatgagatttatttcttatatggttttcttttgaaagataaaatagcactaattgatcccttgtgaaaaggggatattaaacatcccaacatctatctattatattgttaaaatagctttgaaaggaggcaccacgttcgctgtgggagctagaaattcccacattaatcagagaaaaagaaaaaaagaaaaggagagtccaagtagaagtacaatttaaaaatagctgaaattcggaattaaaaataagcaatattgaaaaaagtttccatataagaacccaatatgagattaatcaaaattcgaaataaaaataaaataaaatccaaaataagaaaaggaaaggaaagtccaagtaaaaatacaatttaaaaatagctaaaattcggaattaaaaataagcaatattgaaagaagccaatacgagattaatcaaaattcgaaataaaaataaaataaaataaaatccaaatttagaaaaggaaataagagtccaagtaggagtacaatttaaaaatagctgaaattcgaaattaaaaataaggaatattaaaaagaagagtccatataagaacccaatacgagattaattaaaattcggaataaatataaataaatccgaaattagcaaaagaaaataaaagaagagttcaagaagaaatataatttaaaattagctgaaattcggaattaaaaataagcaatattgaaagaagaatccatataaaaacccaatacgagattaattaaaatttagaataaaaaaataaaataatatccaaaactagaaaactaaaagagagttcaagtagaaatataattttcaaacaactgaaattgaaaataaaaaataaaaacatcgaaagaacacaatacggtattaactaaattttttttaaaaaattctgaaattagaaaaaaaaagattttaattaggaatgcaatttataaataactaaaatttgtgataaaaataaagattattgaaataaaagactatctaaaacacgtgacgagataaattaagtaacatgcctataaagaagtagagtggaggcggttgatacgacatataaaaattgttaataaaacaccaaatagaatcctaatgacgattaaaaggaggaacatcaggtaggccgtgaatcaaacgagtaaggcggttgtcgagacttctataaagtaaaaaaaaaacacattgatcatcatattcgatttttaaaatctcagtgacaataaaaaggagaagcagcgggcagggtgtataagagtatagttgcagagccgccgacggttgacaggacttctagaaaataaaaaaatgaattccaataatagttatgtttgatttttagaatcataatgacaataaagagtaggcagcatacgggctgtagaggggcatagtggcatcgtttgatgggacttctaaaaattataaaaaataaaattacaactccaatttttaaaggttcggaacttctaaaaagtaaaaaaaaccaatgataatcatgttcgattttaaaatctcaaatctcaatgacaataaagaagggaggcagcgggcgagccgtagaggagtacagtggcaaagccgctgatggtttagcaggacttctagaaagtaaaaatgaacccaaacgataattatgttcgatttttaaaatctcaatgacaataaagagaagagacagtggacgggccgtagaggagtataatggcaacgtttgacgggacatctagaaattataaaaatgaaacccaacgtgacaataaactctaaaaactataaaatccaatttttaaaggttccaagaagaatgaatagaaatagtggtatatcaagcaagaaaataaagaaggagaagacatgaggggtagtaactggtgtgacttttaaaaactatataattataaacatgaggatgataaggtttggtctttcaaagtcttaaaacaatgagatagctatttaataaattttaagtaaaatcatactaaaaaaatatatgattttgtttaggtgctagccgcgcaattgcgcgggccacccagctagttaataaaaaaaatcctagatctctgcatcaagtacgaataacaagaaacttatactttatcaatggaaagtaattggacaccactaaattttacgtacacatctctattcatggatgtcatttggaaaattgtacttctcatctacgcagtcagtctacaaaaatatggaatttccaaacgataggtgtgattttggaacaccaaataattccacctcaatgttaaagtggatagatgaagtacataggatcaattatatttgtggacagataaagtacatagtttataatcggacacgtgaaccggccacattacaaatcagaatatacatgttattgttataactacgtttcttgcaaagtatgttctacaaacacttattttagttggttactataaataatattaatatgcttcactaagggatattatggtcgcgtaaatgcatgacttaataagctagtaaaaagatgagcacacgtgcaggtacggttggatagtacaatttgattggtataccttgtaaacgataccgaaccctccttcgccaagcttatttctttcagcgaagttgtctgttgcagcccgtagcgttgataggtccagaaggagcgagtcgatgctctgaatgtcatctgggtttgttgagtctgttgcaagataacaggtgcacaacgactcatatatattgaaactaattagcccgctttgcgataaatttagttttttattcaaagatttgcaatgaatttaggccgagtttagttccaaattttttcttcaaactttcacttttccatcacatcaaaactttcctacacacataaactttcaacttttccgtcacatcgtttcaatttaaatcaaactttcaattttggcgtgaactaaatacacccttagttaaactgaatgccgtgggatgtttaattagtagataatgaacttcaagaaatgaaataattagtttgatctattaagatttccttaaaaaaaggttttacctagtagaggacattccaggctaaccggactaagtaataaaacctaagaattttaactgaaaaaaacacttcaattctcattggattcgaaaaaaaaaacgttctaggacgaaccttacttgtgatgctttaattagattatagataaaatatcctgaagaaggacaacttacatggcactggtgaggccttccttgcaggtgttctccttctccaaaaacaaaagcatgtcaggacaatgagtgctaatattgctccagcaataggcagagtaatggccaagacacgtcctgttctatgtcttgttcttcctgcagacaaatcatgcatgtgagtattaagtaatttctcacgttgattagaggaaatgtaaaaacaatctggatatcatctaggtggaaacgaattataatgacttggattaaaagagtagttacaacttgcttttatttttctgcaacatactactaaatttagaatacaagacaagtacaacttcatatttactcatccatatagcagcatataattttgtaagtacaaattttaaaattggaggtattaataaaattaagtcaaatgcatgtgaatacatgggttatagtattgactagtatctgaaatgagaacttcaacatggaaggagttatggtcatggactactgcaaagtgcaaataactattttgtcacaccattcaaatttccgtgttaaaatatttcaaagaaaatgtttaggtcttataatagggatcattgaatagtttgaaacaagttaccactgattgattttttaagggcatgtttggggaggttatgagagtcagagattcttctagaagctgctattactagaagctgcaccaaaccgtctagattttcactcagacggtaagaagttactttttctcttcttgaaagaaaaatatgagaattgtaagcgatatcactgaatctctacgcacccaaaactgatgccaaaagaaaatggaagcaaaactgcaaacccagaaagggacgctgaactcacctcccatggtccccggtggtgatggtggcgccatgttggccggcgacggcgccggcgccggcggcggccccggcaactgcagcagcggccggccggagaagaacgagtacgactcgaaccggaagttgcaccgcacgccgaagaccctgccgccgggcttcccggcgaaatactggggcacccacctgattatgcggccgaggcagctccggcagtcggcctccgacaagtccggcgtgcactgcgccagcgagaagatcctcgggtacgtcgcgtcgtcgaacccgacctcccccgtgccgaaccgcctgaccgggtccgccgccgcgtagccggccgtggcgttgacgagccggccggaggcggggtccaacgccgccgccctcggcgcgctgacgttgttgtagttccaggc

SEQ ID NO: 36729 - DNA, 3303 bp, Oryza sativa
tgcgcgtcctggaaggcggtggcgacgcaggcggcgcaggaggaggcgttggtgtcgccccggcagagcgcgatggcgtacaccacgtccggcgccgcgccggcggcgcctttggcgaagagggcgcgcgatgaggaggcgttcaccgggagagcgctggcgagggcgcgcacgttggcctggtaggtgctcccctccgtgtagtttccgccggcggtgtcgcacatctgccacggcagcggctgcgcttccgcgagcggcggcgcgtggaggaggaggaggaacgccacgagcagggggactgcggtggcgaggcggctgtcgcagggagtgagatttcgtcggcgtcgcatggccgtcgccaccgtcgtcgccatggtggtctagctcgaggagagagaggtttcggtggccgagggggaaaatacgccaccgtattgccactttgcaagtacgccataaatactcggaagaagaggaaaatatgtggtggaaacgataaatacagtggattaaaaaatggtgaatagctaaagtggtccttcaagtttcatacaatgatcagtttagttcttaatgtttcaatctgtccatattagtccttcaagtttttattttaattcaaacttatccttaaacccacataaccaataactctcatgataaatgacacttatacctcctcattcacatatataagagaaaaattgcatgcaataaattctttttatagataatgcatagcaatatatgtaaaaaaaaataaattatgtacttgcaagtgtatacggtagctattaagctcaagttttatatgcacatgttgaaataatgggacgtatttattcattttggttttttttccggtgtatagatgtatacaaattaagggcaaaagtgacattttctaaaagaattatcgactaaaaatagccatatggtatattaagtgggtacaaggatgattttaagccaaaacaagtacttagaggatctacgtggacaaaataaaacctgaaagactaaattgagctttcggtgaaacttgaaggactaaatggacgtttaagattcatccacgttattatgtgcagtaaaatttttactcattagtaaatctgtgagtaaaatatttagtcgggatgacgtggacgaatatcggacgcccatttttcgatccaacaatagtttctaagtttctactgtctacaaggtttccaccacgtattttcccccaaagaagagtggtggtgggccagggagttactgaccgaaattgtgcgttgaccagacacaattacgttactgcgaagggagacttaaaaggagggtaatttcgtcgattacatttcaatagggtctatttgagtctaccaaatattcattcttgtttaaatcatcctcggatgcaagtgtgactgagatgccggctggccaattctagtagtcagcaacgtcactaataaagtataggaaaattatagtcaaagttatgcaccccttgttcacatatgtaaacacgaggaaacataaatttgaaaacatattgaataaactcccaagctcactatccgattctctattgcctaggaccagaggcgaagccaaaattttctcaaccctaaagcttaattaaagtaatcatcataggttattttttcttttaattttcaaaatttggagtgttattttaatgagtatttagggttaggagtaaagctttatctctaactgccctactcctgttccgccctgtccatggcatttatcaagcgaagtacggcgcataggcatgggttcaaagtcaaactcaatcattttacagttttttcttttaataaattgatttatatataaactttatggtccatttatttctcttattcttgttatccctaatgatatggtttcactaactaaagatgacatattgtattatatagccacgatagtttataatcctgtttcaaataagaaatgtccatcatggactctttcttataatattatttatttctcttatttttcgttggagtgagttgggaactaattccacggagtgacccaatagcatagaattaattaagtattagtattttttttaaaaaaatggattaatatgaaaatatgcgctagtgtgtaaattaaattactcctttcgtcctttctagaggatcatttggtactttggcacctattaaaaaccgaattttgctcctttctatatcagcttcaatggattttatcctatcaaaatattgtagcaatagacaatcgtttggcatgtgtggagatttgctcaaacgttgtaaacaagaacttgtgtcatcttccatccatggcgtttaaaggctgtggtactctgctagtctgctgcataagatggtcgggcaatctctagccaaaaaacaaaacaaaaaaagaagaagaagaaagaaaagaaaagacagagagcatgtcaaccatatctgatgaccattgacaaattattgcctttgatgtagcagctgaaaggacttcagagatgtcaaaatcaaggagataaaaacagagactaatcgctgattactagaaatatttgatgaccaggaactaatcgttggagtatatggctggcgggaccggcggctatgcaaaattcaagatcagaaaataagtaatactagatgccctaggtggacggtcgattttagttgagagctattttggcaatcattcgattcggagatgagtttttccaaggcaatttaaatgttttttctgtcctttttttttctttttcaaggattgtttccgttagagattaattagtatgattcacagaccacatgcgctggttgttttgacgacgttaacttttaatatatctttaaccattcattctattcaatctttcacaaatatgtaagagtgtaaatggtgcttaaaatacgtttaacaaaaaccaagttacaaaaaattaaataataattacatgatttttaataagatgaatggttaaacatatttttagaagtcaatggttttacatgttaaatatcaggatcagtacagtactataaatcgctaaaatacatagaatgattcttagagtggatttaagttgatttttcatattgtaggttgacatctaagctagctatgatgtgtactccgacaatatgctaccggcaacgacattttcttcgtcttcgatcaatcattgaattagggtttacggttagattaattcaaagcaagggagctcatcgctgactctagatatatttctgtcactgtttgattgctcgcatgattcgaaat

SEQ ID NO: 36730 - DNA, 1801 bp, Oryza sativa
acctccaccgtggtacctgtgcgacccctacagcgcgagcgcccgctactcggagaacagcacgttccaggccaacgtcaaccgcctgtccgccaccctccccaggaacacctcctcgtctccggccatgtacgccacgggcgccgccggcgacgtcccggacaaggtgtacggctacgcgctctgccgcggcgacgtcgccgacgcccacgcctgcgagcgctgcgtcgcggccgccctccgcgacgcgccgcgggtgtgcccgctcgtcaaggacgcgctcgtcttccacgacctctgccagctccgctactccaaccgcaacttcctcctcgacgacgactactacgtcgccacgtactcgctccagcgctcctcccgcctcgtgagcgcgccggcgccggcggcggtggcggcgttcgacgcggccgtggccatgctcgccaacgccaccgcggagtacgccgcggcggcgaacacgtcgaggcggtacggcacggcggaggaggagggcgtcgacggcgacggcgacagcggccgccccaggatgtacgcgctggcgcagtgcacgccggacaaggcggcggacgtctgccgggcctgcctcacgacgctgaccaccgtgcagctgcccaagctctacagcggcgggaggacgggaggtggggtgttcggggtgtggtgcaacctccggtacgaggtgttccctttcttctccggccgcccgctgctgcatcttccggcgttcgtggaggcgccgccgccagcgacgtcggcggcggcgaccagaagagaaggtgagcgacagatggaaaccatttttacttgtttgcatgtgtgaaatcgccttagcgcatttgaataaattaatgcaaataattgaacaaaaaggttttgtgtgactccgttgactgcttgtagagttagagatgggagatgcattttcatcatttgggagcacattgcctgttttctgtacgtcaacaaaatagttactcctccactttagagtataagtcggtcttgattttgattaaagtcaaactatgttaagtttgatcaagtttctagaaaaaaaactagtaatattttataacccaagacaaatatattatcaaaatattcaatattaatttaatgaaactaatttggtgttctaaatattactatatttatctataaacttagttaaacgtaaagtgatttcagtcaaaacaacttataagttataatccgaaatggatggagtattattttttctaaaaaaaaagatatagtgccaattagcaatctggctctttgtgcgtttctgtcaagttttattgtcagaatctgtggaaaattccctgaaaaaatacacatgctacttgtaggcaaatggttttctttcattcaggttctggtcatagttctaactacagagatactatctgaatcgaacagtatttatttgcagagaaaaagaggaataagacaggtatagttctagccattgttatgcctacaattgctgcaatgctgctcatcgtcgtagcatacttttgttgttggaggaggagacgaccagaagaacagacgtttctgccctgtaagtcagctaaatttatgatatgttagcatgccaagtaattgataagtttatagacggcagggaaatggtgatttgtttaaatgttatttttatttaatttcatcaccttgattcttaatgtgtcccagcttgtagtgaaatcacatttcccttctttctctctcttttttttcttgaataagtgaaatcatatttcttgttaagcttgca

SEQ ID NO: 36731 - DNA, 542 bp, Oryza sativa
tatttattgacgacataatatatctagccacatttaaagtttggaaaaaagctagcataacaacattgactcaatatgcatctacatgcatggctacaaaacattttagaatgggattattgtcaacatgttcgcacgcatagccgcacatactaggaccccaaccagcaaaatcgttgagcttgcctcggatgtagaaggtggagcatgacctcggcatcgtagagcacgacgagctcgtacgccttcttgaccagaccattcttgtgcttggaaaaggtcacctgtctgttgatcttgttctcgatccgcttcagctccaccctccccgtcacaatgcctacctcatccacaacctcctcaccctcacgctactcctctacaacctagaaacctttctcctgcagctaacatctagctcaatcgattgatctcacgaaacgaagctatggaatgtacctagacagagaaaaaaaaaggtgaggaggaggaagggaagaggagagtagagttttaaataggaaggggggatcggtgcctgt

SEQ ID NO: 36732 - DNA, 474 bp, Oryza sativa
tgtctgcttccgtaacatgcatcttttctatgatcttctggctgcggatgttggtgattcagagtttgctgcaatcgttgaacttcgaagccctgatgaatgtttgaaagctctttcacctcttcgtgcccgggttttcctgaatgctcttcttgattgtgaaataccagtaacaatgagagacgatggtacatatgctttagagcctggttgtgcagaagctagtaccaagaatgatgtaaagtttccagagaggcttatagaaattctgaatgtcctacagcctgcaaagttccattggcaatgggttgagttgaggctgctttggatgagcaatctcttattgagaaaccaaagaatgtgccatatgtaaaagcacttcgatccctatcccctaatgctgagaattttaccctctctgaaagggaaaaggggcttactgaagttattttgtctaggctacttgtcagacct

SEQ ID NO: 36733 - DNA, 9661 bp, Oryza sativa
cctatatacccccctccgtcccgtattattgtcattttagattgtttagcacgtattaaagttaaaaaaaatataatagtaccctttattatttaataaaatatattgttgtatatggaatgatggttgagggtagaaaagagacaaatttaaattagaagtgattgatgggataagtagtactctattgtgaaaactattttaaatcccaaaaagacaactaatttggaacggatggagtatatttatatgaataaaaatgtgaaatggggaatttccagaaaagcaaacttgaaatctaaaattggatacaaatgaaatggtttttatttcagtatagtgaataatattgagggagtctataaataaataaataattaaagagctttcaagagaagtggattaattatttaatgttagtctatatggttattcaacaggtggggatcaattagtcattcccacattcttcatgtttttcttcaatcacaggaacatgttgagcttgaataccaatgcataaaaaacacgggtaaatttatcatgaaaaaaatcattgtacaatattattttttttaaagaaaaatcgtgctacgagagaaagccatagtccaggatgtaccatatctctaagaccgcgtcactactcactacccaaaacaacatattttctttatataaaagaaaatatgtcttatgtgcttgcgtaagctctattgtttgctctttggcttagcagcggcaaccaaaaaatattttttaaaagttgattttgatgtttttatcgtatttatttgtcagcattggtttttaagcaagtaaaaatacatataggaaattttatgtatattttttcgctaataaccgttatgattagatgtaggcaaaacgatgggactgccaatcgcttgatcaagtatcttgtaacgaggtggaggtcgaacaaataatttatattttcttttgaagattttgatgctgttttaatgtagtataattttgcatgatctccaaataaatgcagggtcttgtctatattggtatagcaaatctgctgctttgatttgcagcaataactcgagttggccttttcacatccattccaaaaccaaattcaatgtatgcagtatggcacagctaagcatcctgcagccatccagccaaagggcgtttcagttctcgtttgcatgcaaacaaaaggtcaatacttgtagtgcactggcatgcatacacggtgctagtccaaaaacaaaattcaaatctcccccaattcggggagaaatcaatttgattagcccaattcggcctggattcggagcgttcagagcctggttctcggactgacgtggcggctcatgaaggcccacccaaattggatcactgctaatcgaaatccatattgggccggaggagaattttggaggaacagcccacgttaattgggtcttagcaaaaaggcccaggacaggtggcatcgttgtcgggcccattttagcccatccaaatcgagacacatagattggcccagacatgtaggcccacataagattgatcggcggactggtacggcccatataaaattgcattgtggcccattttggaaatccacgtggcccaataaggtttggcccaccagtggacagcccgccgttactggtgctcgtcgccacaaaactctgcacttctctgacaaatcaagtggtaatcaagtcagcgagatgattctatcagttctcaaaataattttacaagcatttttaggcgcagctacacctacgtagtagttttggtttcttggcaagtaaaccgctttcagtcacaaaattcccgacgaaattcatatatgtaaatgtaaaaaaaaaatgttttttttcaccgggcaatatagatttttttttcaccaggggcaatgtaaatgtgttcttgttccagccagcactaggttcttggaaacagacggcctagaagcagagagcagtgctgaacaaacggcaacatcgacgaacaatgtcaactctgacagagaaaacaagctaagctatgttgaccttgatgatgtcctactgaacaatcgatctccaatcctaccaactaataaacaatctaatcctttttatcgtcttttgcacaatcactcgaactctagggaaaagtgagacgatcaaattaagcaattcgattcataattctctcgagaaagcataaggtcaaaccatttttttttttaaaaaaaacagaacatcctctatcctgtgcattaatggcgggtacgtgcaatgcacgccctctcagtactagtaacatgcattaagcaaaaaaaaacaaagaacaaaatatcaaaattaaaagggcgattaatctatacctaaggtaggcatcgtgacgggcacgtagtgcccacgactccagaatcctgattagtaccctccagatacaattctttaagtatgataagaggatgtgattagttggttaaactaattaaggagattaattagcaaacgtttggacgcctgagctaagcatctgctgctaatattgtattcaggcatgctccccttgatgatggctgtggctgccgtttcatggagctcatgtctctcatgctctgggcaatggctgtctctagccattggagtcattctgacgacgtttttaccccggatttagcatgtcttttctgagttttggctgcacttcttccacatttcaagtttctagatactaatttcatgttgaatctgcttttttttttaaaaaaaaagggggaacaccagtgacattatttctaacgaaaaagggggatacagtataattacatggaatagtgtaattcagattgtagcaactagcaccaagcttgctgcttaaactgaaaactatcacttcaaataggtgcagttaatagcaaactgtaaatgatgctctcagattacgtgtaggtaagaaaatggaagtgtcattaggcttggaaatttatttatttttttaaaaaaaggcttggaaatgactaatgagcatgcagttagtacaatattgtcaagctatcagcatagctaaacatgcttgcacgctggggcctaattaaactaaaattaattaaaagcagaggcacaccggccatgcaaccacgctgctgcgatcccaacaacaattttcgagagcttctatgctgctcgtgcgcagctgcaactttctcccctcaaaagaggcaaccggcctgaacattctgaacgtgcgagagagaagaattccattgcagtgccaatttgtcatttgtttaatctcctaatccaaaagaaaccatcctctgtttagccgtcggtaatctctgcaccgtccattcaaatctcctaatgctaaaaaaaagagttattttgcacgtcacacttctatcctactctgaatctctgaagaatttcaactctgaatttgtaaagttcagagctgcgtgaggttgcacgaaacagtgtattaatggccgtttgtgccgtgcaagatggaaaggtcgatcagagttcttggccattctgcacgcaaagttaaactgtagttagttgctcgtacctaattactgaatgcatcgatgattagtcatgagtgtactgtgacacgctgcactggcaaacaacctggcctgatgagttcatcgtctaatctcaatcatcatctctgctgggactgttagttctgaacctgaacctcgcacgaatgcctgaataatttgagttgcgttgcgtcagcgtcatacattacactaatcctgtcaaatctatcacaattcacaactcatcaggccatgatttgttgctcatcaattaatattgtaaccaacttatcatccaatcattagaatctctgtggtctgattagttcatttcaactggtttggttgaacgtgatgtgaagatgctgtcaaatccctttgtttttaactgaacttccatgtgtactttgtatagtttcagagcaggaatatcagtaaggatcaaatccattaatatcatggttgactctcccctaacatcaagcaattactactactttccaaggtcattaagcaaacataatcttgccatgatttttatacccatgcacttcctttccacgcctaataaaaaataaacaaaaatcagcaatgtctcccaatggcatgatcacttgccatggaccagaaaacacaaaaccatatgcaaaacagcacatcctttgcttaccattgactcctttttccatccaagcctaagcaagagaggaagctgatgcaggaattcttcagaggaaacatgagcttccaattcatggcaagaagatcattggcttgagtgtcttaggaatcaaatcaacatcacaaaaaaaaggtaagaatggccaatcaatccttttcttgtgccatctttggggggtgttctatcctttccatctcctttgcagcagtcaagaatattgcaaaagcagtgcttgttttctttcaatgtttttttctgaatcttggagatgacgacgacgatggcaatgcatgcatgcgtccaattgcacaaaccctgtatgtaaagaaggttcaaaagcaaaagcttctgaaatctttagagcatactggtcctctcaattccatttgcatctgcatctttatctgcatgagatgatttagtttatgacttggtgtcgagtagtactactagtaacctcactatcatctagaaagcagcgagctttgttgctaaacaaacaggggcattttgcaagattttctcaccgctgtcctacataggcacacaaacattggcaaaatgtgtttaaattaagctacagtttcaaatttaaacctaggactaggaggtttgaaatttttttagtgagatgggtttctcttgtttcgatgaacttgtcgtgtccattgcaaagaagaactcgttatatataaagctctctctcttcttgtttcttgcagcgttgagagctcgtcggcatcaatcgatcggcaatggagagtagctcgtcggtgtcggtgtccgacgagagctcggaggcgaacggcggcgggtgctgctcgtcgtcgacgacgccgagcatggacgcggtgaacctgagccggactttctccgacgtgtcgtccttctcggaggagcatggcggcagcggcagcagcgtcgaccacagtggcccgttcgagccgccgtccgccgccgccgtgtcgaggctgatcggccgccgctcgccggctgcggcggcctccgctctcagcctcagccgcctcagcatgaagccccgggccgacgtgctcgaccggcgctccaccgacgacgagctggagctcgtcaaggagaggttctccaagctcctgctcggcgaggacatgtccggcggcggcaagggcgtctgcaccgccgtcgccatctccaacgccatcaccaacctttacggtacgcagcgcgatcgacatgatcgccggcgaacttgttcttgctaatccgtgaccaccatgactaatccgacgagctaatgcagccacggtgttcgggagttgccacaagctggagccattgccggcggggaagaagacgatgtggaggagggagatggactgcctcctctccgtatgcgactacatcgtcgagttctacccctcctcacagactctccccgatggcaccaaagtcgaggtatccatccatgatccatccatggacgattcaatggatttctacttaccaaacgccatggctgattgattgcttgctccatctccattgctgttcatcctgcaggtcatggccaccaggccaagatccgacatctacatcaacctccctgctctggagaagctcgatgccatgctcattgtaagatcccaacaaatttgtcgcaaattaaaaacatgctgaatttgacgaattttggatgagctgaatttcgaatttgtgcaggagatactggagagttttcagaaggcggagttctggtacgcggacgccgggacgaggtcgttcgggtcggcgacgtcgtcgtcgacgatgtcgtcgtcgtcgttccggcggtcgacgcaccggaacgaggacaggtggtggctgccggtgccgtgcgtccccgacggcggcatctccggcaaggcccgcaaggagctccagcagaagcgcgactgcgccacccagatccacaaggccgccgtcgccatcaacaccggcgtcctcggcgacatggaggtccccgactccttcatggccatcctccccaaggtaattaaacaacatcaccaactccaatgcaacagtaacatcaccatttttttccgataatagaagctttatatgatacttcctctgtttcacaatgtaagtcattctaacatttcttacatttatattgatgttgatgaatctagacatatatatttatataaattcattaatatcaatatgaatgtggaaaatgctagaatgacttgtattgtgaaatggaggaagtacattctaacggagcttactcccggcctccgtatgaaatgcacacggccacaaaacaggatctaactagaccctcaacacaaaacaaaaaaattagtgactatcaagccgtagactagatcgccacccatattccagagtaaaaaaactcctatgccacctgatccaaacaacgcgataccaccaacaatagtatttgtcgtcatcatcttcttcttcgtcttgttcatcatcgtgttcttggcagagtgggaaggcgagcgtgggggacggggtgtacagggcgatgctgggggcggagaagttctcgccggagtacctgctggactgcctggacatgtcgtcggagcacgaggcgctggcgatggcggacagggtggaggcggcgatgtacgtgtggcggcgcaaggcgggcgccagccacgggaggtcgcggtggggcgccgtcaaggagctcgtcgccgacgacgaggagcaggacaagaacgtgatgctggcaggccgggcggagagcctcctcctctgcctcaagcacaggttccccggcttgtcccagaccaccctcgacaccagcaagatccagttcaacaaggtaatcaaactaactaatctacaattcatacaaatgcaacagcattagcatccaacattagcattcaactaatcaaagtacgcgaatgcaagaacagcattggctttcaactagtaagagcatgcaaatgtaagaacaaaattggtactcttgattcagctgatcaaagcatataaatggcaagaacagcattggtattcaagtagtaattcagagcatgaaaactcaaggataccattggtattcatgatccagctgatcaaagcatataaaatgcaagaacagcattggcattcaactaattcagagcatgcagatgccagcattggcattctgtgatctatatcttcttttcaaattcaaaatttgatacgttcctgaccaaatgagattggcaaaatttttcatgtaggatattggtcaggcaatcctggagagctactcaagggtgctggaaagcttggctttcaacatcgtatcatggatcgatgatgtcctttttgctgacaagacggtcaggaaacagtgagcgacagccagagcgtctggactctggattgaagcttcccaacaagagctttagatgtttctgttagtgtagctgccaagagaaaaaaaattaaagtaacagtaggtagggtgattttgctgaccttagtgagggaactgtaagctttagcttgcaacaattatgtcttgtatgaccagcagtggttgtatgtatgaagtaatctgctctgtattcctttttgtttcctaacctggcctttctgtcctcttccttattaccaaatcatggtagtactgcacaggtttaagagagtaaaaaaatctgtggttgctaagaacccaggactgactcactgaacatgtatgaaaatacctggacacataaaaaagtttcagtttaaatctagagagcatccaatttaactgaatacgagctaatccgcacttcaaatctagacgcaaactaccattgcatttgcagatttgctgcctccatgatcctactcaattacatttcatatacttgcgtccatcgatggattgtgtctttgtattcaaaatggaaaatccaccgagatgataagttaattgcatagcacgagacaggtaaaaacaggataagatctggttaaacaaatatagctcctcccaagagcgaattgctgacatacaacgatgattctctcaaacttttgctcggctgtatggcatacaactcgaagttcaacccaaatataaacgtggtttataaacattacaacggtgaaaaagtgtgataactaacacaaatactaacttagttcaacttgaaaataataaacataatagataatgcatactactcataataatcactcgaagcaacatggccactctcatacagtgttccatcttctggatgcttaagctcatctccacagaaatagcagtgttgtttgtcaatgggaagacctggaacacctcttggataatgaactctggcgccatagtaaccacctgtaaaagcaacttgtatatgttagtaacattttaaatagaatatcaaagttttgagttctatttttggactaaccaattttttctttcccttcaagagagaccatgcaagtgggtatatatccattgttttcccagcgtacttccgcgaaaaataactcctccgagttcttgcaatcgccctttgcaataaaatttacatgaccatgaaaaccttcgtccagatttccacagctagtgatcgtcctgactaactcatatttgatctatgtttcaacaaaaaaaaacagataccagtaattaggccacaaagatatagtgtgcataatattgcattaagaaaatgaaaatataccaagggccaatttcaaacaaattattcaccagactattgccacgaattatctacttgattataaggataaaatcaaatattttaagaaataaacttaacaaacgcacacaagcttccggtgtacacacaccaactaataaatgttataaaaaattccagaaaaaaatgtatacaagtacttccaatagtagtacacatgtatgaagtctaagcatcaaattatttttagccgtaacaaaaaaaaaagaacatatgacagcttgtaagagtataaatctgccagatttttttcttcttttctctctccatatgatgaatttaaagatgagactttacgcataggtgtaatactattaaataaatgtacatgtacaaaatttgctagaattttttgtggaattttttagttggtgtacacgatccatgcagacaaagttgttttctcaccggcggtacaaggaaaaggactgcgagcgcgaaaagacggaaaaataaaaaactgaaacttgttgctcctatagaggagagaggtggtggaggaacctcccaatctcccaacaggtcctcaaatatgctaagctattctcgataggggggctagctaatttgaggatatgataagtacctcgagctcggacttgaagatagatttacagaatgagctgttggcaactccacctcgacctccataagctgtggtttgtcatcatcaggaagtggaggacttttaacgaataaaagaag

SEQ ID NO: 36734 - DNA, 3765 bp, Oryza sativa
gaagaagaacagaaaggagagctagagggaggaagaaggaaagaaagagggtgatatgtcagtgggtcccacattttggtgtgaatgacagtgtgtcccacacgtatttttttaattttaatacactacgttaacttcacgttaaacaaatcaacacgtcacatagacatcacgttagcgaaactatccttttaaatcaccgaaagaatcaaattacaccggctttaatagttgtggttctaataaattcggtactagtgtttagggacacgaatcagatcggtcaataatttagggagtcagagtggacttattcctttttcttctaacaattccattccaaaaaaagcagtacgtacacaattgggcttctttcttgggcctccaggcgcttccgcagccccagcctatagcacttggatttgtggattcatagtttcgggagtggaaataagtctattttgcttccatcgaccgtaaaaccggatataacccgtctcttttaactcccaaaaccgtctcttcttggcttcccaagaagagctttagatggttctgttagtgtagcttccaagagataaaattaagggataaagtaacagtaggtagagtacagtaggtagagtgattttgctgacctagagagggaactaagctttagcttgcaacaattatgtcttgtatgaccagcagtgcttgtatatggagtactccctccgtttcaaaatgtttgacaccgttgactttttagcacatatttgactgttcgtcttattaaaaaaaatttgtgaaatatgtaaaactatatgtgtacatggaagtatatttaacgatgaatcaaatgatataaaaataataaataattacttcaattttttgaataagacaaatggtcaaacacgtattaaaaagtcaacggcgtcaaacattttaaaacggagggagtatgaagtaatctgctctgtatcaaagcatggtagtactacccaggtttaagagagtgaattctgtggttgctaagaacctaggactgactgactgaacatgaatgaaaatacctggatacataaaaaaaagtttcagtttaaatatagagagcatccaatttaactgaatatgggcgaaactaaaaattaatcaccagtcgtggggataacaacgcaaaagttgatggatcaaatgccttctgcatacaaatttagttgaccacaatgtaaataatgctactagttgattagctacaatgtaacagatacctgatttctagcactttttatgctctttaatctttagtaagccatcagccatccctgcacaagccaaaaacaaaaggaaacaaaaatcttcagtgatagcagttacaataaacatggtaactcacatacatcacaagcgtggatttaaataaaacgctagaaatatcttctcatcactgacataacatgacttgcaatatacacacataacaaaatatctgaaaaacttaaaaaagtagtcatcgatagaaaattgcagataaatttattgatcagagcagccgaaggggcacttttacccaagttctcccggttttgtcctaaacatataatagcaaaaatgtactccttgttgtacttcaaccaacaattaaaaagagtaagatccatgaatacatggcaaaaggaggccaccctgattcatattaccaatggattatgggagacccaaatcttactagtatacaaacacccccaaggagaactccgactaactatataattatctatgtcataaagctaaatttgagctaccttgcaatgcagcctactaagcgcaacccttaagaacaaaggagatagtttcaataaattacatctaggaactatccactccagggttaaactgagtccatcttgattggaaaatgctatagcactcttccacaccatgtttttaaagtacagaagaatgctcgatgcattgcacatatgtatttacaacctacgggtttgcaacaaaattatgagggggaggtgataattgcgccggttagctgtcttcatccagagagccaatgtaagtcaggtcagtcctcctcacccttacagaatccttgagaaagctgcaagctttcagattggcatggtcaccggtaacaccatttgcagaattgctgccactgttggtatttggacagcttgtaccgtcttccagcaaagtccaaggatctatttccatgttaggatcctgtgaaggcaacgctgccttgcatcttcttgagagattggtaggaatccaattgaggggaaattgttggtgaggccctgcagcagatgtactgcactggaatggtgatagtgcacaaaggacagtagaggaggaccacatgttatggagaagaggcgggaagtaggtagaatcggcatagccacttgaatccgccgcctgattgttgctggcaactccatgcgatctaatgcacactgcaatagagcagataatgcaaagaagccatcagaccaagtaaagagaagtcacaggcttgaataattgcagaaagcaaaagagagcaataatatgcaaaaactaaacagacctgcaagctcttagtgacctctttatcaattgcagaaagatcacgcaaaaatttaacagctggcttggagcttggcttagtcttcagccaacttggttggctattgccaagcaaagcttgcaggacacataaaagcctatcgaataggctttcacttggacaatcaagcaggacatcatccatgtaaggttcaagtgaatctgcatcttcatagaccacacgtgttccaaccaagcttaataaggaggaagctagcgtttgcctcatgttactacaaaatatccaaagccaaaaagttagaatatagcataaatatttcaaggacgtaaagtgcaactctgtgaacttaagatgtcacacaactaacaattaaagcaaaagtatcgcaaggaaagattaagataacttatttaagcatgcttaaactcatatttatcacatttctccagctattcatggcaatctagaggagccagaacccactcagctaactaatccagtcaagctcgtaatgcaagtgattcaattctctatctaaagtcgatgacatgattgtcataaccactgaaggcttgatttgcaacaacccactacccaagtactaaccatcctgcttaaatatttattaagttctgttagttgaattccagatgccactcgctgatatctactgataattgaaaagtagccctctattttcataaaggtgttcagattgaagtcccagcaaacagaaaaaaaaaaaactaaatcgctgactgttcgtcccagaccggttttctaatttttaggacaaatcatgtaatgctagaatgtgccacaaaatcattaaatattacctgtctgcaataattactggaagtagcctaatgatgaattgcaggcgcaaccatattgatgatcgtaaagctgatgcggaaggagtagttgaatcattaggtacagggctatgcttcctgatattcggactaccactgaagattcctttgcggccattgggtttactcaaaccttcatttcctgaaggatttgaactattcagtttattaataccgttccacactgctgctttaatatgctcactgatcacacccatatgtttgatcaaatcaccagcaaatacaaagcgaaactcgctagaacttctgtctatgcatggcaaaactaactcagcaagggcttcctgagta

SEQ ID NO: 36735 - DNA, 2709 bp, Oryza sativa
taaaacattttgacggattacttggaacttcatttgcatgatttccactttcatcatgggtctcagaagactgttgactgcggtgagccttaggaggagcaaaagatgctgcaacagctgaagaagcttcaacagcaagagatatttcaaatattctactaaatcgatcacctaaagtttctcttagcaaggccagagagtttatgtggatatccaaaatgtgttgaatcaagtttaatgaattaattgaggtaacacctggattgttaccacctgaaatatccaagtgtttagctattgcatgcccagcattgtcaacaattgcagaaacagcagaagcaactaaagaatgatctccatctggatttgctcctccattttgtctgatacagtctgccaatcccaaaacaatgtcatgagcagtttgatagctatcttccgtttcagaaaaagatgggttctttggtgctgtagcattattttcccttaggttgcgtaaaaactcgtcagtttgccttgcactatctccttcatacttggaagtactcctgctttcccattcaattttttatggacatgcccatcaagttcttcacctgatgaaattccagaaataattgaatcaccagtgattgactttccactatccaattcagcaagcaaccttttatcagatgtggacctaaaatttctttcccacctagcaacactagtcacatctctgtatttccttaaaaaatatcgagcataagcaaaagctactgaagtagactgcctttcacctgacttatgaacagttctattcattgaaacactcaaaacctcgggcaaaagatccattgcaataaggatgttctcatacctgcaatatccaaaagacaaagaaaacaataatgtgaacagcaagattgattttttagaaacaataaaatcattagtacagttataacaaaatttgaacatgcatgtctggttccaactacagttgatccattggatactttgtactacaagatctcacatactcttcagcaaacactaagtttacatctgcagctgttgccactgcagtgtatttgcccatttttcacttcacacaaagaaaaatatgcatgggattgtagtttacacaggtcattgataggactcactaggtcatgatgaagtgatgaactacaagtagatgcaccaagagtgttttccaacaaagcattcaatgacgcaaaacagtccaaacatgattgcttgaaaatcagatgcattgccctcttcaaacaatcaccattaaaccatataaatgctacgtgtatataatgaaaaagaaacgccttaaaatattgcacaacacaaatacagatgtattatagtgtgtttctgtacagccaatgacatacgatgacttgagacacaacttgaaagcaccacaaagtatattggtgaatctgccatcccctcgagttgatgggatcttctaagggtgtgttctatactacatgttcccaacttctactccctcgttttccacgtgcacgctttccaaactactaaataggaaagttgctttaaaaatcatattaatccattgttaaaaaattttatagctaatacttaattaattatgtgctaatgagccgccccattttgcgtgcgcgggggagaagttcccaaccttctctcccttctcttccagacacaccctaaggatgaataaatatttcttttgtgcatgtggcttgccttttttggttggatgttcgcttgctaattctatatattttttccgagaaagatacaatttccaagttaaaaaatttgatatattatttgaaattcattgcagtgcatgggtattttgctagtttggaaagcgtgcacgtggcatttcagtgtctaagaagggccaaacagagaacacaaccgaactatattagtcataaatagtagtggcagaacagagaaaccaatagaaccatagaagccataaaaaaatagaatctgcccagaatattttgtgcaaagatggatgcaaaagtacaaaaccaacaaacagacagagacaacacaagtaacagtttaattggtgttttcacgcgtttcttttttttttttgcactcttttaccatttgcaaattcatgcaaagacaaatttggaaagaaatttcttagttacattataagtgaatttaaaggacgaaagtcaacagtacttcagaagaaaacaatagagaaaaaaaaagcagcttacctgagcaaggatgagaacagaaaagcttcggctacttggaaaacttggttttctttatgttttgggtgcataacacctcttccaacttgaccagatgtggtccttccaatataaatctttgatagaagccatataagcaaccttacagaggagagtaaatcacaacatgtatccattatgtacagcactgacagaagttcatcttctccaaacctccatccagatgcaattttaccactatgctgcacagtggaggcacttatggagttattagccttagaatgtttcacttcatctccttcaattagttgttttatggacttcagcagccagattgaaatggatcttctttcaagcaatctaagtctcttaagtgatttgccaacttcagccagagtcaacatactcatatgatcagcgtctttaagaatgtcagagttagtgccaggtttatggtggggac

SEQ ID NO: 36736 - DNA, 43692 bp, Oryza sativa
atcttcttctgagtctaccaaatctgtttgtcctttcttggttttttttgtttcttctcttcctgattcagccaagagtgtagagtatcccaaattcaacagacctgatatcataagttttacctcttctacttgaactgccactctgccatgattatcatctgttgaatccattagaagatcaggctgtttctgaaggcaggaactcaaagggaccctgccttcaacatttgcatcagtagccagaccacttgaaagctcagaaagcacaagtcgacgctcactagaatatgttgacacaatttcataaaggacttgatcttcagcaatcttagcttcctcaaggatattaaataagcaaaaccctggcaggtgcttcagaattttgtaatgcctcgttttcttttccagatcaaacaagctatcattccaaatggtgattccactaacaattagttgtctcacatatgtctgaggataaaatataccactgcgaataagttcagtcatgaaaacatccacacttttaaatcccgaagcatcactaatctcatgttgatccaaccagcatacaataatgtcatgcagtggacctgggctgctgaagatatcctttttgttattctcatcaatgctacctgtactgtctctaaatccagaagcagtctccattgctgtcaccttgatagaagaatgattcagagtagcacttttaaggtgatccttcattgcaagctgactgctgctcttggaagaagataaattatttatctcattcattttatccttcaacagggaaactgccatatagacctgagagaaatctttgcttcctgaaaattttacattttggcattgtgatgtacggcaatcacggaaagtacatgttgcccactcacaaatgaaaaacacagagcagacaagggataactcaacagctcccatccacatcagagaagatcgcaagcaagggctgacttctttaatccatgtttcttccatcagggtatctgatagataattgaatactgatgtatatgctgctgtcaagtttccagttacaagtgctttgtccaaagcttgcactacgttggctgccccacgaacttgaagattaggattagcaactaaagaaagatcagatgcacgtctttgaactgaacaaatggcataaccacaagagaggtgtcgagatgcattctgtctctagagctagcaattttaccaccacctgctattttcagaagagcacctttaccgtatacatcaggagccacaactgatggaagtggaaagcaatccaaagaaacaaatgtatcgggaacagcaagtatcaagtactgcagtaactcaactaaagcagaggtaatggatgacctttttgggttattcttaacacttaagctgccaggagaagcatcactgagacgttgaatcagtatttccaccagcatgtggatatatgtctgtgagagggttatggtatcaaccaaagaaagtacaataggcaagagtaattctaaaacctcagttgagtctctctcctgaaaggaagtgggttagaaaaaaaattggtattagaagatcaacatagcacttgagaaacatcactaagcatgaacctactttatcaatgcactctgtacctggagctgattaaatacccattcgataagtaacgacggaacaagtaattgttccatgagatgacattgaacaatacgaatcatatacgaccatttaaagtgtagcgaaggctcctcaacatctgcactagcaggtgatgccccggtttttaacttaattgggctgtctccagcaacaaggcatggcaatgactgttcttgagaagatggaagtccaaaaaagccatttttagaacacaattcgtccaaaagcagctgcaagtattcaataacatcctttgtccagtgctgagatcgcaaactatcaggagcagcagatgaaacattattggatgatgtttgaacctgcaattaaagaggcatcatcaagcgaacatcatataattttctaataagcatgaaataacagaactaaattctagtgagcagtggcagtttggcacagaaataacggacctgattaaggtaagtaaccttcacaagccatgatgctcttaacagtgggacattatatcggataagataattaaagagtaacttcctccgaaaaccacgaggaacttgctctgctaatgaccatagacgcctgtttggttgcacaagggcctgcaaaggaatgaattacacagccatttcaagtcaggtggaagattaaggttgcaatgagatccctcgcagatcggcaagacaaaaaaagaaaagactttagagaaaatcgttttctaattatattgcagttagtcttcaattctaccaaaaaaaaagttggtaccaatgtcgccctaaatctgtagtttcttaaatgaaacattaggtgagatggacggcacagtgctcccgtttatacatagtgagtccagtttgaaatgcatcagtttgatacagtatgaaatgtttcaagaactcataatatacagaaagatagctacttaagatgaagggttatttggatggcacactcgccgcacttaattgtagcaaacttgcctcactttattcaataaagtgcataaatgaaatgaaatattacattacaggaaaagaagatgaaaatgacaggctaatttgattgacctcgatccattttctgcgtgtgtcttcattgctatgcatttgctctggatacatcccaggttttgtcagcaacgagccagaaagagggaccccataaacttggccagcctgttaggaaagagtatttggaatattttagaccaatattaactttaaaaagatcaaagttttgcaggaaaaatgtaaatagatgctagctatctagaattaggtggtaaaaatctaattaatgcagttaagtccccatttgtcaaattttcaatacaaacattttgaagttgtgaaatggtttaacaaaaaatatccttatttacagcagagatcctaatcatagtaactacaacaaatcaaaataccttcctcttctgagcacgagattcattgatcgctctgaaccgcttctttagtgccttgataaataaaaataaaattggtagtcaaagtataagttttttcacaagacatatcagttagagaaggaaaacacaataatcgggtaggtcaaagggggaagaaaaatattagattcaatccattcaaccattcagttcaatccatcaaccttagggaaaagaagcaattcttcagcatcttccatatggatctacgtattcacataatattaatcctaagtttctgacagactatgcagccagtaacaatccaaaggtggcaattatccaaaattagcaccaagtaggctgtagagttttggctgttaaccccctgtgatgcatatctcagcttatatataaaagatgtgattcccataattctacccatcttagttcctgatctccagcagcattcaatcatgccgcataccaacctacttctcacttcactctgacaggaagaaatgttctaacaacataagattgcatgaaaaataaagctagttaggttgatgttggttgcctttttacctccttgcattttgtagcaatatctggtttgctcaagtatggaatctgactgagtacaatctctctggcttcctgtaaaaacaccaccaggaacaaatttcagtcaaaacaaaacaaagaaattgcggtcctaatgtacacaaaattatggactcaagattttaatggcatgagactcgtgaaaatgagacaaacaatatatgaaacaagattaaccctagataagcagtgtcacaaaaaagggataggatttgaaacttttggtttctggagcacacctcaattccttcaacggtatccttgtacccagattgcacatattctttggttaaggtctcttctgcacaactcaatgtctggggatagaagtcaggtgcaccaagcctacaaaatccatagtacaaaggaaacactaacttttagttgttttcgaatacaaatatgcaacttctccatgcaaatgaaaaaaaagtaagaatattgaagaatagaaaagctagatatgagaaaatggaaaacatttatgtacatagtcaataagacaataggaacaaatcagttgttgagtaaaacatgcctggcattgagtgattccttgtcacacttcagcttgtaaggagctaccagtggttgccgcctgaaaaatagaatcataagcatattaggaggttcatatgctcatcagtcagcactaagttaatgtcttaacaaacataggtagaaccttagtctgaacaaaatgtagaaaagtcctttgaaaaaaattaaatgtggaagatcatacatttgaaagtgctactcctacaactaatacccccattcttcctgaaagagagaaaataaaaaaggaaagagctaatgttctcctataatttcttgctgagattttaaagcaaaattgatgcaaacagaactattcgacggtgttggcgatagctgtttcctagaatcaatattctagcaattttctcaaaaaaaatattccagcaataaaatattatccatgtgagatgtcacagtacagcattggccatggttacattctcagctggtgcaattgtagtttacccgccactaacaaataatcttcccatcttcagctggaaaataagaagaatacaatcttgtcatccatgccaatctaaatgcatttgaagtccccataagaacaaccatcctataaactacccgtcagttacttggttcaaccatattgcttagcaaggtgcaggagagatgtgccagagtgatgtaacaggatcttgtgtttgttatctttgataatggaacgtggggagttaccctcatggaaaaagcattatctattgatcaataggtataagctgatagttacattatgcaaacaggttttttgtctgttccgtttgccgacctctcaaactgctagtaagaagcctccatcagccagaataaggtaaaaagtactccctccatcccattttgatcatttcctaaagtttttgaagtcttcctaaaatgatcatcatctaacaagtgtctttttgtttatttgtgcaaagagtacatgtgcatcgttgaatgtgttacatgcaaccaaccaagattaatttctattggtgcaatggcatgcaatatttaaaacatgagcaatccacgggacacgaagcgatgaaacactttaatcgatgaggattaatttgagaatgatgaatattttggtgtctttggtcttggtgtcatttacttagaggatgatcaaaatgtgatggagggagtaacaaccataaaaaagagcactgtacagtgaagattgtttgacctactaaagaacaaaatgttttctctttcatttaccataactaacagtgatacgttttcaaatgatatcacaccataaaaattaaaaaggcaatttttatgatattcatctagtttttgaattaaaaaaatgtccatctgattcaaaggacaaatcccactagagtagactgcgactgattttgattgaatttttgttcagaacacaaccatctctagtgccataattttaaaaatggacctgatcagcagacagtgactcatccaagttggacacaagataatcgaagcaagtaagcaactctgaactggtgaaaatacaattcgatgagctagtttcatgatatattgaagcagcggcggattcagggcccagccagcatgggcagctgcccgggctcccagtctttgccgcaatggacttcggtgctgttcctctgctagccaatggcatttgctcccgggcaacaaacggcaccaggcgtcatgcttctatacggtgcagtttgtagttagtatggtgtcctgcacgactatttgagcaccaaagcaggcttttaattgtgcactagtttaagacaggtagaaaaaaatggcaaacaagcagaacatgttattggactcctgatgctgatagattattgtcagaggtcactatctctcttctgctttgttatatttttttaaaactatggataattaatacctaattaaccataccctaatcactcgtctcgttttgcatgtggaccataatctcatcatagatgtcatctcaaacacagcctaagcatgctcaggctcaagaaaatttctggatccaccactgtattgaaggaatcaattggaccgactacttcacaaatcacatcaaagggtttacatgcaacatgggtttcgaaactgggacaatgagcttgaattaactacttattcataccaggaaaattgtgactgtttctaccaaataacaatcaagtatcatttttccatcttttcattaaaccaacagttgagctgttaaactgaccaaacactgaacagtcaataaattcaccaggatgaacactggcaagacttttgaagcaacaacaatggtccaaaagtttgctattgtttttctgaattcctttttatattttgagatgttccttttaacttctgtaagaacaaggttttgtaacagactacatggcagtggccaaagtattactgaataatatacttaaaaaaatatcagtatgaagttcttgtcttcttgatatgagatggctttcttcaggttaggtcatcacgagtaacgacaaatcacagtaaccattgccgtggtcacctactggttgctaacgttgccacattatcgtcacatcatcgtttcttctaccgtaacgagttaataacttcacagcaatcactatcagcaaatatcacagtctacaaagccgaatgcattggaaacaagacaacttgagaggggaagaaaaacagcaaccacctcaagttcgcggggtaattggcaccatggaacgaagaaggctccagcctgcccttctccctccctcctgccaccacccccctgcctggcacgccgccgccaaacccagcattgtgcccagcgcccgtgtacctttgcatcttccctcgcaatcaccacaacactggcccagccatggcgacagagctaacgcaggccatgcctgtcccaactgaactcccatttttattaaaagaaaataaaaacaaattggtattagtaactccaagcatcgaagcaatccgggggaagagaactgcatgtgctgtgtttggaatggagggcgaagaaatcaatccatgtcggattgatctccattccatccacgcccgcctcatggaagcgttgcgggcgaagaggaaggaaggaggaggaggaggaggagaatgaccttgaatccgattcgagccgaggcccgcgccgcgccgcgccgccccctccgaacctgttcgccggcggcgcgcgcgacgaggccgcacagggtggggaggaggcggctagggcgggcgggcgggcggcgcgggcgggaaggagagggcgagccggttttctcgccgtgactccgggcctactcgccggcggcgaaggcggcggcggcggcggagacagagaagggcgggggcgtgtgcctccggcactgccgatcggaaaacgcacaagggagatggagagaggtattggagtggagagaaacaaaaatccaatctctttgaaattgtgataattgattttaaattggtttctttttgggttatttatttgacaaaaaatggcccctttacacgtcttggttttgttttcttgttttctttatttgtttgtattaggtgctttgggctaaaaacaaattagtaaagtataatagttggcgtagagatattgagaaaaatgaagagtctatcacgcaacgagagagaggcccgtttgaattcacatggatctccgtagcacgcacaacaaactagtttcaattcatgtgggtctctatagcacacacaacaatctagatagattggagcaaccgtgttgtaaatagatgtgagaaagtgaaatgcttgttatcaatagataaactaatccaagtttgtggggatctttatagcgtacacaccaaaccaagattatagatctataggaaccaactcaataagaaagtagtaggaagtaagcgaaaagtcaaccgtcaaaacaagaaatcaatactattttggatagatctcaacaccattggaaacaagcttaaagattagcgattgccagggtaaaaataacatggagaaaaggaaaaatccataaaaaaagataaaccaatccaagttcatatgaatcttaacagcatcaataacaaactagatggatcaatgcaacaaacttgagaaattagattaaaagcaaaagcctgtctcctctaagagaaaccaatatgagttcggatagatctccaatctatttcggttcaattacggagtagagggcttgaaaaactataccttttagtcagacatcttggtggaagaggctttgacgatgtaccagaggagagaaagaggaactgatgcgagaaatttgagatgaatagcgaatagaagatggagtgacagtgagagagagagagaggaagatagatacctcaagggaccaaggaggggtgtatttattgttgttgctagtgctaagcatgtattgtcgcctgctatcatatatgttgctctgacgtcatatgcatcgttcacgtttgccatatcctctaccggtgactcatattgacaccctctcatcatgctaagccaagcttctccgtcatcaagcgcaccgttcatgttaaaacatttctaaggttgatgactcaccttgacaatcgtcccattagatatgataagtatgtcatgatggcaactttcacgtggcgcatatgagagtggaattgcatccctcattacacatttgtaatgtgctctctctatatataaaaagagctcaacatcgtcaatttttttatttaaagtgcaacatgctaactcccttttctttcgactttggtaatctaatatatccttatatctttcatctttgctaactccttgtgaatttgttgaatagattacataatgatcaaaataatttgaagtgcccatacttttaatctcttaggacatttttttttgctagggacatttcaaatctctcagactcttactccatccttcctaaaatataacaacttttagccctctgggtttgtcccaaaatataacaacttatccaccaacattctattcccaaccaatcacaaccttccaccattcacttttcccacatacctccattactcattcaatcacaaccctccaccatttaattctacctaatttcttaataaccgtgtctaactataaaacttcatatattctggaatggagggagtaccttgttaactgcagttttttttttaagaaaagaagaagaagaagaaaagcctgttgctgttttgcacaagcacaactgcgaacgcgagaggtccagtgactagtggtttaggcccatcttgcagcagactgaaaataaaataggcccagtagcccatcctcacaagcccataaatatccggcagggctagtggtttaggcccatcttgccgcagaatccgccagctttattaattattaacctcttctccgccattttttcgctccaccattttcgttctcgcgctctcgacgaaccaaccatggcggacaaagtgagaggatcgtgttcgtctcgtcgcccaccgaggagaggagtccgctccagcctccagctgcagaccagccgactaggtgagtggatcgatccccaaaatcccaatgaatccgcgttctcttttcggggtttattcggttggggatgtcgaaaatcggcagcggcatttgggagtagtagctgcggctgccctcgtacgtgccgattggagggagggattggtgtttggagtgaccgatttgccgttcgaatgcgtaaaatttgggtgaattacgcgagagatttgataatttaacactcttttcaatgggtttctattatttgacatcctagcccactttcattcactcagatggtcccatatattatcctcacaaatgtcaattaaagtaattggacaacgaagaaagtgtcaaattatcaattttttcgaattaagcaccgattggtccattttgtaggaataatttgaatcgcttcattttattttattttattttttgctgggttgttgggtttgggggcagtttaaacccaatgcggcatacatggggatctcacggtgtctggaattttgaacaacggatgaactgcgtcctgtgccgactgccgagtgcttgggtggtgtgtagtgaactggttaatcccaagctcccgcctcccggaacttctggattgggtggttttgacagctgagccgcgttgcaactaatgtagtttgcactttcactcacattaggagttggattttggatctacttgttttaccggttggtgtgcatgttggcaattgatttagtagggatgcttatttctcatcctttcagttgcacaaatttagcgcgcaagtgattctgttatttgtgctgtttggatttggcatgctcatgcttcttggaggtttacatgtattttgaagcataattcaaataactgaatgcatgaaaactgtaagcttactgagtgttgttcaggaaaagaaaaaacctcagtggaaatgtatattgtgtgatttgtttagaaagccttttacacatgtacttacaaatacaaacatgtacattgaagtgatctagccctctttgttgacaagcgtatcggggtaaggttcacaaacatgcacacaatggacaagagaaaaattcggactgctgtatgcctgggtgcctagaggcatggctgttacagactggccaatttcatccaaacaaactgaacaagtcagatattcacagcattgtaacttcagctgtcattcacaagaaactgtccactccagtcagacatttggaccagtaaatgtctccccaatcacatgatactttccttgggccgccagaacatagtgcccttgttattcttccgcataaaatgggttattgtcagcatcaaaatcaaaacctctacagttcatctacatactgcctatactcgtcacaaagcaacactgataagggatctgatcagaacttcaaatccacaaatcaaaaaccgcctcatctatcaattcatctaacacaaactcccatatctccacgacaattccttctgtctttgatctaatgtccatccatgcctgaacctccaaatcccttttaattatctgttccaatgtacttgggaaactacacttgagataaccatcaacatatttgtcaacttctgagatgagtttttctcctaccggaggtgtccgtatgtcatgtttgacaaaagataaccaagaagagagtctaaaatatctctcttggatctctgttagtgcttcacagatgcaatcaaacaaaatcttcatatcatctattcggtccccttgattctgtagttcttcgaacatgcaagggctgattaattcatcctctagataccacacctctaaattttgctctgcacataattctgagagctctagcaccagcattatataatctaacctggcattcttatcctcccaaaagacctttacacctgattcattatctgggaagtacagggtcccacaggaaacttcgtgcagctcatctgtatgtcataaaatggtgagtaatacagatactagagtacataatattttttatctgtgcagggaaagaagataaactaatttaaaccattgttcttgcaaacaattgtattaattggacttacattttttcattgttttgcattcaggagagctgtcatcttcatcgaatgaatcaagaaccgatacaggacttggctgttctttcttctcattgctttgctcaggacaaccatctggtaattttggtgatgattttggttcaggtgtttttggatcttgttgctccaaattttcaaccatgctctcaggagagctcatgaacatttgaacaggttcttttccttcagttccttctaatatttcctataaatagaagtatgaacatgtacatcttaaaatacactaacaaaagatggaataaggctaggcattcatttgagcttactggcaaggggctgtctgtgtattgttctgctgggatgcactgtatgttgcaaattgttttggaacaatccaatttgccaactccttcaacaggcacggtgtctacctcatcagtagcatatatgatacctgctcaatattcagagttatttctatttaaagaacaaaagagcactacgcagaccactctgatgataattgtgaatactaaagttaccttcttgggtgtcttctttgatgccacattcttctagaaccgccacctgatcatcaactgctacactagtactatatgcattgctctctgagttatcatgcagttggcttctctcttgggctggttcttctacatcaacagcttttacaagacaaacttctggctcttcaggtgagaaggcattgtggcattttcccctatggtcactcctaggaggtgacacgttgtaatgaggttgagaaagcattccttccaaagattttgatacttgggctgtcggatagctggcagattgactagtgttctttagcatatctgctaaatgcttcttggctttctcatagaagatagatgctcctgttgtatgatcactgatttcactctggctgtcattttgttgcttttgcttactgctggctgaaggtttgattccattcttaaaatttgatgcagctttgtctggcaagctcccttcagtgagatgtctaggatccttatcttcaacgacagaatctttgagctgatgtgaatctcctggaaggttctctgcaggtattgcatttttctctcttttgctgtcaccagtcacaattttgaatctcctcctgacttccttgattgaaaattttgagctttcccttccactgaattctggagcttgcgatgtacatggttgctgatgtaaatatcttgaacttgtagtctctgtctcatcaatccgtcttccttgatttggctttagtataactattttgctaacaggctggggtctattggctctttctggcttttgctttctatctgacctatcctttctccagaagaacacatgcttggtctctttaccctgtgcttttgtagccaactcatgatttgagccccttttctcttcaagaatactagaccgtccaagacttttgtcaggttctaacttggttgttaacctgctattttggtattttcggatattgtctaatatatgtgaatttggcttctgaagcagcttcaggaaaagttcattgtttgaactcagtatttctaccgcatccttgaattctttgaattgagctgccctgctgttagaacgactattctcacccagtagcccttctcccttgctctctggagattgctcattaccatgagtggcatggggattatttaaatcattgagcttgttatggattaaggacttcagtgaaggacacaattcacccttattcttgcaatcaccatgcgggcattcaccatggcacctataaatttcacctaaaaaatttgccaagacagattcaagatcatattcttcagaatgattcaagctcttggaaccctgagaatacactgatcccgataaataagacgcgaagatgtccgtgtgctgatttaaggctgccactggtttatttgtatgctctgagcctccatctagggagacatcatatcccaagtcaggtaatcctctttgaatctcattgcttggaatttttttcaaaagatttactttccccaattcgtcctccataagttttttgactgttcgtttctgtgaagcgcattcttctttgttctgaaaagaagaaaagtaaaatgatgtttaggaaagttgcgactttcagatgcacgcataatccagtatactgaaaacaatgatttggttgtaatacaaactagccattgagttgctttgtaacaagatgctgtccaataccaaattgtgtcagtgttgctattgataacaaagatgattttggtgtttatggttaaaacaacaacagatcatgagacagttacttgcttagttcttgtaacttacatcatcatcatcatctgtttccacaaaatcactggaattcttaactgaatgccttccgtctgaaaaatacagcgtacatcatcagaataatcatccaacagcataaaaattggatagaaaatttatgcgttactcagttgaactatcgtagcaatcaccattgactaattctcgactgtaaatcagatgcactgataggtcttatatgacttcaacaagtgatgcagagaatgaagaaactacgctgcacaggctcctgaattaagtaatgaagccagcaagaataaccaagtacacgcaaacaaaattttgataacattagcattttttttcttgtttttattgaaaagatagtgagcattgggtcaaatgacagcattttttgaagtaatagaaacttgaagcaaaacacgtagctttttccgtactgctataagaaactacaacttcatagcaactatgattactgaagaaattacctgccagctcccggaacgtatgcctcctgctcacttgctttgtatccaataagaattttgcatcacgccggaaataaagcatgcgcatgaggccccacacgcagcctacattgttttcctcttgttcagtggaccgcttgtggcttcgccttcccatttcagataatcagcgttctttctgtagtggaaataacttttcttgtatcttctattgattgttcagttcatcagggagttcaccgctagccggatttcagaaacactgcatgcagatcaagatcagcaaccggacatatattgatggaaaatggcaaatatctctggagaagccaaaacagaagaactgtgctttgttcagcagcataagggagatggctggccatggaaacctgccatccaaggtatcaatgtactgttcttgtttttcttatattaaaaaagctaatcgtttgtacaagctgttaaaccaatccaattaattaaaagaaaacatggtaaggactagggagaacccctgaatgcttgactgaataatcaatacagaaccatggtaaagagaaacctgatgtcaaaaaagaaaaaagaaaccgaaagtttcagttaaatttctgtacaaccaatccaactaatccaaacaattagttgcataatatttcataagtttcccccctttcgcaagcatgggagctcatcaaactccccacttcatggattaaaacagaactccaaactttcaagggttccaaacaaagcagagacaaaacagcctaacagtacaaaaccaacaagaagcacatccaagagcagggcttcatgcaaaacctacctgggaatgcagagatcatgaagagaagctccagcaaccggccctctctttctcccctcctctcctctctctcactcagcaagtcacatacaagaagagccaacagattactcagaacatgttcttgaccatgtgaacaggcgttgggacctgcaaccttgagctgtccatcctttcggcaatccggcgacgacgaaaggaatcggaggcttttcttgcgctgttagctagcctaatccaattcctggtcagtatcaggctatcagctttactctccctctcttcttcttcagtcttctcttccctttgttttccttcgctttgctttgctttgtggaatgagcgcagcacgctagctacggcaccacagcagcccaccacatgccatttctcaagtagaatggactttcggcaagtgcgccaccgctttccagtgcagaaaaagtggcagtagacaatagctgcaagcaagttacaattgctggacctaactctgattaatggctgtgtggttaatccctgtggtaataataatggactaatggtaagtagtagtacaatgaatcctgtgggggcacaccgatgaaaaagattgacaccactaccatggatggaatcgtgtaatactaggcaatagaaatctttcctttgaaaagaaaaataaataaataaattggtttgagataatatcaaagttttaaatctccggctaagcctcttagctgctgaccttctcaacagctaagcacagctatagctggagatagctgcagctaagccatttagctgtttttgcaaataaataaataaataaaagacatgatcttggcataacttcataaccattaccaattgatacataaccagttcaaatgagtacattacaggttcataggagtacattacatcacaagctaagtggttaacagaatactgaaacatcagtttcacaaaagtacaacattctggaataaagacaacagtacaacacaaaggtcatcaagaattctggatagtggatactaaattactaatatgaggcaatattgcaatcttcatttcttctagtcatcaatcatcggtctcagagacatagggagagggagagggtgacttatcagaatcagaagtctgcattggaataccatcatcacaatcttctgagtcggatgatggagcttcaagatgcactggggcattgcgcatcaaagactgtaggcttctgactttcctcttcttagcgtgcacaggccttttccttttagctggtgctgactcttttgcacattgttgatccatttcacttgatgaaggcacaacaccagtaatgaattcattgtcaccatctgccacaacatcatccacttccttctctataggatctctacccttgttctctctcttatttcttaacttggagttaaatttaacaaacaccagatctcgcatcctttcatgaagtagcctgttgcgcttctttgtatgaacctataagccaagtagtgaacacaaagctgcaggtcagatctaaattccataaataagcattataattcaaaatagacagcatgcacataaagctacaggtcacaaatttctttttacctgttcaaaaactgaccagttcctctcacaagctgaggagctgcaggtcaaactcaaaatccttgcagccaacttcctaagatttggtgtgcttgtgccatggttcagccaccattttgttgcataaacattacacaaattacaacaaaaatgatattcagcaataaaattaagttcacatgttgagatctgaacctggattgaaatttttgttctttcgctgccttacggcaatttcgtgtccaaaactcccatgctgatcttgatacaagttgagttcttcaattattttgtcttggatatcttcatcatcaaccaacttatcaatacaggaaatcacacctgctctaaatgatccatcactctcgatctcttgcttatttgggtagtagtagtaggggttcaaatagtacccagccaggtgtagtggagtcttgagcttgttgtcccatcttttatcaatgatatcccaaacttctatgaagcggctcttatcattatcgaatctctgagaaatttctttcttcgcctcaagcattaaaccatggaagaatcccattgatggtacatcgctgtccattcttctcaacacgttagccaatggctcaaagtaattaactgcaatgtcaacatttttccaaaaggtttcagatctgatcactttgctggctttcttccccttggcctgcttcaagtaacccaattgctccatctcatctgatttaaatagtcttactaactctttttttgttgtctaacaagctttttagattcaaataagctgtggcaaatcgtgtaaccccagagcgaaccaagtctctgttaagaaactttctcatcaaatccaacaccctagtatgagcatacaagaaaacagtcacttgtcttgcattagcaatggtttcctcaactggtccaagcttcccaatatcctcgagcatgagatccaagcaatgagcagcacatccattccaaaatattgatggtctttttgctgtcaatagacttgctgcagttgtgttgacgctagcattatcagtcaccacttggacaacatgttgttcccctatctcttctatgtacctgtccacaagttcaaagatatatttgccatctttcctgtcacctgagcattccactgaatctaagaagagtaccccatgagcactatgcacaactaaattcatcactcccctacccttcctatctgtccatgcatctgtcatgatagaacaacctgtgagctcccatgattccttgtgctccttgaatccatccatcaccttttccttccttttctgtaagaacgatccactcatctcatagggactaggccctttcagacttctaccaaattgtccaatggcctctaacatatgagcaaagctaggaagggttactgtgttgtgtggaatactagcttcatagaaccactgacatatgtactcacaagttctattcctcctcttctcttttctgagttgtcaatgctgtttgaaccttattgcttagcttaattactctttgtgtcatactggcagattcttctatagaaggaggcttgtagtacttgtcaatagtatgaccacctgctacagatctagagctactagatcctgttgtctcctttggcttcaccacaagaacattattgccatgatctgaaccttcactgccactttcacaatctgaattttctatgtcaacttcagctctggccacttccttttctttgtttttctgttcctttttactagtcttcttggtaagcaaatcaaacatctcttgctgcactggacttggaactttctgacacttagtagtattgaaacctttaattccagcaagatggtacttaattcttgtaattccagcagtgcagaccttgtcacaatacttgcaccgtaggtgatgtttcttggttatgtctgggcagaaacagtgagcccatgcaggatcatctgagttgataccagcttgttttggtccagcttctactgagacagaggcagcactggacggattacctatacaaaaagcaaacttagcccacattaatgctagcgtcaaagctgcctaagcatcaaaataatgcaaactgatatagcacgtattatcattaccacctaaacaggcgaaacaagcaaacgagagatctcagggagtaagaaaataattcacatatagtaagatctacatcataaggcaagtatctgaaattagaggtaacaaatatggacaacttgttcacatattgtaagatctgcaacatacaagcaaaaaagagaggaggatgtgagaactgaccggattgttgtgccatgccgtcacctttggtgctgctgcttcagtgcttcggagacgttgcactgacggacctcctcgtcggacttgcgccgctgctcagctgccttcaaagccgccgccgctggttggacgcccgctcgaagcagcagccggcgccggtcgcctccacgagccacctgcgttggtcgatccgcttgaagccaccgccgccgccggacgcctttgcgccgccgccgccggccacctccacttttcttgcagctggagagtgagcgcttcgaagttggaatggatagtgtgctgctgggagcttacgagctagggtttgcagcactttacccacctctcgactctggtctagttgggccggtttcctcttgggccagaccggccgtgttttacaatttagctacgctaaattacggccagtttagcggctattgccggctaaatggcgctattagcgtcccgctattcttagcgctaaaaactgcatctcttagctccgtccgttcccagcagctatctccggctatagcggcagctatagccagagatttaaaactttggataatattgacatttttgtttctaaggcccttgctgaggaaaagccaaaaagaggagcgcgtgttacatgtcaaatattgagatggcgattgagtgctactttgctagatgcccaatacgacacagactttaattgcccagcgacaatctgcaggggcgattgatagtttgttacctgtccatccgagagagagatgctatacctcacctccgattttcagagagcactagttttaaggaaaaaaagaacttgcaatatctgtttctgcctacacgttctatacacagtgtagtgttgtgtactctgccttgtgcttaacaatattccagataagtctacaagttaaacaatcaggtaggagtaaaaaagtaacagtatgctaagaaaatatgctcttccaagatcagtttgtttgatatacagctaatttttgcaagatgcattacttatttcagctctcagacaggagttagtggtttagatgggatctatctggtgggccaaatcctgcagttttctatcctcgctttacacctggaatccgattcaaaaggcaacctggaccccacctgtcagcgactcccatccactattccaacagggcttaggttagtgtagggacttaaccctaaataatacagtactcctactacccttgcgttccacggaaggctgctgttgtgacatggatcgtgtgtttgtgaggtgtgatgcaggacacggagacagcggtggcctgacggatcaccggagcctttttgtcatcaccttccctccggtttggttggcctcacgtacgccaccaaaccaaatagtagtaaccaaatccgttaattaattaattattaactcctactttggggaccaaatcagccatcagatttctcctactgaatagtagcaataatatgttagctcaatgcgatgcagtattgaggtgtgtgttggtggtgattttttttctttttgaaacctaagccatctaccgctggttttatattaagagagggaaagactgtactgatgttggtggtgatttgattaagatattactttggttggttgggtggcattgtactgtacctgcaaactactcctacagctacatgagatattccctatctttgccaatcaaagttgggtgtacttaggaaatcaagttgtggccgtccactccaatattgttcttgtaagaaggaatttctttagttcttttgtagagatttcagaccctagatttataatgggtacctccaaaatatttttgttagaagaatcacatcatactacatgaaaatctaggccaggcataatctgtgagcatgtagcagatagtagtagacaacatcatagctgtctgcccttcatcaattgataagtctctctaaattatgaccatctcgtccccatgcaccactcgataaattcttgtcccagaagaaaaggggcttctttgtgtatcattggattcgattgtgagcggggcatcatgcctgcctggatcgaggtttcgactttaaagtatgctgtagcttggctgatcatggaaacacactctggatgagacaacacctttgcaaaactgttttcgacaatctctcattgagtcctgtacagtcatctgccaacttttcttggtacagtatttctttcaggaaaagtgagaattatttgtgttgcttacgatacgctactatttgtccttgggaaattttgatacaaccctgtatgggaggacgatcgagcaaaggaaaaatagtgtaatttttttcctacacaggatttctcttctgcttaacgaatgaatggatgaatgcaattacacatgcttcttgagctcctaaactttacaattctgtgaaaactttatatgaatttcttaagaaatggttttaaatccgttttgaactttataattaactcatttatttgtactgttgaataattatcacaagtcaataagctatttaactatttgcccgtacctcttttctcttcctttcagaagtctaagctacatggctccgaatccaattaaatagcaaaaacttgagcaaattagctatatcaaaaccctcctttcttccaacgtttataatacatgatatcttttgcatgcacaatcctataattccttcattttccccatcatgtggttttcaatcatacagaaaacgataataaaaaaaaaaatacatgcactatcctttttcacgaacatgcaaaaagattgcacgtcaatagaaggaaaatagttgttccacaatgtaattagccagacaggcttttgccaggggaagagagaaaaagcaaaacaaaaattgcagctagaaaaagagaaaaactactactgtggctaaacgtaactccgattagcacgaagggagcagagccatactacattcccaagaaacgccaaaaataacaatgctagctaaaaaccatagatgaccctccgagaggatggacaccataacaactgagaccgaagagagcgcagagtcaaaaaccctgaagttatgttccttccacaactgctaagagaccaggaggaccaaggagtcgaagccggcgcgaatatgctcaggtaagcaggccctagaagatgtacaccagacctgaagccagctgtcaggggggagagagggtaagcctaaccaggaggtgacagcacacagtgccagacctgtcgagcgaacacacagccgaggaggatgtggtttgccatctgaagatcctgattacaaaagaggtaggctgagtggctattgatgccacattgccactatctccaggtacaacaaaactttaagatgatggcactctttgtataatgatcacttctttcttgtgatcaatctgcaaagcaaagaatcgtcgtgctggcttacaacaagtgtcgacaggggctcgtgcatggtggtcacattcagggcgaagcctacacactcctgttaaatctgatgaaccccagcctatgaactcctattaattcatctgttcgttgaatccccctggtcctttctcccctgcctttatgtctcatccgtctttgttaaatgggggccgtgaaacgcaatggcttagacgcatagtcatcaggttcggtaagatcctaataaaacgattgttaaagcaaagcgtagtaccgagtaattataatactgacagtgcttttgtgtgcttagcttgcaatatactatgtgttcatgcagtatggtcgatcgctagctgtcagcactatactatactgaagtgatgcgataccgtaatcttggcgttgagtagagctagcgtctctgtctgtccctgtctttttatcataagtttctgaccggctgcatgtacgcattttgccgagcacaggtcacacaatgacaagagcgtagggtcgtcaacaatgcattaaggcataacgaatataaatcggatcagttgtgagctgtgatctggggtgtgggcccgtgggtggtgtgggttggtgagacagtgagtttctttgttaaatgcctgattcgctgtagtagaaggggagagatgggatggaaggaatatattgactatcagcagcatctactgctactatatgtatggccgatttaaaaaagataccagtcactctgattcttgttataagttgttttaattttttaatcaaattaataatacattttcaatataaaacaaatatattatgaaaatatattcaatgctagatttcatgaaattaatttggtgttttagatgttgataaatttttctataaatttggttagattaaaaaattaaccagaaaaaaggtaaagaaaaacttataatagaaccgcagggagtataatccatagattattacaactaatatctatctgataatatagataaattaagtatttaaaaataaactcaataaataggttagaataattggtctaaacaacacatttgaaacaactttttttagagaaaatatattttgaaaaaatgggctaaataatctacggtaataatccaacaaagtagaataggcctagttgtttgctgaccaattaaggcctcctatggcaatggcaagctcgggatgcgatcacgttgcaatttgatcgatctacttcaatttttcggaggggtccaaatccagggccaagaaggcaagaacatcatcgatatcaaaatcttttgaattaatttctttctttcttttcgtgtgaagacaatcaatgtataaatagcatacgggatcaatgtgtacgtgtacgacgaaacacatctaccatcgtcgtgtttataaattttggagagaaaattgttgcaaacaggcacacaaaactagtataaagcgtcatagtaaagcattgtaccgtggacctagctatgacctgatttgataataacagggaatcgtgacagaacaccttcgctagctagcctcagacagttggacccatatctatttctactttgattgcgtcatatttaagcctttttctacgatctacgctatattagtaaggaaactcatctatttttctattttgataccgtaatagctaggaacagcatgttgagatgaaagagtgtaaatggtgtaattaattcattttctagcaaaagaaagaaatgaccgtggccagccacgttgaggcaccgaaattaccgatccacgggaattagaccgtagactctgtaattcattaatttgagaacaaacaatgattgggaaaaaaatccatgaactatataaatactcctattgtttttcaatagatgacgtcgtggaattttgaacatacctttgaccactccatttgtcttattaattttttttgcgcaaatacataaaatataaatcatacttaaagtagtttttagtcataaaataactcataagaaaataaatgataattacataattctttgaataacatgatgattaaacatgtgtcaaaaatcaacgacatcatgtattagaaatgggtatattactacttaacgttcgtatggttagtttcttcattcatcattttgccggattttccttttttgtctgaataagagcacgcgcagaggctcccaaggaaaaagatgcagcagtgtaggtggagggccggtaagggcatactgggcctcggttgtctaggtattgggcctagctctccggacgattggtgaaactccaacaaaaccgacgaacgaatgtccccaatggcctaatcttttcttagtgtccggagaaggattatttcagcctttttaaaatgtactcccatcatcaaacaagtgttaagcatatttttttctaaaaaaaattgatcatatttgtagtttttatgtactaaattaattgttaatctaaaccctagaagccatcataattcattggttgcatgcatacatatagtttattggttttgttaaatggtggatgagttaattcctccttaattttgatgataaaataaaaggttttatactttttagatgtaagagtactccgtaggtacttcggtagagtgtatcctatcatcattcacgttggacgtggtttaggggtgcgttgtcaaaaacaactttttcatttgaaaacagtgtatatccacttattaatgtagaggctggttttttttatctactagaaaataggcgtgtcatgtgtgcatgataacgcggtcgtccgagtccaacttaataaagcatcgtgcgtgcacaagaacgcaactgagtgcgcttaggacacattttttttctcacccgcatcgctttcccacgcaaaaaccaccatattcagtcaatttatactattattatatttgagcttgctatgatctaaccaagtaatatgtaaaatcattataattgaaatagataattattttacctgggtgcacgcatgagcatttttgccagacatcttaaaactgagtcactggatcactgaaccgatatctatactttctataaagttacagcccactaattctaaatctcaacatgcaaccatgccacatcatcatctattagcatatatatatatatatatatatatatatatatatatatatatatatatatatatatatatatatatatatatataatctcatgtaagcatataacattatctacaatttatttaattccataaatcaatatgcaagcatatccaataaccacactcacatcatttgcacaatattttaacaaatatatctattatttttataatatttaacatatacttcatgataagtactaataaaccctgatgttttactaacaaaatatattgagaattctcgtagcgaagcgtgaggaatcacctagtatcataaaaatgagcgtcaatataaacgtctcgctgtcgaccgtggtccgctctgcagcccttgccaccgccttggtgaggcaggcgccgtcggtcaatgtagcagccagctactcccttcgacctcatagaaaactaagctaatactggatgtgacatatcctaatatttcgaatctgaacataggctgattttttatggaacaaaggcagtacctaatcgatttttgaagttcattcactcatactcctagtggtattaatatctcatatctgtctgttttcaacacatagcacgaccactacgagtagaatcccttaaaaagaaaaacagatggaaaataaaaggcagcgatggtcttgggatgtgaatgtctcatgtgttttttttccctgaaaggctgaaactaccatcaaggaacttgtaataatagatccattacataaaatattcatattcatcatctagacctacgtatggaaagcagacatcactgtggccacccaaatattgagcacaagtgggatgcctaagttccaactcccaaacttggcacccaaaacaatgaactttaaaaaggaaaagaagaagagttattagtacatatttaaaccaacgaaagaaaattatcatgtcatgtgttcacaaaagagagaaacagttgagatccacctcagcaaagaacaatgtaagagtgccatctgaatctttcaccacaaagttgtagtgtgcatatactttcccatgttcatcaaaaagagtatattctttcagttccataatctctaactcggcaggctgaaataaacataatgatattagtccagatatgtaaatcatttccaactcccaacccataaaaaaaattttcaactttgcccaattagcctaggcaaaactaacacttctagaacaagacagatttagaaattttggattgatgatcgaaccaaaatatatcgccattaatttcgtggttccataccggcatatttttttgcttggcatacatgcgtagtggtattttcaacatcttgcattcatcctgtcgtttgcgtttttccaaatcttcaggcaatcgccacttctctgcgaagggcttagcatagcgttcgcaggcagcaataaaagcatcggccagttcctggtcatttttatatggcgatgatcgagtggaatcacgattgtccaggggctgtaatcccacatattctcccccactgcaagtggatataaataaatgtaaacagaagcattcctatagcttgctattctcctacttcaactaaagcatgcagtgaatagattatatttctaatactaggcctgttcatttaactattttgttgttttggtacacaataaaaacttggcttagcttaccaattgaaagatggaattcaagctaaggaggaattggctagttacacatcgagcaaaaaccttaacttttttccttttaggaattcaaggaagcttatggtcctagtttttatcgaggaaatagtagaactactcatatatatcattaaagaagaagcaaacaaaggcagggaaagaaaaatcagatttcagcgaatgccacaaagttctaaaataattatggtttcacatgtttggagcgtgcacagtctttccatctttcagtgttttactctagccactgtggttcaaatccaaatcctgtacaaatatttatgcacgcacagtgcgcgcttcaataagctattgaatattttaatattatggaattttccaagaatctgaatgctagaaagcctagaacgtttgctaagggtatgaaactcgtcagggtgtgtgagttcgcctattccgtgtaacaaacaaaattgggtgcctctttaatctcatcatggaccaggttacagcgagcacagctgcgtagagcctgcaatctttaagctaaaattgaaggaggccacatacctgtcatcatcaatttttgggatagaagtatccgaatcgctgcccggcaccgagttcaaatccatcaagattgcttgttccttcacaaaacgaaaaaaaaaaacccaatcagtaagtgttggcagtctgcaatgcagagatagatatagtccgcggctccgggcgagttggggatcaacaactcgtttggggcgggcaatcgcgttggcgcgaggggatcagcagcagcagcagcggatgtggcggcgagggcgtgcagtgctagggctcggtcgcttacactttggacggagaacggcagggcgaggaggggatcgaatcgggcggaggagtgacggatattttcctcggaagaagtatttatttcagcctcctgcctgattttcccccacatttgagtaggtttccttcaagtgtatccgatcaggattactacaccttttggtaagatacagattttacctttctcggtaagatacagattttatctttagttagcatgttttttcaactactgaacggtacgatttatgtataaattttatatatacagttgttttaaaatatcaaatatatctattgtcaagtttgtaataattaagacttaattaattaatcatatggtaatagacttcccgttttaaacttcggatttgtcttgataggagttgtccgctcattttttttaggtgtttggtagaagttgtccactcatttttttaggtgtttggttgaagcgcaagggtagcatatgatcaccagatagagaacattctatttagatactgaatgggtgcatccggtcgaattggtcggacgaggcacgccagggggtggctcgcccttgtcgctcatacatggtggagagctagtcacatcccgtaggttccagttccaccgctcggaacgaatgccatccccttacattcccgtaattagaattacattcgctctttgcacttgcaacacatggacattttactatgaacttaaaaatacaggtggataaggtcccctactgtgttcatcacatatggcacagtatagcctccataacagaactagtacataatactataacataaatttaacgagtataaaatgaatggaccaagggtgtgttcgcaacccctttttctaacccacctatctcgttttccgcgaacacgtttttcaaactgttaaacgggtgcgttttttgtaaaaagtttctatacgaaagttgcttaaaaaatcaaattaatccatttttgaaaaaaaatagctacagtaatacttaattaatcacgcgttaatggaccgctccgttttccgtggatactgttccggctggcaaccataaatggcgaacacagcccaagtcctgtggagttgcagcccctttatttagaccgtgtttagatccaaagtttttcttcaaacttctaactttttcatcacatcaaaattttcctacacacaaacttccaacttttccgtcacatcgttccaattttaaccaaacttttaattttggcgtaaactaaacacagccttaaatataagcggtctgcagcacagatatcctggatgccttaaatataacatgcaacttcatcatctatatctgagaatataatacagatatccctatggccaccgaaatagtcagcaaaagtgggatgcctaagttccacgccacacttttggcaaccaaagcatttacctgaaaaagggggaaaaggagaaggcattagtgcatgtcttatgaagaaaaaaagaagacgacgaaagagaatataattatcctgccatgttttcacaaaaaagcatagatgctaccattgtcattctcttccaaagggcagcacaggtaaatgccactgtcctctttgcagcagggacatgtctcagcaaagaacaaagtagttgtgccatctgaacatttcaccaaaaagttgtagtgtcggtattctttcctaccttcatgaaaaaaactgcttcctttcaattccacaaattctaactcagcagcctgcaacataaatgagatcagtccagatgtgtaaattgcatttccaacttccaatccacaaacgaacattcaaactttgccaactttcgcctaacacttacaaaataccgctgaattagtaatttatgaggttgactagccaaaatgtatcatcattatttttgtggctccataccggaatattgttttgcttagcataagcgtgcagtgctattttcgcgatcttgacatcacgcttccctttgagtacttccatctctttaggcaacgtgagtggcctcatatggcgtttggatgcagcaacaaaagcatcacgtagtttgttgaattcgtcctcactgcatgtgaaaatatgaaaacataatctaagggtggtgttcttgctgctattaaacaaaatcaggtagtgaatagattatgtttctaacactaggctattcattttgcagatttgttgttttggtccatatattctagcgaaaccttatttgttttctttgcaaataattcaaagggggtcatgaatctctctccctctcttatgaggaaccagtggaagaattcacatgtattattaaaggagaagcaaacaaatagctaaaagaatagaatagctttaagtgaaaaccacaaagctgtatataatagatatactttcgaatgtaaaaatagcttcaagtgaaaagcacaaagctgtataatggatatactcccttggacgcatcctacaaattatttgcatctttctctattgcatatgtttctcccaagcatcatattcataattgttttactccacccaccaatcccggaagcgtgcaatgcaatctttaacctaaaatcgatcgaagtaggccacatacatacctgatatacatcgagatcgatcgagattgctcgttccttcacaaaaggcaaacaaaatcagccctaaactgaaatcgcgcgcagatcgcgagttgggaatcaagagcggagatcgcgaggggatgagcagcagcagcggaggtggtggagggctggaacgaatcgagcggcgccgcgccgaggagttgcgtgtcccccaaactgtttgatatttacctcgtccggaacaagggttatttcagcctcctgactttcccctcatttaagtcggtttcgacttaagattcttgtaataatctgattatcgaatcaaattactataaactagaccttccttttttgaacgctcacgggggaaagactccccacctgaataagattaaccaaaaccaaatactgtacaagagctgaaaacaaagaaaggggcacaggcgccccagaaaaaaaaaaccacaacaggcagcaaaagaagaagaagacccaaaaacgggcacagactaagtttcagcaaatgcagcggaagcgagaaaatagccttccagatggagaccacaaagcaatcgttacttcggaagcggtcagaccaacgacctgcatcctagatacaggcctgagaaggcgatcgatgaactaaggggatcccttggataagctatagtagaataagtcatgagttatttgtttctctggattattaggtttaaaaagctaatgtctataagggcatcaccaatgtttactactttctccgttacccaatgtaagtcattctatcatttcccacattcatatcgatgttaatgaatctagatagatatatatgtttagattcattaacatcgatatgaatgtggaaaatgctaaaatgatttacattgtgaaacggaggaaatacctactttgtgaataatggtaggtcttgtttcagtgggtattagttattgttgtagctacaatattaaatgaacaaaagtgggtggtaagctgggtcccacaaccactagacatgagagagggaggagagaaattatttgtttatttcttatggctaggtagtaagcatattacctggtatttgttgcttactactcccacagtgtatacaaccgggcagtagtagtattttatttcttaccacccactttatatgcacattgtgaatgctctaatgctctcagctattgtggaataggtggaggatgagacggcgacgacctggggaaggagccagggcattggtgggggcttggagaaggattcacgcgcaaggttagggtttgagggaaggatccacgcgctgggtgcgggcttggggaaggattcacacgtgactagggagagagaaagcggatgcacgcgcggccgggggagacgccgaattcgtgcacgactaggaagagagaaagcaaatgcgttgtggccgatctgttgggttcgatgacaatgttgggtaatttgcataaaacttttaagggtagtggggctttagctatccaataatatgaaaaaaaacacattagaggagattaccagattatagtaatatggcttatagtttataattataatctacttgtttgtttcagattataataatcctaagctgaaataaatatgaccttagtataaaccaggatttatagtcagacgtgacgtagagaatgcgtctcgtgggaacgttctatactacctccgtcccataataattttatttctaaaaaattaaaaactgattaacaaccaacataatttaccgcaatagcttttttttttaactatgctgtttgcttttcttcgtatcgaaccagatgctatattgtacatcgttgaatatagcgtccaggtctggacatttggcgtccacacctggatgctctggtactcgcggcaactattagaaatcgacctatgatttatagtactataagttaattaatgagttattaattgttatacaaaagcatacagtgtacatcacaatattgtagcaccgttccagagtagaacctacacagaacataaattacatgccgctttgctaaagcccatccgagaaaacgttcagcaacacaacctttctacttgcgggtgattctgaaactaatctgttataagtaggtacattaatattagtcaatagtcatcaaaacaatactctacatctatatattcagaacagatatccttgtggccacccaaatagtcagcagaagtaggacgcctaagttttatatgctgcactcggcacccaaaacaataaccttatataaaaagaaaaagaaaataagttaatattagtacatatttaattaaacaagatgaatgaaaactacaatttttcacaaaaagagaaatcttatttaccattgtcattctcttccaaaggacagcacaggtagacgtccttctcctctttgcagttgagaaaatccacctcagcaaagaacaaagtacgagtgccatctgaatcattgatcaccagaaagttaaagtgtgcatatactttcccacattcttcaaaaagactcctttctttcactttcataatttctaacttggcaggctgaaacataatgatattagtccagataggtaaattcatttccaacttccaatccacaaacaaatattccaactcttacccagcctaggcaaaactaaaacttatacagatataaaagtacaaattcagaaattcgaggatgtctagccaaaatgtatcatcaatgttattttcgtggatccataccggcatatctttttgcttggcatatgcgtgcagtgctatttccaccatcttgcatgcctcctcttcttgttcaggaaataaaatctcgtatgacgaggggaacacaccgctcttgtaagtagccattaaagtaacatacagtcccgtgtcagatatatatcgactaagtagtctaggagtgggatcatcctctatctgtagtcccgcaaaatcaccttcactgcatgtgaaaagatatgaaagcataatcatccccaaaatgcatgtgaaaatctcatgactcgaatgatatagtgagcatcgattatatttccataaacctttaaggtggttcttgcttctaaaatcaactaagcaggctgtgaatataatatatttctaaggctaggcctattcatttatctaatttgttgttttggaacaccagttaaaaaaatgattggctcaatttcatcttactcacaataattagaccgagactgaattgcttggtgtcaccgaatgcccttccctacctgcgggtcaaattgcatacccgcgctgctccgatagatcaccgggtgcaaaactggggtctgcaccagcctcaacggggaaactaccaccctaagctcaataagactttgactaaccaatatttttatcaccttgcattattgcataggcctcatgtctacaattatctaagttatacttttgaataagcatcagtccctgcgtgaggaaagccttcaatccatgtctatctacagtggcggacgcaggatttattggtcaggtattcactcaaacaattgcaagcatcttgtgcctgatgtttggtggactagggttagaagatttgaagcagttgactaactaagtgttgtgagctaggagtgcaggagtatatttgttgagaaaaaatattagacaatcgagtatatatacatgtaaatacctacatatattaagttcttttgtgaaatttttgggtattcccgattataaagggaatacccactgcttccatcactgtctagctatccctatcttgaaggttaaactccttcggtgtagtagtagtttatcctttggtgtagtagtagagttgtgggtgtatgactccactcactatggttgaaatcctagtgtcaacattgatgcatgtgaggtgggcttcaaataggaattttttgtatagggattttttaggaatttcctggcatccattctgtggaaggtttgttcaggggaagcacttgtcagtctatgtccatctataactaaaaagaaaaaaaatattctagttgcctctctaatttcgtttaaaactgacaagggggtggaggtagatctaataaatctcatctcatcaggaacctatggttacagccttacaggtagcacagaccatagagcatcagattatttaacccaacgacgaattaagattctgggttctaatagggtcgcacaaactatgccgcgagatataaaccttttgtcaacaactttgtttcgccttgcctcgtgttgtaactagctggatgtaattatttctcaattttatactccttctgttttatattataagactttttagcattgttcatgtttatatagatattaatgaatctatatatatatatatatatatgtgggcaatgctagaaaatcttataatatgaaacgaatgaagtaatacaaagatacgcaagccttgtgcgtgttctcgaaacaaaaagaaaaataaaaatggtcgcatacctgaaatcacagtgcttgcgacggcatgatgaatcgagggtcacatacaccgtgactgatcgttccttcacaaaacgcaagcaggtcagtatgtatatatatttacagtccaccgagaagagatatcaatcactccaaggacacattcacacgagaggaagaagagggcgctcacctgaatccgctggcagatcgcgagggcgagggcgagggcgagtcggggatcgacaagagcggtggaggtgacgcggtcgatcaacttggcgacggcgaacacggcgagggaagtagcagcggaggaggcggttgatggccggcggtgagggcgtgtagctagggctccctcggcgtcgtcgtcggggttgccgtcgcttggaatttgggggaatacatagcttccgcctcaacgcgcaacgaacgccgaccgagggaacggcggccggcggccggcgaacggatcaaatcgagcagcggcgagggaaatcggggggagagagaaaggtgtcgatttatttcagcctccggcgagcgtgtccggaatatacgtagtgagctgcgagcgtatccgagattccgatcaggtttcacgccctgattgttactgctccggttaaagttaaactgcttttaaatttggatcaagtttatagaaaaaataataaaatatttataatattagattaattttatcaaataaataattaaatatattttcataataaatttgttgaaaatattattacttttttctgttaaacttcaatcagtttgactttaaccaaaatcaaaacgtcttgtaacataaaacgtagagagtaattacgaaaatactttacctcggacgactggcgcgggggagccggatcgggcgctccccctgcgcaccctccctccgtgttgggcccacccacttctacctcccttttttccacgaaagatattttacctaatgtacttataatgtttcactatttataaatctaatgttgcagtgaattaaaatattattttgcaaaaaaaaactcacatattttggaaactctctattaaaggaatttgatttattttttgttccaccaaaaatgtttcacctattgtactcgtaatatttcactatgtatagatctaatgttgcagtgaacgaaacattccattgcaacaaaaaaacccacatattttaaaaccctctattaaaagaatttggtttatttttttgttccacggaaaaatgtttcactatgtataaatctaatgttgcagtgaactgcaacattctttcgctatttactgaaacattgtttttatataaggtgaaacaacacccgatttaaacgagtgaaacattttcgatctacttagtgaaacaattctgatatacatggtggaacatcttgcaacatttaaaaataatttaataataagcttttttttttgttggaatatatccatgtgtggtcttgttttaaagatttaattgcaatgaatttaatggtgcaatcgaatcatgatttggataagtaatttagaagaaaaatcagtttaaaatagttttatacgtaaatcgggcgctgacgtcagcctgattttactccaaacggatcgatcgcccgagccgtatgctcgtccgagtaattaccaagtcattgataaaataaaaagtcattttttttgtgtgggatatctaaaataaaataatagaatattccttctccctcttcatttccttcccatacctgatatccatcgagattgagattgctcgttccttcacagaaggcaaataaaaaacaaaccgcgcgagggcgagttgaggcggtcgatcgcgtcggcgaggtagtggagcgctggcggtcttacacttgaacggacaacgggcttccgatccctgggaacgacgaccggcggcgaacggatcgaatcgagcggcgccggagaatcaatcgggagcggaggaggacccgttgtctgatattttcctcggaaagaatggattatttcaccctcattacattctcccgtttaagaatgtttccgtcggagtatatccgatcaggattatattcaagcccgatgctccgttcaaaaaaaagcccgacgtggtgtacaagtgcatgggaacgttgtaaacagcgtctatataaaccaaacgagaaaattatcttgccatgtgttcacaaaaaaaggaaaagaacaagagttatcagtacaaatttaaaccaaacgaaagaaaattatcttgccatgtgttcacaaaaaagagaaataaatcttcttatattcgtaccattgtcattcgcttccaaaggacagcacagaaaaacatccttctcctctttgcagttgatatccacctcagcaaagaacaatgtaagagtgccatctgaatctttcaccacaaagttgtagtgtccataaactttcccatgttcacgaaaacgagtatattctttcagctccataatctctaactcagcaggctgaaataaacataatgatatattagtccagatatgtagaacatttccaatttccaacccacaaacaaaatttctaacttcacccagttagcctaggcaaaactaacacttctcgaacaagatagaatttagaaatttgagattgacgatgagccaaaatatatatcgccatcgttttcgtggttccataccggtatatttttttgcttggcatacacgcgtagtgctatcttcaacatcttgcaatgatcctgtcgtctgagtctttccaaatcttcaggcaatcgccacttctctgcaaagggcttagcgtcgcgttggcaggcagcaacaaaagcatctctcatttcctgggcatttttaaatcgcgatggtcgagtgggatcgtaattgtccaagagctgtaatcctggatcttcttccccactgcaagtggaaattaataaatgtgaacatatatacatatgctattcccctacttgaacttaaagcatgcagtgaatagattatatttctaataccacgcctgttcatttaactaatttgtttttttagataatatttaactaatttgttgttttggtacacaataaaaactttagctcaccaattgtaagatggaattcaaggaggaatgggctagttacactacatcgagcaaaaaccttaacttctttttcccttttaggaattcaaggaagcttatggtcctactttttatagaggagatagcataagaactcatatatatctttaaaagaggagcttggcaaccaaaaaaaatcagctgttttcagatcctgcaatcttaggaggccacatacctataattaagtactatttgggtagaagcagcgggcttgcgagaagatgatccggcgaggggagcagcagctgaggtggatggctgggggtgagggcttgctgctgctggagctcggtcgcttgggagatacattatccttaaaccttccgatctccggcaacgacgaccggcggcgcgactgatctccggcaacgacgaccggcggcgccggcgggatcgggattcgggagcggagtgacgatattcagcgggcactgatttttttttccttcccccacctctttttaagaagggttttttttttttttttttttttttttttttttttttttttttttttgggggttgagtccgatcaggattcatgtccgacgtggagtgcaagtgcgtcgctgggaacgttgtccagaacagcgtttgtactccgcccggcggccggacacgctaacggcaatcctaaccggaatcgtagaaaatataaaaacattaaatttttataaacatttatctagattcgtagctacaaatatttatattttgttggggacggaaggatatctaatatatgttagttggtttctcatgtttaaaattaactagcaagatacacatgctttgcaacgggttgaattatatgagtatattcatatgtgttaagaattttgttcttttttgctgtatctggtggcggaaacagcatatgacgaatgttgggttgttcgatttcttttcttgctctcaattagtttctctcatgttccatttccactcttagtgatggaattcaaagaataacggatcctccatttttcccacggttttccgactccactcttagtgattgaattcaaaggataacggatcctccatttttccggcggttttcctccagttcgaatgagccctcattaaggtgaagggatatgtatagatggccacccaaatagtccgcagaagtaggatgcctaactttcacatgctgcactcggcacccaaaacaatatctaaccttaaaaagaaaagggaattaagtattagtacattttaaaaaaatgaaagaaaaacataattgttacaaaaggagtgaaaattctaattatactaccatcgtcattctcttccaaaggacaacacagatatccgaagatgagattgctggttgctgctgggccagtggtggtggggggacatcccctgaccaaagctccgtgcgcgactaggttggctggcgaagttgcagtgtatgctgggcgtagactaggcgaagtggtttgttgacgcccctggtagccacaccaccaacctttaacttgctcctctggcaattgtcgtcagcggaggtgaaactgcttgttgtggcagttggatgctttgaggaagacccgcattcacttgttgaggaagatttggaattgtgcctagaggatcgatgctaggttcaacctagactgtgatgtcgaaacctatgtcgtcaaagcaacacctgggactatagtttggggcggtatcatgtgagcctaccagagagattggacttgggattgaagcatgttcggcataggtgctcgtgcagctacgccgactcttgccgacaaagctactgttgttgctgcatctagtgaagcatctcttgcaacttgactacctcataacctcatactccggccttgggaccaaagcagcttagctcgtagcccgtaggcactcaactttatctcctcttgaggcttgcttgtccgagttcattgccagaggtccctcgagctaggctttggcttaggcttctaaggcatactcgacataatcttcgacagcacccgcatacctctgcagaaccaccctccttcttgtcaatcttctcttcagcggcattgactttggctaggctccccacggacggcgccaattgttgtcgaaagacaaacacttgtcctggtgtacggaacaaaaaaaaacaatagttgtattttttttattgaacgccctttacaatacactacctgagagctatctataggtttacaacaccaaatctaaccctatggtttaccatgtataggcttttacatttttacccctatatgataagggtatctacagggattttttttatgtccttggctcacttgagtctactaggccttagcaggccaggcttaggccgccagataggcgttgtcagcctactccaatgcgtttcaccacagctcagctcgccttcgccttgactcgatcttggtaagagctccacttggcttcaccatgttccatcgtgcttcgcttgcttcgatgggctagtgaaagagcctcctaacctgcctccaataatacgcatggacaaagtccccatacaatcttttttttttgccgggtcggcagaagaaaggcttttttgccgggtcggtggaagaaaggccgatcaaatttcattaagatggaggctatgtacaaatccccatgcagtcatgacaatatcacatactagcaccaatctaagtagaacccacaacaagcatacgtagaacatgaattgactatagctagtacaaaaggaaatggtccagtctggtgaagttccatgcccctttgcttaaattaccttccaaacatcgatatgaacgttcagcgtcacaaccttcctacttgtgagtgatcctgaagccgatgtctttagtaggttcattacataaattcgaaatattcatcatctgtatctatgtacggctcacagatatccttgtggccacccagatagtcagcagaagtgggatgctgaagtgccacgtcccactctcgacatccaaaacaatgaccttaaaaagaaaaaaaaagtattagtacacattttaacaaaatgaaagaataaatacaattattcacaagaaaggaaagataataccattatcattctcttccaaaggacagcacagataaacgtccttctcctctttgcagtttagatccacctcagcaaaaaacaaagtatgagtgccatctgaatctttcaccaagaagttgaagtgtccatatactttgcgacgttccgtaaaaagactcctttctttcagttccatgatttctaactcagcaggctgaaacataatgatattagtccagatacatttccatcttctaatccacaaacaaatattccaactttacccagccaaggcaaaactaacacttctaaaatagggtgtgtttgaggagaaggggattgaggagattgaaaagatacataaaacgaggtgagccattagctcatgattaattgagtcctaactattttaaatttcaaaaatggattaatatgattttttaaagcaacttttctatagaaattttttgcaaaaaacacaccgtttagtagtttgaaaagcgtgagcgcggaaaacgagactcaacctcccctatctccccagaacgaacgatgcaagatttagaaattcaaggttagacagatattcgtggattggtaccagaatatttttttgcttcacatacaagtgcagtggtatttctaacatcttgcactcattctgttctctgagtctttccaaatgttcgggcattggcatcttgtatgcccagggcaagttacaatttttgcaggcagcaataaattcatcctgcagttccttgaaagtatattcatcagatggtccagtgggatcatcccaggtttgtagtcccgcaaaataactcccactgcatgtgaaaagaaatgaaagaatattatcccccatgcataggaaggtttcatagtcaaagatattgtgagcatggaattctatttccgtaaacctgagtgtggttcttgcttctaattcaacaaaagtaggtcgtgaatagaatatatttctaaggctaggcctgagtattttggtatgtcagtcaataaaaaaaatgattggctcagtgtaacaccctgaaaattcgaccgacaaaatcaaaactctaaaaatgcagatattcaaaaaaaaaaacttttcaaactaattgcaacatgccgattttattcgcctattttacctggatttgatctcgaagaatattaatagtgagtaaagaacagttaatcaggaataaaccttaaaaacaaattggtaaaataaatataaattaaaaataaagattaggtgtggatagtaataaataaaatattatcgcgaccataattggatcaattaaatttaattgcgatggaataagaatttaccctaattaaaactcaaataaattatataaaaataaaatatgagtaatattaacctagggtgaattcattagttgagataatacacatattgagtaaacttcgtttatgcaagatttagaaataatagaatcaaattcatataggaaataacctaaaatcgggaataatagggaagtgcactattcattgcccgcaaggtgttcgatgtggtccctagcctttccccttctcccccacctctgccctagccgccccgagcccgcgcgtcgccgccttgcgccgctcgcccgccgcgccgccgtcgccatcgtcgccgtcggcctcgcgccccgtgccgacgcctcgagccccgtgccgctgcctcgcgcctcgcgccgccgctgccacgctgtcgccatcgccgtcgcgccgcgtcgtcccatcgccgcgcgcgtcccatcgtcgctccgagccgcgcgccgccgctgccgagccgttcccatcggcgtcccgctgccgcgccgcgccaa

SEQ ID NO: 36737 - DNA, 9507 bp, Oryza sativa
gccattcccgtgccgctgcgccgccgttcccgtgccgctgcgccgccgttcccgtgccgctgcgccgccgttcccgtgccgctgcgccgccgttcccgtgccgctgcgccgccgttcccgtgccgccgcgccgctgtttccgcgccgccgtgccgttgctccggtgccaccgtgccgccgcttctgtgccgccgtatgccaccgtcgccaccgccgtcgtagccgctgctgccgtcggtgagccgccctccttccccctcgcgcccaccgccgccaccgctcgggtaggagggagagccgagagagagagagagccgagagaaagagaggaagaagaaaagaaaccaagggagggagaagccgaggaagagagaaaggagccgggagggagagaagaaagggaaaaagaaagagaggagagaaagaaaagaaaaggaaaagagagaaaaagagaaaaagaaaagggagaagagaaaagaaaagaaaaaggaaagggagaaaaagaaaaaggaaataaataggaaattagagggagtttggggaagtttagaaaatttaaaataattagaatttaattatagattaattatagtcgtagaattacaaaatttaatataaattatggattattcttagtaatttctataagaaatcaattcgcggtagtaatttagatgtaattaataactaaacaaatagatgaattcttatagattattatagattatttttgggtaatccctataagtaatcgattcacggtagaaattcggatttaatcgctaggaattttagacgtatattatatttaatcgtttagtcatagactaaattaaattgtataatatttctaggatttcgtccaatatttagctcgtaatagaaatttctaacctattatatacaatgctcggggagagtaaattattgacaatgaaataattatacccgcaaagtagtttaaatcgaaattgggtttgccgtagtttgcagatagtaaagttaataaaaaggaatcgactttcgcattcgactttcatttggatttatttggatttttatttgaattctaatcgaattcaaatcaatttttgcacgtaactatagagcccgagggagttgcggatccaagcgaaggccaagacccgcaagactttaagcaaggcaagtcatcactattcgttgaacatgttgatcctaattgcgaaattgtttgtttacaaataaaattgcatgcaatgatgaacgtcctacttgtgattatgccatgccttgattattgtttacccttaaaatccttgtacccatgattacgtatgagtccctagtcaattatgacaactgcttagaaatgctattctaaaatcatgcatactcatatttatcaaatgctatatgcttgggcaattacctttgggaaggtaattgagatgcggcatgtgaagacatgagcgccacattgccatgatgttgatgacatgatttgtgaaaggagaaataaaattaaacaactgttttcgactggggcggacggaggatttgggtggtatctggaaaaggctagtaccgtccccggtcaattaaggaccgagccatgaagttaagcatgaaacgacccccgtacaaccgtacttctcgaatgggtatagacctagcggattagatagccgagcggaggcagtatccctgcatagatggttcacccctgagtgaggcaggtgcgctacgatgggacagccgttgaggtagggccaagaggcgtgccctacatcggtgtcgccattggtaggactgccatgagtgtgtgagagagagaacttaacttgaaccataatttaatatgtgtgtgagacttctctttcccgggagcgccagaactcctctcactgctagaaacatggacgcctagagtgcatgaggatttaagttcatggagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgagacatgtattatacttggctagactctaaattctttaacgtgtgtgggatgggatgttgcatgatgatttttatgctgatggagccacttcctgagaggcgggaaggtggacatcctcagaaaaccatgacgaatcaatggcgggaagctatccttgggatcacaatggatggtggacagaaccgtcgttgtttaaatacaaactctggtactaaaatttgatcggtcaatgctaggtcttaggcttgtgaaaagaattacaaaacttgctttgcgcaaaagaactatggccatcctttgaactcccctttcatatgcattgttgctgtggtggcttgctgagtacggttggtactcatccttgcaaatataaaatttatcagatgcgggagatgaagcctcggaggatccctatgcctattatcaggagagagatgaagacgatggcgtccagtaggtcttagtacgttcgttgcctgtggcaatggcatgccgctgcctaaatcccgctgccttatctatttctgcttttggatgtattccggacctctcggtccgatgatttaagactatgcctgcgggcctatgatgtaataattcgtattagacactcgtgtatgtgcacttgatattccagctatgaattcgtgtgtaccaaactacttgatccagggaaatggtactgattacacgattgattcctgttataaaaacgggggtccacactcagtatactctgatgaacaactcagaagagagggtcaccaggaggaactagcaaaagatttactatattgtttcgataaaagagaaacaaccaaactaaaaaaaagaaagttttcagtgaatagcacaaagttgtattgtaataaataaatatagttttgacatatatggagcttgttcattttcttcgctcttctttctcttgcatatgcctctccgaggcaccccatactattggccgataaaaaaaaaactcaaaatcagtcactatcatcccaatgaagctcaatgagacttgataaaccaatagttatattatcacctaatagcaggggtaatgtccactcttatcgaagctgtgcttctgaataagcatcagtccttttgtggggaaaccatgaaacacaaaatcaatccgcatgtagcctatttccaaggttcagtaaggcacagtagtagagttgtggactttgtgggttgcataactccgtccactacggttcaaatcctagagcctaaatttatgcatgtgaggtgtgcttcaaatagcaaattttcataggaattctgtgatgtacatggaattttcctagcatccttccgtcgaaggttttcaaggaattctcatgtatatttgcatcctccatctatagtaaaaagaaataaaatccatattctagttgcctgtctaatttcgtttgaaaaaggttaaaggcttacagttagcacagagcttttaaccaaaaacgaactaagatgctcgcatatatatacctgaaatcatcatcattttttgtggtaaaagcacctgaatcgtcaccaagcttgtgataggatgatgagtcgaacgtgattgatcgttccttcacaaaaaacacaaacatacatatcactatatcagttataagtatttacagtccgctgagaagagatgccatgccacgcagatggcgaaatccccactcaaacagtaacaatgatcgaggcgctcacctgaaaccgcgcacagatcgcgaaggctagggcgagggcgagttggggatcagcttgatgtgtggcgcggtcgtcgatcaacttggcgagggcgaacacggcgagggaatcggcagcggaggcggtcgagagctggcggcgagggcgtgctagggctccgtcgtcggggttgccgtcgctcggaggttgcggggaatacatagcttccgcctcagcgcgcaaggaacggcgaacggcgggcggcgggcggcgcgaggaggcgtccggcggcggcggaaggcgagccgatcgaagcgagcaacggcgaggggtttaggagctgagggacgatgcgtcgccgtcggatgttctgattgtgtttaaattacggatgtgtagctttaggattcggacagtaagtaccaaaggaaattgggtctttttaacgacaaaattctagatgatcgtggattatgctttccttcttgataataactttatgcaacttcatgacgccaaacgcgttgctacagaaaattgtactatgaatctatattggttaagcttcttgatgacatgccctcaggcacgagcgtatttaaacgatgttaatgagttgtagttatgcgcttgtttggtttagagctaattttgtcatttaccttatcaatattttggtaaatacccaaaccttggaaaattttgccgctactaaggtactactatcaatttgtaactgtgtgatcaaaattagcttccatctaaacaagcactatatattagctccaatgggaagtatcgagccctaacagttgggtgctaatagttttcctccagttttctaaatagggcaataacactataatcctcttcaatagctttcacttgtgcgcttggaatagttggatcatatgacaaaactgaactaatacgagtatagaagttaaaaaaggctcaagtttttatttgactactttctaaagacgaggatgaaaataatcgtttcttagtttaatatgaaaaatagggcataggaagatctgactctatgggagcccaaaaaagaagttaatttagattatctaggatattgtaatcaacatagcaaaatagttttatagttgtcgatatttcagtcaggagagccttccacgtttgatttctcatgcaaaaggcataaagctggatgcatggtgtcgttccttagcaaaactgcttcgcgctataatgcactgccgtctatacatatacagcaggatgtcacaccaacaaaaactacaaaactgaagggtacacatgatcataatcatgtccatcttttgagttttgatgttgatgaacattttattacttcctaactcagttgcacagtccagcctagccaatcttctgcctggcccatctgcaggcttgtcaatgaagtatatagctgctgagacacgacaccaactcctttgttgccagcatattcgaccctgcaacgaaaaatccattgcatagtatgatggaacttggaagaacaaactttctctgacttcggaaattttaccaagacaagtccatcttagtaggagatccaacaaaaaaggttagccacgacttactagccactagtgaataatatacacctttcaattgtttttatatggctttagtggttcctttattcaagcaacatggggtgaagaattggctaggtttcggcccattaggtagttcatatggcttaattggtgatttatttgaggaacaatacataatacgggtgtaaggaaaggaaacaatttaaattttgacttttgactacacatacagcaaacggctgaaatttcaaggaagcaatgttctaaaagtcagcactgggtgccacctaggagcctggtagccgccacaattaggaattagatggtgtattagactgttgaatttcttggatggtgttctgttgctattttagtgttatattgtctaattttcatgtaatatgcttgctaatttcttgaaacaatgcaaggaaggataagagtatcaccttttcccttgataggtaatactacccacaggagacactacgacagcagttcctgtgcagaaaacctcatcagcttcaagcagctcgtctactgacacaagtcgctcctcgaccttcaagaaacaaaaaaacattaatagaagatttcccaaaaaattgagaatagatgtaacaattttcagtaacagattgagaacagtgttttgctgcttctaattggatcgacatcgctaggaaaaataggttctatcttcttcaatgtagccgtagctcatatgaacctaaccatgaatataacccttggtagattgaaatatagataacccattgttaatattcacagcgaacaagaaggatgatatggacaaatagaaacatggacttggatacctagcaaatacacaaggatcaatgttgaatacctaatgctgttgtcaaagatatcaaatcacaggctactaatttgagctacactgaaagtaaaacatcttgcttgttagttcatgggattgatgattaatttacctggaaacccttgctcagagcaacatcaatgatacttttccttgtgatgcctggcaatattgttccttttactgctggagttgaaatgacattgccctggtgcaaaagccaagaaaaataataagggtgtgtttagatggggaactaaacgggccctaaatagatctcaagtcaaaagcagcatgtataagatattccttcaatttgttgactatccttatgcaaaaataagcaataaatgttttgtctgcaatggaaatacaaagtccaccataaactaaaacaaatacaacaatagtttgccattcaggatacgacacagacaacctggctgaacctaataggtgtagaacaaccaattgttagtacgatattatcctatagaatagtcatggcactgtattgctagcgaaccaatacctatgaccatgtgttgtagatatgcctgtggttttcatttaggtaacaattcatagaggtttatgcatggtagaaggtactccctccgttccaaaatataacaacttttagccttcaggatttgtcccaaaatataacaacttatctaccaacattctcttcccaaccaatcacaaccctccaccattcacttttcccacctacctccactactcatccaatcacaaccctccaccactcgctttacctactttcttaataaccgtgtccaaccctaaaacttcttatattctgggacggagggagtagcagttttgagtttgtatgttatgaaattagatcccttgacacattatctccatcatttatagaagtacactaacccacagggtatgcatttacttatggatgttgctagcaactaacacataaaacacatctatattttttgggtactaccatgctatctgttacagattttcaaaagttttgagccagaagcctgttcaatctaagagtatcaaatatctacttcaaagagcgtatgactcatttcatttatttgaaacctctttaatctatatagacataaggacatacatctatcagtaaagaaaacaaagctgatcgttaatacttaatagagtaggttacaaatcttagcatcggttaatttactgtggtagctttcagaactaaaaaggctaatattaactggacctacaggagaaagtgttcgaatcaaactaacaggtattattgacagcataaacacaccttgacaacaaaaatattacatgaagaaacttcttcaagatactttttgtgaacagcatccaagtagagaacatcagaatagcccttttcttttgcaatcttttgtgccatcaagacctatgcaaagacagtatataaattaaagccagtgaaaataataacagaattcaacatagaagatagcagaaaataataatgataagatagcagggagatataagtcgtcatacaaaatagcatttcatttgaagtatatctgatggttcaattatttttcatttcacagcttcataatggcctgtatgttcttaagagaattgcactgacaactctcctttcaaccacatgttcacatcaatagaatgactgttccgtagtttaatatttgcagatctgaactaaaaacattacatcaaaaacatcagaaagagaaatatcaggtagcgaagttgcagaaatagccatgacaataacttccgcatcaaagctgtaagtaatgggtttcaaacttgactgtagaattaccgaggcataatttcctatggtcttcacacttccagttccaccaggggttgcacgatgaaacttatcttcaactatcaaatttattggagctaaaccttcctgaagatatgagtgaataaattaaattaaaaaaaatccatgatacatgagctgtttagaaattctacattcaaccatcagttatcaacaaccaacaaaagtggaaaaaaaatcataaattcataagtcaagttgctgcgaaatatatattcagaaacacggtgtcaagtagaacgcagattataacagtatctaccatagcttttttttttatttatggcaacaacgctgcggctaaaagagggagcagaattaaagaaaaaaacacaaaccttaaagtagttccccacaggggagacaaatataatgaacgtatactcaggagcaggtgcaagaccaagaacagcaccactacccataagtagcggtctaatatataaagaacctttaccggtaggaggcacctggaattaaaaattatttaacaaatgattaaatcaagagtatgaacagcggcctagcccactatgaaatgatttactttttacagtaaacccacccatctcttgtttgctaaaacagtctgctttactgcatccacaaactgctcaacactaggcgcaggcatgcacattctttctgcacctgttctcattctcagtgcattttcctccgggcgaaataataagatagagtcactgttgttctatatgcttttagaccttcaaacaatccctgtaaataattataatcttttaggacgaaaagtatttaaaaaggctcaattttccttatcttcagttaccacaatgtactcaggatatatgaagcaaggagatctacctccaatacaaacctatccgtaattaaggactccagaagatgggttcagcgctataggtccaaatggaatcatttcaccctcagaaaaattcccgtcctgtccgcattttgtgatatacatgtagtcggtctgcacgattccaaaaccaaggttctcccaatcaaaatcagctacctcagatgccttcctgaaaatatgcaagagttgccatcagaattattcctgaaatgaccaacacatcgtcacaatttgacaggcaggtcccctgcctggagggatacagttcaacgaatcatgcagcttatggtaagaatcacacacgtgtagtcacttgctagagaagcctcgcatcttctcacgcctcgagcctttagtggaagcgacgacatcgaataaagtcgattctgaatctgcagcagcgagaaaacaccagtatcaaatacagtattttaataaaaaacgaacataaaaaaaaacagcatggacttcatcaatttaatctccacaagcacttcacaaatcccacctacaacaacatat

SEQ ID NO: 36738 - DNA, 5018 bp, Oryza sativa
ccccgctctctcgccggggtatagggtttctgcggctactgcggcggcggcggcgcgggagagcagcggaaacggagacgacgatgatggccaaatcggacgggaatggcacgggggccaaatggggaagcggctttactcacagaaccttctagccattgtagccgatgtgagaccgactggtggggcccatgctgtgtgggccccacttggcagtggctgggctcgggatcccgcgggtgtgcacgggggtgtctggaattctggatgaggagcgcccggtaatcgagcaaccaaaatatagttttttatccacatggttttctggcaggtggggcccgcgcaccttcacactcaatggtgttcgtggctgccgccgtgcggtactgcggtgggtattgaaaagggcaaaaaaaaaagtggtggctcgaagaataggccgacttggctttggctagctctctttcgccacgtcggaaggcaattttattttgttttttcttggtaggatttctttctctttttttaaaggtttactcctctattacaaaatatagatatttttagcataatagtttattccaaaatagaactatttttccgtttgcttctcttatcaaccaatcacaaccattttcgatttaattatcatattcgcttcatcttcacaattaatcataacttttctctaatcatttctatcaactttcttaatacttgtatccattttagaaatggcaacaatttatgacagatgtggtagtggttctgctcttattgacctgttacctcactctcaacatcgttatatattcaattttagcggcataactgttaaagtcacataaaaaatatatatatatatatatatatataagaacataatatgatacgaaagacaatcagacaaatattataatttgatagtaaaaaataatgcattgggggtgttcaatctttgctaccagctgcaattgccaccgtgagttaatactgaataccctcattgcatgactactaatgttgtggttgtcctcctttgtctaatgtgtgatatcgatctatgtgcaagttgacacaaacatcacaatgtgtaatgctctatcaaccaaacaggtataagagaagcgtatgctaattaccggaagaatacttgctttgtctgtagacataagttgaagtattgtggagcacgattgcttaaattctaaaacattcaaccgcagaaaaatgacattgctagcttgcaacatatgtttttttccacagcagctttggattgatttattttcagctagggtgcccattcagctatttgatgctctctttttcgcgaacgcgtaaaaaaattgtatgtcaatatattagaagaagcatagatttttaaaatacacgacacaaacggccgaaggacattgtcagggaacaggagaaaaacggattttcttgggttttcttgccacatgctctatcaacatatgttcttttgcacagcagtgtttggattgaattgtttttagctattggattaaattgttttcagctatttgatgctctccttttcacgaaagaaaaaaggattatacgtcaatatattagaagaagcagagtttttttttaaaaatacacgacgcaacggtcgaatgccattgtcagggggaacaggagaaaaaaaaaggcttttctccaggggcatcgcgcaaaagaacaaatttgatgctctcctactctatcacaatataaggcaatcttcttgccttctttttatttattttttcaaactcacataatcatgtctcttctggtatccgatagagatctctctctagtccaagtcaagtgttgtccttttattttttttttaaatcattgtcctttaaaattttagctacttattaatcagcatgcacagacctagatcagtcccggctccctggtattggatccgaccgatcgagtgatgtgctctcatccatccatagccatattatccctgcaattgtttattttcattgccaaatgaaccttaagtgataaaacttttttttgtttgtgtcaatcgcattgtttattggttaattctctgaaagtgataaaagggcattttatttgtgtaacctaatgaaatactagtttttgacatgcatattgtgtttctcgtgactgcaagaatatgaacatgtcactagtttaaggtgtgtttgaaagatagagaataaaaaagaataaaaggatatgcaaaacaaggtgtgtcattagcgtatgattaatcgagtattaatcattttaaacctaaaaatatattaattttatttttaaaataacttttctataattatttaaaaaacgcacacaccgcttagtagtttagaaagcgtgcgcacgataaaggaggatatttttttccgaatatgcttgaaacaaccaaggattgttgacatgtgtcgacgggtgatacccgtagaccggatataaagggtattggggtacgttggtacaaggatctacgtagtacgacatcgaacaatcaaaagacaagaattatactggttcaggccccttggtaggtaatagccataatccagttgatatgtgattatatggtggaaaacacaggttacaaagggaacgatggaacttgttggattcggcgagatcatagtcgagtggattcgactagctctcgatgacttggctcctcgcagacttcggctttgtaggctgtgtgggttgtgttggctctgagattcgatgatctatgccctccctaggggggtcccttttatatcatagatctggaggtctccaagtaggactcggagatatcagacccaatacgatacgtcgacgacccagttctgtccgagaaggactcttcccatctgtagatttcgtgaaaggtttccttaggatatgtagaaaacatccgcgtgtgtgtgggtatgccatgtcgatatgtaacgtatattgaagggtagagggtatgcctgacccgtaaccctgacagtagcccccgacttctgcttaaaatgaactcgtgcaaccatttatgacttcgggtgtcgagaacgttgtcattcttggcgcgaggaccgcggagatagaacgtagtcgagcatgccgtttgaagcccaacggtcacgagtgaattttgaactgaagtccagaaaactaccgcgcgtaacgggcccagagatttccggcggggatctctctccgttccttggaattcgcaccgttggtagtgtgcttatttaaaggaattttgggagctcattttgaagtctgccaaccttgttgaacacacaccacctgccagcgctccttgccttctccgccgccgcaagaaaccctagttcgccaactcaggcttgttttccggcgatcttggaacaacaatggatctcggtaagtcgtcttccaccagcgcgacgttgaagaacctttaggaggacggcgcccttcccggccgtggagacatggagagagaagtaggaggtactgatcctcagcccctcttaggtcgcatggttgtgatcgaagattacgttctctgcggttttcttcctccaccttccgagtttcttctcctggtgttgaatttctatggtctttctcttctccatttgaatcctaattccatcgcctttcttagtatctttgttcatctctgtgaggcctacattggggtagagccttttctcgatctcttccgtttctactatgaactgcgttggatggaatccaatagggtgtctggttgcgtcgggttccgacttcgtgatggcatgaagtcgcgttatatccccttccagtgtccttcttcccgcagtaagtggcggaacaggtggttctatcttgagatcaaggactcgaaccctgtcttcgttgttcccgaggatcaaccggacaagattccggcctggaccgccaagccccctttgagcccctctcttcagtcgtttatcgacatcatcgatgatctccgagaacagggcttgtcgggatatgaagtcgctgcagacttcgtcggtaggcggatccagccgctccaggctcgggcccatccagcctataactatttcgggtcggatgacgcgacccgggtttctcctcggggtatctttctcgtattcatcttggcgtgcttgtagtcgcgttcctcttgacttatcaaaagttggtttccgtttaacaggtctaagcagcgaagctatggagcggcgcgtcggtcaagtgatgatcagcggtccgaccacggctagcgacatccccgtgcccctttgtgaaaagggggcggcggaacgcgatgaagccatcaacgtaagtgtatttgataagcatctcgtattctcctttcgaaatcaccttatgacctgattaagcgtaggcccttcctttgactgacatcatcgggccgctcgcggaccatcaggtggcgacatctctaaaggagaaggttgtcaaggaggcatctgatgcggccaccactagcggtggcaaagtcccgaccaaggcgaggaaattctcgtctgtactcggacattgccgcaaggcagcgacccccctcggtatcatcttgtcgtcagatcgtgcagcaaggagggtttcttcttactctgtattgattgtctttcaggcttcagacgcgtcccctccacctccacgacgacagcgcattgtaacgatcggcgagaagtaagtaaatagattcttggattctcgtgcttttcgttcaaatggtgtttgattcgtggttgtccgtagggaggcgcgggcgaaggctgcacgggccaagtccgggggagcttctagcgcatcacctgccacggcctcgacagatgtcgtgcccatgaccgggagccgggaggcgacgcctagtggccccatcaacaatcccgctgcgggtcgtggtctgccagcggccgttctcacctgggaggagctccaagtcgagatggggcgtcttctcgaagctggtgctcgcggcatcggcagcgagatctcggaggcgaggt

SEQ ID NO: 36739 - DNA, 19767 bp, Oryza sativa
  unsure (1)..(19767): unsure at all n locations
gtcgagatggggcgtcttctcgaagctggtgctcgcggcatcggcagcgagatctcggaggcgaggtcggaagcggcgacggcgaatgcgcgtgctgagagattggtgcgcgagctagctgaagcccgtgaggacctcacgaagatgagggagttggtggccggcaacgagcatcaacggaaggggctcgaggactgaatgtcggaactcgggaacaatctctccgagatccatggctcgttgcgggtcacctacactggcctccatcagctcgccgaggagtgcggcgtcaagtccacgatcccggcgaatcccgacgagtttttgctgacttcctctcttgcggaactggcgacggcgatggggaaaatcccctccaagcatgcggccaggatcgcggaggagacgtcgaacggcatctacaccggagcgtgtcacgtcctcgcgtgtgtaagattgtcgcgtcctgaactcgatctgcgcgagatcttggatcagggggcggcaagcgacacgcgtaaggaggtgatggaagaagtcagtgatctgggggagtctgttctgcccctttttgaagagtaggacttcttgtatttgttatatattgtgtaaatcttgaactctggccgccttcgttcgtgcgattaccacccttgtccaattttgtatgttgatctcgggagtttttgtccattatagagatgttgatgatgaggatgtccagcagcgcgggcagcctgagtcactggcgatgattccggtactcgattttgaaccacatgtttcgtctgacaatgtggatcaaactcttgatgcgaaggccgggatggcaacggccacctcaagtgagtagccttttcacctcttagtgacctcttgattaggttatttatgttgtaaaggaggtatccaacttgtcttagtggtcatcacatttagcagatctcgagggtgcccttgcaaatcaagatcgtcgtatccaatactggaagacgaaatttgaagtggcggaacttgagagaaccatgctggccgtgaagaaagagcaagttgtggagacgctccgaggtcgcgaggtgtggttcaactcttacttgagaagttgctgtgcctccatggccagagtatgcagggaactccgagtagtccgcgatgatccagaggagtcggcgcctgggtacatctcttggctaacacggggcctgtgcccaacttgatggcatcggcaagcatatcgacgaggccttgaagcaagagtgtcgtcgagtgagccgatacgccggagtgcacatgctggcttgcctacgagatcaccgcccgcgcttggacctcgagtttctccgccatggttttgctcgttctcggagaactccggcggagatagaccatctggcgaggtcgatgtcgccgctggccgagaagatcttccagtctatggactagcgttggccttcttggtagtactcatgccctgtcacagatatcttagggaaagatgtaatgtagtggaaaatttatgtaaaaactgtaagaattattttgtgaataaagaaatattccttaaacaaatgtatcttactctagatgtcgtgtgtaagagtgtgttctcagttaatgactttggtcagccgtttgagtcgtacactctccctagcccccagccttgtcgtcggaggaattttctcggaggataaggctcttggaccattgacctgccttggttgaataagctctgatcctagcccccagccgtgagtttggaaaattgatttccgatttcacggcttggttaatacgcacggtgagaactcttacacgaccagatcttacatggtcttttgtctctacaggatctgacaaggccttatcggctctgggcatccccagccgaagatcccttaggttcctcggaggccttgtcgagacggcgtaaagggacataaggacaggtttcaacgctaggtgtcatcagagtaagggatcatcgggtgaaaacactttgattgtgatatgggacctagaaataggctttattgatactataagggtacttacaggtacagtggtattgactcatacatagaatttacgtagttggtcaatgttccaagaatttgctaattcgcgaccatcaccgtctgcgattttgaatgcgcctggccgcaagacttgtgtgattgtgtaaggtccttcccattttggtgagagtttgttttgccctgcttgggtttgaactcgtcggaggacatagtcgccgatcgaaagtatgcgtgctcggatgcgcttctcgtgataacggcggagggactgttgatagctggctgctcggacggcaactcgctcatgatgctcctcgagaagatttacatcgatgtctcactgttcctcctggttctcgttggaatacttctgtactcgtgtactctgatgtcgtagctcgccggggagcatggcctcggagccgtacacgaggaagaagggtgtttccttattggacgttgtcggtgtggtgcgtacggcccatagtactgatgggagttcttcaacccactttttgtcttgtgacatgagcctgtcgtagacgcgggttttcatcccttgtagtactatgtcgtttgccctttcgacttattcgttgctttgagggtgagagaccgaggcgaaacatattttgactcccaacccgatgcagtaatcttggaagtcggtgctgatgaattgggagccgttgtcggttatgatgcggtgcagtagtccgtatctgcagaatatccctctgatgaatttgatggcgttgtcggccttgatttcccccgtgggcactgcttctatccatttggtgaatttgtcgatcgccacgaataggaatctgtagccgccctgtcctcgtggggatggcccaagtatatctagcccccagcacgagaacggccaagtcagagggatagtctggagcgcttgcgcgggtagctttgtgtgtttactgtggaattgacaggcttcacatcgctggaccatgtcgaatgcatctttaagggcggttggccagaaaaagacttgtcgaaaagctttgccgaccaatgtccgaccggcggcgtgtgacccacatatgccttcatgtatgtcgaggaggaggtgtctgtcgtcgtcagtagagacgcatttgagaagtaccccgtttagcgcttttttgtataaatcgttaccgaccatacagtagatctttgctttacgggttattttctcggcctctgtatcgtcctcgggcaactcctcgctgctgatgaatttgattaatgggatgcgccagtcgtctgtggtttcgatgtcagcaacggcgcgttctgcctcggtgacctccgagctgatgtcgggggtgttcgggctaacttcgccgctaacttctttcaccgatggcttcgtcaggatatcgagaaaggtgccgggttcgagtggttctcgtctggctcgacgttgtccttgcgatagacgtgtcggacctcgatcccatcgaacctcttctctagcttcctgacttctacgagatacttggataactcggggttagagcatttatagtctttgtgcacctggttcgcgactagctcggagtcccctttgacgattagtcgcttggcgccaagtgcggctgcagctcgtatcctggcgagtagtccttcgtattctgcagtgttattggtcgccctgaagttgaggtggattgcgtgcttgaattgatctccggaaggagacgtcaagataaatcctgcccctgctccttggctgttgagtgcgccatcgaacgccattgtccatgtttcgttgtcgccttggttgtctgatttgttgtccggcatagtccaatcggcaacgaagtcggcgagtacctgggatttgatggctattcgcggcagaaagtggacatcaaattggcttagctcgactacccatttcgcaatgcggccgacaacgtctttgtttctcacaacttctccaagggggaaggaggatacaactgtgactctgtgagcttgaaagtagtggcgcagcttccttgatgtcatgatgactgcgtaaagcattttttggatatgtgggtatcttgtctttgcgtcatggagagcttcgctgatgtaataaactggtcgctgtactttctctctctcgacaacaatgacagtgctaacggaatatggcgtggcggcaatatagaggaataattcttcattaggttggggagcaacaagtacaggggggtttgataggtagcgcttgagtgcaataaatgcctctttggctttctgtgtccatataaatttgtcttgtttcttcaatagagcgaaggttgtgctcgttctcccatcctagcgacgaatctgcttagtgcttccatgcatccagttagcttttgtacctccttgagtctcgtgggcgacttcatgttctcgattgctttgatcttctcgggatttgcctctattcctctgccagagacaaggaatccgagtagcttgcccgacggtactccgaacgtgcacttctcaggattgagcatgaggcgatatcgtcggaggttgtcgaacatttcccgcagatcgtcaatcaatgagtcgcttgtcttggttttgacaacgatgttgtcaacgtaagcctcaacattgttgccaagctggttgctaagtgcgccctggaccgtgcgctggaaagtattcccgacggttatcagtccgaacggcatcttaacatagcaaaataccccgaacggcatgatgaatgctgtcttctcttcgtcctctattgccatgctgatttggtggtagccaaagtaagcgtcgaggaagctcaatagcttgcaaccggctgttgaatccaccaattgatctattcgagggagaggaaagtgatccttgggacacgccttgttgaggtcggtgaagtcgacacacattctccattttccattggccttccgcaccatgactggattggctagccactctggatgaagtacttctctgatgaagccagctttgagaagtttgtcgagctcttctcgtatggcttgtttccggtctggtgcaaatctccgcagtctttgctttactgacttggcatcgggtcgcaccattagtttgtgctcaatcacctccctagggacccccggcatgtcggacggttgccaaacgaacatgcaggcattatcgcggaggaaggtgatgagcgcgagttcctatttctcgtttagtgtcgccccgatcttgacagtcttgtcgggattggcactggagagtggaacgatcttgatggcgccgtccggcttcggcgtcttatttgtcttgctcactttcttgggtggctcagttgtggcgggtgggctgggcgtttgctcgactatgtcgaggctccgcttgtcgcactgcactgccagctttgtgttcccctgaatagtgattgttcccttcggtcccggcatcttgagcacttgatacgcgtagtgagatatggccatgaacttcgcaagtgcagttctcccgatgatggcgttgtaagctgtatcaaattcaacgacatcgaaggtgatctgctctgttcggaagttgttggcttggccgaaagtcacaggcaacgtaatcttgccaaaaggtctggatgatgattggggagtaattccatggaagggttgatcagttggtgtcaactcactttgcggaattcccattgcgtctagagtactagcgaaaagaagattgatcgagctgccaccgtcgatgagaactcgcgctactttgatgttccgaataatgggttcgaccacgatcggatatcgtcctgggataacggcggtcttggggtggtcttctttcgagaactctattttctgcttagaccacttcatcttgggtgcagccccccgccatgtcgaacagacttcacgttccactttcttgtattctcacttggaggagtacgttgtggagccgccgaaaatgtgtgagatgtggaggtcggagtctggatacgcataatccgattcgtgaggagccgtctcttcgttcttctcgacaatgcgtactcgcttgcctttttcaaacgccatgtgcttctcgagcgactttttgaaaacaaggcaatcttccagagaatgtctgtccgtcttgtgtatggggcaccaagatttctttgtgtcgctgccttgtgggtctgggcgcttgggagggttcgcgtattctgctgcgaggacttccgcttgagctttccttttcccatttttgcgatttttcttcttgcttgactcagatgcgtctgtggctgatttcttctctcccccggtcttcggcttgtcgttcttgcgtcttagcgcatcgtccacatgggcacatcgctcaacgatctcgaataacctccgagtggttgtgatgcgtcttgtcgccaattcctgggtagtgtagcgatctctgacaccggatttgaaggcgcggattacagaagcgtcggtgatttcaggaattgtgtttctgcattcgttgaagcgtcgaacatattccctcaatgattcacctgagttctgtgtcaacgcgtgtaggttgtcttcgatcgcgtggcgcttgtacgttccttggaaattggcaacgaattgttgccacaggtctgcccacgaagagattgagtagggaggaagatgcatcagccatgaacgtgcagaacccttcaacgcggttgataaatagttcgctagcgcgttgtcgtctgctccggcagcatagagtactgtggagtagacttgaaggaattcttctgggttggtgctcccatcatacttttcaattgctccgggtcggaatctctcaggccatcggacatcacgtagggaacgaccgaaagccctgcacccagcgttgggggcggtgggttgtcagcggtcgtgtgtccttcgtggatgtctgtctgacgatgaggaggacgcagatgatgatgatgacgatgggtcacttggttccggcgtacgattacgagtatgacggcctggatctcgggaatcctatcgttgtctctcgctgttgtctcggcgccgatctccattattgtcgtcgttacggcggcggccatgaccagtattgtctggcccccgtcattcgcgatcgttgcgattgcggtggttgtcgtgatcccggtcctcgtttgagcggtctcctcgatttccgttatcatggcgccgtgaagagacatgacgccgagagcgatttacattgtctcgtgtgcgtcgtgcttctcggcggccgttgatttgatctcggagatcgccagcgccgcgaggtggaggagtggctcgttgaggtgattccctccgttccggatcttcaccattggcgtcgctagttggcggctgatcttggtgcgctgcggtagcgacttcttcaaacgcgttgctaaggttggtcaccgattcccgtagtcgttctgtcaacgctcgaggtcatcattcagaacgggatcgtaaggagtttcccttagtaaggcttgaacggccctgatgtgttgggctggagtagtcgattgattcgccgcttctgcgttggcttgcgttgacgtgccaacgtcatcgatagccaatacctcctgcggcacgctcattgtcgatgacccatagtcttcgagaagatgtaagaccggtggttcatgaggatcgatatcgattacctcaacgaatcgatctgaggctggagtcgctccttgttccttgccgttatccctgacggggacgtatgactcaggagacggagctttcatggcgccgaggaagactttgtagctcgagaggttgtgattctttgtcttgtgaataggacaatagacatcccgagttggagaagtacgctgaattccacgttctttgcatgcgcgaatttcagcatggacgttgaggaaaacccagcaatcttgcagggtgtgtttcttggttttgtggataggacaccaagaccttgtggcttcggaagtcatctttgccggctcgtggttcatgtcagaagggcaaggtttggccgtatcagaatccttcccgagcttggatgtcgtcgatgatccgttctccgtttcgacaggtggatttttcgacatgaagtcgccttggtttgtagccactgcgttctcgtttccggtcattggaggaccggttgagatcagcgtcgtggtgtaaaacgggaagacgatttcgccgacttgagtccataccagcattgttgaagcagggagcgcttggctgaggctggtgttgacgttgttgtcgacgaagctggatgacatagtagtagaaccttgagtaccaaatccccctacctggcgcgccactgtcgacgggtgatacccgtagaccggatataaagggtattggggtacgttggtacaaggatctacgtagtacgacatcgaacaatcaaaatacaagaattatactggttcaggccccttggtaggtaatagccctaatccagttgatatgggattatatggtggaaaacacaggttacaaagggaacgatggaacttgtcggatccggcgagatcgtagtcgagtggattcgactagctctcgatgacttggctcctcgcagacttcggctttgtaggctgtgtgcgttgtgttggctctgagattcgatgatctatgccctccccgggggggtcccttttatatcacagatctggaggtctccaagtaggactcggagatatcagacccaatacgatacgtcgacgacctagttctgtccgagaaggactcttcccatcagtagatttcgtgaaaggtttccttaggatatgtagaaaacatccgcgtgcgcgtgggtatgccatgtcgatatgtaacgtatatcgaagggtagagggtatgcctgacccataaccctgacaacatgtcctttgttttagactagggcagtgttttgccacttaggacaagtgactttgagtcctagttaattagtgtctactaggtgtcattgtcaatctgtgtttgcacaacttctgctaaatatgttggtttttatgatgtgtagaacttgagatatcttatatcttgttgtatgcattgcatgtcactagttaaactcagttttaccaagaagaagcttcattctctagtgcatattgctggcttgatttagttgtgtcgacgttgttcaggtggtctcaactctcaacctttttcttggtttatgctttccatgccctgaacagtaagtagtaacataaatcatcagccaccaattaactgaaaaaagctttgttgttcactcgaaaaaaatatggcaaaaagggatcagccacgtgcccaggaagtgagtgttgccccgtcattgtcgccagaaagcgaagaaaagcaaagcaaatctaatcgtttctcttcactccaaaaatagcaaagcaaacacatccgtctctctctctctctctctctcccctactactatctcctcctgcccttccaatttatgttacaaacaaatcgttggttcctcttttttcttcagtttgtttcagtgcaactcagttcttggaaagaaaggttggatttttactctgaacaaagcgaaaggtaaaaccatctcttttgtaatgcagcaatttatgtatattttggcgtcctttcagttattttgtttgatcaggtgtggcaatgggcggcagcggaacgctgatctccatttaccctgaggatctcactttcctatgtaagttcagaggacttcttgagattatctaatgttgttaacatttacggatggttagccttaacccacttgtgtgggttcttcactccattaaattctcgtgtgtagttgagctggataagcggtgctattgcaatctcaaggtggtgaacaacagcgagcatcatgctgcattcaaggtccatggccttccatttcatgaccaatattttctaaaacttggcgagaaggcttgatgaaagtttgtttcatgtcaagacgacattaccgaggaagtattttgtccggccgaacacgagcattgtccagccatgggattcttgcacaataacaagtaaatagtaccttcgccgcataataagttaatctaatacgagatgtgacatatcccagtacttgtccaaattcatagtactagtatatatcacatcttgtattagattaatttattctgggacggagggaatacatgttcctaatttggccattttatggtatgccaagccatggctctcttcaggctccttgtttggtcttgatatttggatatctgcattgttcttgggtgatgtagttacgctccaggcacataaatagtgcccaccaaatatgcaatgcaaggataaattcttgatccagagcaccaagctagtagctaccagtactgacatggatgagattccccccaatactgtgagcataaaatgcaaatagatgatttgcaagctttattagtgatgcattattgttacaatgacatgactactgacccaccaactatatgccatttttgtatcggtccagttcaacaaggaagtcgataaggtgattgaggaaatgaagcttaaggttgtttatacagttcccagtggaagttttgatgattctagtattacatcttgtcgaaactagatttcggcaataataaaagggggtggctatcaagctggaaaagtgtatgggtttggagacaaaggatttatacaggttcaggccttcttattgaagaagtaataccctactcctgtccggggatgaatccgccgaatgtcttattgattatatgatttggagaaaatcaacatctgccgctagaggcacccggaccccccttatatatgggaagaagtccgtgttacaaaagataatctatatccctaacggaatatgcagatacagataaaatacagtcgtagccgactaagtctcaaggtatttccttgatgtacaagttgagaaacaaacccgagacacaaataagatattctatctatatttggtatcctgtattcagtccaaataccatcgccgtgtagatatgggatatccataatctccacagtagcccccacgacctttgcagtcaaccatcatagccttctcaaagataatgatccgagtgcttcaaacatttcatgccaagatctgccgagtagcgaagacaaagactgtaaagggcgaaaagataaagaatatggtgcatcgaatagatgcacctaattaggtgtagcccccaactatgtgattagttaacaaactaaacatatagttgagaacaaaataatagcacaatcatgcatcatatgacaaaagcatacgcgacgcccaaagaggcattctagccgactgctttttagccataataaaaagaatccgagtggttaacactctaaaaggttcacgaatgaacacacttgacgggcatccgaatagaaaattctaagattacccaccaaaaattataaaaattatggtaatgaataagtctaatagcctaggctatgactatttaccataatgagaacaggcatataacataccaaagaaacgactatggtaaaaaacaagtcattccaagttaacccagacagcttttgtagcctaaaaaagcttacaaaaacagcataacacctttctgtcgggcaccttttaatttgcattgcaataattccaaagaattatatgaccacgtaaaaaggattttatcagcattgggcaacactattatgcgcatagattgccaaagcaaaaaatgcctaagtccctaaggagcacaatgggccacgctgtcaaaaatactgggctgaggtactgttcaggcctaagcccatttgcacctccgatacccttaacaagaaatcccgagatccaagcgtcacttcgtcttccccgccggaactctcgccattttccccactccctgctacagtacagagctgcgccggcaaactagggttcaccattccactcgaatccaccttcaaaaagttcatcaaaatccttcccgtgatccgccgcctcaatccctcacctctccctagccatccctcgaatcaaatcagcgcattcgggtaaaatcgatggcggaagagaaagaaagctttgaaggccaatgggcgccatccgacgtgacggaggagaacctgaaggagatggtggcgcacggcgttcttcctgccaaggagatcatcgggtggcggccagcgtgcggtgaggcttttccgtcccccgatacacacgaggttgtggtcttctctcatttcttctatggcggcttcgctcttccgacctcgaaatttttccgcgggatattaagcttctatggaatcagcttgcatcacctaaacccgaattccatagtccacatcgccaatttcgtccatgtttgtgaagccttcttgggaattaaaccccacttcgctctgtttcgccgaatcttctttctcaaaccccaaccgaacaagagtaagccatgtgtagtcggaggggccggatttcagctgagaggaactctgagccagaagtacttctcaatgcccatcaagacttcaaacaaagggtggcatgcgaactggttttatattcagaatcctgagcccgctcttcctgagtactcttgtcttcctccggtgtaccaagatacctggaactctcttcctattggggatgaagcagcccaagccttggaattgatggatcgcatgctaaaactcaaagaacaaggcttacaaggagagcagattactcggcacttcatcaaatgccgattggcaccaattaaagaaagatcccgtacggcattcgagtttgacggcaagcatgatcctaatcgtgaagaaccagactctctggattttaaaatcatgaaggagagaatgtataaaatcttctcaaatgctattgtcgtcagctactcacatcagctgccagttgtgccatataatgcattcaattcgcctccgcaggtatgtatctgaaaccttcaacccatgaccaaaacataatcttgtcttcatgttgagttaactaaccatggaggcatctcattcaggaatatgtattgatgaaatctgaccccccaattactcagcgccggtctcctcgccagcacaccgttaagggaggtggagggccgacaatcagatcggactcgcaacctcaaacctccaatccgactgggcaaacaggttctcgcaagagaaagctgatgcttaacgatgacgaaggcgacgacggcaacaaatctgggaacaaaagcctacccaataaactcccaaagcataccactcccaggaaaaaactggctggccgtccaacgccaaagatcagaacatcttccaggcataaacctcttggtaccatttcgctccggtatgcttctctcatgaaaataatactgaatattgaaaggacactttgcaggaaaccatccgacatagatccaactggaaaagatcctgatccggttgtgacagagccaagttcatccaaggattctgagccgactgccgagaaccagccgactggcgctcatacttcaggtgatacagccgatccgagtgaccagcctccgactggagaccagtcggcagcaactgaaactacaacaacccaagagcccccgactggaaaccagtcggacgtaggtccagaccaagaaattcccgaagttgaagcgcagacgacgacttctcaaggaccagaggctggtaacgacgctatgattgggtcttcaaataaagaacaagaatcgcctcacgctcagctaggaacatcctcgggtaactcatcttctcaagtgatgccgatttgaataactccagcttattcgtctaatatcttggaaatacatcaggaccaccaggcgatgacgaagaagaaatccctcgcataaaggcggctgacgactctcgtcctcctatcttgctcaaatggtgggacgagaactcacaagctgccggcatcgtcataaatcgtcaaaaagaagatgaggaagtgtgccagctgaagaaggcacttggagaagccactcgcattgtgaatgtaaatcctctgggtgactgcctttgatgactttgttttctctttagcagaactaaaccatgaaccatcatgcagagaatccatcttcgcaatgaggccaagacagcaactttagaaaagctggttcctcatttgggaactcttgaagcagtcagggaccagctacacgaggccaaggagcttgccaaaaagacagagaaggaattaagggaccgaattgcccagctccaggattcaaacttcgagctgagtggttcatcaaaaggtaatcttctagatctgtcccattaatttatgttgtcataactgtatcctcaaacatttggatttcaaacagcgcaagccaccaggatggctcagatggagaaacaaattgaagtcttgaaaagagacaaagtagaattggctgcgcaaagggactcggccttgaaggaggttgaaggtaccgccagctgacaatctgaacttctctctttttaaggcagtagattttgatcataaacgtgttttgtagaccgcaaaatcaaatctcaagctcaatttgacgtcctggttggtaagatcaaaaagcttgaaggagcaagagatgaagtcgctaatgtcgctacaccacttgtccaagctatgttcctcaataacagtggtccgagtgcactcgacgcaaccgaaatcttcgacaagctgagagttgctccagatgtatatttcaagaatatcaagaaagctggaagtatgggagctagcatggcattggcgatgaccaaatccttgtacccaaggattgaaattgacgccattgatggctttgcagacgggacaagcgaagaagctgctcttgatcttatcagcaatgctcaaaacgcggctgacaagattgcaagtgacgttgtagagcaattccgcaataccgaccttcagccgagtagtaataactctgatgatgaaaaaactgattctgactgagtatgaatgtaacaaatggaggttcaacttgtacaatactggtgtatttatgctgtgtttgataattctagccaagtctttgatttcttaaaagcttttatcaagctttgttgagcctagaacccaaagaagctattaaaaactttcagtcctcgcagacgaagtagaaaaaccaaacaaggcaatgatagaccaagtaagcaaattaaattgataaaaaatcacactccattattatgatgatagcccccgactgacaacgtcaagaagaaaacttgatgttgacagtcaagatagggaagtacaatgataagtttaagcgtagaaacgacgaagatgttcaatgttccaagagttgtcaacgagtgtaccgtcttcgcgcttgagtcgataggaacctggtcgggtgacgtcagagatgataaatggcccttcccatagaggagataacttgtgccgatctcgtgtagtttgaattttcctcaaaaccaggtcgccgactagaaaggcacgggatcgaacattgcgattatgataacgtcgcagcccttgtaagtatcgagccgactgaatcaaagctgcttcgcggacttcttctaatcggtgcaagtcatccactcggtcctcttcgtagcgttcttcacggtaatttcgaaagcgcaaagactcgaattcaacttcactcggcaacattgcttctgccccatagacaaggaaaaaaggtgactggcctgtggcccgactgggtgtagttcgcaaagaccaaagtactgatggcagctgtttcacccatttgccggcatagggttttagccggtcaaaaacacgcgctttaatcccttgaagtatcatgccattggctcgctccacctgtccattgctcatgggatgtgccactgaggcatagcaaatcttgattccaaagtcttcacaaaagtctttaaaaactccgccggtgaattgtctgccattgtcagtgatgatccgattgggcactccaaatctatgcacaatgttgatgaagaagtctcgagcgttatctgctgtgattgtgacaaccggtttagcttcaatccacttggagaatttgtcaatggccacaaaaaggtgcgtgtaaccgccgactgcctttttaaacgggccaaccatgtcgagcccccaaaccgcaaacggccaagacagtgggatggtctgcaactcttgagctggtagatgaatttgtctggcgaaaaattggcaaccttcgcacgtgcgcacaattttgtcggcgtcggacactgcggtgggccagaaaaaaccctgccggtaagctttgccgacaatggtgcgtgcggcagcatggtttccgcatatcccagaatgtatgtctttcagcaattgcctcccttcctctaaagatacgcagcgttgcagaatccctgaagggcttttcttgtacaactcagcttcatgcataacgtaaagtttgctccgccttgaaatccgctcggcttcatctttgtcttgtgggagttcttgagaagtcaaaaatcgtatgaggggctctcgccaatcggcttcaaccagagctacgtcatgagtgcccgcaatttgagtagtatccttgtgaggtacggtcggcgtataaaggtgttcgacgaaaacatcagagggcgccacctcgcgcttggatccaaagttggcaagtctgtcggcggcttcattgttgtgtcgaagaacgtgactaagctcgagtccatcgaacttgtcttccaatttgcgtacctcttgtcgatatgccatcatattgtcgtcaaggcaggaccactctttcataacctggttgacaaccagctgtgaatcgcctcgaactattagacgctttattcctagggaaattgcaatccgcagtccatgaaggagcgcctcatactcggcgacgttgtgggatgccgaaaaatgtatccaaagcacatagcttaatctttctccagttggggaaatcaagaccactcctgctccagtgcccgaaagtcgttttgatccgtcaaaatgcatggtccagtgctccatcttctccgcgggggtatcctcctggcactcggtccattcggcgacaaaatcagctaacgcttgggacttaattgaaattcggggcttgaatgatatgtccaaagacatcaactccaaagcccacttagcaatccgcccgtttgcttcgcggttatgcagtatatcaccgagtgaaaatgatgtgaccaccgttaccgagtgactttgaaagtagtgagatagcttcctggtagtaattagaataccatataacagcttctgaacctgagggtacctcgttttggagtcggctaggacttcgctgacaaagtaaatcggtcgttggactttctggacatggccttcttcctcgcgctcaacgaccaagactgtgctcacaacctgggaggcggctgctatatacaacaacaacggctcctgcgggtgtggtgaggctaagaccggtggctcggtgaggagtttcttgaaatcttcgaaggccttctgtgcatcgggtccccactggaagtcgtctgttttctttagtagcttaaagaagggcatcccccgctcgccaagtcttgaaacaaatcggctgagcgccgccatgcatccagtcagcttctgaacatctttctgggtacttggcggtttcatgttgaggatagcagtaattttctccgggttggcttggatgcccctatgagacaccataaaaccaagcagcttccctgacggtactccgaaggtgcacttttcagggtttaatttcatcctgaaagcgcggatgctcgcgaaggtttcttctagatccgagatcaaatcatccttttgcttggtcttgacaactacatcatccacataggcttcaacgttgcggccgatctgcgttgagaagcatctctggatcatacgttgataagttgctcctgcgttttttagtccaaacggcatggtgacatagcagtatgctccaaagggcgtgatgaatgaagtcttcaagcagtcggattccttcagtcggatctgatgataccccaagtagcagtccaaaaaactgagaagctcacagccggcggtcgagtcgactacctggtcaatgcgaggcaacccaaaaggatctttagggcaagatatgttgaggtcagtataatcaacacacatgcgccattgccccgttttcttccgaactagaaccgggtttgccagccagtcgggatgaaggacttctttaatgaagcctgctgctaacagcttggttaattcctccttgatcgcgtcttttctgtcttgtgcgaatcggcggagtcgttgtttgataggcttggcatcttctttgacatataaggagtgctcaatcacctctctaggaataccgggcatatcagatggtttccacgcaaagatatctttattgttctgaagaaaggtgatgagcgcgctttcctatttacaatctaactcggcgcctattacagcagttttagtagaatcagaaggatctaagggaatctttttagtcttggcttcgctttctccactttttgaaatcttggtagcgggcacttctccttcgctcgccgtggctgcagccagtcggatatcctctcgggctgacgccatctcgcgggtttgggccatgtcgcaactctccttgtcgcatgtgacggcttgcttgatgtcgctccgtagggataggactcctcggggaccaggcatcttcatcatcatgtaagtgtagtgcgggacggccataaacttggctaacgccgggcgtccgagtatggcatggtatgctgtctcgaaatcgtcgacttcaaagctgatattctctgtgcggaagttttcccgagtgccaaaagtgaccgggagggtgatctggccgagtggagttgcggataatcctggaattactccgtgaaaaggcgcattgcttggttttagctcggagcgaggaatctgcatatcatccaaggtcttggcgaagaggatattgagtgcactgccgccgtcgatgagggttctgcgaagcttgacattacggaccactgggtctagtaccagggggtaccgccccgggtggaccactcggtcaggatgatccgagcggtcaaacttgattgcaatttctgaccatcgaagatactggggcgtgtcgggctgaacagcattgatctcccgttcagtcaacttttgcttccttttagactcataagccagggggccgccgaagatatggttgagctccttgcggtggtcttgaaatcctgccggggtgtcgccgtcgtccttcttcctcgacgtactttgttcttcgtcggagttcttccgtgtagtcttggtgtattgctccgcaaactgcctgtagacgaaacaatctttggccacgtggttggagttaggatggtgcgggcattgggagttcatgatcttgtcgaacgtgttgacgcgcgaatgctgtcgagaagagtgagtggcggttgcaacaagttcctcaggcttacgcttgcgggccttatgattgttactttcacctcctcccttagccggcgtacccttgtttggcttcaactgggacctgactgtttgatgcggtgacggcgtcttcggccttggcgtactcggtggctttttcnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 36740 - DNA, 595 bp, Oryza sativa
cctatgttcagattcgaaatattaggatatgtcacatccagtattagcttagttttctatgaggtcgaagggagtagctggctgctacattgaccgacggcgcctgcctcaccaaggcggtggcaagggctgcagagcggaccacggtcgacagcgagacgtttatattgacgctcatttttatgatactaggtgattcctcacgcttcgctacgagaattctcaatatattttgttagtaaaacatcagggtttattagtacttatcatgaagtatatgttaaatattataaaaataatagatatatttgttaaaatattgtgcaaatgatgtgagtgtggttattggatatgcttgcatattgatttatggaattaaataaattgtagataatgttatatgcttacatgagattatatatatatatatatatatatatatatatatatatatatatatatatatatatatatatatatatatatatatatatatatatatatatatatatatatatatatatatatatatatatatatatatatatatatatatatatatatatatatatatatatatatatatatatatata

SEQ ID NO: 36741 - DNA, 642 bp, Oryza sativa
  unsure (1)..(642): unsure at all n locations
nnnnnnnnnnnnnnnnnnnnnnnnnnnnnnnnnnnnnnnnnnnnnnnnttcaccttgcgtcctcatccggatcaactgctgggaagaaccagaacgagtcgccgtcggcggggaactcgccatggcggtgcggcaccgtcttcttcagcaccagcagatcacccggcgccgcgcccaccctcgactccgaccagaaccacgcctggccacgggcggcgacgtccacgtcgggcagcgtcgacggctggtgcgcgaacaggacggtccccggggcgcggccggccgcggaggaaggcgggacggccgccgagcacccgcggccgagcagcagcacgcgctcgccggggcaggcggcgatcggcagccacgccctcgcgtcccagttgagcttgtagagcgcgacgcggttgtggcgctcgtccgagagacgaggaggacgtggccgagcgactccacgaggtagtcccgccacagctcgagcgacgggagcgcgaaccccgtgtccctgcgctgcaccttggggttctcgtcagcgagatcggcgcgccacagcagcctccgctcgtggacgaggtacaccgtggcgcagacggcgacgacgtcgctgagggccgcgtggtggcggaaccccggcgcgcgcag

SEQ ID NO: 36742 - DNA, 1503 bp, Oryza sativa
  unsure (1)..(1503): unsure at all n locations
nnnnnnnnnnnnnnnnnnnnnnnnnnnnnnnnnnnnnnnnagatcagcgaggcagccacaggttgaaaattatagtcagtacaggttgtggtcagatatttactgagaatcctaaatattatacatgttgttacaagcatttctccaggtggaacagatcggtgaggccaccacaggttgagaattatagtcagtacaggttgtggtcaggtatttactgagaatcctaaatactatagatgttgttacaagcatttctcttagcaatcagtgtaccaactgtagttcacatccttgttcatttcattatatcaaacaaattctgtaggtgcgataacgagatgaactgtccactactgtaaataatctatattataatgtaatcatccatcaatttgccaatgatgccggtaacaagtaaaagatttattgaaacagccaaaatttaactgtgtaaatttggctagcatcatttacttgacattgtatttcagactatgttttacaaatctcacaggattacaaaacatagaccaatgagcaatacgagcaaaattactagagctgtggacaaaattagcctgacatgcaccaaaagtgcaaacctgagttttttttaaaaaaaagaaagaaaacgatcagagcagtttatatgacttttagagacttgttttacatgagttaatctgaacctggtcaccggaattgcgctgcatatgtacttctttcgcaatcaggagtcaagttaaaggtgattgaatttaaaacccagttacaaacaagatccaccagggttaaaagaacagaaagtacaaaggcactcacaattagagttcagttcttcggtaatttatctccaagattcagtctcaccgcacttaatggtgtggcagccagaacaatttccaatgctgagaaaaggaaaatattttagtaaatatttccattattagaagctttaatcagttgctataggatatgtagcggtcattgatatattaacagcttgaaaatttgtctgaatttatattgattgcaaagcaacaaatttgtgaacgaaaaaggaagttaaagcaaatttataaatttagacaaatgaccgaaatgacctgttcttgcattatgtgggtgtgttcagattaaaatgtcttagaagacagcattagaacaggttagtcattaaatgaaaaagaaaatttcagaataggtttgtcatcaaatcaaataaaatgcttcagaaggcagcgacatattttatcaaatcaaataaaatgcttcagaaggcagcgacatattttgatctaaggcataaaatccaaaactacttgaactgtaacattactgattttagctaacgtctcataccatcctacatactaagattcataacttgcagagctttcctccctcccactaaagtaccatgacatgcaatactgaaatctaccattaccaaaagaaaacgagaagtgaagaaaagatcaagtagtccaattgaagaca

SEQ ID NO: 36743 - DNA, 2375 bp, Oryza sativa
  unsure (1)..(2375): unsure at all n locations
actatagggcgaattcgagctcggtacccaaatcatcccgtattgtaaaggagagatcgttggcccatattgttaaggagagatttgtctccgagccaattccagccggaaattctccctcctcatagcctcgcgcagtcgcgctagctgacggccacggcgccggcgccgaagctcgcgtgtgctacttgtttccgtaattccgtctcgcacccgctcgcgctcactgtcacatgccgttgccttcggtacgcaactgtgactcccaccctcgctaatctaatctgagttgttacttgtcagtgctccggcttgtccttgatttgtttgctgttgctgtcatcttccgtgcagtgcaggctccgtatgcggcattggtcgctccagcgtaattgtcgatggggcctcaccgaggagctcaagtttagagtggtaagtgtttttgttttttttttcagatctctgacgatttttattctattcacgtatttctctttgtgaatttcagtatcagggatggttcaggatgtcgttggtttgagggttctaatgcagctgaaaatgtccctgtatcttctttactagctgatgaatgtggcttgtctagatagtaatggctacatattgttatcacctattatattggagctagggtttgaaatttcgtttcgaaagttccgaaattttgctccccaccggaaagttcacatctcgcctgaaattttaggttttttttttttgcaaaagtttctgaatttggtcaaaaatttattcaaattctttcaaaatcagtcaaaatttcaaataattttggccaaaatttttcaaaatttccgaaatttcggtcccctagtagaaaaaccaatttcaaatcagactgaaatttcggatccctccgatacgatattattttggcccaatttttttattttcttgaattttggtaatatttgttcaaaagtttataaaattcaccatatcggcacccccatacaaataccgaaaacgaaagattgaaccctaccggtaattatatatttccttgtttgccattgatttattaaggttttattataccattttttgcttgcattagtatcatcatctcatgattgataaattaatagcatccgttctataaaacttagagttcaattcaacaaatttagtcgaacttttaaaattctaaccattaattttatcagattgttaattattgcttttctagggccataaaggtggaaatagttcaatggaagcaaggtcgacattctggttcctctgagaagggtttgaataagaagtagaaggttaacatgcttccgaggctaaaatttttcggcttcactcgatcaagaagtaacatactatgctctctctgtatgagagacagtttattatcataatgtgttctttccgttcttttttgtgtggaccttgttctgacatatggtgatcctttagtaatggctttaccattttgtttttaatgtggttctggaagatgtaaaaccctgtatagctccaaacatgcatcctgggtcctcgttttcttcagcattactgaagttctagaagtacaataggcttacgcaaacggcaagtaagaaatttttgtttaggtgtctttcaatattgggttaaatttcacgaattaaaagttaacaaatgtggatcaaattcaccattctgaccttgatgtacagtatacagctcacagtcacatgcattcccttgtatgaggtttgcttttaactaacagggagatgagccgcgggaaatttattgaaccttcaaaacaaccttgacatatatgcatattttttttcgcgaacgcacaaaagattgcacgtcaatatattagaggaatagagtttttgttacacaccgcaattggccagaccggcctatgccagggaaggggaaaaacaaagtcaaaaaaacaaggaagagaaaaaagaaaaagaaaaactcgaacgctactccaaacaacgagagggggcagagccacgctacactcccaacaagtccccaaaggaagtgatgaaccttgagttcctctcgacactcaaggctattgttggcccgatctttcggtgagttgtgataactacgatttgggagaaacgttgacgatccgactacaaccgtacgagacgttgtgttgcgccttagcgatcgatacacctctccgtgggttgttgatcttgccggtgcagatcaaccctattcctgcaagcaaatcgaagaaacaagcaagaacaagataaaagcaatctgatattgcaaatagaaatttaatacaaatgatnnnnnnnnnnnnnnnnnnnnnnnnnnnnnnnnnnnnnnnnnnnnnnnnnnnnnnnnnnnnnnnn

SEQ ID NO: 36744 - DNA, 3299 bp, Oryza sativa
taaactttcatctaaacaaaacccaagaaaccctgaaggggtaactagctatatataggggtgggaggatgacctaggggtgcctagggtcgtgctccaccagcttggggcgcaccccacatgggcctcacctgggccggggtcccaaatgaggttacaagcccataggcccattacaggtgtcacagcaccttgtttcttcagttgctaccgactgagatggaatttggcaatgaggcttgatgcattggaaagaggactccgagagctttccatcaagtactcacgggctgaaaacggaggtcgtatggagcttcggcggccgtttgaagtcagcagtgtagcaggtggccgaattggattttggcacttggaggactcgaacttggtatcttgttgttcatccatgatgtgagcaacggatgtatccgtagtagccatggtcacatcatcctccccttcttcacggaaaaccgtcctcggtttttccatatggtgttcttcatatagtccattcaaaataacctgtttcatccaatcaaaactagagaaactcgaaatagtgtgattagcaataacatgtttctctaaatccaaacaaatgaaaactctatgcaccaaatatattcctctatcattatatttgccaaagatatgaaaaatagcattagttagacatggcaaatcagacttagcaaataatttctccttcaaattatcgagctcacaaaaatcatcaaactgaacatagcccaaagtatttaaagaagatagcaatttacgttcctcaacttcattaacaatatgaacagcatgcttaaaatcagcacacaaagaaacactaggaatagcatgttcattcactagttgtggcatggatataagtgaagcattatcacacaactcttctttatcacaaggaacagcgagtaaatcaacttgtgacaaaggaattccagcatttggttccactaacggttgctctacttttgcatgaaaagtggacaaatttacttcgttaacaatgcactcaccttgattaatttcagtaccatttactttaccttggatgtcctctttagatgatggaggtgtctcgaacttgagtgtgaacaatggaattggtggctctttcatgtctctctcctcctttttgtgattacgcacttcctgcaaatagttagtaattggaggcaaagacatagcgtgtttctttttcatatcctcctctattttactttcagcattgcaagcaagttgtaacaaatgagaaagagatgtatatctttgacaatcaagcatgtcctgaatttctttgttaagcccacataaaaacctcaattctttagcttcttcgcattcatctaaaccacaatgtaataaacaagcttgcatatcatgatagtatgaagtaacagttctggtatcttgttttaaacattgtagtttgttgaacaaaatgtcagcataatacatgggaacataaacatctctgaaatatcgtttcaggtctttccaagattgtggtattttgttatgcctacaaagatgtttccaatcattagaagcatgtttaattaaaacactagaggcacacataaccttttgtttctccgataagacatgcttttgaaattcactatcaaccgctagctcccaattaatgtaagcacgaggatcatagtttccctcgaaataaggcagtgcagatttgatcttacctagaacatcatcacttacctcataatggtcatgttgatccctcctcatgtctcgacgaagatgtcgatgttgagcacagctatccccaattatcttgcatatccctgccattgttagtagaaaacaagaaacatacacaaaaatatgcgcgttcctattaactactaggtagtggcagctcaaaaatcgcacacactcaagcttttaaccaaactcttacaagatcttaccaatgcaagtggaatggtgacatataccgactcaaccaagcaccccaatgaaggttggatgtatcgatgccttggcaaacacttgcggtaggctgtaatcaaatatgtggagctctgggtagggttaaatatgtagcaaaggaatagcaaatgctcaaatcagataatgcaaagttgaataattgttcaaagtcaagtaccgtgctggtcctaggctagaacgtactagagacaaacgataccacaagatagcactaggaacaactcatgcacaactctgatatatgaagtttagctcaaacataacagtattttctcttttctttctttcttctttcttctttctttttttttccttttcttttctgtttttttttgtgtggctttttttttctctttttttttgcacctttctgcctttttttttctcacttttttcttgatttttttaaacaaaaactgactcaaggaccttaatgtaagattacagggactcaaacataaatataaaatttacagggactcaaatataaaagtctaaacccaaaattaaaattatacaaaaaatggaatgctgaatttatgccggttccgtttttccaaacagatctcgaaaccgacaccaaacaaaaattcgccaaggtgtttgacacaactcggaaccgtggaattgagggagggggtcggactcggccaaaggggcgagtgggactcggcaaggaggtggagtggatggcagccgaatttggtgtatgggataaaaaggaaactgatttttaaccaatccaatctactatatctttccaaaacaaacttgactacttccaaaatcagatatggtaattcaccttcctcctctcgtgcacgacacaggcacggccaaaacaaacacacacaaggatcggcaaactctagatgcaactcaagaactccaaaactaaccgacagaaacttctgaaaactacaaaaatagaaccttggcaacgagccgattccgttttcgtaggtcccgacaacaacagagacacggtggcagcgacgactgtggtacaaaacgtgaccagaactcgaaactctaaacgaactagacgctaagaccagcaacacgacatgacgatgcaacacaaaattcaacaaagcaaaaactgaaaagaacaatgcaatggcacaatatggctaggtaaatgatacgaatttttttgtatggctattttctggttataggaagataaaaactcaccgagcaacgaaagctctgataccacctgatgaaccctgagttcctctcgacactcaaggctattgttggctcgatctttcggtgagttgtgataactacgatttggg

SEQ ID NO: 36745 - DNA, 3275 bp, Oryza sativa
ccgaagagagcacagagtcaaacaccctggaattacgttccttccatagctgccacgagacataccggtctcttaaggtatgataccttggaaattattgtcactaaggtctaaatgcttgagcttttgaagctttataaaactggatggtatgttaccatcaagattgttgtgactaaggtctagttgaacgaggtttcgaagctttcccacattgtacggtatactaccatgaagattgttgtaactaaagttgagacgatctagctgccgaagatttcctaagttggctggtatttgaccatctaagctattctttcccaaagaaaattgtatcaagttagtaagatcaccgatggatgatggtattgacccggtgaaattgttctcctggagatatagaagttctagattcctcagttttcctacccattcttcgattgtgccaataagattgtttttacttagccacaaactagttaggccatgaaggttccctatactcggtggaaccactcctacaaaatggtttacacccaaattcagatattgcagattggtggataggttaccaatcgagcttggtatatctccttttatttgattacgagctaggttgagtgcttgaagaagggtacaatttgcaaatgcgtgtaaccatttttcattgtcacttgcttcgagatggttacccgctagatacaaatcggacagatttgcaagctcactgagataactaggaacctggccatagaaattgttgtttgtcaagtctatcaaccatagccccgaagcgttgataagggaagttggtatatgaccttcaaacatattcctcgctaaggaaaggaattggagattagggagcacatcgccaatgttgggtggcagtgcttctttccctagcatgttatcactcaaccataaagtctgtagagaagacagattgaacagttcatgtggaagtcggcctgatatgttgttcataaaaatgttcaatgacaacaaatctgacaatttcccaagctcacggggaatgcttccctcgagatggtttatttgaagagagagatagtttaggccggtaatgttgccaagggtgggagggatggttcctgtgaatgaattattggaaagacataagctcgagaggttcgttagaaggcccaatttggtgggaatttcaccaacaagagaattcgaggagagatccaacacccttagtctcgaacagtttgcaagcccctctggaatagtatcacgcagtgagttatgcctaagatccaggactttcagtctgtggagatggttcagcggaggcaatttgccggagaaatggtttgaagagaagttgagtgccttgagaaacgtgaggttcccaagggaggagctgattgtgccggacagggagagtttgaagagattcagcgccgtgacgcgcccagggtgcctccggctgcagctaacgccggtccactggcagaaggggacgcttgcgttccacgagctcatcgcttgcgttggatcttccgttatatgcttcttgaaatccatcagggagagcagatcagctgtgttgttcagagttgcttcacaacggatgctgccagctccgtaagacagcagcaacagcagcaaaaacgccagaaatgcagccatattcagaggatgattttggtttcaaaagatccagaggatggttggcctcagcgccttccttatctgccaaacgtaaagcgtgaacatttcagcacaaaagtacaatacgatagcagtaatttaacactagagatgtatttccagcaggagcagacgatcgatgagacgactttgcgatgaatggttaacatgcgcgataaattgcataaataaatatcgagagatcagaatgcacctcgcccggcgtgtttgcttccgccttgttcagtgcagaggttggaaactcgcttgctcgtaggctcgtagctaacgcggcgaaaggtacgcatgcacctggcacaccctatccggtataaaaacagcttgaacgggcgggcgtacctcagcttcgcttgatatcatgccttaggctgtgtttggatgccccctttcccaacccctctccctcgttttccgcgtacacgtttttcaaactgctaaacggtgtgttttttgcaaaaagtttttatacgaaagttacataaaaaatcaaattaatccattttttgaaaaaaaaaattccaaatgggaacggcttctagcgaacacactcttagcaggtacgatagcagactatataagtcaaccgtaagcacatatcaagaagataaataagaagagataagaatagcgagctataaatttatagtcagctgtagcacatactacaaatgtaatatgtgtatgacaggtgaaaccaggtactacttgtgtaatactctctccgtcccaaaaattaagaaattttagagttggatacggttattaaaaaagtaggtagaagtaaacggtgaagggttgtgattgaatgagtagtggaggtaggtgagaaaaatgaatggtgggagagttgtgattggttggaaagagaatgttggtggagaagttgttatattttgggataaattctaagggctaaaatttgttatattttaggacagagagagtatatattttaggtaacgaattagctattaaattgactatagatgctttggagctactagtaggctatactgttaaacttgctttattacattgcaagcaatgaatttcagttcttcaaacttttatttccttttgctttttaggcaataaaccacggccgcaccgcacttctggtggaaccatcacagattcacaggtgttcaaagaagagctgacacaacttgcaacagactgcttgaaaacaaaaggtaacggaggaacttccgatgctatttaaggtgaattgaaatcatttggtacttaagaaaaattgaatgcactggataattaaaccaccaagaacataaacgatattttcataattattatttacacgtaaacttcagagtaaatttcaaaaaactaaaagatatagtgaacaaactatcacagaactatagatctaagatgatatattagaaaactgtagatttaacatcaaatttatcgtaaaactaccaatttaaggtggagtattgtaaaattaaagatttagtaatagagttatcataaagagtaattttaccatccaacatttagtaccttaagttatcataaatttttttaggggctcaagatactttttagtg

SEQ ID NO: 36746 - DNA, 4055 bp, Oryza sativa
  unsure (1)..(4055): unsure at all n locations
ttgtgtctgcagctgcagcagcaacggctgcgtatagtggctgtaccagctagctgaacagacccaatgttagtgctaagaatttaaacgctaaaatatgtagtttggttatagttttatttttaaatatgtagttttgtgatatttagccataaatatatagttttataatatatcatcttaaatgtgtagttttggataattggttaacctctgtagttttgtgaaatttgctctaaactttatatattatatttatccattatgttattagaaactttatatattattcactatgagggcttgcaaactttcatactggccaaagcggaggaaaaatgatctttttttccatcaaatacatcatcatttagtagtttgataaacatgctaacggataacgagaaagttgctaaaactaacggcataaaacaacggggcctaaagcaacttttaatatagctaagagcagtttcatgaaaacgtcaactagttttagataatttataaacatgcataataggtttgcctattcatatggttcaaatatctatctccactactgtaataatactacaagaataggttttgtttgtccatcgacgcgcaaagtttcggtccacacttcatgtaaaaaacaccctttctggatgaacatctggttcattctttctctaagattccattacaacgcacaagcactgtataatttgttaattacttcttccgtttcatattataaaactttctagcattacctacatttatataaatgttaataaatgtgtctagattcattaacatctatataaatatgagcaatactataaagccatataatatgaaacggagcgagtaacatacaatattctttttctcctcataggcttgcctttatctcatactaataacatactcgtacgttgttaaagtgatgaaggatgataactctgctttttagtactccctgttctatattttagtatttccattcttcgtatagattcactaatatatatgtgatatacatatgaaacacatatataaatccatacataaatttatttaaatctcaaaacattttataatccaaaactgatatagtggtatagaaaaactacacggcattccctcttaaatactaaggctgtgttcggtactttgctttcccaactccccctctgaaatacgaaagttgctttaaaaaatcatattgatctataggtttttcgttttccgtgcatgggataagggttttccaccacccgcccccgaacacagcctaagagactaatgtcacgccatttcttaagtactagttaagccactgaattgtctagatttgtcaggtttccaataaatcatccaagtggtacaacccactgtcattatcctccgatagaaagctgttaatattatccagtcgacagcatgtacagatttaaggaacgaaagttccctgatgtagagataccgaatgattgtggagaggtcgccgattgaattcgggataaaaccgcgtagcagattattactccctaatgtataacgccattaactttttaacaaacgttcgacatttcgtcttattcaaaaaatttatgtaattataatttattttattgtgacttgatttatcatcaaatgttctttaaacatgacataagtatttttatatttgcataaaaaatttgaataagacgagtagtcaaacattggttaaaaagtcaacggcgtcatacattaaaatatggatggagtgctagctagcgacaatatttgcagaaagctagctttgtctgccagtagcttcaagtttgttttcaactccgcatctatccagtcaatatgacctaggtttggaacctttgagcaactccaacagattgattatcccactcttcaaaccaaacaatataaaacataataaaaaaataaggtctcactggccatttaaatgactaagccatctcactggccaaatacccaggtgggctggtcaaatctagccagccggtttagctggccaaaccatagtatcgaagcagtgctagtgagaattttctttaaaaagataataatagtattttaataaaagaatttgtaaaagtggagatggaccgtcagaaatcataaatttagtatcatatcgaccaaccaaagtttgatatggcacatatcgaagaactacggtttgatatgtgacctctcggtatgtggttgttcgataggttgataatttgattaaaaaaataaagaatacatgtcctaagcttgtttggccggataaaataaataaatgtgcatgacgcgaccaatcgaacttgcgaagttcgatatgtcctcctcaccgaattaaggaaaaaaagaagagtgtgcatgtatgatggccaatcgaactacgatagttcgatatatcctagctactgttcagagtaggattgattgcttttatgtttttttaatcatgccaacatcacctgtcgaaccaccacagtttgaattatggttgttcgacatgtgctaaatttgttatttcatccaacaggaatttatttttatatctttttattaaaaagctattatttttgaaaaaaaaaatcagctagtgacagcactttctaagtagctacctcgctcccaccgcctcctccccatcaacagttcctccatctctccgtatccaatcttatcattgctgccaccgtcttcctcatcttgaggaagacagccccgttgtcaccctggttgtcgactcgaaggcaggacaacgagaaggaggacggcaagccggagcctcctcccgcgctcctatgttgcctcgtccccatcttcgtcgccaccatctcttgcatcatcccctacccctatcgttggaatcaaatggagatgctggcaccaacaccgccaccagcctcccctgcatcacttgtcgccaccagtgaagaagaaggcctcccacaccgctgtacaccttggcggcagtatcccttgcgccgtcatcaccgtcacccccacccacgagccttgcctcaagcagcggctgaccgttgccaccccctccatatcgggtgaaccaaggaagttgccaccgggcccaacgggcgccaccatagtcatcaacatatgtgaccgtagcccaccatccccccaccccttcctcctcgtcgtcatccagcttccaccatctcacctctcttctcaccctcttacacggtcgatcagttgcggcggtgacggcttgggcgacaacaggacagttggttgcgtcgcgggcttgggcaaagaaggcggaggtggggaaagaacagcaatgtcctactagtggacaaccgaaagcggaagagaattttggagggaggaaagtatatacacactgacatgtgggaccgattgttagattgaagagtgtaaatagagaagctattagagtaaaaataaaattgtttctctattcggtatgtaagctgtggctaaataaatatttggagaatcagatttggataagctgttgaataggagtatgctcttaccagcataccgaaagacgtataggaatttctcccaaaaaattgttgttatccaaatctaaccttcctagtactgaaacattgcctagggaagctgccttcaaacatgttgtaactcagcaaaattaaagcacatctgcaagaccaggactactactcacaccaactgctgagataaaatgtttacgcacacgccctgggtgattcgggctgccggtggtgtggacgcttgtgttccagcggctcaatgctccaccctactggatcactggtgatgcatcgtggatctcaactcgatcgatcccattatcccaacctcttcatgtcttccactatcttttcgagggaatcacttagccacttcgctggatgatggtgaagtggggagaggacgggagggagaagggaaagcccttctcgcaccgcacggcacgacggccttttgctgcctgctttaattcgcttttgctgttgcctctagcttagcttnnnnnnnnnnnnnnnnnnnnnnnnnnnnnnnnnnnn

SEQ ID NO: 36747 - DNA, 7008 bp, Oryza sativa
agactcgtctttcaatatttctttttttttaattccaaattttcgttatctttatttctatataggctctaggctctcttcaaatattattttttttaattctgaatttttattatttctaattgtatttctatatagattctaaactcatcttttaatattctttaatttttaatttcgaatttcagttacttctaaattgtattcctgtattgactttagattcttcttcccatgtttttttaaatttcaaattttagttatttgtaaattgtatttttatacgaactctaaactctacttttaattttattatgtttattccaaattttagttagttttaaattccaatatggactctatactctacttctaatattccttatttttaattttgaatttctattatttcttaattgtatttcgatatggactttagtctcctcttccaatattccttattttgtaattctgaatttcaactatttctaaagtctatatatatatatatatatgacacctatttgctactatcgggagtagttactccctccgcttattggatcgggttagtggaataacccataatccgataatatttgcacaaaatattagcttgtagttagttcaaataatttctaaatcatcggttgcatgcaaaccaattttaaaaaccggtagaacgtcagctaaaaaaatggcagaacataactgttttgaaaatatcgttggcagaacataatgtgaatcgggaaaggagcagaacatggaaaaaaaaaacgcggacagaagatattctgctcatatgaaaaaaaatttaagcggacagaagatatcctgctcatccaattaggagcagaatagaactggaaagagagcagaagatcgagcagaaattctgtttgaaaggacgcagaacatcagctgtttggcggcacatgaaattgttgatgttctgctcttttcaaattgattttctgctactagccagcagaagattatgtatgcgcatcaactaaaaaattggcagagcatcaactaaaaaaaatggcagaaactaatctgcatcagagaagtatgcatgcgcatgcagcagaagctaatctcccgttccttaaactatggatatgtaatagaatagcttctggtccttcaaacgatttaatctactactagagcaaggcccgtgcagaaacgagagcagaacattcctgcttcttctgcgcttgtagcagaacatggatcgtagtttctgcttgtgcttgtatttgggtttagagatgtagcagatcatggcacacggcagaactgggagcagaacatcacttctttttttgggtttagagatggacatgcactgatttggagcagagcatgatctgctatctgatttctgaggagcagaacatgttgcagatttggtagagatgtagcagaacatggcgtacagcagcagaactgggagcagaacatgacttcttaatttcttatcgcctaattacatttacaccagcatgatagtttctggtgaaaacagaactagagccaccaccacctgatacatttgcacctgctgcaggactgcaaagttgctgcaaatgcaaaacataaagaaagcgaattaggagcagaaacgatcaagaaaggaatcgagatcaggaaaagaatccaaaagatgaaaaaaataacagatgaatatgataacaaaccttggaactggaatcctccatgccagggctttcaccgttatctgcaacacagccgccggcgaggctacaaatctgacttcagttgggttatgaaccctccaaacgcagagaacaattttagatcgataatgttctgctcttccttaacgacggaaaaaatatcctgctttctcactttggataaacaaacacaagtttcaaatttcatatctacaacaaactcgggaggcttcgttcaattgttggatctactgtagaagataaacgaccttctgttgaccaccgagaaaaataaaagctggagggagtattcgattcattagacccggtaacagtcattggcattagtagcgatcgaattgagggcgcatagggagggagtagctactcccggtagtagtatataattttcctactaccgggagtagttaccggaaatgctagctagcgattgatcgctaggggtagctagcagcgatcagattagattttctcccctccacctggttttcttttttggcaccgcattactttcctattttaataaatttatgcacctaaagtttatacaccttaagtttacacatctaaagtttagagattcaaagtttataaattaaaagtttatatatccgatttaaatttaaattgaattcaaatatttttatatatatgtatttctatacatctaaagtttatagacccaaagtttataactcaaaagtttatatacccgattcaaatttgaatttgaaatatatccgattcaaatttgaatttgaattcaaatatcctatttaaatttaaatttgaattcaaatattttttttatatatagtatttctatacatctaaagtttatacacctaaagtttatacacctaaattttatagacctaaagtttatatatccgattcaaatttgaatttgaattcaaatatttttcatatatagtatttctatacatctaaagtttatacacctaaagtttatagacataaagtttatagacctaaagtttatatacccgattcaaatttgaatttgaattcaaatattttctatatatagtatttctatatatctaaagtttatacacctaaagtttatagacccaaagtttataagtcaaaagtttacatacccgattcaaatttgaatttgaattcaaatattagtttatagacccaaagtttataagtcaaatattaaatttacatatttatggtgtagtaggaagagaaaaaggggaggaggaaggggggagaggagggagcattggagtaaggggagggccgggagagggagagcgatcacccgcctattaggtgtccccagtagttactcctatcccttagcggatcgggttagtggaataacagaccgagctgtttaattaagtaattaactaaatgatttattagttcagataagtgctaaatcatcggctgcatgcaaatcaacattcggatggagtttcttcctcacgcgtgctcgccttggcagaatatgctctgcttctgataggcaaaagatatatagcccgccaattgaaaaaaatggcagaacatcaggaaaaaaaatggcagaacatcatcgggaaaataaatgttggcacaacaaatactaaaattttctctatgtaacggcagtacatattatgcctattgattactaattgtagtttattatgtgtacgtacttaaataaaacgtatttcatattttgcatatctgaatttctgctcgggatagtttctgcttgtataaatgtacaacacacagccgaggtaagggatgaaactcttctgcacagaatttacggcagaacagaatttgtgcagcagaaagctataatcccgctcctgaatcaatggatagtaggataacagaatatcttctgctctttcacaaactgattccattcactattagacatacgactaggaagaaacaatggcagaacatcttttcctccccaacccataattcgtgacttctaatctgttgtgtccataagtccattcaggtcatttacaatttgtaagaacgtagaatatagagcaaggaatacaaagtgcagaataccttctgcctgttaaactgaatctcatcgtctatatgaagcttataaaacttgaaaatgagcagaaacaggaaaggaggcaggcagtatgtgagtatgtgacccgggaaaggagcagaacatcgattagaaagggagcagaaaaataatttgaacagaagcagaacatcttctgctcctccaacaaaatcatcactaaccagaagacgttaagaaggcagaaaattttctgctcgttggagttttactcattgctagttttgcggccagtcgttgcaagcatggttatgacaggcatgttcagcacacaaggagaacaacatcagttaggaaggaagcagaacatcgttttcgaaatagatcagaacatcaatcggcttaatataacaatctgcaacgctaacaaaaatatgcagaatataacaaaaagcaaaaactcttctcgacagaaactcgtcaagaccttttgctcggtttttaaatgcacatgcatgtgtaagaaaaaaaaaacctagattaaaacggagcagaaggttggtacgttcgatttctgctccgtacgttcgtttgtgtgctgccgatagtcaagccataatctagtatttagttatttatttgttaattgtttaattcaataaaccattacgtggactggttggttaatggatccccttcattaaatttgtttggagctccatggtgcgcgggctccatgattcaaattgcgtatatactcaattcaaatgagtatgaaatttttttaaatgtttaggtgttaacattaactactttactaactagttcaaaacaagtttgaactaaatttaaacatgtttttgttagattttgattctaggtatatagcatctaaacatataattagttaggtatgtaatattggattgtaaaataaagttaaatttgagttgttttgttgctaggtatatgtatgaatagaaaacttataactaggtatatactcacaatttgaaaattttgaaaaatttggacgaatttgtgtatttcataccatggtgcccgggcaattattatttagagtagttaaatatcatgcaaacataacatatcatttgcattttgttgtaattttagaactcaatatgcaagccatatcaaatcattatctccacatctttttcacattattcaaacatatatatatatatatatatatatatctattattttcataatgtataacatgtatttacccacctattctacaacaaaacgttgggtatcaatcagttgatttaagcctatagggcaataaattgagaacaagagaatgggaaaagacattaaaaaaagagagagaatgtaaaagactagagtgcccttgagacaccaagacacacgttgacacgtacccttgggcctaaagagagatagtacagcgataactgataagtgggcataaaaggtatatgaacgtactggtcacgcactaatggcatgttaagcatagaaacctttgagactgttataactaaggtccaagcgactgagttgacgaaggtttgccagactggatggtattttgccaccaaaattattgtggctaaggtccagctgcctgagcttaggaaggtttcccaagctgcgaggtactttgccactgagattattgtgactgaggtccaacaggacgagctgttgaagatttgccacgctagatggtacttcaccatggaggtagttgttgccgaggttcagccatacgagctgttgaagatctccaaacttggatggtatatcaccttgaagattgttgttactgagattaaagctcactagccgctgaagatttcccaagctgggtggcatcttgccttttagattattgtaactaaggtccagctgtgtgagttgttgaagatttcccatgttggacggtatgtgtcctgatagattgtttccgtccaaaagcaggtactgaaggttgacagacaggttcgaaagcttaccgagagagctaggaatttgcccagagaaattgttctctgacagatatatcaaatgtagctgtgaaatgttgccaagggatcctggtatgttaccttgaaacatgttaacacccaataagagccattggagattaggaagggcatagccaatgtttgacggcaacgatttccccagaaaattcatctccaagaatagcattcgaagagaagagagattataaagggcgcgtggaatttcacctgatatgatatttacactcaggtccaacgacgacaatttcgacaacttcccgagctcagaaggaatgtgccccgagagataattacgagaaagcacgagatccgacagctcagagaggagtcctatgccgaggggaatctggccttgaaataagtttatgctcaaatctagctgcgtcaaactggaacagtttgtaagcgtgtccggaatgatcccgtccaaaatattgttactcaggttgaggacttgcaattttcggagactgttcaggcgaggtatctgcccagagaagcgattaccagaaaggtcaagcaggtgaaggtaactcagattcccgagagaagcggcggcgagtcgaccggtcaagttctggccggcgagctcgagcgccgtgacgcgatgctcccggcggccgcatttcacgccattccaccggcagaaaggggtggttttgttccaggagctcaggacgcccgccggatcgtcgccgatggcatccttgaactcgagcagcgcgagcatgtcggagtcgtttccatggaccgccacgacgcagtggatgttgccggctgagtagcagaggagtactaacgccgcaaacaaagctacgagcatggcgagctacctgcacagtggtaaagcaagaaatacttagtacaggataaagcttttaaaaagctaccagtagcagctatattaaaaaggttatgaggatatcagcaccggcctgcacggctgcagttggtctcggttggaatctgactgtggatatgatctccgaacctctcgtgctacattttcgaaggaatcgtcgtcgcttcgtcagttgatttttctcgggctggcaccgtcgcgcacggcatggcggtctttctcgccgccttcatggcttgaccgccattgcagcggagacgaccttgaccccacaaaattttgagaaaatctcctgtaccctcgaaaattcgtttaatccccttacgtgcc

SEQ ID NO: 36748 - DNA, 2055 bp, Oryza sativa
  unsure (1)..(2055): unsure at all n locations
nnnnnnnnnnnnnnnnnnnnnnnnnnnnnnnnnnnnnnnnnnnnnnnnnnnnnnnnnnnncagtggatgttgccggctgagtagcagaggagtactaacgccgcaaacaaagctacgagcatggcgagctacctgcacagtggtaaagcaagaaatacttagtacaggataaagcttttaaaaagctaccagtagcagctatattaaaaaggttatgaggatatcagcaccggcctgcacggctgcagttggtctcggttggaatctgactgtggatatgatctccgaacctctcgtgctacattttcgaaggaatcgtcgtcgcttcgtcagttgatttttctcgggctggcaccgtcgcgcacggcatggcggtctttctcgccgccttcatggcttgaccgccattgcagcggagacgaccttgaccccacaaaattttgagaaaatctcctgtaccctcgaaaattcgtttaatccccttacgtgcccataaattttatcccgttccccttgtgtgcccataaatcttgtcccgttccttatatacccctaagttcttactttgatcttctctatatccatttcgttaaatgtttttgaaattgactatattatctctctcttatacttatgtgctagtttagtgataaaaacacaattcttatatgaaaaagatctatttgtaaaaaaacaaagggaatataattatttgacaataaattttaaaaacaaatctaaaattttaaataaatttaaattaacttttatgaaactggtacactgttttcatcaaaatttgaatctaataaataaataattttggttcataatttctagctaaaactcatatggatttgtaaaaaaatgttcaacaatttaaattttcttttacatattttacaaaaaaaataattatgccccatttgattttatcatgaattacaattttttcacattgtgaattatggagtagatagcatgtaagtatgggaaatgggcgacatgatcattttagaaaaatctaacagtcaactaacggaatagggatagaagagatcaaaataaaaactcaagggcatatagagttttgagacaaaatttaggggtatagaagagattatgaaacttttcaggggtatgtagggaattttcaccaaaattttccctagcttcttccaaaattcatttctaaaccgaattaccagatataagaagtccctcaatttacaaaatcagatcacccgatgtcctaggcagtattgtgaccgattttaggtgtcttggcaagctgagtcactacgagacccatgtggaccccatatgtcattagctatcactttctttctctcccctctcccttctcttctccttgtctgtccagaacttgatccagcgtcgggccttcccggttgctaggttgcacagtccaggctcctgtgggtgtgggtggtggacgacgacgtgggagacggcaccggtgaggccatcgacgcggagagctagtgttggaggagtgcgcagtggagcggctccgctatgaaggcgtggaggaggaacatcatgatgttcgcaccgtcgacggtgacgtcggatcactacactgggtacccaaaagtactggaggactatagtgattcaaactggatatctgatactaataagataaaggccacaagtggatatgtattcacacttggatatggcgctgttttctggaagtcttgaaagcagacgatcttaacgaggtcaacaatgaaagtagaactcacagctttagatactgcaacagttgaggccgagtggcttcgttagatcctgatggacttgtcggtggttgaaaaactagtaccagcaatcctgatgaactgtgataatcaaacagtaattattaaagtaaacaattcgaaggacaacatgaagtcatccaggcatgtacaaagaaaactgaagtttgtcagaaagcagaaaaactccagagtgatagcattggactatgtcaagacagctaaaaannnnnnnnnnnnnnnnnnnnnnnnnnnnnnnnnnnnnnnn

SEQ ID NO: 36749 - DNA, 5365 bp, Oryza sativa
aacatcatgatgttcgccccgtcgacggtgacgtcggatcactacactgggtccccaaaagtactggaggactatagtgattcaaactggatatctgatactaataagataaaggccacaagtggatatgtattcacacttggatatggcgctgttttctggaagtcttgaaagcagacgatcttaacgaggtcaacaatgaaagtagaactcacagctttagatactgcaacagttgaggccgagtggcttcgttagatcctgatggacttgtcggtggttgaaaaactagtaccagcaatcctgatgaactgtgataatcaaacagtaattattaaagtaaacaattcgaaggacaacatgaagtcatccaggcatgtacaaagaaaactgaagtttgtcagaaagcagaaaaactccagagtgatagcattggactatgtcaagacagctaaaaatctagcagatcagttcactaagggactatcacgtaatgcgatagacagtgcatcgagggagatgggtttgagacccacttgagttgcccaatagtggtaacctgtcctttgtgattggagatcccgtgaattaggatggagaaagaaactattgggtgactgagaggagagaccctgaaatgggctcatctctatgatgtacttctctcctattctgtatggaaggatggtatatacctcaatgtgatttgagtggcttttcgtaaagcagagatacctacagaacatcttagaaggaacatacctatataagtctaactgctagtcacagtctatgagatctagttgatctttatatactcatgaaaaggcttggaatatgatttatatgctccaaacaaaggggatgtaaacggcagcctagtaccagttaagagttcgagtgaaacctgatcgcacaaaactgacaattcaatgtatagtccattgttcagttgtgatctggtgtagctcttttcctaggtggaagtttaacttaacagtctccaccgaaacaatggtataacaaataggttcagttttaagaacatttcttgtgagccatgaaatttggtggggattattagaataaatgggctaggcccaatttaattcaattaaaatctcaagagcccacaagtaatgttagagacaatactgccgccttgaaaatttaggtggaagaatacggtgatattagagacaaataatacatatatattagagacaaataatacgtacgtagagagattaaaagaaagatgaataagaaatagtgtatactcatctgagtgtggatatgtgattcagaatttcatgtataaactaaaaacagtacacaccaccatccaggagatctggtggtagcggtaggccgccacggctgccttggcttgacatatatgaaatcaaatcacagctgatggtgaaattaaataacaaagctgctaagatcgagacgttttaatccttgcggcatcaactggagactgacggtgaaactaaataacaaagctgctaagatcgagacgttttaatccttgcggccggcatcaactggagaaagggagtagatcagcgcatcgctaaacacctagatctatactcattctgtcgagcggaaagggagtagatcagcgcatcgctaaatacctagacctatactcgttctgtcgagcggagccagacgatgccgtttcgtggtcctgcgacgccggcagggcagaagacagcaggccgatgtggatcacgccgtcgcttccgactcgctgtggacgccaaatcaacgatgtatcctgccctcatcgcatcgctgccaacccctccgaatatcgagctctccactgataactgatttatcgatcatccaatgagctggtatttatcgatccggttttccgattaccacgggttaattgagattacggattttttttcttgttaaaaatgaaaacgggtgactaaaatagatttttgctggcagccgacagtgccgccagcgaactaaaagccagtgaaaataatacattttcactaccggtcagccagccgccagggaaaatcgagtttaactggcgacatgttaagacaaccactagcaaaaataccatcttcgccagcggcaagttaaagatgaccgccagtgaaaacattttttagggttaaaaaaaattaaaaatcagcgccgctagtcgccacggccgcatgcactgcccattgacgaaccccaccacggcggctctcttgccactgttggtcgccgccgtcgaccctgaagaggggaggttcccctgtgccacccactatagatctagagaggagatgagctagacttccctgcgccacctcactctcccgagctcggctgttgccaccggatcagtcacccgcaggagtccccaccgctggtccgtatcctgcccgagtcgccacggccaccccatcccctttgccgccgccaatcgtcactgctgagcccggagagacgatactcccctttgtcaccccactccggaaatggagaggggaggagctaggctcccctacgccaccccactctgccgagcccgtccgccaccaccagatctgttactcacgcgcgggagttgctgccgccggtcaccgccaccacccctcctctttgctgccaccgaagccgctgctgctggacccgccgccggttgggagggatcggaggaggagaggagtaaggcggtggtgcgccggtgaggaaggagaagaggagaggtgtcgatctgaggagaggagaatgtggagtggatctgaggatttttgctgtgcgtggttttttaatgcactgtgactgattttttttatgaggcggtggattttaaaggcggtgctctttagtgaccgccagcgctggcagtcgcttaagagatccgcttgtaaaaatatcttaagtggccgccaacgaaaatcgatttttgctggcggttggtgtccgcaatccctcttaagtatctttacaagcgtgcatttattaaatccgccagtacaaataaaagggtggtgctatgaaaaatggtttctattgtagtgacggtaacaaaatacataggaaacttgattgaatactcgatcaatccatgacaatatatatcaggataacacattgacacagcgacgcccggttctttttcattaagatacatattttacctcggtttccattagcacactttttaaacagctaaatggcatgtttcgtgtgaatattttctatataaaagttgctataaaatatcaaataaattcaatttccaaatttgcaataattaaaacttaattaatcatatgctaatagctttttgtttttcatgccttacttaatattcattttcattagtatcaaacaccactcgagtccctcgcaaaccacagccctgctcaatcagttcccccgcatgtccacttacaacgcccacgttaagtggcctaggagatccgtgcggcacacctcactggtgatggtgctgctagcacgactgccatggggcatgcgatagcggcggcgtgtgagaaggataaccaagcgaaatactgcaatctgcagttgcgatggctaggggtgggcagaaaaagaccgaaccgaaaagaccgagaccgagaccgagaaattcggtcatcaattcggtcctaggtagtgaaagactgaattttgttcggtcaattcggttagtctcctcgggtaaccgaatagaccgaattatcaaaaattatctaaaaacaacctacaatccactatgtttaataggattaaactctaattttcacatccctacttcttctaggcatgcaacctaataagagtctttactcataaagtgcttacgaattttttttgtgatttttgtgttgaaaatttccattatttctttgcatatatgaaaatgttgttgaatttcggtcaggaccgagaccgaatttgttggtcttgatattttttcactgaaattcggtctttatttttcaaagaccgaaaagatcgaaagatcaaagaccgagaccgaaattttcggttagaccgaatgcccacccgtagcgatggcggtcaagttctacatggtcgaagttgtctcgacataagttatcgtacactcttgtcactcgcactcctcctgcacaatttgagcttcaatttatcgatgtctttgtggtgaaatcccgtggttctatctaatgattttatttgaatggattagggtccaatttactgacaaattaaagttttttcaccttcatgcttaagttgggaatttcagaatggtccagactgggctaccccgtccctctacacttatcgcacagatatgaccgaaaaaggactatgggagggacaattgggacaaacatcctaaggcccggtttagttctttttttttttttccaaaaacgttacattgaatcttgggacacatgcatgaagcattaaatattaataaaagaaaaaaactaattgcacagtttgcatggaaatcacgagacgaatctttttagactaattagttcatgattagctataagtactacagtaacccacatgtactaatgacggattaattaggctcaaaagattcgtctcgcggtttccaggcgagttatgaaattagtttttttattcgtgcccgaaaaccccttctgaaatcgggtcaaacgtccgatgtgacacccaaaaattttcttttcgcaaactaaacaacgcctaaatttgttaagcggctaaatatttagtactccgtagtttctaattaatccgttgcaacggacattttttcttcctcttaaagctacgggcatatttctggtcctcttaaagcaatggtcgtattttcgtcctaaaaaaaagaaagtaaaaaccttttcctctctctctctcctctcctcctcacgccgcgaacgcggatgcggccaccacctggccctgcgccggcgcggcggcggcggcggcggcggagtcctcccctcctctccctcttcccgctgtggggttcctgcaatctgcatttggtcagcaatggcggttctagccgctaggtgaggatctattcctaaatcctaaccctcccaccatgttcgtgaaagggtttttgggaaatgagcgtttaggatggtcgaattagagtactcgatttgactctggtagaaaaccctagaaagtttgcttccaaatttgctcttattttttcttgtgtgtgtgcgtgtgtgcatgtggcagaggaaatttaggaggttggatgtacccagatttggtattttctggtgctttacctacatcggtgccaaagttgtaatccaattttgaggccttcaggtgttgtggtatgctaagagcttaataggtatct

SEQ ID NO: 36750 - DNA, 726 bp, Oryza sativa
gaattagagcatttgatgtccttgtgctagaagaaaatgcaaacacagtattcatgaggctcttaattttgtatcacaatttattgtcaggtttagctaaacaatttgacttttgattgatgcacagattttgtctgaatttgatgtgtatgcagtggttggaggtaacagaccccttcatatgcgtgatattagggtaacagttgagagtgacggtgcctttgtcataaacttcaaaggagtaaggggaagtcccatggtttgtgccatttgtattcgaaaaacggtagcaatagcaggtaagacacaatatattagattcaacttactccttcaaggtctaattttcagataagatgtttctgtatgctcaccactgttttacattcctgacagaacaagtccttgatagacaagctgatcaactgagaagtgtttcccaaaagtacgaatatgccaataaattatgggcagctgccatatctaacttggaaaataaaatcaaggtaaaagcagatttactgaattgataaatacatgaggtgctatgttttactaattatatcactttttaattttcaggtcatgaaacaagagcaaacattgctatctcttgaagcaagatggccatgcaaacgctgttcctgaaccgagtaagatggtaggagctgttcaagcattaggttatatccatcagttgcattattgtaaaggttttagagtatt

SEQ ID NO: 36751 - DNA, 597 bp, Oryza sativa
agtcctaacaccagtcttgaaaatatagaatggtcaatcaaacatgacagaatcaaacggacaacttgaatacaatgaacctatttaactgtcacgagaatgtactcgatatgattttttttttcttttggaagatactttcagaaattaaactgcagacagttggtcatacaatccccaattcctacaatctcgtggatcaatctaccataaaaagcagcaacaatgaggagaatggaatatcatactgaatacgctaataaagataacataaacatatatgcactagccattcatttgattcttgtaagctgtcattcattttatttttccaaagttgaaaacatgattcttacactagtgtcatttttcgatacacaagtaaacaaccatgaactatgattgtacaaaaaaattaactcggaagataccctacgcatcctcaattttgagtagcgtgctgcaacatcaaattaacttgcacttgctgaattcaggtttcagtaaagtaaagatccatcatacacttgacattcaatttagcccctagaccacactacacatctcattggtcatgggagaaacgtaccagctaga

SEQ ID NO: 36752 - DNA, 859 bp, Oryza sativa
  unsure (1)..(859): unsure at all n locations
aattaaatttaccgaccaatgttttgtgtatgagcgtcttctctcttaccgacttcgatcagtcagtttgtagagtcatacactctccctagcccccagccttgtcgtcggagaatcgttctcggaggataaggctcttggacccttgacctgccttggttgaataagcactgatcctagcccccagccgtgaagttggaaagctcagtttccgattacacggattggttaatacgcacggcgagaactcttacactaccagatcttacatggtcttttgtctctacaggatccgacaaggccttatcggctctgggcgtccccagccgaagatcctttaggttcctcggaggcattgtcaagacggcgtaaagggacaataggataggtttcaacgctaggtgtcgtcgtggtaagggatctctgggtaaaacacttggcgatattatgtacctactatcaactttgttgaggtagaggtagtaggagaaatcgctacaccgttggtcgaggaccaggcagtagtcgtaactcgaccacttgaagtggaagtagccggagaaacgctacgtcgctggtcgaggaccaggcagtagtcgtaactcgaccacttaaagtagaagtagtgggagaaacgctacatcgctggtcaaggaccaggcagtagtcgtaactcgaccacttgaagtggaagtagccggagaaacacgtcgctggtcgaggaccaggcagtagtcgcaactcgaccacttaaagtgaggcaagagagatcactatgttttactggttcgagaaggannnnnnnnnnnnnnnnnnnnnnnnnnnnnnnnnnnnnnnnnnnnnnnnnnnnnnnnnnnnn

SEQ ID NO: 36753 - DNA, 484 bp, Oryza sativa
  unsure (1)..(484): unsure at all n locations
nnnnnnnnnnnnnnnnnnnnnnnnnnnnnnnnnnnnnncttcctcgcgcactgcaagagatgaaaacaatttaacaccgtgagcaaccaatcaaccgccaattagagaaacaaactagtgttcagttgattcgatacatacgttggagtaagcagcagagcggaacttcttgatgccgccggcaggtcggaggtcctcaatgctgtagccgaggggagcttcgtacatcagggaggaacgactactgctagacttctttttgccacccttggactccattagtgcatcaatttgttgactgcagagaagaattaaaaggatcgatgagaatctgcaagactaggcaatgcaacagattgtctgatcgtcaaagtttcaattactaaagagatacattcatgtttcatcaaccgtatgaactggagggaannnnnnnnnnnnnnnnnnnnnnnnnnnnnnnnnnnnnnnnnnnnnnnnnnnnnnn

SEQ ID NO: 36754 - DNA, 402 bp, Oryza sativa
  unsure (1)..(402): unsure at all n locations
gaggagggctaccctgttgtcgactacgagtcggaccttcagaccgccatgtcgacaacagttagataggctacctcaaatattgtactggtgtgattaccatgaataagagcaataccggcttcgaccaacaggatgtagggttattacctgacaattcaggggcccgaacctgtataaaaatccctgtctccatctcttttaccttagtcttgcatatatcctagcaccgacgatccccataccatgcaaataccagaattgtgacatcaaacgtcgacagtggcgcgccaggtagggggattttggtgcttcaggatttcgacgagatgggttcaaaagatggattctccaacaacaagnnnnnnnnnnnnnnnnnnnnnnnnnnnnnnnnnnnnnnnn

SEQ ID NO: 36755 - DNA, 740 bp, Oryza sativa
atccagagcagttttgtcctacgtggggtaggcgtggcaacccagtcagcatttcattttttaaacatggtggggcccacctgtcattctcttccatctccctttcctcttcccctcttcctctttctttctctctctccgtcaggcgcgcacgccgggtcaagcgcgagcgcgcggttgcagtcggcgatggcgtcggctgccttcccgaaggaacggaacacctcggcacggccgacgaggcaggcagtcgcgaacgggtacgggagcccgccacggcacgcgtcgagcaccttggagaaatggcgcacggcctcggcggggaggtccgcgtccagcgccgccaccgcggcggtgcgccggcggagcgggagcttgacgtgcgcgaggggagctgcgacacggactccgcctcgcttcccgccgtccctgacgctgcgccggacttggaggctcttcgcctcaccggcgcggagataccattggccgtcaggttggacggcagcggccgggtctagagcagcgcggcggcgtcctccattaattcaaggtggaagcgggagcttggcccaagtgtcggcgcaggtgttcttggagaagccggcggggacgcggtgcttgggctcggatatgtcgaagcttcagaggaagcgggaggcagcgtcagagtggtcacaggtaggcgagagcaggtcggtgcgggaggcgacagcgaggttgcttgagccggaggagcaaca

SEQ ID NO: 36756 - DNA, 3463 bp, Oryza sativa
  unsure (1)..(3463): unsure at all n locations
nnnnnnnnnnnnnnnnnnnnnnnnnnnnnnnnnnnnnnnnnnnnnnnnnnnnnnnnnnnnagtactatatgaatagtctggctggctgcttcacaaagtaacagagtgatcgctactggagttttgagtattctttaatcttcagtgcgcttccctcatcagcagctcctcatcttcttaccctctgtgccatctatctcctcgacagcatcgtcttcccagtagagagcctccattttaccagctttctccgtgttttcatcagcaaagcaatgcagaacagatcgtggcgacccggtggcgatttcagcagtagcagtgaagctctggtaaatgagcaaacccccagaaggcagctcctgctcaaccatgttgctgcaagaataggccccgacatccagccccttggcccaggtccctgcatggttgcggccaccaaagatggtaaccgcaacagagaactccaacgggccaaagcatctcaacaccctcttgacaaggtcaccataggcaagggaagcagggttgaagcccatgacctcgtagctggcatagctgaagccatcctcaggagtcacatgaatggttgagaaagcagggccgtggatggcattcatggagtagccgcagggctcgaaatcgaagtcgcagacttccatctctgggatgatgtcagagatacctgagagcttggtcatttccttagcatatgttgtgtgtccatcagcagaagtcttgaagaagacagaagctttcttcttgtccagcccagtcatgcacatctcaagagtgaccacaggttgctccgggtgctgggtggcatagtagacatgccacttctgccctggctttgcaggatctccaatcacgtatgcgttgccaccagatttgagaccgccgaagtagcggttcaggactgcaacctcctcagagaagttcttgtgtggagagggctgtgcttcaggaaaaatgaatgtcccacgagagtacttcacagcttcaagtggcagagatagctcttcagcaagctcaagaatcctcggaatggcgagcaggagcttggtagtcccacaggtcttgatcacaatcttgtatgggtacacaaagaggctcgattcagaaaggacatacgagtcgaagacctcattggagagctcagacacaatggtgcacctcgccagatcaagaacagagtcaatctgagcacgtgacagtgcacgcaaccccctgccattggggtcagcaaagacaggcgcctcggagaaagtgatctcgaggcgtttctcatatccctcaaacccgatcgccgagaccggtggagagtcagcaactgacaggactgccattgtttcgaaggacgatgccagagatgaggaagaaaggaagcaggactgatgaccttcccggtcactgggaagcagctagccagagagatgtaagaaagcccaaaacgagaattcagaggagtaactaaactactaggtcaaggtagccaagggggctatcaagagggcttcctcgcgcactgcaagagatgaaaacaatttaacaccgtgagcaaccaatcaaccgccaattagagaaacaaactagtgttcagttgattcgatacatacgttggagtaagcagcagagcggaacttcttgatgccgccggcaggtcggaggtcctcaatgctgtagccgaggggagcttcgtacatcagggaggaacgactactgctagacttctttttgccacccttggactccattagtgcatcaatttgttgactgcagagaagaattaaaaggatcgatgagaatctgcaagactaggcaatgcaacagattgtctgatcgtcaaagtttcaattactaaagagatacattcatgtttcatcaaccgtatgaactggagggaaatttcagtaattcgttctgactatgactattatttgcaaaagcataagaaatttcagactcaaatagcagattgtcttgtcatcaaaatcttcgttgcttttgagacacattcatatttatcaaccatatgaactacacaaaaaaatcaccaattcttttggactattatttgcataagcataagaaaattcagactcgaatcatataaccaaagtcttaattcctttacattcatgtttcatcagacatatgaactggagcgggacaattatttgcatataacataaaaattcagactcaattgaagaatatttcaatcagccacctgtggctaacagaagagatgagatcgaaaatttcgactaagttttgacatacgaatctattacgatatagataacttatcatacatcgagcacaaggggatctactcagcaaaaaatcataaacagaataacacgatatagatcagaaaagaaaaatatgaattcagaattaccattcacaagactgagtgattaaagattatattttgacgccaacaaaggaaaatacttctcctaccattcgtaccgaaaataactacttttcatagatcatctaacatactagatcaaacaaacaaacgaagtactagacagaacatcaagaacaggtcgcgcgagatcttgcaattccttaaacaaaggaaaatacctttcctaccatccgtaccgaaaacaacaactagtcttcacagatcatcaagactatagatcaaacataaaacaaacgaagtaactaggcagaagaacaccaagaagaacaaacaggtcgcgcgagatcttacaatttcctcggaaataaagttacgattccccgctcctcctcgtcgcagatcgatctcgaaccttcagggagaagaaaaagatctccccctccggaaaatcggcagcgctcctctccctctctctcctctcggtttctctcgaccacgagacggggaagagaaacaaagtgtatgggaataccaaaacgaaaccaaccaaaagatgaggctgagaaggggaggccttcccttcgccgtgtatttatagtggggtggtggtggaggccgcgggggaggaggtctcgcgtgcaaaggcgtggttcactggacccgcgccgccatgtggggcccacctcgcgtgccgattccaccgccgtgggggcagggggaacccggggtgggctgtggaccgcgtgcacggagttttcctttttttttttcttcttttcttctcttgccttccaggctggctgggctggcgggctgattctggacggctccctctctcggtgggtatgacaggtggggcccgcacgaggtgctgggcgggacgcgtggacaggggcgcgtggaaacgctcgcgacctcgcgttcgctggatgcgtcgacgagtcgtgggggaaaagaattgatgcttttttttttctttttttgcgcggctatttcggaggagtccgtagtataaaacgtgttgctggatgacgtgcttattttttttttagagagagagagagggagagagaatttttt

SEQ ID NO: 36757 - DNA, 9850 bp, Oryza sativa
ttttgaacccccccccccaccaacttgtaaaatcggttaaattaggccctccgacggtatagatggctggtttcgctgatatgacaaattgatccgatccacttgtgctgactaggcgtttgcatgggaaaaaaaaacaaaaatgatcccacatatcatgctcactcttctctcatcctctcccccgcccccaattttctccccatctactgcaagcaagcaagttttaagcagtttacaggttttgttatagcttgtaggcttcaccaacaccgcacacgacgagtgtcatggtcagtttggtcccgaggacgacacgcacgatcaaggggatgccgacgcatgccgcagtggcagcgcaagcggtcaaacccagacacgtcacgagggtggggggagaaggtggaggtggatgcgttgtgatcggcgaaaaggggatggagcacgacggtagactgcgaggtggcatggccgaggatgacgaggacgcatccgttctcacgggaataggaggagtgcatcatggcacgacacggaagtcgtaggcaatttggttctagagtatggcggcctgccatgctttgcgtggtagtgggctcgcgttgttcctgccatggactccctcatcgcgagcagatagaaagaagagtttgtgtgtcgttattgaggcggcgatcgcgataccagcatccaggctcgattggcttggcggcgtgatccttctagctgccgtttgccagagatggagagaaaaaggcgagagaggagggggaagagtgagaatgacatgtggggctcatttttcctcatgtaagcgtttagttagcacaagtgggtcgggtcaacccacctgaaagtgcatctaggacccctcatttattttggtgttaatgacaacacaattagagggtaactaatgctttttgttgagatgtatgcaaggatgaaaaaggagtggatgtcaacacaataagtattgcggcatcttttgtggtaattgtcttctaatccatgtatatcttgtgttcttgagtattaggatgtcgtactattaagagggatgccacatgcatataattggtagaacactagtgctcaaaatcatttatttgaagtattcctgttttatgtctgtcggactatccgatgttcagactatccgatgctcagactatccgaaatttcacagaactttgctcactgtcttgggtctgagtgttggctaaaaaatatcggactatccgatataaggtcggactatccgatacgtcggactatctgaaatttctcaaaacttcactctctgttttgaattgctttttattccttttgagtgagttttaaatcagactatccgatgtgatcggagtatccgatgatccagagactccgaaattcaatggaacttgagtctctgtgagaggatgaaattcttggttcaaaaataacggaatatccgatatgacatcggactatccgatcgatcggattgtccaaaattctccagaatttcgttctctgtctctggcctgcttggggggtcaaaaacatcggactatccgatgtcacttcggactttccgaggtgggatgaaaagattctctcccaacggccacattttgagggcttctataaataccccccacctaacccttttctagggttacccaactcatttcattctcattcactttgggttgagcttggtgctaaggtgctttggatctttgagctctttctccctctctcaaatccctccttgttctttgtgtggtggatcttggtggttgtggatttggggtttgagggcctagtgtgtgtttcactcgatcttgagcactagggttgaccaagagttgtgtggtgtttgttactcttggatgttgaggactcctagacggctaggtgtcactcccgagccaccgatctacgtgtggttggccgggagaagtttgtgaaggccggatctcgcctccacaaggaaagagataccccttagtggaaggaggagtgcttagtgcaacctcttgaggaaagggttagcaaagacccggctcttagtgagctcctcaacggagagtagaatcccctcaaggatttgaactccgggaacaactcggtgaatttcattgttggtgatatctcttctcccattatttagctttgcttttgtgccgctatagatctagtcgctgtttgcgccatactcttgtttgtgcactagatcttcttgtagtgttcttttagtggatcagacagtctgatccaacatcagacctatctgatattttcggatagtctgactgttgatcagactttccgaccctaactcagttttagtttccgcataaagttttaaattatcctattcaccccccctctagacctaattgaccctttcaattggtatcagagcataatctcctaattaggcttaaccgcttggaagcataagatgaagatgcatttgaagtctattaacccatctatttggagaatagtcgaaaaaggttatgttttgcagaatcccgaagatcccaccaaggaggacgacgagaatgagcacaagaacgctcaagccgccaatgcaatacttagtgccttgagtggaagtgagttcaaccgtgtggatggcattgagagtgccaaagtgatttgggacacgcttcagaacttgcatgaaagcacggatagtgttcgtgagtccaaggtttagatcctcaaggggcaatttgagagatttgtgatgttggatggtgagagcccaagtgacatgtatgaccggttgagcaagattgtcaatgagatcaagggacttggctccaaggacatgaccgatgaggttgtggtcaagaagatggtttgagccatcactccaaggaactctaccttggttaccatcatttgtgagcgtccggactacaagactctcacacctcatgatttgcttggacacattcttgcccatgacatgcttgtgcaagactccaaggaggtcatccaatacatcaaccaaagctcaacgacaagcatcaagaagtaagacttggcattgaaggcaaaggaagaagaagaagatagccacaagagcaagagcaaggaggagatcgatgatgaagaaatggctctcttcgtcaagaagtttggcaagttcatgaggcgaagcggcttcttcaagggaaattcttccaagcatcactccaacaagtcaagtggaagacattctgcaagagtgtgctacgtgtgcaaagagcccgggcacttcattgcggattgccctcacctcaaggatggttcccacatcaaggaagataagaagaagggtgagaagaaggatgagaagaaggagaagtataagcatagcaagcgggaacattatggccaagctcaccttgggatgattttcggctccgactccgagtcaagctcaagttatgaagaaggagtcgccacattcgccgtcaagccttcatcaccgccaagactcttcgactactcaagtgatgaggatgctcccatttgcctcatggcaaaggagcctaaggtaccttctcctcccaaatcatttaatgttgatcttgttagtgatgaggaggatgaggttgaggatgaggttatggatgacaaattgttcaagtccataactaaggaatctctaccacacttgagtgagttgcttgggagaattgaggaccaatatgcaactcttgagaggcaagaggctttgctcattcatgagaaagagcgatctcatgaactcaagagtgagcttgctaaggagagagagaaaaatgaggctttggcacggctttacaagcaaaccaaagagtctcatgctaatcttgaggtggcgaacgctcaacttcaagagagagtggatggcttggacaaagcatacctctctcttgaagagaagttcgaaaccttaaagaatagtgtctctctccctagcgaaccgtcttgttccaaaattgttccaagcaatgaatcatgtgtgagatgcaaagatattgatattgaagcttgtgctactaactctatttctttgagtgctttgcaaaagcaaaatgagaagcttatgggacttcttcacaatggcctacttaagtgccatatgatagtaaggccctaaaggagtacctaggctatcaaagggacaacttcaaccatgagggtcttgggtatgttcctccaccaaaaggaaaggtggacaagagtatgatgataaagaggccccaaggttttagcaattttgttaaggcaaaaagtatccttcctaatgattctgcttcacattgttcttttgatgcatcttatgttcttaggaagaatgctagtggtcgtgttgttgctaagtatgtaggaccaagggacaaaaatttttccatcaagagagttctttgggtgcctaaggcacttgtcactaacatgagaggacccaaacaagtgtgggtacctaaaactagaaattgatctcttgtaggaatatctctccggtggaagaagttgggtgatcgatagtggatgcacaaatcacatgaccggagaagaatcaatgttttgctcccttgatcctaatggctcttcgcaagagaacatagtcttcggggacgatggaaagggaaaagtaatgggattgggtaagattgcaatctccaatgacctttccatttctaacgtcctcttggtaaagagaatgtctcttactttcgtgttttcggtagtaagtgctacattcttaataagaaggctagatcctcaaagtttgctcctaaagttgatgaggggttcttgcttgggtatgtgtcaaatgaatgcgcataccgcgttttcaacaaaacctccggtattgttgagatcgcgcgtgatgtgacatttgacgaaactaacggctctcaagtagagcaagttgactcacatgtgttaggtgaagaggaggaccctagcgaagcaatcaaaagattggctcttggagacgtgcgtcctagggagccacaacaaggggtctcttcctcaacacaagtggagccacctacatcaacccaagccgacaatccctccacttcaagcttggatcaaggtgaagaaggcgagcaagtgccactctctccgataaatctagctcacccaaaaatccaccaaagtatccaacgagatcaccccaccgacaacatcttaggagacatcaacaagggagtatccactctttgcaaatttttgtgagcattactcgtttgtatcttctattgaacctctaagggtggaagaagctcttaatgatccggattgggtgatggcgatgcaagaggagttgaacaatttcacccggaatgaagtgtggactttggtggagcgacctcggcaaaatgtgattagcacaaagtggatcttccgcaataagcaagacgaggccggggtcgtgataaggaacaaggcgaggttagtggcgcaagggttcacccaaatcgaaggattagatttcagtgaaacatttgcgccgatagctagacttgagtcaattcgcatattgcttgcttttgctactaacctcatttttaagctatatcaaatggatgtcaaaagcgccttcctcaacgggcctatcaacgagttggtatacgtggagcaaccaccgggcttcgaggatccaaaatatcccaaccacgtatacaagcttcacaaggcactctacgggcttaagcaagcccctagagcttggtatgagtgtctttgcaatttttttgtgaaaaatggctttgagatcgggaaagccgattcaactctttttactaaaaggcatgataatgatatttttgtgtaccaaatatatgtcgatgacatcatatttggttctactaacaagtcttttagtgaagagtttagtaggatgatgaccaaacgttttgagatgtccatgatgggtgaattaaagttcttcctcggccttcaaatcaagcaactaaaggaaggaaccttcatttgccaaacaaagtatttgaaggacatgctcaagaaatttggaatggagaatgcgaagcaatccacactcccatgccatcaaatggccacctcgacctcaacgagcaaggtaaagacgtcgaccaaaaggtataccgttccatcattggctcacttctttacctttgtgcatctaggcccaatattatgcttagtgtgtgcatatgtgcaagatttcaagccgctccgaaggagtgtcaccttgtggccgtgaagagaattcttagatatttagtgcacacacctaatcttggtctttggtatcctaagggagcgaggtttgatctcattggttatgccgatgcggattatgccgggtgcaaagtggataggaaaagcacatcgggttcttgcaaattcttgggtaggtcccttgtttcttggtcttccaagaagcaaaactccgtcgccctatccaccgccgaagcggaatacgtttcggcggggagttgttgtgctcaacttctttggatgaagcaaaccttgagagactatggcctaaatgtgtccaaaatcccactcttgtgtgacaatgagagcgccattaagttagccaataaccccgtccaacattcccgaaccaaacatatagatattcgccaccatttcttgagagaccattccacaagaggcgacatagatatccaacatgtgagaaccgacaaacaattggcggatatcttcaccaagtctctagatgaagctaggttttgtgagttgagaagtgagctaaacatcttggattctcggaatgtggcttgatcttttgcatgcatttgtttttcatttactagaataggtttgcttgctacatcatgacaaagtgaacattcaattcatgaataaacactagtcataatctatgtggataacttgaatctatgtgtacggggatctcattctctaatgaatcttggtccttgcacaatttgctatagattcgtacattccctctctcgagggtgcctagtttttctttcttttgctgcatttgtccaagtaatagtctagccatcgagttcatcctatcaaaatgttgttgaaaaattcttccttgagccatcctttattgtctctgccacaaaggatgtcggactgtctgacatcaagtcagactatccgaccataatcggacagtccgatttcaaatcggactattcgacgtggggccaagggcaaggggacttaacctccctaggggtaactctttcttaccccttcagtcatttgtctcagtcgtttctctctccacccttcttttccactccaaaccctagttctaggccaccaaaaatcttcgtttcggagtctccgattgctattccttcgctttagggtggtttccctccctcaactccttccaaatcactggttccccagtgattctcttggtggttcttgaggtatttccttgtttttcctcgatctccctcatgatgtattatttcaagatttccttcggcgaatcttcttgttttagtgtctagatctagtacctacaagatcctttgattctattggatattcttgtgtgaatcgagatttgttggtctagggcaaaaggtcgtcggattgtctgatatgccgtcggatagtccgatgtacatcggatagtccgacgtcaaatcagactatccgaccttcttttggcccagtccaaatttctccttgcttcacatttaagtattcttcttccacttcttcttaatctttatcctctgttctaaatcagtgtatcctcatgatcaggggtcagttcaagaatcaactttactctcgccgtgggtcaatgagttctcaaggtcgctctccctcttccaaggctcgtcatgctatacggcgtatgtccgaatcccgcaaagatgccattgacgcgcaagctcaagcctctgaccaagcagctcaagtggctaatgtggagtgtggtgctcctcttcctcttcgccgcagccgagtcagtggagaaggatcaagtgcacctgctagcaaagtaaggagaggcaatcctacggattcttctgagccgggtcacggtagtggttctcatgcaccatcctttgaggaagagattcagttagaagaggacattgccgctcagcaagctgctcaggaagaagggcctttctttatcactgctccctctagagatcctaattatcatcgaagagtcgtaaggtggaaccgcaagtggactgaagtggagaaagagtgtaagaaagatccctacaaatttcaacagttgtccactgatcctcggttttggaacctttttcagcaggattactatgagatagtgattgcacctaagaagggggctattcttatgcagtgggttgattggaagtatatggaggagttgcatgatccaattattgatgaagtcattgaagcttgtgctcggcaaaacttgaaggaactcatgggcttgcaatacccatggtgcaaggaaatcatcgcacaattctatgccacagtttactttgagcccaacaaagaaaagactattcattggatgatagatggcatcatatactcagtgtcatatgccaagtttgctgccattttggggtttccggctccaatcgtgtcaagattcatgatgagaagcccatggacacaaattctcttcacttcttgtaccaagatgtggactatgagttaggcaccatcaaaggtctccttcccttctatgcctatctcaataagctcttgcgcaaaactcttaatcccaaggaaggtgatgctagcaacgtccttgcctatacaagaaatttgctttacaagatgaaggctcacccacagctctttgacgcctttgacttcatctttgaagaaatccggcttatctctatgatgcctaagcgaggacttagctatgggccttacattacgaagatgattgagattgtgtccaagaagaagtttcacaaggaggtggcacataccggttaccaagtccgtcccatcaaggctgctgttgtgccggctggacgaaccactcgtgcttcttctcgtgccggtcactccgctaccgtcaccaagccggactccaactcgtccttgaggttcttcaagtccatcttcaacttatgcaagaccatctcagttcggcaagccaaggaacgcagagcaaggaagaaggacactcgacggctcaagaacctccttcgcaacgcccatttgccgtgttctcccgatggttctgaggttgaggacagtggggaggatgtgattgaggacccttttgcagctgaggcaagctcctctcatgcggatcgtggcaaggctcctatggaggaagaagaagaggagaaggaaggtaatctatctcctttcgtgaaggctagtcgaatcttgggcttttgtgtcttgttatgtgcaaatatctattatccatgctcaaatgtgtgaaatatcttgtcattggcatatgcatgaggttatattgtcatttctaatctagtgcatagattgagggggagctctcctatttcatttctagcatatctttaggggagctccaccaaaatcctaatcttttattactcctaagtgtgttgtcatcaatcaccaaaaaggggagattgaaagtgcatctaggacccctcatttattttggtgttaatgaccacacaattagagggtaactaatgctttttgttgagatgtatgcaaggatgaaaaaggagtggatgtcaacacaataagtattgcggcatcttttgtggtaattgtcttctaatccatgtatatcttgtgttcttgagtattaggatgtcatactattaagagggatgccacatgcatataattggtagaacactagtgctca

SEQ ID NO: 36758 - DNA, 3789 bp, Oryza sativa
  unsure (1)..(3789): unsure at all n locations
nnnnnnnnnnnnnnnnnnnnnnnnnnnnnnnnnnnnnnnnnnnnnnnnnnnnnnnnnnnnnnnnntgaacttgcattaatttaattttatctccaatcagggctgtatggtctgtaagcaaaagatgtttttttggcgttgtggacggtgtacggttgcagcacatacaaaatgtgcaccatggccagtaattcatttaaaagatgaccaaggaagtgctatctgttggaggcatccctctgattggctccttcaaaatgaggtctatccttttacccttaagattgaccactttatgttgctagatgccccccaaaaaaaaatctagtacaatatgatatgttctcaagattcaagaaaaaaatgggtgtaagattaaaactaaattgttggaacatacttttttctccttgggtgatgttcattttcatttttttatctgtgcaacaaagctattttgttttactgtatgctgcattattttaatgtcgatgacaattactgctttggatggatatcaaattgtctttatatataattattttctcacttgtgctcagtgaatgtaagacatgttttccaagtttctttcttgtcgctttaacctctcttctgttttaactcatcttatcctgcttatataatattgtttgatcttgctagaagttatttacagtattagttctttttctagaagtgttaatgcttttttataagtgaaaagtcttaatcttctttttttctccatcttatcataacattgctggtattcgctgggttcctaggctaagcaagctagtgcaatcacacatgaatgcatcaaagtccttttggtgcagctgtgacactgaactatcacgatccttattcatctttcactgattcgtttccggaattggtttgacttcatcttctctataatttttggactcctttcaactacatgaaatgattgtgacactatggttccgttcttattaataaggttcatgtgtagcatcattttttctattacttgcttttaaccgcaggttaacaaacttgtttcatggtttcaagcccaatgctgatgtctccattacattcaaaattttatcctaatttggattgtgggaaattaataaaaccataaaaggttgctgtttaagctaattcttttgaagaatacttcaaatagtcatttcatatgccttcttgtaatatttgtaatgtttgaagtgtctgacaggactactttgtttaatggtggcagaatgctgacttgacgaacagcatagaggttagtgttttgtatgatataactccattcttgctatattctcttctatatttgtttcaattgcttttagataaagccattgtgcacatttcatagctagtcaccttggaatacctggatggttcaattataggcttctgggcatgtttctcttgtttttttggaattctgctaaagtagtgctccccctatgtcacaagacaaatggtattttgggatgtgaatttttgcttcttttttttttacttcggctgatatttgtgcagctatatataggatgccacatatttttatgttcatttgtaattttagtacaatatactcctgctctgaaatgtttaatgttggttagttcatttgaatgaactaacgtcatacaaaaagaaacagagggagtattataaaaatttagttagcgaggctgtaatgtaacttggagacgaaaaagatgaaaacatcagttaatttatgccaggagggctatttgaaacttgcttttactatacacctaaagaacatcagcagtgcaattgaaattcacgaagattggcgaggagcatatttgttacactaatgctataaacccttgtaaaagtatttcagtgttatctcattcaaacaaaaaaacattttttttcttcagaagatgaagtgtgttgcctgtgaaatgtttcttcatggccacactgacatgtttgttctgtaggaagtattttgccgactacctgttccatatgttaatgaagacttcaagattgattcaaccatcagggatttcactgcagctgtctgcaaaccaccacactttacgtttatcagacgcagtatccttaagtaacagttatagaatgaagcctttagctattacattttctataatgaccttcgtctttgtctgcttttcatctctacatatcctatttgttttcttgatttttaaaagatgtatatttaatcaagaaaaaacgtcctgattctcgcgcggaagctgggtgcacaaactgcagtgctgattctacgtgcaaagatgactgcgaatgcaggtaaacagtcttactttgtcaatacatttcatacagaagttttcatgaaagctttagtttgattcgtgcacaaattcttcattgcgctctaaagatggcaccaatgtcctcttctaacaaaacagggtgcatgtctcagcatgtagctatgtcctctgttctttttacctgtatttttgtacattatgtatgctgggaatttaatgccaaatttatcaatatcattatcatataatgaactagtcttaaaatgttgaccatgcattcaaggactagtaagactggataccatttttccaatttgttttaatcaaatgtagcctgacatttgtttcttcaaaatatcattacgttacgtatgtgtgaaggttgccgttgttgttttcctatataaatctttatctgcttttgatagctgtactgctgtagctaatgctactgtagctgagggtgctttagcatcttttttgccactcatttcaaccactctcttctgccatccaaaaattgccactctctcgttaccactcttctgttgcctttttacatgtttctctgagttctaattttttcctgcactttatcaggggcctttacatgagttgttccaagaattgccactgctcagatatgtgtacgaacaagccattccgcaaggataaaaaaataaaagctgtcaaggtaattatgtcctgcaatttttttcttgatttcgttaaggacatcaattaccattacattcttccttacctgtgtaactctttcggcatacatataaagttgcatgctgtgatattatctgccgtaacttttcaaatttgtcaagttcctcatttgtcgaagagcctgtgcttttagctacaagttgtatcatcatggaacaactaacttactgattacattatttgaattttacctaaacttggaactgagcttcaaacgttgatgatatctaataacagaagtattgtgccaacgactcaaaagtattcaagtccacaaacctcctttgtattgttctttaatgtaaaatggcatatggctatgatagtgctgtttgaagttgtcatgccatcaaatgtagattactttcaccttctgttgacacctccgggcaccatcattcttcatttgttagggagaataagtctgtaactgcagcaactacttttctgtacagacaaaacgttgtggatggggtgctatttcattggagccattggaaaaaggtgattttataattgagtatgttggtgaaggtacaagttactctaccatttaaacttatattatacaaattagcatattctttagtaaactgtatgcatgtcattgtggagtcacattatgccattacagtacaatccaaatttcttgacatgaatatttcctgaagataaatttgaagcannnnnnnnnnnnnnnnnnnnnnnnnnnnnnnnnnnnnnnnnnnnnnnnnnnnnnnnn

SEQ ID NO: 36759 - DNA, 3662 bp, Oryza sativa
  unsure (1)..(3662): unsure at all n locations
nnnnnnnnnnnnnnnnnnnnnnnnnnnnnnnnnnnnnnnnttctgtacagacaaaacgttgtggatggggtgctatttcattggagccattggaaaaaggtgattttataattgagtatgttggtgaaggtacaagttactctaccatttaaacttatattatacaaattagcatattctttagtaaactgtatgcatgtcattgtggagtcacattatgccattacagtacaatccaaatttcttgacatgaatatttcctgaagataaatttgaagcaacttattggtagttagcatgaaaaagcctgtttagtcattgcatctgtttaacagaaaaggtacctcagctttagatgaaaacttattatattaatctgaaaattggataacgagtgtacattttgttcccactctattttataacataacatagctacgaagcctacaattatgaacaatggcagttcttgttgccacttattcttgtgaccttagctctttgtggtttttattttattactccctctgtcctaatatgtagctatttctagcagtcaaagtgcatcctaaaatgtagctatttctttacctaccttttcatctcaacccatcataaccattctccatttaatttcttcacctacttcctctgctcaaccaatcgcaacctttccccatttaattcaacctacttctcaagaaatgcttccattttgggacagagtatgtctccttcactgttttttagttgagttttatggcgctgtgggatagcatcgtattatatctttctgggtttgattcaaaggctcttagctattctctctataactaattacaacaacttaatgctatgctcatctgttcttttcaaatgcttttctaatgtgttttaaacattattccagtcatcaatgatgcaacatgtgaacaaaggctttgggacatgaaacggcgaggtgataaaaatttctacatgtgtgaaatcagcaaagattttacaatagatgcaacatttaaaggaaacacatcacgttttctgaaccacagttgtgatcccaactgtaaattagaaaaatggtaatgccatctttttggaacagaaaagctctgtactcggtgtttgtgaacagtatgaaatgattaatgttcctgattgtctatgtggcttgtccaggcaagttgatggtgagacaagagttggtgttttcgcctctcgttccatccaagttggagaacacttaacttatgactacaggtatgtgcaaacaatagtttttcaaactatatttttaaggatcctaagtattcttactgaaaaaggtataatgaatacattcttttgatatggagatatagttcctgcatagagaaactgctttcctgcaatcagctatggttaaccatgatttgaaatatatgcatatctagtggagtatatgtacatatgtaaattctggtgtgtgaactagaacctttgtactattattgtgtggcatgtagcttttacatccacattatgggctctgtgaatgactcggcaagaaagagagaaaatttacctcgttttttgcacgcatgcttcccaaactaataaacggtgcttttttggtgcaaagaacatatatacgaaagttacttttaaaaccatattaatccattttcaagtttaaataattaatactcaattagttgtatgctaatggctcacctcgttttgagtatcttctccttatcttttctcctccactcaaacgttgttcacttgcttcccacttcctcttctagatggtgaatttccaaatcatgcttcggtagcagaaacaccacgatttttttctgtattttcttatgaaaccaattagcatttgtattagattaaaataccgttattatgtgggagcgttgaaacggtgactattctcccagcccacacgaagaaagatttttttttcttccaggagtcttgtgaataataatgattttctatgagcaacagtaacaatagttcacgttccttttcaggtttgtgcatttcggggagaaggttaaatgctattgcggggcacaaaattgtcaaggttacctgggcaaccaaataaagaatcctacgcagcgtgctctcgcaattgcagcattggagaacgagtggcttgaatctttgaagatacaacaggacacctctgcttcaagacacaaaccgatgacacatttgttaccttggaccaactgtatagaggtaccatttaacttgagaagcaaacggaaaatacaccggatatgctggggatgcaaaaggaggagatcagccgttgccgttacatctccaacaagcatacaagcgtcagttactgaagctgctgctgctgctgctgctgcatccctgcccgctttgccatgaagtggcaatagctgaagtcgcttctcatctgtataatataggatgacacatttctcacatgaaattgatttttgaacgacgattcttttgcattgctcctccccaccaccaccaaaactccctgttgtaatttgttacaatattcatttgattacatagtttgtttaatttacagttgttcgctgagaatactcgactatctcatgtaatcaatgttgtgctccaactctcgattgcctcagccctcaagttgaggcgagtacatgagggctattattgtcttagagaatcttatactattattttgacacattccttctggctagtgacaaaatatcagaaacacggagaaggcactggtacagaagagtatatcagatttcaacattcattcactcaacatttctagattgacactgaagcatttcttcgtggaaagtaactgcatttgaaatagatcaaatcaacaaagcaggggtacctgtctcagtccctgttgcagaaccacttgggtcactgataggtgcagaacagtgataggtgcagaacagaagtcatatttgccaattgccgtagtgttcgtacacagaatcaaatcagcgtacaaagtgctcaattcattgcctgatagcaacaaatgcagtctcaatcgactcgaatcagattcccatgcaaatccaatacgcaagatgttttgacggtccaatagacatgccaagaagtacctatcatccatcacacaagggaagaaaaacaagcatcttgacaaagaaataatgtgccgcctcccgcctcccaccatcaccagaatactaccacacaaccggaacaaacaaagggagtgacaatgccgacattattataaaatgacttgtattatattcccaacattaaagtttgatattcggatacattttgctcactgtggcagacaaagcagaccacctagagcccttttattcagaatatatgcaagataataaagaacattggtcatagcatatactagtactatatgaatagtctggctggctgcttcacaaagtaacagagtgatcgctactggagttttgagtattctttaatcttcagtgcgcttccctcatcagcagctcctcatcttcttaccctctgtgccatctatctcctcgacagcatcgtcttcccagtagagagctccattttaccagctttctccgtgttttcatcagcaaagcaatgcagaacagatcgtggcgacccggtggcgatttcagcag

SEQ ID NO: 36760 - DNA, 648 bp, Oryza sativa
  unsure (1)..(648): unsure at all n locations
agtgttcagttgattccatacatacgttgaagtaaccacaaaaccggaattctttatacctccggcaggtcggaggtcttaaatgctgtaacccaaggggagctttcgtacatcagggaggaacgactactgctagacttctttttgccacccttggactccattagtgcatcaatttgttgactgcagagaagaattaaaaggatcgatgagaatctgcaagactaggcaatgcaacagattgtctgatcgtcaaagtttcaattactaaagagatacattcatgtttcatcaaccgtatgaactggagggaaatttcagtaattcgttctgactatgactattatttgcaaaagcataagaaatttcagactcaaatagcagattgtcttgtcatcaaaatcttcgttgcttttgagacacattcatatttatcaaccatatgaactacacaaaaaaatcaccaattcttttggactattatttgcataagcataagaaaattcagactcgaatcatataaccaaagtcttaattcctttacattcatgtttcatcagacatatgaactggagcgggacaattatttgnnnnnnnnnnnnnnnnnnnnnnnnnnnnnnnnnnnnnnnnnnnnnnnnnnnnnnnnnn

SEQ ID NO: 36761 - DNA, 5313 bp, Oryza sativa
  unsure (1)..(5313): unsure at all n locations
gtacccatttgggcaacatggaaagggatattccacatcgttttcggcctcgagagggaaatgcggccgtttccggtagaaaatccggataagattacaccgcagcttgcagatcgcaacgggagagagaggagaggagaagaggagagaacccctgcacgcaagtgcggaggaggacgaggagaatggcgtctctatcggatcgccgacgccgacgcgtcgacgttggacagccaagtgagaaagtttaagatcttaaaaagcagttggttggtttacgagaatttaaaaaaactggaagaattaacttctggattttaacttattttgtgtattttgtaattacaacttttcaaaaaattagatgaagaactagactgtttgagagagtttgattctcaaagaagctacggctacgactgcctgtaactcccaaaacaagtcctcatctcgacctgaagccatggaccgcgaggctgagcctagtatggagattgggtccggcccaacttagaaaggttagcccaatcggtgattgggcctcgtataatgtagcggaggatagtgtttgggcctttgggcggggcccagcagatgctcctcgaaaggttcggccactctccgtccgtcttcctcgtcggcacgctgcacagtacgcgcgctgctcctaaacccaaaccctaaagccgccgattcctctcctctcctctccacaccagctcgatcgcgatcggggtcatggccgccgccaccgcggcgccgtcgatcgacgaggccaaggcgaagagcgttctccgccaggtgtccgatcccgccttcttgttgtttgttcacggcggatttctcccccttttggcgattttgtttgagcatttatttttgggggggaggtttgagcttttgatttggtttggttgtcgcaggtggagttctacttcagcgacagcaacctcccgcgcgataagttcctgagggagacggtcgagcagcgcgaagatggatgtaaatgatctctcgcgcagtacattttccacgcggattgcttttctccggcgcgatgattgagtgctgaacttagcgtcttttttttttcttctcattttgttggaaatgtgcagtggtaagcttggctttgatatgctctttcgcgcggatgaagtcgcacctcgggctggacgccgccgtgaagcccgaaactgtgccagaggagacagtgctcgcagtagcagaggtgctacgtcgttcccagatgcttcgtatctcggaggatggtgattcctctctttcctcttaattccagttattcgtgattcactagcaacgagcacaaattgctggcaattgaatttcaaaaggagttggtaaataccagtgaaacatgtgaagtgtacatttttagataacgatgtaaagtgtacatatactctgctttgtgacctgctattcaatgttgtcaataaacttttgttttccttctttagtaatgataaatatgccatgttctcaaatacagtgttagtttgggaactagagctggtctacttttatgtgagttaagtttctctagtaaattggtttcttttttatcattgctgatttgctgtatttttcaaatgcaggaaaaatggttggtcgagctagtgagctgttgaaggcagatgaaatcatcaagcaagtggactcaaggacagttgctgcgtcaccattgccttacaatgtaaagctggaagatgtccaatctttctttgcgcaatatgcaaaggtgtgtccaagtactgaacacttatagtgcacaacaagcttgcagttagtttgaaatgaaattgaaatgtaatgcaaagagaaaaggtggcatggctaggctgcataaattcgattcaaagttcaacagaacaaaggaagttttttttctcgtgaacctttttcataattaggattttgagtatcatgaacataattaccagttatgcatgctggctatctggagcttttccagtgttatgattacatgtgcaatactatactgcaaatatcaatgaattaacattttcttggtgtacttgtgtctgaattgtaggtaaatagtgtcaggctaccacgccatatctcaaacaaaaaacacttctgtggcactgccttagttgaattttcagaagaggatgaagcgaaaattgttttggagaataatttgttctttgcaggggcaaatctggaaataaaactaaagtaagccactaacatatcctttttgcatgataatcatacatgtggaatgtgcagataaaatgcttgctttagtactatcaccataaatttctatgttaattccaatatattcccccctagctgtactgccataccggtaagttgttagttatcaaacctcatttcattgccaacattgctttcttttctattaagtgcaatttgaatgaaatgtgcgaaataagctgcattaattttgtacttcttttgtttagtttggtgtcagatcatgcaagcatttccctctagcaagttccttgtcttgcatgtttacctcttttagtgatacttgaattaatgatgcctttcacatatttgcgttcattctgttgctgtatgtgacattatgtaacttataattcgttgcctgaatcatgaaggaaggaatttgatgctgaaacagaatctaaaaaagaagcatatgaaaaggcacatcctaagaaggacgagcagaatgaagggtgacatttttacaggctgtctgttcaattacttttccttcctttagagttcaaatcaagaccattttcctggaatttgtgttgcagctatcctaaaggcctaattgtggccttcaaattgaagagaatcacggttgatggtggggtgcaacaaaactgtgcagacaatgatactgccactgaagaagaaactccaaagtccatgaagaaaacatcaactggggaatctgaagagaggactaccgtgaacagtgatatggaggaacagaagtcatcagacgacatgactgaagcgaaagaagtgaatgctggggaagctacagaatctggtgacaagtgcacagttgatgccttgctagaaagtgaaaagaagggtgataatgaaacatcgatcaaagatgacagaggcctctctggcaaagcgaatagtccaatctcaagggaagatctaaaagaagcgttcaaaaaatttggaacagttcgggtattttaatccacaccactttctagctttagtttttcttggtataaacaccagtaacagttctgtttaacattatggaatgaaaattatgaaacatatagcattcttctagattcaaatatggtccacagagagctcagattttaactcatgggtcatatggcattatctttgtactttcatttgtccttaaagatctggtgggatattaagcatgacgagttgtaaaattattaagatcaattaactatggaatgggaaatgcctgaaaatgttcttgatacacaccataaaatcgtggtaatagactaatagctagtcctaattgtaaattcatatttgtaaaagtttatttatggtccttggaggagcacagttatgaggtagtggtatgacataatgttaattatctatatctttggtacctggcatggctgtggtggtgaactgttcatattgtatgtcactatgtcacaaattcacatgacactttttaattccgttttttactttcattgcacatgtttttcttcctgaagtatgtggacttcagtatcggggatgaatcgggataccttcgtttcgaggattctaaggcagctgaaaaagcccgcatgtctgctgtattagctgatgaaggtggcttgatagttaaagaccacattgttaccttggagcctgtgactggtaattgacaatttgacatgtgtttattagagtttttttaataccattactgcttgcattgtatcatgattaataaatgtagaatatccattatagaaaatttttagttccatttaatgatacttaggtggaatcgactcctattattgtttgacgctgtaaattaattcctcaaatctggatgcaattaaattggtttgtggggtcttactttttttgtttttgcaggtgaagctgagaaggattattggaatacaatacgtggcattcaagggaaatacaaggacaataggagttacaaaggaaggtattcaatgaattaacagtttaattttatttgtttatgtcctgtttggtactacgtacaatattatctctagaagtaattgcagacaattatcaggaaaggcacactacagcattcagtaattttgtggcaaattagaccgaaataactttgtgtgccttttgagaatgttatgactttttcatttgcaattttcgagctagatgacctgcgctaattgcaatttatttgtgcattgcagtattgtggttaccacaaatatgctccttaattccttgtatatatatgtcgaatagatacttccttgcacgaaaattgatcatctcgtatgcccatgtttaatgttctctgcagaatataatgtgtctttgccccttgtcatatatatgttattgctctttttctaggactggaaagagctacagaggaggaaagcagttcaatgggaagcgaggccgacattctgattcctccgaaaagggtgcgaataaaacacagaaggtcgaagctgctgcttaggctaattttaacgtcttcactcgaccgagaagtaacatgctacgcttactatcggtggtcttgtatatttattatatcagagaccatttattaccatattttgtgactgttattgtccattttttatgctaaccttgttccaaggtatacttccgtaatgattagcctttagtaacggctttgccgtttacttttgaatggctttggaggatataaccttgtatagctccaaacatgcaaacccggagctgtttcctgcagcggagcagagcagctgtcctgacaatcttcagatatcttcaccgtcctggattgattacaaaacgattatttcatcattctaattacacaaaaaaaaggtttagaaatatggctgatttcaccgttctgggatttatactttggggcctcagctcatgatcacgagcattttcgtgtaaggtttgcttttaggcttttagcttccagagaagatgnnnnnnnnnnnnnnnnnnnnaccttcaaaaaaaaattgtagtagtactctggatacataatgatctcttaaggaataataccttggaaattattgttgctaaggtccaactgcc

SEQ ID NO: 36762 - DNA, 4812 bp, Oryza sativa
  unsure (1)..(4812): unsure at all n locations
nnnnnnnnnnnnnnnnnnnnnnnnnnnnnnnnnnnnnnnnnnnccatactgaatggtatactgccatggggatatattgttgtaaccaatgttcaagtcccgtaactgttgaagacttccgaaactagttggtatgtgaccttcaaagctgttctttgccagagataacagtgacaagtatgaaagatagccaatagaggatgtattggcccaacgaagttgttctgttggagatgcaggaattctagatagttagctttccaaattccaatccattcttcaattctaccagtaagattgtttctacttagctgcacatcagcgaggccccgaaagtttcctatactaggaggaactacgccggcgaggtggtttccgtccaaccatagttgttcaagactcaagagtgatataagttaccaatcgagcttggtatatccgcctctaggggtgtgtttggaaaatgggttaggagaggtgggattgagaaatcaaaatgaatgaagggataggataaaatatggtgaaatgaatggatggctaagattgaaacttaccctttgaagggtgggaaatcatatcccaaacccatttttcaaacattgcctagctgatcatgatttaggcggagcattctcagattggtacaatttccgaatgcccgcccgaattttcaactttcatcgttacttgcttcaggattgttatccccaagatctagtttggatagatttgaaagcataccaaaatgactaggaacctggccgttgaaattgttaaagcatctccaacagcctctctattccactctccaagttaaattttagccattctagaaaaaaaacgtgctccaacaacctctctaaccgaatggctaagccatctggctggccaaaacctttcctccgctagccaaatttggccagccaaaagtgactagccaaccgtgggtcccacacattcctcctccccatctcctctctgcctcctccatcgcatcgtttgccgtcctccgcgctgtcgacagtcgcgcccgccgagcctcctgagccagacgacggtgccggcgtcgcgcctccgaggcacgacgacctgccgcagcagtacgccggcgatcccttgccgccaccgctgcagcagcagcagcagcagcaggaaggctccccctcgcagcacgacgactggcacttgcagcacgacagctgccccttgcagcatgacgacggcagctcaggcactgccagagcaacgccaggcagccgacgcacggcgtcgtgcaggaggagcacttggggcagcagccgccgcagctgctacagcacggcgtgcaggatgaacacgagcaccccgtgccgcagctgcagcccaaaattgaggtgaataaacagcccaaaatcttggaacaagtcaacgatctgcacgaaattcgccgttgttgcttgcctacctttccattctccattcgcaatttttgcagtgaccaacaattccaaatcgatcggaatctgatcatatccaccctagccaaccaaacgcaacaaaaatagcagagaatgagcgagatgccgccgcacaccgtgtacttgccgttcccggcacaggggcacatcacgccgatgatgaagccgccgccggctcctagtccatgcgcccctcacctcgaccagcaggggtgagagctgctgggttgatggggattggggaagaggaaacatgtagaggaagagaggggaatacgtgtgggacccactgtcaaattggagaagataaatagagatgctgttagagtaaaaaacaaatttaactctctaactttttggcaaactagctaaatgagcatttggagagtgagatttggccatgctgttggaaatgctcttagatgacaaatctatcttctttatcccgaactcccgatgcgttgcaaaaaggaaattttgatacccctttctatgttatgttaaaaataccaaaataatttaaaaaggatcaaaatacccattacaaaccaacggtttgatttgaatatactatactggtaccaccagtagtggaaagtaccgtaaaatcccccttaaagaaaggtcgagttcctcgagaaacatgaggttgccaaggaaggggctgattgtgccggacaggaacaggtactgtaggtccagctgatccacgactcgcccagggcgcttcttccggccgcatctaacgccagcccaccagcatacaggggtgcgtgcctcccacgatctgcacaccgtcgtggagcaatggacgctgccaactccgtaagacagcagcagcaaaaacgccacaagtgtagcctccttgctgtgatgcagatgcagacgatggttggccttggcacagcaggcaaggccggcctccatgaccatctgccagatgtaaagcacgaacattaacatatatttcatcgcggaaaacggaggaaaacacagtaggatcgatcgatcacctcgctgctgtttaatttggcgtttattccggcagcgaccagcggcagctagtgatcgagttggaagctcactcgcacgctcgtaggcttcgcagctgctgcaaagaggcgtagctcggtgtagccaccatcaggtatataggttctgtttggggagctttagattctaagaaacagctgtttggtagccagcttctgagaatctggaaaagctgtgaaatctagcttcttagttcatttctcagaatctgtaactacatattctcagaaactgtggactgtttggagcagcttccccaaaagagggccataaacagcttcatcgccgcactgtgacggtgtccacgtgcttcttcaccggcgacggcgaccgctgaccccagcttgacttgctgtcacgccttacagcattaggcgttggctatgacaatcttgctttaactacgaagccatcacgctttcagtggaacaagagacggccaacttgcaaattaacggactgaagaactgatgagccaccgaacctttccctccaacaagatacgaccaacttgcaaattaagaggcatttgaattactgtgtatctaggtttgccagatttcaaataaatttatccaatttgtaccacccaaattgctaccatcctcagatgataaagactgttaatatcatccgtgacagcacatgcagttgggcaatgtagatactgaatgactgtggaaaggtcgccgattgaatttgggagacccgcgtagcagattacttatagctagtgactgtatattatactctatctgtagaaagctacagttcgttaacggatcaaagaatctccaccttctgctttctttaatagaggttggcactctgtaggaaattgtacagaagggaacaaacttggccgctaatccaccattgctgtgaggacctttgacctccaaaacttcttttccaagaagatagtctaagagttgcaaggaccttgacgcccaagacttctttttcaaaaagatagtctaagagtaggatcaagatttaggttgtgttggccactgggaaccctttctcctcagcacgcaaaacagagcagcgaattaacacacaattaattaaatattagctaaaaacttgaaaaatagattaatatgaattttaaaacaactttcctatagattttttttaaaaaaacacacactgtttagcaatttgaaaacgcgcacgtgaaaaatgagaaagcagaaattgaaaagtgtagtatagaacgttgagtattagtacatgttggtgcggttaacaacgagcaagagccagaacaaggaatttatctatgttttaagagatttacaaaaataaactattgttttaaaagttttgcaaaaatatacttctcctgtcctatcaatctattatagggcagggtgtataaatcgccctacggtagagcaggctatgagcacgtcatatagtgggaggggcacgccatggcaattttatagccccacacgacagcgcgagaaagggtcacttgtaaaattaccacgacgcaccccatgcatcaccaaactattgctaatgtcacaaaactaaatcatcctacgggaggttgagaagggtccgcctacaaaattgccatagcacacccctcccaccttatggtacgtcacatagcccgcgtctacctaggacgatgtatatgccccaccctacgatagggctggaggtgtatatttttttacaaaactttaaaacggtaatttatttttaaaaatattttaattaatccggttaattttttcgtccgtcattaaaggatgggcccacgcgattttcgccggtaatgcgaatcgcgacgcgtgacggcgattttgacgctccacaaataaaaagagaaactgaaaaaaaagagagaaagctagcaagcagcccaactaaagcagcagcaggccggcccaacaaaaagcaaacgaagcctagcagtcagcccacatagcaaagcagcagcccagtacagtactgtgcgatactgtagcaaccgggaataagttcacttgaggtcccttaatttatcgccgaatatgaaatccatccctaaataaaaatgccaggtaacctcatcctttaacttacaataccttgtcaatttcgatccctcggcagtatcgtggccagttttaactaacatggcaagtgggccccacacgggtcacatgtcagtgcacaaataataccacattttgcctagcttgggcagcactagcttaaatagaaggcttgtannnnnnnnnnnnnnnnnnnnnnnnnnnnnnnnnnnnnnnnnnnnnnnnnnnnnnnnnnnnnn

SEQ ID NO: 36763 - DNA, 1505 bp, Oryza sativa
  unsure (1)..(1505): unsure at all n locations
caatatcaagtaccaaaaaataaccatgtattgcaaccaactcataataatacatgacaaaagtaaatactttttgggtttcaaactttagtctataatacataattttattttaaagtggtaataatacttttcctataatcattcatgtcaatggatttagatcaacaaataattatgtcatgttagcatcttacttacaccggaaagattcgatttgctcctacacacccattactattgtttttgggactatctagagaactgtcgaaagttttttatggagaaaactttcaaatctaactataatataattacaatataatttcactatagctataatgtaactcatatataagtattaaaataatatatgtataatatagttacagtgcagtagttacaatgtagttataactaaaatgtaactcatttaacttttccaaaacatgcagcagatcaagtggctagcacgcatggcttccaggatggggaccctgtgttcgagcctctgcaagcacacgtgtacagatttttttttccaaatctcgcgcggatcgcatggctagaaaatcatctcgcgcggatcgtacagccagaaaatcgaatcgcacagctagaaaatcatctcgcgcggatcgtacggccagaaaatcgaaagtttttagcctccaaaactgtcgacagctagccagcaaaaccattgttttttttatgtttcacccaatgcaacgcatgggcattttgctagtaaataaataattcccagaacaaggctcccattagaaatttgaaatgtgggcatgtgggccgcggacttgagaggccgtattaacttgggctcttggattacaaatcatcccgtattgtaaaggagagatcgttggcccatattgttaaggagagatttgtctccgagccaattccagccggaaattctccctcctcatagcctcgcgcagtcgcgctagctgacggccacggcgccggcgccgaagctcgcgtgtgctacttgtttccgtaattccgtctcgcacccgctcgcgctcactgtcacatgccgttgccttcggtacgcaactgtgactcccaccctcgctaatctaatctgagttgttacttgtcagtgctccggcttgtccttgatttgtttgctgttgctgtcatcttccgtgcagtgcaggctccgtatgcggcattggtcgctccagcgtaattgtcgatggggcctcaccgaggagctcaagtttagagtggtaagtgtttttgttttttttttcagatctctgacgatttttattctattcacgtatttctctttgtgaatttcagtatcagggatggttcaggatgtcgttggtttgagggttctaatgcagctgaaaatgtccctgtatcttctttactagctgatgaatgtggcttgtctagatagtaatggctannnnnnnnnnnnnnnnnnnnnnnnnnnnnnnnnnnnnnnnnnnnnnnnnnnnnnnnnntta

SEQ ID NO: 36764 - DNA, 380 bp, Oryza sativa
ttcaccaaagtgtttttttggattacccacaaagagttattttttttatttcacatttctactatatgtatcataaagtttctcttttcttttctgtgcctaataggaaaacgttgattcgctgaaaacttcagcaaaagagcacttgaagaataagtgatcgctgtcttcgtcttgatgcaagcatatttcgtattttaccgtttgcaccatgttcttcacaagcaaatttgtcattgttggtagtcgatttttgaagataagccaggcacaagttgttgaactcataggggggctgaattcttctacacaaattccctagattggacaaggggcagaagcagaagtattgatctgatcatatatagcctttcatgtga

SEQ ID NO: 36765 - DNA, 1237 bp, Oryza sativa
  unsure (1)..(1237): unsure at all n locations
nnnnnnnnnnnnnnnnnnnnnnnnnnnnnnnnnnnnnnnnattcctccgaaaagggtgcgaataaaacacagaaggtcgaagctgctgcttaggctaattttaacgtcttcactcgaccgagaagtaacatgctacgcttactatcggtggtcttgtatatttattatatcagagaccatttattaccatattttgtgactgttattgtccattttttatgctaaccttgttccaaggtatacttccgtaatgattagcctttagtaacggctttgccgtttacttttgaatggctttggaggatataaccttgtatagctccaaacatgcaaacccggagctgtttcctgcagcggagcagagcagctgtcctgacaatcttcagatatcttcaccgtcctggattgattacaaaacgattatttcatcattctaattacacaaaaaaaaggtttagaaatatggctgatttcaccgttctgggatttatactttggggcctcagctcatgatcacgagcattttcgtgtaaggtttgcttttaggcttttagcttccagagaagatgnnnnnnnnnnnnnnnnnnnnaccttcaaaaaaaaattgtagtagtactctggatacataatgatctcttaaggaataataccttggaaattattgttgctaaggtccaactgcccaagcagtggaaggtctccaaagctggatggtgtgtagccaccaagattattgtggctaaggtccacataagtgaggtttcgaagcttttccatactgaatggtatactgccatggggatatattgttgtaaccaatgttcaagtcccgtaactgttgaagacttccgaaactagttggtatgtgaccttcaaagctgttctttgccagagataacagtgacaagtatgaaagatagccaatagaggatgtattggcccaacgaagttgttctgttggagatgcaggaattctagatagttagctttccaaattccaatccattcttcaattctaccagtaagattgtttctacttagctgcacatcagcgaggccccgaaagtttcctatactagaaggaactacgccggcgaggtggtttccgtccaaccatagttgttcaagactcaagagtgatataagttaccaatcgagcttggtatatccgcctctaggggtgtgtttggaaaatgggttaggagaggtaggattgagaaatcaaaatgaatgaagg

SEQ ID NO: 36766 - DNA, 1683 bp, Oryza sativa
  unsure (1)..(1683): unsure at all n locations
nnnnnnnnnnnnnnnnnnnnnnnnnnnnnnnnnnnnnnnnnnnnnatgtgaaataaaaaaaataactctttgtgggtaatccaaaaaaacactttggtgaaatgaaaaaacgataatttataacacattctgatctttttacacgtcaagtgttattcgggccatttcatgagataaaccagtagctcctaaaaacatatgaacaattatatttagatgaataatagcattccgtggatactttctgaacgctagcaatatacatctagcaggctagaataaatatatgcatacaccgagtaaaagagattagtgtaaattgagataagcatctttcataaatgaaagagagcagagcataatccatgtgaaaaactgaaaaccattcaaaaaatggaattgaatgataactattaagcctttttctttgcacggattcagcacgaaatgcagcacaaaaattgcacataatggcacaggagggagaggataccgggagtgcattcggcaaacctgcacagggtcgctttcaaggacgacgtcgaggaagccgatggatgatcgcaagctgaaccggtttgacattcacaacggtggcgcaccgtgcgctggatctgcacatgacggagttgaggaggaagatccaatgacgaagtgcaccaggtgacggacctgcaccttcagggccgggtggaacagatcagcgaggcagccacaggttgaaaattatagtcagtacaggttgtggtcagatatttactgagaatcctaaatattatacatgttgttacaagcatttctccaggtggaacagatcggtgaggccaccacaggttgagaattatagtcagtacaggttgtggtcaggtatttactgagaatcctaaatactatagatgttgttacaagcatttctcttagcaatcagtgtaccaactgtagttcacatccttgttcatttcattatatcaaacaaattctgtaggtgcgataacgagatgaactgtccactactgtaaataatctatattataatgtaatcatccatcaatttgccaatgatgccggtaacaagtaaaagatttattgaaacagccaaaatttaactgtgtaaatttggctagcatcatttacttgacattgtatttcagactatgttttacaaatctcacaggattacaaaacatagaccaatgagcaatacgagcaaaattactagagctgtggacaaaattagcctgacatgcaaccaaaagtgcaaacctgagttttttttaaaaaaaagaaagaaaacgatcagagcagtttatatgacttttagagacttgctttacatgagttaatctgaaccttggtcaccggaattgcgctgcatatgtacttctttcgcaatcaggagtcaagttaaaggtgattgaatttaaaacccagttacaaacaagatccaccagggttaaaagaacagaaagtacaaaggcactcacaattagagttcagttcttcggtaatttatctccaagattcagtctcaccgcacttaatggtgtggcagccagaacaatttccaatgctgagaaaaggaaaatattttagaaaatatttccattattagaagctttaatcaggtgctnnnnnnnnnnnnnnnnnnnnnnnnnnnnnnnnnnnnnnnnnnnnnnnnnnnnn

SEQ ID NO: 36767 - DNA, 1615 bp, Oryza sativa
tgtctgaatttatattgattgcaaagcaacaaatttgtgaacgaaaaaggaagttaaagcaaatttataaatttagacaaatgaccgaaatgacctgttcttgcattatgtgggtgtgttcagattaaaatgtcttagaagacagcattagaacaggttagtcattaaatgaaaaagaaaatttcagaataggtttgtcatcaaatcaaataaaatgcttcagaaggcagcgacatattttatcaaatcaaataaaatgcttcagaaggcagcgacatattttgatctaaggcataaaatccaaaactacttgaactgtaacattactgattttagctaacgtctcataccatcctacatactaagattcataacttgcagagctttcctccctcccactaaagtaccatgacatgcaatactgaaatctaccattaccaaaagaaaacgagaagtgaagaaaagatcaagtagtccaattgaagacatcactgcgcttagcaacaattgctgaaaatattatatccttcaaccagatttttcctgatttttgctgaaaatattatattgacgatgtagaggaggggctgcaagaagttaccaatgaaattgaccttgctaatctggcaatccccaagcagacctgctttgtggctgaccatgtcgttaattcacattcactgccttgcaaagcgtggccaccactatggctgcaacagtcatggtcgtcccttgggagcaggaacagctgggccctgccgacggcgccagcaccccttgcagcggccaagcctgcagtaccagccgatgcccttgccagcacaggaggaccatgcaagcagcccatatttgtggagttggacggtacaacagctccctgcagtcctgcacctagggacgaacatggagttgagcaagctgactaattatgtttcaattaagcccgagcaaaactataaaacaaaaccacactgcaatatgaaaaaaactacggagtaaagcgtagaagtatccagcagtgtgcctatgttatgtttccagggatcctttgggaccctgggtaaattattaaattctagctaaattacgccatgttaactagtataccggtaaatagttacataattcgtatgtattggactcttggtatttttttgttctgggttcatcactggaaatatctattagcacaatgcaagcacatgggaaacagtcggtagtacatgacgaccaacatccatagtactaagtgaaagcatcataatacagaggagaagatcagaagaggcacctttggtctcctcgacaatattatgaagtttctttctcttggccatctcttcatagtacttcagtttaagatcttcacactgcacaactgcagcaaaaaaaaatgcttacaaactttttcatcaaatactctaaaacctttacaataatgcaactgatggatataacctaatgcttgaacagctcctaccatcttactcggttcaggaacagcgtttgcatggccatcttgcttcaagagatagcaatgtttgctcttgtttcatgacctgaaaattaaaaagtgatataattagtaaaacatagcacctcatgtatttatcaa

SEQ ID NO: 36768 - DNA, 4154 bp, Oryza sativa
atttttttttttgcgggagaatacaatgttttaacttgatacaccgtgtatgaattttcaggacaggcgccagatcaatacaattaattggatcactagcctgcaaatctgcatgtcattgcaaatatggacaggattaaccataaacaaattggttggatccagcaaatgagattcagacaaaagctttcctggttgaggaagttaaaagcaaaaaaaggaactcatgaatcatgatctgctattgcccgaataaactagacaaagccgtgagatatccagccagctgcaggaatgaaagtgcagatgattataaatgtgctgtactttatggtagataggtaacaatggtatattttttacagtatcatagctattcgttgtgggctctgattactaagatggtatgccttctttatattcagatgaaatacctgtgccaagataccctttcctgtctgaccttccagtaccaatcctacagtcagtcctatcattgccaatgcaccattaatagcttctgctcgacgacgtctctgcgtagcaggcaactatgatatggcataatgttgaaaggatgttcataaagcattagcaccaacatagagcattttgattttaatcagagaggaatacaaacaggcgagttctccagcaggaaacatggagtaatctacggtaatgactgaggaaactatttctggtttacatagatgtgtttttaggtgcagtacttattttctccctgataaggattttacagactagccatgatagcttttatgcatggtcatggaatgccatgacaagcaactgaataatcgaaaataaatttgagcaaagaaaccttgcagatttcaaaagcaactttcgtccacatgaacatcatcacagttaaagcttcctcaataattagtttaggataactgaattatgcaacacagaacacactgccacattttgatcaataaacagtagaagataaagatctggtccagcaaaaagtagatagggcagcacaagtcagtaaaaaggctaagagccttatatgactagggaaaagtcaatcactgcttccagctctaagaaagaaatttgctgataagtgtttataaaactgggggtgttgttattaattttggtttagaaaacaacaagaatattttgaactttagaggagacaggtctggtgggaactgtggaagtacatgacaaatatcaaatactgcaccttcagcttttctctggcctgaatttgttgcatttgttgagctgctaagcgcttagcttccagtggatcaaccattaccacattatcacctgaacttcttttgccttctgatgcctgattcatttgaactcagtgtcttagataccaaacgataatgacaaagttttgactaaagcaaaagaacattgtatattagtttcaaaagaagtattgaatccatttttagaggcaaaataatatctactctatagctaaaaataatgaatctctttctgcagaaattcttgagggatacagcacctgctcaagatccactactaaatatcatgctcctacaaaaacacttgaagttaccaataccatattcaataaattttgtaattttacattctgtagacctaccaaaccaaaagtacttttgaacccccaaaaatgaaatgatctacacagaaagcctgaatcatacatctgtgctagcaaaagccaagaagctttgcacatgggtccttcgatagaatgtatgtcctggctgcttgtattggacagtccatctaagcaaggaaaaaacatataattgggcatcagttaactcggtggaaatactacagatgataaactgaagcaaagaaatagccgttggcacataatagtaattccaatagtagtttgatcactcccaacccaaaaggtgaaggtgaattgtttaacactctagaaaaacgagtagtattcttctgctaccaaaagtaattgtgggtagtgccagacattatctctctttttttttcttctttttttttgggaaaatgagggctagtgctgtgccagactgatccagtgaagtgagccagcgacgatggccaccaaattcatcacaatgaaaagttctaaactagtcgtaccaaatatcatcaatatatggaacagctgatgctaaattcactcgaattgcagagcagttggaacaaaccaacaactgacagcgaatgattttcttgtgtactaaccaccacaacaatctccccaacttactggacaaacgaacgtagcatcacggagcacctttaccttcgaaccatgaattatgcatcggaaaaaaaaaagagatagaaatgggtggccaagaacacgagcaagaaggcaagcgcggatcaatggggacaccatatgaaagaaacgcttgcctggacgtggacggagccgaggacacatgccccgtggagaggaacggagacgaagaggaagcagcagcagatggaggaggaggagtagccgacgccgagaggaacacacgcggagagcacgccattcttgcttcccaccaccgcctctctctcctcccctctttctatggactcgagaagccgtcgtcttccacctctagtttttctctcctctttcttcattttttttttctcctcggtgtcgtggttatccaagtcgccgtggtcgtttgggcctacgtgggcttaggccggcccacgaaaaaaatacttggaagaaaagatctcctcgcgtgagccgacgccgcgagcgaagcccgcggcgacaccaccacccaccaacgttagcttctgcgtgtggccgtgggcgcgcgctccgcccgcgccatgacgaccgccaccgccatcgtcgccggccacggcctcgcgctgcgccggagcctgcacctctccaagcccagctgcgccaccttctccgcgcgcgcgcttccgcccgccgcccattgctgccgcaccgtcgtcgccgcggccgcgccgtcgtcgcggacatgccggtgccggtccgtctcctccgagagctccaccgccgccgcggccgacaccgccgacgacgaggaggaggtgaccaagagcgactcggaggaggaggagatggacccgctggcggaggtgtgctacctggacccggaggcggacgcggaggggatccgggagtgggagctggacttctgctcgcgcccaatcctggacgcgcgcgggaagaaggtgtgggagctggtggtgtgcgacgcgacgctgtccctccagttcacccgcttcttccccaacacctccatcaacagcgtcaccctccgcgacgcgctcgcctccgtcgccacctccctcggcgtgcccctccccgaccgcgcccgcttcttccgctcccagatgcagaccatcatctcccgcgcctgcaacgagctcggcgtcaaggccgtccccagccgccgctgcgtctccctcctcctctggctggaggagcgctacgagacggtgtacagccgccacccgggcttccagtccggcaccaagccgctgctcaccctcgacaaccccttccccaccagcttgccggagaatctcttcggcgacaagtgggcgttcgtgcagctccccttctccggtcagtgcagtattggcaaattcgctgatccattaattccatcaaaaaattggtgctgttttgtgtgcttgctagtgtgatccacatgttctcttgttgcgatcgagctgattgttttcagattgttgtgtgattgttcagctgtgagggaggaggtggagtcgctggagaggaggtatgcgtttggggcggggctcgacttggacctcctggggttcgagctcgatgagaacaccttgatacctggggttgccgtggaatcttcgcgagccaagcctctagctggtacgtttctcccatgaccaatgagatgtgtagtgtggtctaggggctaaattgaatgtcaagtgtatgatggatctttactttactgaaacctgaattcagcaagtgcaagttaatttgatgttgcagcccgctactcaaaattgagaatgcgtagggtatcttccgagttaatttttttgtaccatcatagttcatggttgttcacttgtgtatcaaaaaatgacacaagtgtaagaatcatgttttcaac

SEQ ID NO: 36769 - DNA, 3015 bp, Oryza sativa
  unsure (1)..(3015): unsure at all n locations
nnnnnnnnnnnnnnnnnnnnnnnnnnnnnnnnnnnnnnnntcgagtacattctcgtgacagttaaataggttcattgtattcaagttgtccgtttgattctgtcatgtttgattgaccattctatattttcaagactggtgttaggactcaaagaggcttaatcagaaacatgtgttcttcaatccttgcagcttggatgaacggtctagagatctgctcaatggaggttgacacgggcagggcgaacctgatcctatcggcgggggtctcgaccaggtacgtctacgccgggtaccagaagagcgccgcgacgacgcaggaagccgaggcctgggaggcggcgaagaaggcctgtggcggcctgcacttcctggccatccaggagaacctcaactccgacgggtgcgttggtttctggctcctgctggaccttcccccgccgcctgtatgattgatcctgcagtccggagagtagcatctagcagcgtgtgtttccatcaaagatcactgtgtagtatgtgtagctccagtaacaaaattttcaatacaagatcccttccatctgtactacacactggtgtactaaggaggaaaaaaagaaaagaagaggagataagggctctgtgtgttttcatgtgagatatgagtttcttaagaaaaaaaaaggaataagttcacttagtccctcatgttatcattgagtttgaagcgcgttcttaaatggcaataccagatataacatgttcctcatcttataagaccggtgtaaatctaatactaaggcagtattggagacggttttggctaaggcggcaccaggaaaaaaaaacatgtggaacccacactggcatctccttcattcctatctctctatctccctttgttggttgcgactacgagagggacgaggaggaggaggtgaacgagaagcaccggcatgggagggtgcagcgggaggatgggcacaacgggaaggatggagagaagtgccacgaggagaagcggcaggagcgaggttgggcggagtggggggggagcagaggaggccaggtgaaagagcaatagtgggaggccggggggaggagcggcgggagcaaggccacaatgacactggttctgcttgtccatccgcaagtctaggcttggcggcggcattggtagcaatggcaatgtggtgtcctatgcaccaccacgagaggagggaggcgtgaatcaactccccgacatcttccttgtcaaaggttgcactggcaggaataagcacaatagtgtcagcacagtggcggcgagcaagtccagctactccacggacagggccaccccaatgacggtgaggtagcagcgcgccatgtcgccccggtgctccacgaagatctagcgcagaaagacgtggactctcgttgtgaggtcctgtaggcgtctacatctctacgcagcccgacggtggtggcggtggcctagatagtagggttgtggtggtccatggacgcccgccgcgcgcggaggtggtgagtggagtcgagaagacgaatcaacgctgttttgtgtggtggtgtgtggcgcgctttggcagagcagcgtcttggacgcctcgtgcacggattggaggtgcatcacaactcgttgcgcattgcgtcagctccctcgtctctttcctcttctcttcttctaccatagaccaccggtgcccccttgtcgccaatctcctgttgctgctaccacctcctgctaatgggctcatcagctgccgcccctctccccgccggtgagcttctgcggaggaaatgggagaagtggaagagagaggaaaggtggaaggcacttacatgcgggacctgtattttttttttgtgaataggatgccacgttatccaaaacaatcatttgtactgctttaggacctggttttgaaatatgaaagtttaacgtttctggttttatggtttgaggatgtaatttgaactcgacattacacaaggtacctaatgggaacttcttccaagaaaattcaaggtttgttacagtagtttcgtgggcttcccctctagtggctcttaagatcagcaacgtgcctactctgccagtccctctgtttaggccttttgtatgttcagctgagacgctcttagccccacgaggccagtctcccaggcccaacacggcgaacacgtcccacagccacaggccacacagtcccgcatgcacccacgcacacggcggccggccgagagatgatccccaccgtttgctgcccacgaggacgcctagctaggatcgcccgtgcgtcatcgagccaacgctcaccatgcgcccacggcccgctggccggctcagcacggcacggccacgagaccacgagcggacccattctctcgctcgcctcattggctccaccccatgctcggggtcccaggccccagccgggcctcgtcctagtcctccccactccccagccccagatccaggtgcaataacgaattaacgaccgagtctcacgaggccacgacaatccgcccccacacggtgctgaaattccactgaaatagtagcactgctagctcttctgtgctggactgctcgtacactgcacttcattcgtcctaaaaagaattaatctattattataaaatatcacatccaatactagctagtttattttttttagacagaggaattacatatcacataatagtattagatggaatcaccaatacataaatggaataatcactaatatacttttctttgctcctactctattaatattaaggaaaaagtacaaatttccttctcgaactatcgcggtcggctgaattttccccctaaatctgaaaaccagacattactcaccccgaactttcagtaccggacgaattacccccctcgacctaatccagagcagttttgtcctacgtggcgtacgcgtggcaacccagtcagcattttcattttttaaaacatggtggggcccacctgtcattctcttccatctccctttcctcttcccctcttcc

SEQ ID NO: 36770 - DNA, 3327 bp, Oryza sativa
caccgtctcggcgtggcccacgctctcctcgatctgggtgtgcagcaccttggacatgtcggccaccgcctgcttcgtgttgcgggcgatgagcgccgtgtaccacgccgtctcgggcatcttcatccgccagtagtaggtgagcgccgccgggacggtgccaaacatgacgatgatgcgccacacgtagtcggcctgcgggatgagggacgcggcgtggttgtcggagtaggacgacaccgggtacgcgtgcggaaaccccgccgacaccgcgagcgcgacgatggcgtcgaagaggatcccggacccttgcatggcgaacacggcggcgatgaaggccccgcgcgtcctcttgttcgcgtactccgacatgatggtggcgctgagcgggtagtcgccgccaacgccgtgcgcgcggcgcgagcggcgagagagagaagagatagaggaagaaaagaagagtatggcaggcgggtcctctaattttttattaaaaaaacgctgattggattgccacgtatgcgccacgttggacaaaaccgctctgaattggtttgagggaggtaattcgtccggtttgcatagttgggagtgaagaatatccggttttgtggttcaggggtaattcggacaaccacgatagttcgggggggtaattcgtactttttcctaatactaatatatacgaagcaaggtttttattcttctttcaaaaaaacataagtttgtatagcagcatctcacataaaaacagattttcttttctaggaatatagtaaacttttacattgtcttgtttggatgaacacacgatcaatatcgaaagagctgatttgcaaatggttgtgctcgcgtgagcgggtttcgatttggattcaaaaaaatttatgtagaatgtttctatatccgtcaaaagtttctaacattaactttctatgcataaactttttgaaataacatcccacggtgggccatgcatgtgggttaattaggtcaaacatgttcatgtatctaggtcacatgtgaacactcaccaattagacatccccggtcaatatatttagtgacaatggcacccaagtacatttttatgtcttatcttgagaaacataatataaatgtaggcgctcacaacgggcacaaactcactcctatgaacgtacacatacacatcttacccctataaacatctccgaaagactaagctgatatatcttaagattgacgagatcatcacaatcgcttcgctgttgatggataggttgcttatcattgaaagaactagctggtggcccgtgcaattgcgcggctagcacccaaatgaaatcatattgtcagggttatggataccacatacctaatagtagttgactaaatctcggcaggatccaccacataccatatcttatacggaaactaacctcgagggagttccggataaggaaagacaaccagagttctacatggaaacgacaaggactactcggattgtatccatattggtttccctaattctacttggacaaggggacacatatgggtataaatacaagccccttaggaggacagggagacacccacgatgagaagatcaacacccaccagaagccacaacatacaagcctatatacgccaagacaagccgccggatatcgacattagagatacgcctggatcgaccctatccggtactttcaaaggccggccttagggatctagcactgtctctgattccatcgggcgcgagttcgaggaggagggctaccctgttgtcgactacgagtcggaccttcagaccgccatgtcgacaacagttagataggctacctcaaatattgtactggtgtgattaccatgaataagagcaataccggcttcgaccaacaggatgtagggttattacctgacaattcaggggcccgaacctgtataaaaatccctgtctccatctcttttaccttagtcttgcatatatcctagcaccgacgatccccataccatgcaaataccagaattgtgacatcaaacgtcgacagtggcgcgccaggtagggggattttggtgcttcaggatttcgacgagatgggttcaaaagatggattctccaacaacaagctactcgatgacttcggctgtggggaggtctaatccgaccggaatatatcctccgacgagatcgggaccatcgccgccgagaaggagacgccgacctccacccggtgcagctgctgtcccaagtgcgacgcccatccaaggaatgccaagcccgacttggtggcagatcaatctgtatttgcttcgttcttgtgtccggttaggactggaattaggcaaacggaatacgtgcatgcatgacaaccgtgccgaccaatcaggactcaggagatatccatccacaggcctacatgttgacgtacgtacatatgccgatcggtttccaaaacctattcggtatatgcacatcaacacatgtctacacagcacgactgcataatattcaaacaaatcaacaaaggtatttagtagattgatttttataattgatctactaattccgtagatacatccggcatgtatctacaaaggtacgcaatattttatacacaatttatcgtacctatatttccaatttatacagtattgtcagatcaataatttattatgtttatctagagcatgcttcttatacaatatccgttgtgcgagtacttccgacgataggccaactatggtctaacgctgggggctcactccgttctcttatgtataaatcatgcttgtttacggtttacataatgcctgataattacatctgctcgttatgtcctgataatactagaagatccatgcagttttttgaatacatactcgatattatctactatatatcttgccttctagaaaatatttttcaggaacaattgagcactcgagtaggttatagtcgagtacactccattatcgagaacattctcgacaaatgcggagttatcacacccaacctaccaacgaagatcgacgacctatctcatagcaccggccatcgctggactactcgagaaaaggttgttaacggataattcctcgcgaacgtcgtcagcttgatcaccccacatgattgcgagcggacatccggatatgctgtaagttgggtatgtgagtcatgctggccacatgatatgcatatataataaaccaactttaccgcccctataggtgattaagagactcctactcctggttctcgaaccgcaggcatgaaagctagtgattttttttgcctcactttaagtggtcgagttgcgactactgccttgtccttgacca

SEQ ID NO: 36771 - DNA, 4108 bp, Oryza sativa
ataacatgtcaccctttgagcattcgctcgggggctatttctatttgatattcttttctgagtattgatttcaggaaaattctattcgacattatcgaagactccatgtctctatggttctacaccaagatcgactaaggtgagtacgacaaatgtcgacaaagctccgtcgcagactctacgccttctcgatcgctcgagaacggttgctggatctcgacaaggaatacagaatgaagagatggtgcacccaccgagataaaatttcttgacttcaatctaaattctcgattacagcaagacgagagacttagtcgtacgctctgtactttctcggtcgacatcagagattgacttagacaaaccctttcggtgcccgcacgaggctgacaaaggaagtccaacgttatctctaaactccccgagaacggtcacatgagctcgataacagttactccaatgtctgcgcgcagttgagaatatgaattcgttcatttgcatcgaagtcgggggctactgtcagggttatggataccacatatctaatagtagttgactaaatctcggcaggatccaccacataccatatcttatacggaaactgacctcgagggagttccggataaggaaagacaaccagagttctacatggaaacgataaggaatactcggattgtatctatattggtttacctagttctacttggacaaggggacacctatgggtataaatacaagccccctaggaggacagggagacacccacgatgagaagatcaacacccaccagaagccacaacatacaagcctacatacgccaagacaagccgccggatatcgacatcagagatacgcctggatcgaccctatccggtaccttcagaggccggccatagggatctagtactgtctctgattccgtcgggcgcgagctcgaggaggagggctaccctgttgtcgactacgagtcggaccttcagaccgccatgtcgacaacagttagataggctaccccaaatattgtactggtataattatcaagaataagagcaataccggcttcggccaacaggatgtaaggttattacctgacaattcaggggcccgaatctatattaaaatctctgtctccatctcttttaccttagtctcgcatatatcctagcaccgacgatccccataccatgcaaataccagaattgtgacatcaaacgtcgacacatatatttttcaatatggttttacttaaaatttattaaaagctatctacggcctgtgcattgtcttttctctttattatcattgggattttaaaaatcgaacataattatcgttcaggttcatttttttattttctagaagttccgccaaaccatcagcggctttgccattgtactccattatggctcgcctgctgcctcccttctttattgtcattgagatttttgaaatctaacatgattatcattggtttttttttactttttagaagttccaaacctttaaaaattggacattgtaggttttagagtttatgtcttgttgggtttcatgttttataatttttagaagtcctttcaagtgatgccactatacgcctctacagcccatctgccacctactctttattgtcattgggattctaaaaatcgaacataactatcgttggagtttattttttattttatagaagtcccgctaaccgtcggcagctctgcaactatactcctattcaccccgcccgctgcttctcctttttattgtcgttgaaattttaaaaaatcaaatatgattatcaatggggtttattttttcactttctagaagtccccgcaaccgccttacccgtttgcttcatggcctgcctgtcgtccctccttttaatcgttattagaattctatttgatgttttattaacagtttttatatgtcgtatcaaccacgaccactctactcctttataaccctgttacttaatttatcttcgtcatgcgttttagatggtcttttcgaacaatagtctttattttttaccaccatatttggttatttataaattgtattcctaattgaattttttttcttttttaatttcagatttttttttcaaatttttattaataccgtatagtgttcttttaatatttttattttttatttttgaatttaagttgtttcaaaattgtattcctacttgaactctcttttagtttttctaattttggatattgttttattttttattctgaattttaactaatctcatatcgggttcttatatatctcatatcgggttcttatatgtattcttctttcaatattgattatttgtaattccgaattttagttaattttaaattttattcctacttgaactctttttttctttttgctaattttggattttattattatttttattccgaatattaactaatctcgtattgggttcttatatggactcttcttttaatattccttatttttaattacgaatttcaattatttttagattttatttctagttggactctccttttattttctaattttggattttattttatttttattccggattttcattaatctcgtattgggtttttatatggactcttatttcaatattgcctatttttaattccgaatttcagctatttttatattgtatttctacttggactctccttttctttttctccgattaatgtgggaatttctagcccccacagtgaacgtggtgcctcctttcaaagcagttttaataatataatagatagataattagctctaaatgcgagcaccatgtcaagtatagaatcgaatagacaggctccaccaccagaaactcaaccagttgagttcagggtttacgattctgacaggcccttccgtttcgagctctggcggaattcggaatttcgtgaaatccggtggaaatccggtaaattccgaacaaatttcataaaccaaaacttgaatacaaattccctgagtttaccgataagttcggttttggcgaaattccgatcgaaatcatcaaaaattcgatcagtaactgagcctagtacatgcaatctagcacatgtaagtgttttctttttattattattttttttattcttttctttcctgatataagtttgagttaatacacacaatacattattttttaaatttttgttatcccaataggttctatgaatatcatagtatttataagattttatttgatttttttctttttttattaattctattttgaatttggatgaaactcctcgaactctcagatggtttctactttcgagtctcgtcgagccgttgaaatttcacgaaatcggaattgtaaacccaggttgagttatgcttactttgcatcatgaaagcattgtctcccccatcgtcataggtaattttttttttcaaaaaaacatttgtggttgtttcttttttcttagcttgcacactactcattctggcactagcagctagtgtgcacaagttttttaaaagaaaaaggtataatacatattatttttggagaggatatccgtacgaagaacccaaatttatgaatcacaaatcgttaacaatcaattgcaataacatcttttgtgtttttaaacctttgtagggaagaacggattcgatgggggggggggggggggcgccggctactttctaccacaaactcgatagcgtgcgcgtaccgtccgtccccccaacggccgggcctgcctacataccggacctaaccaacaaaccaactgggctggtgcacgcacacgcccccacgaacgtacgcacgcacgcacgtgcagtaatgagacgcaacaacttttggttattgcaccggcgcacaagcaaagtccgtcgtcgcagcaccctacagccaccaccaaaaacgaagtactactactgctctctgctcgatctttctctggaagggcgtggcagggttttggatctatggacatggatgtgtcactactcgctgcggcaacgcgtagtagcagtaggagtactgcgcaagggtatgcacatgcgcagctcgataggcaatacagctaggaatagtcacctagtattagtagccttttgccgc

SEQ ID NO: 36772 - DNA, 3079 bp, Oryza sativa
  unsure (1)..(3079): unsure at all n locations
cccaactcttcccgggtccgtgccttcgcattgcgtcgcatgcatctgcatgcgtgcagctacctatagctagcgaagcacccgtccatccatccaccagaccgacccccgtgccgtacgtacgtcgcgagaggctgcgagcgtgtataggtagagtacccgatctttcgctggccgcgccgcgccgcgcgagcgcgcgtgtcgtcttgtcacctcttttggccggcgcgccgctgcggcgatttcgcccagcgcgcgagagaatgcatgtgcgcgatcgatcgatcgacgtaacgagcaatctcggcatctcgcggggcgcggcgcagctagctagctagcgctgtacacacgcgcgatcgtgcatggccgcggctactagctagcggcaaggaaactggcggactggcggtgtgagtacgggaggatctgcttccacgtgcatgctagctgcgagcatatggcaaaggccatttgggtgcccatgcatgcacggatacgcataaaatggctattcgagcatagaccatgcatggtagggggtggtggtgcagggcatatgcagatgcggcagatgattagcggtaccggagtagcctttttagctggctggccaagctctgtacgagtacgcacatcgcagtatacatgctgatagatcacaaagatgaggcgatgcgcctctcgatcaggtcacaaagatggaactacgtgccacacgcaggtcgcacgtgcctccctccctccttattactcctacacacttggtggcgcatgcatcgcatgagattctcattagtactttcagctactttctgtcttcctgcatgcatgcgcggcgttggaatctcatctgtctaccgtaccagctgcaaccctgcaaactgcaagcgccctaaattaacctgccctgatcaaaccaaagctatcacagcaacagctataatgctgtcgagattactacacctactccgtacgtaggagtagcattccaatccacattaaaaatgagtgttccataatgaggactttatatctttttgagctcccagttactatacatgtaagaatatactgtactgtatttcatgcacttattttccaatcgttcacctaaaactctggccagatgagcctatatcggtatatatatctcgtcttgagcacgtacagttggggctttatcaaaccatcccagcgtacatataacgtacgccaaacagttcggccatgagcccatgatgaacgtacgtgcagctggtacctgctacaaaaagggagcaattaatttgtttcgcctggtatgtatgggactagtttggatcagctgactgcaacttaaacagctgcagtgagcatcatttggatgcaaatcggacggtctagaatctctagattacacactgcacagtccatatatagcactgtagcaaaatactgcagtacggagtcctgttcatattgttactatatatcattgaatttgaaccgttgatataaaatcggatggccaaaattatgtgtagtagttactccgtaactcaatttgaaccgttgatataaaatcggatggccaaaattatgtgtagtagttactccgtaacttgtagtggatctataaatttgtacatatgtacagcactgttcataatcagctatactctattgatttattggactcacaatatatataccagtatatgcagatggcagaactgatgcatgagaagttgtaattgtaataaacacatatcactactagagaaaggggctttagtcccggttaggaacctcctatactcccgattatacaaccgggaccacgaattcaggactaaagatgcccatttttaatcctgggtaaaataaccgggagtaaaaatccatttttaagtcccggttggtgttactaaccgggactaacaccaactgagactaaaaatggagccaggataggtccgtttgctcctttatttttttttcttttcttcattgtttttgatatattgatttcactctatcccccatccccgaatcgtgaaatcccaaatcaacaatccccaaatcgtaaaatcccaaatcgattgtcacctccaaatcctcaaatcgatcatctccaaatacatcacaaaatcttaaaaaaattacctcacaagttctacaaaattcatcacaaatacatcacatattcacatcacacacaaatcaaatacatcttagatccgaatcacaaattctaaaaaaaataacaacccaaatccggcaaaggcacaaccggccactgtgcgccggccgccgccttcagcctgccacagccagccgcgctgccctccgtgctagccgctcggccgccgccgcctgccagagaagtgggagcaggggggagggggagggggaaggagaaggagaggaagagatagggctagtgaggagaggaggagatagaaaccacacgcgcatgcctcctcgatcggattcgcgcgcacgcctcgatctccgtatatgccgatcttttttcccactacaaatagatctttataaagaaaatataagggtctgacactggctgccgttttttgaaccgggactaaaaatgatctttagtcccggttgatgttaccaatcgagactaaagatcaaaaagtacccctgagcttttaaaccgggactcaggtttttattagaaccaggactattgtgaaatttggccgaccgatcaaaaatagtttctccagtagtaccttttcttggtgctaattagtggggataagtactgtatatcattacggatttaatttatggaagtgaacaatatagaagctttttgtgcactgagttcaactagtagtggagcttcacaatatagttaactagataaataccccgccgcattaatgtgggaaattaagttgtatagtatgtacaaataagatgtaatatgattattaaaactaacaaattgatacttgtgaattttgagcctaaaaataatgcatggtgttatcggagaagaaagaagagannnnnnnnnnnnnnnnnnnnnnnnnnnnnnnnnnnnnnnnnnnnnnnnnnnnnnnnn

SEQ ID NO: 36773 - DNA, 2482 bp, Oryza sativa
aaccgggactaaaaatgatctttagtcccggttgatgttaccaatcgagactaaagatcaaaaagtacccctgagcttttaaaccgggactcaggtttttattagaaccaggactattgtgaaatttggccgaccgatcaaaaatagtttctccagtagtaccttttcttggtgctaattagtggggataagtactgtatatcattacggatttaatttatggaagtgaacaatatagaagctttttgtgcactgagttcaactagtagtggagcttcacaatatagttaactagataaataccccgccgcattaatgtgggaaattaagttgtatagtatgtacaaataagatgtaatatgattattaaaactaacaaattgatacttgtgaattttgagcctaaaaataatgcatggtgttatcggagaagaaagaagagataatttgaaccatagatctatcatacaaaggctaaaaataattggggtaatgtggcttaatgagataaaagagaaatggcattaactatacttaatggtatataagtatataggatttacagatcgaattaatagatggggccacacattaatatgaacaagttggtatccatagtgcctctccctctaagctagctaatgcatgttttggacattcagcattcaattgccgtgtttagtacattttcagtgctactccctccgtcccataatattattataagggattttgagtttttcttgcaacgtttgaccactcgttttattaaaaaaaattgaaattattatttattttgttcgtgacttagtttattatccacagtactttaagctcaacttttcgttttttatatttgcaaaaaaaaattgaataagacgagtgatcaaacgttgcaagcaacaactcaaaatatattatattctgttatggagggagtacatgactctcacaacactataggtccccgtgcactgaagaggaagtctcatgcacctctgaaaattcaacatattggcaggcagacaatgagagagttaagcttcaacttgccatacatatggctggcactgtgtctgcatttctgtatgtgtggtgtgtgtgagtgtgtgagagagagagagaatgagagagagagagagagagagagtctgagactgtatgaatatgtgtgcgagagagtgtgtaaatgctaagcggttacaggggcattgaagagggggctcagtggctctcatgatagctagcagagggcagcgtagtagccaaggaggagggaaaagagatcgacgatcgcagcaactcgcatttacttgcagtttgcagctggagtagcttgctgttggcgctgtacgtttgtaacttttgtaaacctaagttgccaaaaaggtgcaagtcaaaatgcaggcaacccaccctcacatctagtaccccctctccccaaacttgggggcctcctttagttctttcccatcaccacactgacatctacaagatcacaaagatctctctctcctttttctttctctctctctcgttgcgtgagcttgtagcaaagagatgtgatgcactaggttggcagtagatagccagtactaccatgcatatatggatgcatggctctcgatctcgtaggagtacatgtacacatccctcctcctgatgggtgaccatccatatgactgcagggccttacagggtgctgtaacgcatcaaccccctgaacctgaagagtcacaagtcacagcagcagcaagcagcaacaattctttccttttctccgcagtagttttactacagtactaccctttattcctttttctttcacacgcatcaagggcacacacatgcaatgcaagtacatttttctcatctgataaaatgggacaaaaataaaggtttgcctcatttcattgatagagaagatagaacagctacacaaacacaacaaagaagggataattaaacaccaaatcatgcatgctgaggctggtctgaaactttggtcgtcaacactgtcgatctgcaccgtggcacgtacgtcgatcgatctctccatcatatcacatgcaagcacgtatacacattactgtacttgctactataccatatagtacaacgacatcagccatcgattgatcacctgcatccgtcactgttatgaacttataatgagtgctgtttgcgcgcacatacgatgataaaaccgttcgtgcatccgtagagtatatgccactgtgtactacagagagattgactgttcgcgtatgcaggagtaggatccaacatatgtgtgttcatgcatgagcattcgatctaattaagctatgactgtgtttatatatatctaaagtttggatccaaacttcagttattttccatcacatcaacctgtcatacacacacaacttttcagtcacatcatctttaatttcaaccaaaatctaaactttgcgctgaactaaacacaacctatatggcc

SEQ ID NO: 36774 - DNA, 747 bp, Oryza sativa
tatagggcgaattcgagctcggtacccacagtcattcagtatctacattgcccaactgcatgtgctgtcacggatgatattaacagtctttatcatctgaggatggtagcaatttgggtggtacaaattggataaatttatttgaaatctggcaaacctagatacacagtaattcaaatgcctcttaatttgcaagttggtcgtatcttgttggagggaaaggttcggtggctcatcagttcttcagtccgttaatttgcaagttggccgtctcttgttccactgaaagcgtgatggcttcgtagttaaagcaagattgtcatagccaacgcctaatgctgtaaggcgtgacagcaagtcaagctggggtcagcggtcgccgtcgccggtgaagaagcacgtggacaccgtcacagtgcggcgatgaagctgtttatggccctcttttggggaagctgctccaaacagtccacagtttctgagaatatgtagttacagattctgagaaatgaactaagaagctagatttcacagcttttccagattctcagaagctggctaccaaacagctgtttcttagaatctaaagctccccaaacagaacctatatacctgatggtggctacaccgagctacgcctctttgcagcagctgcgaagcctacgagcgtgcgagtgaaccttcaactcgatcactaactgccgctggtcgctgccggaataaacgcccaaataaacaacagcgagg

SEQ ID NO: 36775 - DNA, 836 bp, Oryza sativa
  unsure (1)..(836): unsure at all n locations
annnnnnnnnnnnnnnnnnnnnnnnnnnnnnnnnnnnnnnnnnnnnnnnnnnnnnnncgcacatttcattcaaattgcacttaatagaaaagaaagcaatgttggcaatgaaatgaggtttgataactaacaacttaccggtatggcagtacagctagaggggaatatattggaattaacatagaaatttatggtgatagtactaaagcaagcattttatctgcacattccacatgtatgattatcatgcaaaaaggatatgttagtggcttactttagttttatttccagatttgcccctgcaaagaacaaattattctccaaaacaattttcgcttcatcctcttctgaaaattcaactaaggcagtgccacagaagtgttttttgtttgagatatggcgtggtagcctgacactatttacctacaattcagacacaagtacaccaagaaaatgttaattcattgatatttgcagtatagtattgcacatgtaatcataacactggaaaagctccagatagccagcatgcataactggtaattatgttcatgatactcaaaatcctaattatgaaaaaggttcacgagaaaaaaaacttcctttgttctgttgaactttgaatcgaatttatgcagcctagccatgccaccttttctctttgcattacatttcaatttcatttcaaactaactgcaaccttgttgtgcactataagtgttcagtacttggacacacctttgcatattgcgcaaagaaagattggacatctttcaactttacattgtaaggcaatggtgacccaacaactgtccttgagttcacttgcttgatga

SEQ ID NO: 36776 - DNA, 1934 bp, Oryza sativa
  unsure (1)..(1934): unsure at all n locations
nnnnnnnnnnnnnnnnnnnnnnnnnnnnnnnnnnnnnnnnnnnnnnnnnnnnnnnnnttccctctcgaggccgaaaacgatgtggaatatccctttccatgttgcccaaatacagtagcaaagctagtacttagaattctgttatctttagagtgacttgtcacactctgtccgtttgatttgtcctcctctcatggcagcagcaaatggtcaattagtcgaagtagtactatccaacatgttcacggcctttcttctccgagagtgactgtcggctgtcgagtagtgtgtgatgaactgaaaccgttcctttttgggatggccgctgaataaaccgaaacggagaaactgtgggcagctctgaattaagcctcaaccttgtggctcaaagaagtcccaaaccgtgtgtaccaagcaccacaaaattggtttcgattttgggatgctgagaagaatcccacgtataatcatggagaaatgttcaggttttttaccttttgctttgccccccaggttctgcatggaaattattaaattgaagaaatgagtgccaagcgtccagcagctgtgaaatgctttggattcccttttgccaacttcttgtacatgtgatcaatcagtttgctaaaatagaggtagacctcggttggtgtttcatgggcacatgtaatctttgtgttttgagactgcaacaatcgtggggatcatagatatgtgagctcagttgatgttgaaaatttggtcataattcggcatattttaatccaaaataacaagataataaacatgatatttacaatgggatttgatttggtgatagtggtgaatgtaatcaacatgagcatgcttaatgtagaataaccatcaacaatcatataataacacaatgttgacattgcgatgaatattaacagtaaaacttctaattgaaataatgtaagaaggttataccctaagaatggtcatccgctggagtttgaggcagtattgcctccgttggtgttgacgggagcctccttctccttgtatccagtgttgccgttgtctccagtgtttgacatattggtgaaggtgaagtagatgttgacgaacagtgagtagtcgcgccttgcgctcccaaaaacctgatcgcacgcccgtccgtacaaacgtcgcagcaacgcgtggtttcggaggcctactctcccaacgcgtgtgcacacactcgtcgggatgggattactgtagcagcaacagcgttgaaaatggatgaaagtgtgtctctcttctcttttaggagatcaaatccattctcattttatatgaggaatggaagatgaagagtaaaaatcatggaataggaagaggaatatagtaactaattctcatcaattagccatgaaccatcctccactacacaaccatcaaccaaccatcaattaggagtaattgatgtaggttaccaatggaataggaagaggaatagagcaattaattgtcatcaactagccatgaaccatcctccactatacaaccatcaaccatccatcaaataggagtaattgatataagttaccaattccctaatcaaatggattaattctcaaaactcctcatcccattgatatcccataagagaatgaatacacatgaattcctagcataatgaggcttggaatttatttgatttaattgatttaaatggatcaattacccaattaaatctaacagttgagaagcagactcttgactgttgagatgcatgcaaggctactccaagccaattaggctgacgcctaactttgccagaagtaagatgatgccatacaaagtgaggtagacaccttattaactgtagtacaggtttaacaatgtttgcctagaaattgagtacacatgtgatccgaatgtgtgaattaacaaagtgtgactctccacgatcgcaacaacaacca

SEQ ID NO: 36777 - DNA, 1587 bp, Oryza sativa
gcggcgcgggaggaggatgcggatgatgaccggagcaacgaggccgaggcggcgtcgtggcttctccccgagcccgacgacaatagccacgaggatagcgccgcagccgccgacgcgtttttccccgacaccggcgcgtacctcggcgtcgacctggacttcgcccggtccatggacggaatcaaggccatcggggtaccggtcgcgccgcccgagctggacctcaccgccggcagccttttctaccccgaacactccatggcccacagcgtaagcctcactaccacacagctagctctcgtcgatgctcatggcgcggcgttatgacatggtttcctacgcgttccgcagttgtcgtcgtcggaggtcgcgatcgtaccggacgcgctgtcggcgggctcggcggcgccgcccatggtggtggtggtggcgagcaaggggaaggagagggaggcgcggctgatgcggtacagggagaagcgcaagaaccggcggttcgacaagaccatccggtacgcgtcccgcaaggcgtacgccgagacgcggcccgcgcatcaagggccggttcgccaagcgcaccgccgacgccgacgacgacgacgaggcgccatgctcgccggcgttctccgccctcgccgcgtcggacggcgtcgtgccgtcgttctgagaaaggacgtacgcacggtacggcgagtcggcgacgtgcgccgtcgtaattttggcgcgccccgtgcgcgcgtgcatgcgtgcgtgtgtgcgacgcatggccccgtgtgacatgaataatatgtacagtagtttttcatccatggacgtagtattctattgtactccttgtactcctactactcctcttctgcctaaccaaggcttgtacattaccatgggagtagctgtttttgcaaccgtgaccatggttcagtgcttcaagttcaagggcgttaatgttactgtccattctacttttggaaaggctagtactcctcctacttgctactagaagcttgccgaaaaatggtaaagaaaaatgtgcaagaacgaactgcagtactcatatctccatcaaccaggaggttcgagcatcatactactctattatacgagtgtaatcatcaaccaataactcccctaacctcacagtttttctcctgattttggtttttttttggatatctgactgttttacacgtctccttttactgttctgtgcacctcggcctaatttgcatgcttatgcgttgccggtgcgccggttgattacgtaattattcatgtatttggggtttggatgccggtcattgtgacggttgtttccggttggctggtgcgttgagtgccgcgtgccatgctgccattttttgttttgatctaattgtttcttctgttatttcagatcggtctatccgttctgtattctgtgtctttgtgactttttgtttaggtccttggtatttttgaaaattgaatgtgaagaagacaaaattctgtttttgggtgtgtttgtggtttgttcttctgctgggtatggaggtgcgattttccccacctgccgtcctccctgctggtcacaccaaatgcctcatgctc

SEQ ID NO: 36778 - DNA, 3881 bp, Oryza sativa
  unsure (1)..(3881): unsure at all n locations
nnnnnnnnnnnnnnnnnnnnnnnnnnnnnnnnnnnnnnnnnnnnnnnnnnnnnnnnntacctaatggtacatattcaaagcaccctttacacagctttccgttcctgctaatttctggtacgtcttttatatacctgtgaggtgaaaccgtgccacaactttcgtattgggggaccccgacattttctgaaacaccttaaaaggggtggaaatcttgaaacctttttttgttgcaaatgccatggagtttgatggctgcaaccgcgtantgcaaccatgtgacctcggtactagcgtacaccnnnnnnnnnnnnnnnnnnnnnnnnnnnnnnnnnnnnngtgccgtcccctgtgggggtggtacacatgtagcgcatgtgatcatggcaatggtgacgcgatgcatgatacagtgaatgttgtaggagtatatgtgagctgctccagaagagctgtgaacctggaaagtggcgcagcacggtgaccacagcgcatccagatgcagtggagacatccagaagcatgtgtaatcctctgatattacggcatccgcaacaagcaaaaagagcagcacctacaaaagacattaattaataatactagtatttagcacaaatattccagcaatgtgaaaaatctaatggtacaaaacttagtcttacggactacatggggtctcaaagtcatacagtcgaccaaaacgctaggctcctgcttcaacaattgtatcagcagcggcggggtttttcccgaagggtacacaaatgcttccgaagaacatactcaatccctatagcttttcaagactccataacacaagcgcttacaaaaacacaccgagcccccctaacatttccagcaaattggaactaggcgggttacgcgttatttgcgtagggggactcctcgcggttggctggctgtgctggtgatctgctgtagcttcgctcacgaggaggtggaggtgatcggctgtagcttcgtgcacgagctggtggtggcgacctgctgtagctgcgcctctttggagaacgatcccgtgggctgtaactcctaaaacaaagaaaggttttaaaaacaaacaaacttgcggttatcacagaaaatagttgcttaagggcatgtatgtggcaacacaacaacagtagcatgatattccgcttcaagtaaaatgagacaatctcaactacaaaatccttcaaccgagttgttaccatgtttgccttaatctactgtcatcttatctgtatgatcaatccacaatatgctataatgcagtaacaaataacaaactaaaaaaaataaacactagttatcttaatagttattagtgatcatggtaacagtatatgcatcttagtaacatagccctgaatttgaaattgaacccaaatgtaagtgcggacaaagctgatcagtgccattgagcaaatattttagtgagggagaaagttacaagtttattggaatacttatatatcttgtacttcaagcttcttatgtaagcacaccttttagtttctccattttcacaatcttgaatatggggtagcgcagctatataagttggtatataaaactgcaaatgtaacaacgatttggctggccaacaagaaagaatctagggatgccaagatatcattttgtcattactcatatctacagagcctgtttgaagacaataactttacattaccttctaccatagcttgggctcctccggtatcttgggctgcggctgcgactacgaccgcggtaccttggactccggctacggctgcggctgcggcgtcttccactgccaaggcctccagaaccaatccgtaagcggcattcacgtgcaaaatgaccaggttcgccacattcatagcacttcatgtcagaaccaccggaacgatctcggccacgaccactaccagctttggttgacagctcaaccctccatccattcttgcctataagcacatcacatatcagcaggatgattgtaagcggaattcatggactgtttaaatttgtgagtaaccctataataatatgttaagtaatagctaaagcatagaagtaggttggaaaaatacaacacatcaattgaaagggtaaaagaatatcttggtcaagtaacaaatcatatgatgatatcacaattttaatgtacaaagctacatgcacaactgaagtcacagagaaaaaagaaagtaggcatgtaccaatatctatcaagtttcttaacttggaacaacatgggcctaatgtgcttgcaacaatatatgtatatcacaatatatcagatcaatataaatgtagagtgtcaaattttgacctcgatttactaatatcaccactctagaaataaataacaaggcccggttaggttaaaagacggacctcttagttgatatcatgtaaaggttcaatttagaattctactagtgaacaggaattgagattcagaatttatgaaactatggatttgcccctgtctattattttcaaaacgtccttctaagaccgaacagtttacaggagatagcaagatgcattcatgatggtaagctaaaactatatgtttggacacaacatattttatctataaattcagtgtctattgtttatccaaattaaatttataagttgcttgaatcatgattcagacagagttatttatactataaccaagataaaaattgatggggactcacttgactaaagaaataatgtaatagccattttaatggcaaaactatgtaatgccagaagttgaaatagataactcattagagaagtgcataacatgaaactatcttgcatgaactacaaagacaaatatctacgcttattaccatctaaatcacgaattgcatcttctgcatccctgcggtcatcaaagtcaataaaggcaaaacctggtggttttctagcaacccatacactgcatagaagaaacaactcagttgaaagtggaagaatcagataatctcatttgcagacataattaagaaatcattactgctccatatagactatgaattcattaccattcttagtattgagtaacaacctaaatatctcttccatggttgtcgatacaaaaatcatctttaatgttgtgacagaaatcagcaataaagaaactaatacacacacacacacaaagaaaaacctatggcatacaaaccatgactactccatgtgaacatcaacagccttcaacataaccctttggcatgcagatacaaacatgccactgagtggttcaactaatgagtaagtgataaactctttagaccagcagacaagaaattcagaatattgagatatcgccagtctattaagaaaggaattcaggcgtacactgacagaccaagagataacatgactttatttcatatacttcacagttaacgctgcgtcacattgttaaacatcataactttacttgatctgcctcttcatatcttattgttcactgcaaactcaattactcttcaagttcacctgatactttctagcatatacgttgcatcccacagtatgaggcatgacatacaaaccagaccgatcctaatactcaaattagatatattttcccaatcccaccagtagaacagagcacttaggtgcccaacaataagtgaccaagtaaggcagattacttgtttatataaaaaggaattaattatatccagcaaaattgcattgcaccgagctctccacctcacatatgtcaatgaactaattttaccccaataaaagcacagtacaagacaatcatcccctgctatcattactaatttgagagctaatacccaccatttaaaacttaaattgtaaagctgcagcattccaatttcaaaatcacacgcttgactaacatccat

SEQ ID NO: 36779 - DNA, 762 bp, Oryza sativa
ctcagagtcagcagaatctcacacctctcagaaccccaaacacgcggaactcgtcctcgatctcccgcgccgtcacgcgcggatccaggttccccacgtacacgcgagccatgagcgcgctcgaccctgcaggtattcaacacaaatcactcccaccacgctgaggaaagcaacaagcaccaccaccaatctctaccaaaccaaaagtagaagaacacaatcacacacacacaaaaaaaaaaagaggaagtaaatccggaaattcctcgcgtttccgaccggaaaaggggggcgcaaaagcagaagcagcgggggatctggagagtacttgcctttgcgggcgcgtccgccttgggggggatttgggtttcggggtaggcgaggaggaagaggaggagcggctctaaggttttaagctcgagccgtcgagcgagcggaaaaggaggggcggaggggcaagggggagtgtaatatcaggcggagggggttgacggattggggacaggggcatttacgggattcgagttaaaatttttgtctctgtttggattacaacgggttcccctgcccggtgggtcccggaccagccgtaaaccattctccctcagcatttgaattttgtctaaattttatctaagaatataagaatttttatgttcgtttcttattttaaaaatattaacacatgattaattaagttttaattactataaacttaaagaaagatttatctcaacttctataataaaaattttcgtacaa

SEQ ID NO: 36780 - DNA, 544 bp, Oryza sativa
tgacatatatgcatattttttttcgcgaacgcacaaaagattgcacgtcaatatattagaggaatagagtttttgttacacaccgcaattggccagacccgcctatgccagggaaggggaaaaacaaagtcaaaaaaccaaggaagagaaaaaagaaaaagaaaaactcgaacgctactccaaacaacgagaggggccagagccacgctacactcccaacaagtccccaaaggaagtgatgaaccttgagttcctctcgacactcaaggctattgttggcccgatctttcggtgagttgtgataactacgatttgggagaaacgttgacgatccgactacaaccgtacgagacgttgtgttgcgccttagcgatcgatacacctctccgtgggttgttgatcttgccggtgcagatcaaccctattcctgcaagcaaatcgaagaaacaagcaagaacaagataaaagcaatctgatattgcaaatagaaatttaatacaaatgataagttggggtttcgaatacaagcagacggacggtctag

SEQ ID NO: 36781 - DNA, 829 bp, Oryza sativa
  unsure (1)..(829): unsure at all n locations
nnnnnnnnnnnnnnnnnnnnnnnnnnnnnnnnnnnnnnnnnnnnnnnnnnnnnnnnnnnnnnnnntaatatataaagtttagagcaaatttcacaaaactacagaggttaaccaattatccaaaactacacatttaagatgatatattataaaactatatatttatggctaaatatcacaaaactacatatttaaaaataaaactataacaaaactacatattttagcgtttaaattcttagcactaacattgggtctgttcagctagctggtacagccactatacgcagccgttgctgctgcagctgcagacacaacgtactgtttgtgttggctacacaacagtaaagttaagtgcagccgaacatgcccattatgtttgagttataggcctccaagttttgtgattaaattaacgcaaaatatgtaattttgtgatagagcgattttaccatccaacatttggtacctcgaggtaccatattttgcacacaaaattttggtactaactaccttgagggactaaattttatttgagagataccaaattttacactaaaaagtatcttgaggtactaaaaaaatttatgataacttaaggtactaaatgttggatggtaaaattactctttatgataactctattactaaatctttaattttacaatactccaccttaaattggtagttttacgataaatttgatgttaaatctacagttttctaatatatcatcttagatctatagttctgtgatagtttgttcactatatcttttagttttttgaaatttactctgaagtttacgtgtaaataataattatgaaaa

SEQ ID NO: 36782 - DNA, 870 bp, Oryza sativa
  unsure (1)..(870): unsure at all n locations
nnnnnnnnnnnnnnnnnnnnnnnnnnnnnnnnnnnnnnnnnnnnnnnnnnnnnnnnnaaaactcaccgagcaacgaaagctctgataccacctgatgaaccctgagttcctctcgacactcaaggctattgttggctcgatctttcggtgagttgtgataactacgatttgggagaaacgttgacgatccgactacaaccgtacgagacgttgtgttgcgccttagcgatcgatacacctctccgtgggttgttgatcttgccggtgcagatcaaccctattcctgcaagcaaatcgaagaaacaagcaagaacaagataaaagcaatctgatattgcaaataggaatttaatacaaatgataagttggggtttcgaatacaagcagacggacggtctagccgacacgcgcgctgcaagcgaagtagcaatggctaaactttcatctaaacaaaacccaagaaaccctgaaggggtaactagctatatataggggtgggaggacgacctaggggtgcctagggtcgtgctccaccagcttggggcgcaccccacatgggccccacctgggccagggtcccaaatgaggttacaagcccataggcccattacaggtgtcacagcaccttgtttcttcagttgctaccgactgagatggaatttggcaatgaggcttgatgcattggaaagaggactccgagagctttccatcaagtactcacgggctgaaaacggaggtcgtatggagcttcggcggccgtttgaagtcagcagtgtagcaggtggccgaattggattttggcacttggaggactcgaacttggtatcttgttgttcatccatgatgtgagcaacggatgtattcgtagta

SEQ ID NO: 36783 - DNA, 603 bp, Oryza sativa
  unsure (1)..(603): unsure at all n locations
nnnnnnnnnnnnnnnnnnnnnnnnnnnnnnnnnnnnnnnnnnnnnnnnnnnnnnnnnnnnncttttcttcttcttccgctagccaccaccatgcgtgacgactcaagcggcagcatcgtccaccattgctgctgcttcctccatggccgcgcaagcttccggccatcagctggttcttcctcgcttgcctccttggggcgccattggatcaggaagaggaggctgaagacttgcagcaagcggtgcgcccttatgtgatggccctatccccaccgagcttttcttccaccgcccctcctctcgttctattctcggatgcttcttgcattagaggcattcttttcgtttcgatgaatgatagttaagcggtgtcttcttgaccttgcaagacttttcatcgaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 36784 - DNA, 626 bp, Oryza sativa
ccatagtttcgaactgatgactaattagcacatgattaattaaatattaataaaaaatagaaaattcaaataagttaatatgattttgtaaagccactttattatagaaaatttggatagaaatgattccatttaacagtttagaaagcgtgttcacgatgtcaagccgatgttacctaacgcctccgttacttactgacggcatgatccgtgcaacgcaagtttcgagaccggccgaaagctgggtcgttctaggaaacttgctttttcgtctttttcttcgatggctcaaatcgatataaattaaataaaaagaaagcaaacgcatgattttttttttcaaatgacgcagcagcacatttaacagtttagaaagcgtgttcacgatgtcaagccgatgttacctaatgcctccgttacttactgacggcatgatccgtgcaacgcaagtttcgagaccggccgaaagctgggtcgttccaggaaacttgctttttcgtctttttattcgatgactcaaatcgatataaattaaataaaaagaaagcaaacgcatattttttttttcagaatgacgcagcagcaccataaaaaagatatggatgaagataagcacgtcatatagc

SEQ ID NO: 36785 - DNA, 1874 bp, Oryza sativa
  unsure (1)..(1874): unsure at all n locations
tggccgcgcaagcttccggccatcagttggttcttcctcgcttgcctccttggggcgccattggatcaggaaaaggaggctgaagacttgcagcaagcggtgcgcccttatgtgatggccctatccccaccgagtttttcttccaccgcccctcctctcgttttattctcggatgcttcttgcattagaggcattcttttcgtttcgatgaatgatagttaagcggtgtcttcttgaccttgcaagacttttcatcgaaaaacactcttcttcacttttctcgtaatatccttgccaacatttctcgtcctctcgcgtctatcactcctcccatcttctttgtccccgtctatccctcttgagcttgtgacttgtgtgctaaggtactttagatgtactacttttgttattatagatggctatgtagtgagttggtctatgtttctgatatatcttttgagttatgaatcaattagttgtatggtcgtcactcgtcagtagttccttgcgtggtgattgatctctctctatatatatatgctccttgttttattgatcctaactaacagggaaagaagatatgccatgctagtaagcaaagggcaacgcttgtggtgtttaataccttgtgcttgtgatatgtcctctctctctctctctctctctctctctctctctctctctctctctctctctctctttaacccttgttcctgtgtattcacagtgtgtacatcagtacatgttggtgtttctgattctctctttattttttgttgatgccgtcacgcgcttggacagttggacgtgcaaaatctcttgctatatatattatgctgtgtgttgtttcgtccgtgagactgtgagagtgatgttaatttgttctccggatcctctctgatctgttcgcatttgctgcgtcgaaaatgcgagacggaccatgcatgaaccgcgaacacagccgtcgtttcaacacacaaaaaaaatgaacgaattttcactggtcgcgctggctctgcagtctgcacggacactatttacgtgcactgaaacatccaggaccctccatcgagtatatatgcacgtacacgtacgtgggtgtggtcctacgatcgaactgcatacatctaccggtcgtatatatatacggtagatgcggggtagtagcgttatattaccgcgtctgcccacacaaattaacatataccggcccgacaccgatcgcgaattaaccccgcattcaaatccccgcgcgtcgtaccacgctacgtacgtgcgatttcatcgcggatgcgcaggcgcgcgggcgccgcgcgacacccacaactgaacgcagaacgcacgtacgtacgcgcgcgacacggcgccagcagcagccatcccttcccgggcgcgccgccggctgatcgatcggtggcgcgcggcaggccgggggcgatcggatccatccgaaacgctctcgcgcggctcgccgcgcgcccggccctcctgctccctgcccggccgacacaccgtacgtgcgcgcgacacagatcgatcgatcgatcgatcctgcgtatagctaagctgaccaatatcgattatcgtcgcgccgcggcgcgcgcgcgcggcgacgagccgacgacgtcatcaccagtccggccgtacgcctcgcggccacttgcatatcgatagctcgatcgatgatcaacaggggccgatctgtcgtggggatgcccggggtgctcgagcccccactacccgtgatggcgggatcatgggactgggctcttttaaaattttcgagggcttgtagctttatatagttnnnnnnnnnnnnnnnnnnnnnnnnnnnnnnnnnnnnnnnnnnnnnnnnnnnnnnnnnnnnnnnnnnn

SEQ ID NO: 36786 - DNA, 2870 bp, Oryza sativa
taagctgaccaatatcgattatcgtcgcgccgcggcgcgcgcgcgcggcgacgagccgacgacgtcatcaccagtccggccgtacgcctcgcggccacttgcatatcgatagctcgatcgatgatcaacaggggccgatctgtcgtggggatgcccggggtgctcgagcccccactacccgtgatggcgggatcatgggactgggctcttttaaaattttcgagggcttgtagctttatatagtttattcagatcaccgttactattttgcttaggttcgatatattctggtggtcaagcgtctttatatagtttgttcagttctcttgctcttttttttcttggattcgattctggcgatcgagcgcatttatatagtttgttcagttctcttactactttttcttgggttggattcgattctcgcaatcgagcgtcttcattatacagtttgttcagtcctcttctactatttcttcttggatccgctcccatatgatagatcgtccgatacgctgccatggccccccgggcggcatgcatgcgcgcgcggcgacggcacgcacatggtgacaagcttagtcgtcgacgcgcggcgcgccacttgccactcagagggcccgttgtctgtgtgtggccggtgcgtttaggttagcaacgcactataacagtaggattgacgattgttgacaagctagctagccggcctgcatgcatgcaccatcgctgcggcatatgcatgagatgaaaaagagagaaacgggggatgtcaccctactacaacctacagcatttacacctaacgaacggcccgacgtctagctagcaacgaaagattcagtatcctacagttccctccagcgatagatcatagatgaacagggtatctcatctcatcgcattggattttaaacaattggggtactccctccgtcctataataggtgacgtttttgactttttatttgtaacgtttgaccattcgttttatttgaaaaattagtgtaaatataaaaaaagataagtcatatataaagtacttttgataataaagcaaatgataaacaaaataaataataattctaaaattttttgaataagacgaatgatcaaacattgacaaacaaaaattcaaaagacaagttatatgggacggaggtagtacgtagcatatgccgacaaataaatgcacctgcttgagaatgccttggtcaacatatagggtttctgtaaagtgccttctactgctccagtgctccttgctcttccgcagaggataatcattctcaaaataaattgaggtccttctcattctaaactttacatcatgtcacatcaatcgtttgaacacctataaataatattaaattaaagctaaaaaattaactaattgtaaagattgcgactaatttgcgaaccgaatcttttaaatctaattgctttatgatttgacaatgttgcgctagtaaacatttgctaatgatgtattaattaagcttaatatattatcttgtggtttactgacggattatgtaattagttttcttattagtgcccaaacaccccatgcgatatgctatataatattcgatgtgacacgccaaaactttacacccctagatctagataacccctaagttatggcaaattttgctacaagacatcgcgactttgcggttttagccacggacaccgcacgaagtcacttttgggggaagacactcttaaaatgtggttatttgccgatggacaccgcatacattaaaatattaatttttgggtcaataggagagatgaacactgtaaaaggtctaaaatacccctgggcccacttgtcatattctttctccctcaacaaactccctctcacactctagccaaagcgccaccttcgctgcgaaggcgacgaggagtaacgcgtgcggggatggccgccgcgttgcccgagcggaggccgcggcgaggaggaacgcgtgcagggacgccgcagcgacacctgctgtgtcgcccgagcggacggaaaccccccactgctccgccttggagagagccacgggtgcggtcctgccagtctgggtgcacggcgagcagcacaatggcccgggtgttgaagccgttgtcctgcttgtctttgagctcagtggtggtctcgtcttcctcgccgctgtcgccgccactgcgtcggccgatgagccggaccaggccgcgcttgatctccctgtccatgccccatgacatcctgttcttggttggcaggaacctgttcgattgaattccggcgccaaccacgagctcaatttcggcgagaatggctaatcgtttggaagtttttgggttgttcgtggagtttacctatatcccgggatgagcaccttgcggaaggcctcggaggcgaacgccatgaggcgggcctgcatgcggaacacgacgcggctggagtagtagcagcggccgtacgtggcgtgcgtgatggcctcctccgccgtcggcgccacggccgttccctgttgctactgtctgagaaagaggaatagcagatctgacatgtgggcccaagggcacttttgacatttcacgcgatttctctctcctcctcacctgaaaattattattttaatgggtgcggtgtccaccagcaaatatccaacttttgagaatgtctttcccaaaagtcacttcgtgcggtgtccgtgggctaaaaccgcaaagtcgtgatgtcctgtagcaaaatttgccgtaagttatctatccatacatgaattgatcgagaagataaattaaagctaacacatgaccaccgcccaaaaacatactttctccattctaaaatagttatctttctaacattcaagatttattttaaaatactt

SEQ ID NO: 36787 - DNA, 3743 bp, Oryza sativa
  unsure (1)..(3743): unsure at all n locations
nnnnnnnnnnnnnnnnnnnnnnnnnnnnnnnnnnnnnnnnnnnnnnnnnnnnnnnnnnnnnnnnnnttagtagtgcaaagcccaatgcttgggcaagtttgggactaccaaatttttggtagaggaaagttgagaagagtagaattgatttgatgccaaaatgtgactatgagagacaactatgtgaacaaaaccccaacgttttggtagtgcagtacttgatttatttttttttaaaactaaacagtacttgatttgttaccctaccaaattttggtagggcaaaatttggtatggtagcaaaccaaagtagccctaagccaccggacaccagcaaactattcatccagtgaggtttaatcaacaaagagttttgagaagacactaatacatccgctcttaagcatcacactaactgaataacatgaagatcaacagaaggaaacaccattattttttaacaaatttctgatatcaagtcatgtgttaattggtaagtggaaacaactatgcttgttagttttacatggccttatcattggtattgtgtacccaagtcgatatctgacatgttttgcattcagaaataatgcatgtgaaaaaaaagagattatcctgatactagctgaataagttgtcgtttgccacaacagtttaaaatggcaagtggtagcagtgtactcacccattctccatggtaaagtgatctgtagtacttcacaaatttctcagaggcaccagtgtatcgtcccctttggcactcaaaacacttgaagccaacaaacttcattatagaaaagaaagtaaggacatatattattttcaaataaaaaaagttgaagtacgaaacacagagaaactgctaaggcctcactgtggcaaactatacatgtggtactcaatatagccagtaaaacagtgcctggttttagtttgttgtcagaaagcagaggtcagcaggtgctgttttcagttaaatctgaagattttaaaaaagaaggaacttattagcaatattgagaatagataatacaacagaataagatgttgtatgaatgagaacatggtcatgaagggtgatgtaaaaagtgggggaaatgaaatgaagtgtttatatgtgccagtaaagtttcagaaagagtaaatgggtcatcaatggaatgtattaggattggtttgtttaattaagcacacttggataccagattcctgttcattaaaaagacataggcccaatgtattaggataggcctatcaaattaaccacactaaaaaatagacaccagatttcaattcactaatcaatttatcataggtaaatttatttttccactggtgtgaattaggaaagacatgcagtggtaaatattgaagtgcactgtaggcagtaatcatgatgacactaaactgccataaccagaaattacctgcaaccggaaacattgagaagaacaaactgaactgataagcaagacataggccctgtttgggggagcttctcccagctgcagcttttcccaaaagctacttctgttagaagctgccccaaacagtccacagcttctgagaatctgtagttacagggcctatgtcttgcttatcagttacagcttctgagaatctgtagttacagattctgaaaaatgaactaagatgccagaagctggagaagctgggtttcagagcttttccagattctcagaagctggctaccaaacagctgcttctcagaatctaaagctcccccaaacaggccctaagaaacgcaattcagtctgaaatgttaaaacagatagagaacaaagcatagagcatttgcaatttcatttcgaaatacttcaaaagcttcagactactcttaaataataaactgccatgacatataatgcgaatcagaataatcaacttagtgaaggaattatcattgttctattatgtcaataccaaaagagaactattaccaactagtgaaaatttctaaagaactgaaagaatacctataaggctatataacatgtgaaactttcagctagtaagctgagcttgcaaaacaaactttaacactttaaactgagcattcaaactattaaatatccctatttcaacttaggaagcagaatattcactaatttagccacccgatggatttccgtatctaaaaatagcttctagcacaaacttcaaaactttcaacttgaatattccaattttcaactgaaaccttccaacttagacccattcatagagagattacactatagttaataaactagatcagaagcttcactgccatatcaatctaaatagattattgcttcttccttgcacccaacgacatggaattttactatagcttttccctgacaagatttgtgcgcaggcacttgagtgtaaaatgagagaggcgcaaaattcccagcctcccagggggcaatgatgcaaccacaggatgaggcaatccaatttcctagtactaaatttaacctacttaccgccgcagatcgataaaccgcacacgaccacaccctcctgcaataatcatccccctcttcgcagcctccgcgtcgctgatgacccctgacaacgcaggaccaagacttccagaatgatccccccggttctcggatttagttaggggcaacaatggcggcgagccggcgggtaccaaatgggatggagcgggcggtgtgggactccacagatggaacggaagcttctggaaaggatcgcgtacgcacctcggccatcatctccggggaggcggggcgcccggttacccgccggcgtcgcgcggcgcaacggcgggacgccgaggaggcggccgcggccgcggcggtgcttggtgggcgaaactggcgtgggccgcggccagcctccatggctttaggcctatgggggttggattcttgtagctgatgggcttacagaccagaagagcccattgggtatagcccaataagcccagaaggagcgatggtccatcccgctatgttggtgggcttttttcttggatacgtgtgttggtgggcttgatatgccattggacttgttaggcggaataagttcactttatgctcctcatctgaatgtcgagtttaaatcacattctttaaccgcaatatcataaatcttgaccacccaacttacaaaaccgggttgaattagttccttcagaggtatagatggatggttttgatgatgtggtagtgaaagggtcaattaggcctagaggggggggggggtgaataggataatttaaaactttatgcggaagctaaaactgagttagggtcggaaagtctgatccacagtcagactatccgaaaatatcagatagtctgatgttggatcagactgtctgatccactaaaagaacactacaagaagatctagtgcacaaacaagagtatggcgcaaacagtgactagatctatagcagcacaaaagcaaagctaaataatgggagaagagatatcaccaacaatgaaattcaccgagttgttcccggagttcaaatccttgaggggattctactctccgttgaggagctcactaagagccgggtctttgctaaccctttcctcaagaggttgcactaagcactcctccttccactaaagggtatctctttccttgtggaggcgagatccggccttcacaaacttctcccggccaaccacacgtagatcggtggctcgggagtgacacctagccgtttaggagtcctcaacatcccagagtaa

SEQ ID NO: 36788 - DNA, 13193 bp, Oryza sativa
aacattcaagatatcatgtgagataagtagtatttaatttaagtatgaaaaagtggtgtttgtattgtaagagtagtgtctaatactaatttcttgatgatgtggagtttatgaaaattatgtctaatgtcttgggttgggactggccttatcatgctctataaatcttttcctctcatctctcttcttttaaaattttgcaacacggctaggcttttgagcatgtatgcctcttgtgtttctctggcagtactctttgttattaggtgtgcatactactagcgcaggctgtgcagtgggattaggcggtgtcaggattgcaagagtgaactccacactcacagcggatccacactgcatgtgtacataaacatgaagacttcatgctgagatctgtatgattgtaggattggctccagggatcaatcttacgaatccaacagctgcacacacgacttgtgaatacgtcagttcctccggttccaaggttgcagcgcataaagtaaaataagccccatttgtttttggttttcatatgtaatttgagtttcattaatcacaactctatcaagagcaccccttttcagttgggttaatttgaaccgtgccattgcaaatatgtctattcagataaatgttattacaatttatctattcgtaatcgtgccacttaaattttcaaaatggaaccatgccatcgccgtcacgttttctatctttttttccccatcgacaccgtggggccccccccccccacctgtcaaatcatcttcttagctccatcctcccatcttctctttttttcttcccactagttaagtgcccgtgcgttgcaacgggaaaaaaataatacatcaatttcaaattatagagtaaaattgtgctgaatagttattgagtgtttcttaataaaaagtagtaatgcaataaaatcctaattcagtctggggatatacgtattcagctgtatttacactcatgacatcaaatcaggtaactaatcgcaacaagtatatacatccagatggcattgtgtatttcgtaacatggcaagtgaatgcaagagaagtaattttgcgagtataggggacaaacccaaccaatacagcataggaccacacgtccgcaattcaaacccagagcaataccataatgtttgcactgctaggatatgatagcgtcaacgattgattgagaacacgcccaagtatcttctgtcatgaggcacatattctctatgcctgcaatatattcaatataaaaatctaatgaaccacaatacataaagcatcaatatgtcctctagaatcacacaccacaggtgcaccacaagctagcttgtttggtcatattcatagcaggtgatattccaatgggagaggaatggaggaaggttgtacacttgctggagatcagagagtgacttagtttggtttgcctggataagaggaaaatgggtcagtccttatttgccagtatatagtaatagttatatatgtatgtcataccattcccgtataactattttctctatatgataatactatgtgtttgcttctaatatatactggagcataacatgtaatttgtgcaaagatgaaaacatcagtcacagcaaaatctttaaaaaagaagaagggaaaatagttgcataaaagagaagctttgaaatctggatcaagaaatgacattgtcccatgaactatttctcaaaaggacaaatccacattcttaaaagtattagtatttcttaattttctccacaagttcttcaacaacaaagacatttcatgggtcaattacagaaaatacagacctaaaaacaaaggatagagcctcttctttataagagagaagagggggaactttttggtggatattttagaacagtcgctatggttcaaggaaatagctaatcctcaagtgggtaatggacaatcaattctatggttggatgatacataagccaaaaaaattgaattgaattgcatatgagcacagaggtagccattcagggctcctggacccactaaattgatactttgctgaaaaaagggaacaaatcaatccaaaagtcagctctaaacaaatgacattgatctgttgatgtagcataagcagtgcaattaaaagccatggaatatgagtaaacggatggaaggtttcgtacagaaaaccccaatttttgatagcctaacaagaaccaatttagggagcctcataaataggggtggaaaaaaagctcgggctcgtgagcttagctcgggcttggctcgagcttggttggcttggctcggctcgtaagccaaacgagccaacccaagccttctttttagctcgttgctgaaatgagccaagccgagctagctcgcgagccgcttgttttggctcgcgagcctaggccatcgtgtgtttatatcgattattttactttatatggcgttattatttgtcaacttgaaatttatcattaagattttgaactattgaatatataaacttatttaaattttacatgttgatgattagctctttgctttttttaataattacaaaatatatatgaagaggtgttttaacaggaacgcttgcgaaccagctcgagctggctcgagccaggaaacaagccaagccgagctcaagttgtagtttgtttgccaaaccaagccgagccaagccaaacctagtttattgcgagccactgcaagccaagccgagctaggctcggctcaactcgtttccagccctactcataaaggtttctacaaaatgcaggccattcataatgcaggccacacaagaaatgctatctacttacatcaaaagacatcgagcgttgttcttctgaaaacagatttgtaggcagtcctagcagcctatgtactcctatttgtaagtcaaatatttcttaacttattgttaaaaaagacatgtccagcatccttgagtctagcttgcatcaacactggctacttcaatcccatgtaaacatatgaatatgacaggcaacaggataaagtttaagagaaaaatatagagcaaaaggtttgtagttgcagcctcaatcccatataaatgtttaaaagcttgacagcctgatgtaagattttttttcattttccaccgctggttgtacgattttgggtagcaatcgattgggtgggctggacaggtgcagccaaaaacgccgcaacaatcagaactgatcagtctcaatatgctgtgacttgagaatttaatgcgttaagaaaaatagagcagcacttaatcagaagttatgtgcaattgatctgaagatagcattatatagtttagaaaggatatggcatcgaggtggggaacaaaagtgtgaaaatccccaatgatggagcagaactcgatagtgaagcattacctagtcatcgaacatcagtttcttatgccaacaagatctcaactaaattgcaagctcaataaacaaaagaatcaatatcctctcttgttctttacactatacaaagaccatttcgtttgacctaacccatccatcctgcccaagtttttcaagtctaagccattggggggagttcctttagttggtttgctcagtgtttcacaaccactattttcgcaaatttgcatttgaactgtaatggttgaaagaacgagatctagcgatgcttaccttgtccacagcatggtggagagagttctggtggcatcggaaaggagagcgtgtctgttaggtagcctcctagtccttgctcacgaggaaaagcagataaatcaaccataggagatggtggaatatcattcccgttgtgtttcaaagccctagaataacaggtaatcaagcatgcatatcacacattttatcctataaatgatggacctcaagcatgatttcaagatagagtgaattcacattgaaaacctaaaaacgggctagtgcaatttacggatactaaaaaaagtaggaatgtccactcttacgtgagtgaaaatgtcaccaaatggatgactcccagagaagtcatctgggccaccacctgacgcttggcgctcagaaaatccagtagaacaatcgatcgcaaatcgaaaatgacaaatcacatattcactatttatgtcagtagtaaggaaggcaccatttggcattgagacagattatcatagtcctgtttggtgcaactgcttttaaatattattttgttgtttggataactgtttcccttagtttgatttataaaacaaactaccaggaagatagatctatatctctacggaaacttaaaaagcacatgcacagtcacagaaaatagttaataacctggtcgtatgtttcacgcttatcttcatgcttcaaaacctgagataagcatgacaaaacacaccctttagaataagaatgtccaatggttaatgtaggacaagctaagatggtgcccaaacaaagaaaccaaaaacatgttcaatgtaggacaaactaaaaatactctgttacttccttgtttcaggcttccattttaatttatgagtttccagatggatgttacatgcagcttgcactcatgcggttaggtctgcctagcgatggaactccgcccaccagatctatgctgagatgacagcgaggaaagaagccgctgaggcgctgacatggcccattctcctcccgcatacggcccctggtcatgggcgtggaccgtggggaagggatcccgaagacgaagataggagcgtggaatgttggaggtgaggaaatattgcaaaattagcatgcaaaaaacatcttaatggactgaataatatgcacataaataaaccgatgaaaaaaactcacatgatcttgttaacgatgttggtgtgatgcccccaatattgttatccatatcttaatttagtgttagccagctgaacaatcctaacagcatgcttcacatcgagagttaaaacttgtttctgtaaatcagaagaaaaattcaaaagtaaactaatgagagtgaaaataaattattctgaacttaactctgaaaacagcttagaaaagctgatgatattcgcaacatcatgttccttttgaataaaaagtatgaactccaagcagctattatatctgtttattccatcgattaaagatactttccattaggaaaaagatatattagctgcacatttcgtagaacacatgaatgcttgcaggtatatattagctgcacatttcgtagaactcatgaatgcttggaggtactctccatgcattggttatgtatatgtgtgtttctggtgataacctaaattagttacagattacaccttcagccaacatttagcttgtacaagtccaactcaagatcaacttctatattgaggcataaataaggaactctcaatttattgaggataaattatgaatacactgtgagaggtctttcttgaaaggaagattactatgatctcattaagaacaacaatagtagtgcggcatacacattttttctcaagtttctagtttgcatgaaataaatatcagttatcaatgttgataattcgaaaccacaaacaaaactatatacttattaagccgtaaggctgcactatcaggtcacttattgctattttttgggtttttaaaaaaaaatcatcatacacatggagggtctatatccttataactatgtgaatttggaatgtgagtcttatcctacaaattattggaagcatacactaataaaccattttatttgcactgtgcctcaactctgtagccaagttaaacacagaagtatttaatacagtaatgaccttttcaattcagagctttgaggcaaccttctgccacggcggggtgatcggttgctgctcggcgcggggtcgtgtcgtcgggggccagctcccatgatccagtggcgactgcagagggcgaggagggaggagaggcagtgtggggtcgcgttgttgggggccagctgccgcgatccggtggtgggcgaggagggagggaggcgcaggcggagatgggggtgggggcacggtcggagaggggcggcagcggggtgaccgtctgctgctcggcgcagggtcgcgtcgtcgggtgctagctcccgcaatccggcggtggttgcggatggcgaggagtgaggggaggcaaacgcgtcgtcgggggccggtgtcgcgatccggtggtacacgaggagggagggaggcgtcggcggcgctggggtcgcgggcggaggggcggcgcaaggggtgggtgcgcgggcgcgattgcgctggggaatcgggagcgagcgggggcagcggcgaagggagcggggagagcagttgggaagaggggcgcgatagagggagccgaaaggggagagggcgcgcgtctgaagcgttgattttgcaggaggatcctagaagcaatcttagcccttgaattatccaggactcaccaccaccactagagaatttttaagtagtagagatatgtctccaccacttcttagtttcctttctgccaacccatcctgacccaccacttctcagtcggcccgccactattgcgtccacctcgtcgatgaagacgatggctgtgtcctgtccctggcgagccggaactagccagtcaggcaccatactcggcccattgtaccatgcaagcctggtgctgttcatgccgaagaatgcctaccgaggtctcgcacacgatgaccttggcccgcatgctcttcccggcgcctggtggtccatgcaggagcactgggtgtgtcagcggcagcttgacgccctcccggagctcctgcttctgcgcctcgcaaccattgatgtcgtcgtacatgacgcccggcttgtcggtgtccgccatgatcggaaccgtggtgccgagcagccggcgatgtcggagggaaccacgccgacgagtgcgagcgatatacggtgcagcttgacattcaccgagggcttgaggaggtcgtggtggagagaaatgggaaaaaaagagaagacgatgaatctgacaggtgggcccacgtgcagatgatgaagaagactgaacacatgacgtcgatagtatggttcccattttgtaaaatttaagtggcacggttacgaataaatgaattataatgatatttatctggatagacacatttgtaatgacacggatcaaattaaccctttccagtttgagctagagactcaagtgtttttttctcaaaaattatgtgtattattccatgtaggtcctttttccacatgagttttgttgtgcgtcctctgttttgcctatacaaattaggcattacttttgcactttttaaaaccgagacttttaagcacatataggggccagttttagacaaaaactggtacatatagtattagtatttttttaaaaataatacctataatatattatagctggtgttttttttaaaaaaaataaccaacatatgtaccactacgagccaagcttgccacgtggggagcaaaaaaaaaatgttgtgttgtgtgcgagccaaatatctcagcttctccctcacctaattcgctccctctctataggtctccctctccctctcccgatccccacttttccagctctccctctccaccgatgcctctcattggcagccaacggttcgccttggccccctccctggtgcaaggcggccagtggcccatctctccccagccccctaatttagatttggggattttaatttggatttgggacagcgaggagcaattcgatccatcggtttgattcgagccgatttttttttacctcgcgtgcatcacaaaggtgtcgatggtggaactgacattaatgacttggagtcatctgttccacctctgtggtgccggttgggaaatccggcacctacgaaggtgtcccaaccatcaccgatggcactttctgtggtagtagtgtggctatttgggaaatcatgatgttatatcatgcaagtatttacaatttacatggtgaacacgcattgaaatgcgttcaccccagttcattcatcagtcgggagaaaataacttcaagcattcatgcatgtagaaaataactgccatatactcgagacatatctacatcagtatgcacctttcactttacatagctaggcttagtgcttttttagcatttttcattgttttttattagaaaacagtttcgaatatgcgtaatttactagtcttaggaagcatcgggaatataaggtcaacgatcatcgtcctcatgatagaaattatggtagacacgtgtaaaaaaatatacatgtcggaacatgagagtttggttgttctgtgggacaggacacatcagcaccttatgtttagattcttgacttacacctgccggtggaatattggtggtaccttccaccatggtgcatcaagatgcaagatgtggacaaatatggcatttgcatagtttgcttaagaaccagaggcagatttaaaagtcactaggaatatggtagatgtgcttcctttattagtccttccttgaatactagctttactttgtggtttcttctcttttcttcgaccatcacatttgtttctctatgacatgattagtaagcatcaggaacgaaaggtcaaccttctcagtgaacgctcgatatcaatcattgcacacatattggagatgaccaggatttccttaggtgaattctggcaaggaggaatgatcacacacataaccccagcttcaaccgatggaagaagacccgaaacacaaccaatgtaaatactaatgtaaatcaaccgtgtgtacatttaatcatactactagaatactaacactacgtgcaggggttgaggcaagatttcaccgagagtaggaccaagctatgctgtttcaaaattttcaccgagtttctatctaaattttggtatatattttgccattgaaattctttgtcacgtgtggggcccaagcccaagctgcctcacacgtggcttcgtccctgactacttagtggaatgtactgtaaaagctcccacaatccttaaaacaagagataataccttctaatagcttagagcttcagtgtacaactcgaggttgggctgtggcggtgcagttgggctagtagcaaagcaaggtcgagggttgggtgaagcatcgctcgcacaaacgcatctagctagctaccgttccgacaccacttgtggaaggagctcatgtgcatagggatcccacatgcatgcctttcactttttctgtgatattttcattcccgagtaagatgtgttcgctcttcaagctcacgccacgcatttttggcccaactaattaagcagcgtattgcccccaaaaaactggattgttctcctgtctaaacctgcgttgaatcaatataccaaaatgagtagggcactacgttcgcttgctagatggtgcaaagacagaatcgaaggtgaaattgttaagaaaaaatggagagagatgagtagaaataaccaccgagagaaagtcttcctaaaagctggtaacaaatacttcctctgttttaacatttgagcaaatttatagaaaaatataataaaatttgcaacacaaaacacacattgtcacttatatgggcctgggggtacctggctagggaaaagggaagcccttcctgtgcgacgcgcccagcaggcccaacgcccctcggaggaacgcgcgttcggccacgaagcggccgccctccccccccccccccccccgcggggggcttggggtaccttgtcatacccctcgggcccgaggggctgaaccgcccccaaggccctcgctcggccgccacgtggcagccatgtggggacttgagcgggcgagagcgccgtccaccaggcgcatttatgggcagcgctccaaccgccccagtcgcatttaatgcaacgtggcaggtcgtgcgccgcccactgatggacgtgcgccgggcgaccactttttgactggtccgtgacccggcgatggatggatgggacaggcggcagcacacccacgtcccacttcatgtcagacggcgtgggggccggtatgtcccgtcccatcatgtgcagggaaaggacgtgcaggtcgccacctcccacgcgtgtgtgcccacgaagtcgccaagcatttaatagggaatgacgggggacgtcccccgtgtcaggcgaaagacttcggtgggggccacccaaaggtagcatggatcgcttccagcccaaggcatgggacgcttttttgtataggcagtgtgggcccctcttttaagaggagagcgtaggggcagtgtatatggtatcccctttatctataaaaggaggatctcgccctgcgagcaaggggacgactcctggtagactagattttggttagaagctgtccaagcccttaaatttgtacgcgggcccccccaggatccgaactctctgtaaccacgcgaagatcattacacacacaaaagtagggtattatgctccatagcggcctaaacctgtataatctccctctctcatttcctcgccatccacctcgcaagcataatccccggggatccgcctcgctttcgcgaggatacgtccctaagcattgtgcctggtcccctagccgaactcacaaaggggggcctcacaatctcccgctagacagtatcaccctctgacacacatgttatcaaaatacattcactgttcaatttaataaaactaatttggtgtgtgtatgttgctattttttttttataaaccttgtcaaacctaaagatgtttcaacaaaaaaaaggtaaaaacgacttgtaatatgaaactgagaaagtaacaacaacattatccattaaaaaatgtattgaatgtgagtatcaattatgaggagattactatggggttaaatacactaggattcaatttgtgaaactcaataggaggctgcgatagttaaactaggtgaaaccccgcccattgctatgggagtttactatgataataataaatagaaataatgtgtaagatagctagacgacagaaacttgcatatagtgatgtggtttatgataatttaaataatatagaatgatgatccaaatgtaaaagtaatatcatgtgactttatgatagaagaaaatgagggagaatataattccgaccatagattaatcatttgatggctaaaaacaatttgaggtgatatggcttaatgagagaagagagaaataacattgactaagtgaggatgaattgtataggtatatagatattaaacaaaatgatggagagatatattgaaatattttgagaattatttggaatgatgatttgacatgcttggattttaaaagctctaaaatttaagtgagggtgaactgtataggcatatagaatattataaaaagtgatggagagatatattgaaatattatgtgaattatgcgtaatgataattcaattaacatgcttgcaatttaaagctctaaaacttaataaattagcatgcttgcatgaggtttgagatgcaataattgttaatggatgatgtggcatctttgcatgttgaagtttaggatttagtgtaccttaacattatagaaagataggatatgtgaaccagcatgtacgtaaacatggacatgatagaaatgtcactggtgcatactgcctcaaattagattttcgcgagattcacatatttatctctatatgcatccatgttttatgcttatgtgtaagttaaatttatgccccatccatgtaatcctaaaaataattatatatgtgcctatgcaaatggcattacgtacggggattcccattagctagaaaaatgtaaatgggatggcaataatcatagaaaccatttactatatttcctttgtttccacctacatatataaagtcatcatcttgactgtactcatctcctcacagtggttacatatagtcatcttattgggcgcccttctctatatcgtatggattgatgttccatccaccagccagtattgtttcttaggtgcataaagcctagcaagtaggtttaggaggcgatgggaacttacgattcggttcgtgaggcaaatggagtacttttgcaccttatgttcagattgtagactattggtatattggtaccttcctccatagtgcatcaagatgtgtacaagtatggcatttgcatttcgagcataggagcaaaagctaggcaagatgatagctggataggaaaatgggtctggagtggatatcttaatcaagggctatggttacatatcgtttaacgcggaacaatattatgttgctttacggagcattatgtgcatgctattattttttagataaccgcatgttattaaattgtgtgactgtgtacattttgttttgagcctgaactatcccatcttcagtacattcatctgacaaaaaaaaaagaaaagaggagcggatcggacaataaatttatccagcactagtattacagaaaactagaagaaaacatattacaatacaacatgcaaagcactaggaaccattttgggagtataagatttactctgtgcgcaccactatacacatgcagtgtcctgcgcaaaaccttgttcctcttctaccggtgttcagtaatcagtaggcttgtttaagttgtttatttgcttagtactgtacaccctattttttatgtgatacgtggtaagtttagatagtattcagaatacatggaagacttaaatctcagtgcagagaatcaggtgcatgtgcacagtctttaaaagaaagtgtgagtttcataaaacctattaggctgtgctcgggaggtgaggttgggaactcacctctcgcgcacgcaaaatagagtgacgtattttcttgtgattaattaagtacttttttgaaaaatagattaatatggttttttataaaacaacattcgtatagaatttttttttgaaaaaaaacgtatcgtttagtagtttgaaaagcgtacgcacggaaaacgagggaagtgatctagattgaaaagttggggaaagaactcagtctcagtccttttatgaagtatgaacgctagctcactttgtagtttcttcttccttggatcatcagatttctttaattttatggggtatccgctctgtcagagaaaatggaaggagaaactaatgagcagaaataacaaggaaaagatagcctatgtaaagcctggcaacaagcactactaaaaaaaggggcataggtgccggttggaa

SEQ ID NO: 36789 - DNA, 5755 bp, Oryza sativa
  unsure (1)..(5755): unsure at all n locations
ggttcttctttagaaccggcacctatagttgtttaaaggtgtcggttttacttgtttagactctgcggaggagggaanagcattataggtgccagtttagctgttccggcacctatagtgccgatctctatgaggttttttttttactagtgaagagcattatccataaaaaaaaatctgtattgagtagttcaaaataaacttttattccaatgattacatggctatggggttaaacacaccgggcttcaatttgtgaaactcaatcagtagaggacatggttaaatatgtgaattatacttgattccaatacttgaagtgccaatgtcactggtgcgtactgattcaaactggatttttctgagattcacatatttatctatggcatccaagttttatttatgtcttacatgcctatcatcctaaaagttgttatcatatataaaaaccatttagtacttcctttgtttcagcctgcatatatgaagtcatcacgacattggtcatcatgacattaattcactactggagaaaccatctttggtcgatcagccaaatttcacaatagttccggttctaataaaaaccgggactaaaaaatatctttaggaccggtttaaaagctcaggagtacttctgatctttagtcctggttcaaaaaatggtaggcagtgtcagacccctatattttctttaatcccggttggtgatctatttttagtcctgcttagtaacaccacccgggaaaaagatcagcatacacggagatcgaggcttgtgcgtggatcgaatcgagataactatctcctcctccctcccagctctacttctatctcctttcctcctctcctcacttacaccctatctcttcctctccttctcctcccccctcccccctcctccccacttctggcacgcggcggcggccgggtggcggagggccgggcggccggcgcggagggcagcgcagctggcggcggccggcagccggcggaaagcagtggcctgcacggcagggcgcggccggttgcgccttgtgttgttttttttctagaatttgtggtttggatctgagatatatttgatttgtgtgtgatgtgaatatgtgacgtttttgtaatgaattttgtagaacttgtgatgtatctttttaagattttgtgatgtacctggagatgaacgatttgaggatttggaggtgattatcgatttgggattttactattcggggaggattgatttgggatttcacgatttggggacgggggatggagtgaaatcaatatactaaaaacaatgaagaaaataaaaaaaataaaggactaactagaccttgcctgggactaaatctttagtcccgggactaaaaatggatttttactccgggttatttcaaccagtctttagtcctagatttgtagtcccgattggaaatccaggactatatagggttatcaaccgggagtaaaaagcatttctccacaagtgattgcttacatatagtcattggcactactacgaaaaccatttttcgtggcggccattttggatttttgttggcggaatttgcagccaccacaaagcaaaggccagtgaatatcaagatcttcgctagcggttattgacagccagcaaaaattcattttcgctggcggtcatcttaagccagccgccagcaaaaatacattttcgctggcgttggcttaagacggccggcagcgaaaatccattttcgctggcggctgtgttaaatcagccgcctgcgaaaatggattttgggaaaaaaaaaacacgcatgcagctgccagccgtcagcgaaaatacccatgctgccgcccattgattcattaatttcaaatttcaaatccacatctagattcgctgctcatttccaaattcaaacacgaaatacaaaatcatcattagcacagatcaaacatcatttacacaatcaaacatgatttacacagatccaaacatgtgcatcatctggaacaacatgcaaaaagaaaaagaaaaaaaatcaaatctagctgaaggcggagcaaggtcgacggtggcggatccggcctccccgctgcccagcggcggcggatcccgccaccccacggcctggcggcggcggatccgcctcctagcggcctggccgctgcggatcctgcctccccgcagtccgccggactccccgcgggctgccgcccgctcctgagcgccgccgcgcccgcgcccgagctcgccgcgccacctcccgccaccgtcgcccacccgcctaccgtcgccgccgcgcacccgcctcgcgtcgtcgtcggtggagaagagagggaggagagagggagagaagggaggggagctggagagagggggcgggtgggtggtggactggtggtggtggtggtgggccgcgtggtcaatattaatagatggtggtccatctatgcaagcggtccttctaccgccagcgaaaatctggcggttgcttaagtgggccgccagaaaaaataattgtattttccctaccggtctgtatgacacaaccgccagcgaaaattatctatctttgctggcggcgcacctaagtgaccatcagcgaaaatagacatatcttcgctggcggctggtataatgcgaccgccagcgaagatccattttcgctggcggtcggtgtcctttaccccctcgttacaattttgctggtagttttggcatttctccgccagcgaaaattataaaccaatgccatgaaaaatcgtttttctagtagtgtggtctttctctacgtctacaagtatggatgttgcatccacctgctagagttggttcctaggtgcataaagcctagcatgtaggtgatgagaacttaggattcagtaactgtcacatcggattgttgaatactttctctgaccagtagagcactgtgtgggagtgcatgcgagaggtgacggcttagtatgacataattcagatgacaacgcttcggcaagcaacgatggctctaacttatagagaaaggggtatcagcgtacaactgcagttggctgtgatgcaaagatagatccttgcatcctaatgtggctgtgttttttttttcttttgcacctatgtatcggacaacaataaggttatagcgataatcagataaaaatttctccaaccttcacatacaaaacttgtgactagtatataaccactctgttaagtgatctctaaaagcaacctattgataaaaaaaccggctgatgctaaattgaacatttgtactgtgaatgccattgaaactatctaggaacatgatattagatgatcacaggcaaggaaacaagttgcaaccgcaacaccaatcacagcagaatattcatggccatcataaaatttgttcaacttgtgtgtcatttatttgagcctttataagctaccgacgattcacctaccactaataatagtctcatttgtccgaccatactccctacatttacataacatacattatttcttttatttttcctataatgtttatagtgtaagattttaataatttatatcattccttttagaaaatgatttttaactcgaggtgaatttatcggggcgtgacagaactcacctatatgttctctcttttttgcatgagtgatctgctaccctgctcccaatactaatatatgcatgcatctcagtattcttgatccaaatccatctcacaatgtcttttgctaatatggataagtaaatttacaactataggctgttgtccgtgcatttgtttgcaagtcttgtttcttagtcgtatacatatagtaaagtatccaaacataagttttagaccaaagataatattttgtcttggacctttatgtatggagagtgggttcgtagagatgtcttccaaatttgctagccaggtgaggagcccaatatatgtcagatttcaacccttggagatactgcacacttagggttctacaatggaatttgaaattccttaattagtgcaaaactgtgaattactacattattccagtgatatcttagttagacattggagatggatatcttaggggctggaggagtaacgtgggatagactgtatagtaggtaagaatactacatgcatgatgtggcacttcaaagcagaaacactactagaaaaggcattttctccgacattggatctttttctttttgcgggcgggtatggccatcggagcgaaaaccccgccggcgaaaatgagtatagggaggagttggaagtccgcctgcaaagataggttatcgcaggcggaccacataaggcaccacctgcgaaaatgatctgacggtctgactgggtgactctgtgagatagtcggtttcgtgttgttttcttgaaatttctagattgcttcatgtttacgacttctagatggtttctatccgtatgtgatactattgtgtgctgatttgagtcaagttcgtgcgaacttgtacttagatatggagtttctttgttgttaatgtgcaggtgttattttaggccatgggagtatagccggtgatggatctaggctaggctttattcttgtgtttgatcctattaaatggtattagagccatgcttgctctttttaatcttttccgattacgagattttgtgacaagcctactagtatgtctccttcgtcgtcttgtggttgtttgggtgataataataggaaccctaaacttctgaagaacaaaaagtattcatcgatcaagcatgctctaattcacgaggtgttggataattttgataatgacaatgatcatatacttttagttgattttctctcaaatcaaggtaagtcttgtgacatttgtgatttattgcttgaggagaataagtggttgaagaatgtagtaaaatgtttagaatatcaagttgaattcttatcaaaacattgttcacatttcaagaattcttgtgttgatttgaccgttcagaataatttcaattattgcttttaatgatgaactataatattctatttcatgtttaacttttgaaattgatgttttaaagtgcaatgcttctatgccatgtgaatcttgtgttgctttgcaagatgagctattgagcttgctagtgctagaagtaagataagtgatctcaagtctttagatgaaatacactctgattcttgcactaacttggctgttgaaaatgagaagataaatttggcttatgcttcatattttgatcaattagaaaagattagagctgaaattgatgagtttaaagcgtagctttgctgcagattatgatacaaagatagtttgattttcattgtagaacttctaagaacaatttcaagtatattttaaatttatcttcatgatagctaggtgccaggagtgatgaagagaagcactaaattaaattacataatcaaattctaaattttggaatcggctttatagattataatccaaacttacctcattagagcgtataaagtctggatgacatcttgtctcaaactctcaatggcatttgatcagtacatatgtatgacacaaagtctttcaatttacacagtcttctagtatttgtattagccattggttttggatgtcataacgtagtcttaggaggcatagggaatgtaaggtgaacaatattgggattgtcatgatagaatctgtcagaagaatgtacaaaacaatacatctaatctagtgagactcgagagctttggatattcggcatatatatgatgcgataaaattggcatctgt

SEQ ID NO: 36790 - DNA, 13856 bp, Oryza sativa
  unsure (1)..(13856): unsure at all n locations
atattgaaaccatttattttatttttctattttggcctacatagagccagcaagactttgctcgtcttctcccattgctcacaaagtcatctcattgctctactctaagcctacaagaatgtctgttctatttaggcttaggcttaggaggcaacggggatttagatatcagagaatgaagaagataaagtattgaactgttatgtattttctctccatgccaatggtggcaatgtgtgagaggcatgaaaaattggcatttgcgcaaataagaaagcctccgtggacaatatcggctatatcagtcaagtgttgcccgatgggagcagacaaacacatcatttttttaaataaattgtcctttaattcctaattcaatctaaatgtgtgcatcacacggtgcagaggcttcatatattcatatatatgaacttagtgcgcgtaggaggcatcagagaaatttagattagaggggtatgttagtatcagattatagcatttgctacagatgccccccaactctcctacagctatggggcagtggatgatggttcacctgaccagaagcaaagtaggagaaggatggaaagctagttatcaaagatagttgtgttttggggtacaacgatgaaatatcagttctccggtagtgctagcacggagtcctttacgggttcttntggnncncccctgctattagggtacttccaacaaatgtaagaaagtaactattttcctcctaaaatttgatggtaaaatgtaagaaaggttggattattctctcaaatgaagaattccgagccaatctgctgttttattgtgggacaaaccatcttcatgtctcttatgtgtggaggcaaatttccaaggttccgatattaggaacaaagtcagaagacgactgagacgtactggccatttgggaaatcacgatgttatatcatgatgttatatcatgcaagtatttacatggtgaacatgcattttgttatgttgaataactgtaatacgtttcattgatcaagtttcttgctagtttgttcatcacgtactgggaaggagaaacagaaattcagtcatttactttggccagtactaagtccaaactcaagaatcgttatcttttgttgtgacatctcatacattagttagagattgatatctttgcaaaacttaggtgtattggcaggaatcttatacgttgtgtgcactatgatgcagaaaaaatagttgtaaaacatttttctattataacaactaggaagatagcccacgcttagcgcgggcatgggtcgtatgctaagattgagacgcttataagatgaaaatattaaccggtgaacatctaccacgatttctccgtaaattcttttcatcaacattaatttcttttataattttctaacctattagctttatattatatcatatttaagtaatatcaataaacaattatttataatcttcttcatcatttgaaaagaaggtagacttattttccctagaaaacatgtcaacgaagagtaagtgcaaagtaaaactaaggtatttttctttttttaattgcatatatattatcatggtttcttcgaggattaattgggtgggacatgaagctccactaaatatatgggtttatatagcctaatatgattgatgtgatttgagagccgatccatctatgaacatttaatgtagagtgggtcagaagtaccacgcaagctaatgtgaaagccaaatataattgcacaataatattttaaatgtgatgtaccatgtatacacatttgtttttcttatataagatagctctaactgttagaaataatgattccaccggtttaaagggcataggagtattccagaaatgtagtttaaaaattatggttgttttaatattcaacattactacgaagtaaacgttggttgtgatggaattttcccactcgtgttcatgtcccagaattaaaattctttcagtagtaggtgacgtacccgtcgaaagcgagacgtacgtagtgacttcgtccatctcaaaatatgtcatcctagtctatcagaagtactcatgggggtatgtgcatgtgtgtgttcacataggtgagtgcgcgcacgttgtaagcactcgcgtttgtactttgtttctaaaataatatcaaacatattttttgtttctcttttaatttaataaataaaacaatagggagggggtgacagggttgtgtagatgtgagagtgaggaggaggtggagattttatttttctaatttttctaaatgatttaagtgagagccgatgacagggtgtttcattttttctaagaatttccaaggtcatttatccgttttttataggacgtgagacatgataacttaagattttatttttaaaaaatagatctaatagataaaatattggatacgtcaatttaattgatcaaatttaatctagcacctcgtatgtccagccacgtgtcgctcggtgatttgtagtcagtgttcgttatgttctttttttttctattcgtgggaaaaaggctgttggttactccctgtgtcaaaaaatttagatataaatatggacaaattcacatttatccatatcttaactacttataaaaaatagtaactttccaatcgtcacaatatttttttgtccgtcaatccgaccaagcggtaccctctatccacacacacgcaattacatcccatacgatatccaaagaaaaaaaaagagtttgattcaaaatcagctaaaaattaaaccaacagactctgaatcgaacttaataaaatcagctgggatgatccacaggagtgaaagctggaaaccaacggaatcgagcaaatcacaaagcaatacgtaatatctgaccggcgacaagctcatcgtccgaagagagatggcaggtgacggacgaagatggagaggagagacaagctccagcggctcaagacacgccgtcgccgagggcgctccgtcaacccgcaggacatttctgcagccggatccacccatcggaagtagcggatggcgccgctgcggcggattgcggtggggtaggccacaaccgccgccgctcacggtgggcgaggcggcggcgacgctctgtgttaggggcaatctcaccatttcaaaaaatttctcacctgttttgactcgaaatataaaatattgcctccggtgtcctatagccaattacataatttttatagtttccattagccatgtcacgtttttacggtgtctcccagccaattacacatttttgggtgtcctgtatcaaattttgcttttttttcttataattttaggacatattatatggtgatttatgagcgctctagagcgttttaattgatttttgttaggtatagtgatttagtatcgcataatacatattatgttcgattaatttttcgttgttatttagttgccattcaaacgatagggtctaccatcaaataatgtattttaactttttatagtaaaatatagctaatgttatcttgatttatttatttaattataaataaaacaatagttatattatgttagttaaaaaaaagaagaggagataattgaattggtgaggagaggatggatgagtcatctttttttttgctttatcatcttttatcgttagtagatgtttttttttcttccgcctaacagtgggaagctttatttgtttttttttcaattatacttacgtacggacatttagttttatttccttttcccagccaccagttgcatattttttaggaaaaactatcacctttttaataatagatctaatctaatgttctaaattaacgggtccatcaatttaagtgaaaatcgacggtgagattagatagtgccacatggcaatccacatggcggtccaggagtgtttgtagaagcgccacttggcgactcgagagcgtttataggaagtttaatgtacttttagtatataatagaatagaatggatagataagtaagagcaatggcttgcagatcactctaaaaatactaataacctggactagaaacaatagagcaatggccgcagccacaactacaaactctgcgtgtcctgtggaaattatttcctaaattataacctggacctcattagagtgatatttattaaggttaattggattcatgccactgcaaatatgccgattcacaaagatgccaataaaattcgtctattcatatctatgccattgaaattcacataaaattagaaccatgccatcaccgtcacattttccgtcactgccgtctagttttccgtcacattttctttcttcaattccttcttcccttttcttcccctatttggtgggtggcagggacagaagtggtgcgtggtcgacggggaggaccatcctgcagcggtgtctgtcgccccaccaagcacgacgcgggcaagccaagccggcatgctggactgacgatatcatgctgtgagcattggccatgccgtgcaggtgcactgggctgagccaatccggccacgccaaagccgcggaagcgcctcgccggctccggcgtgtgggcacagcagccaaataagaacagaagaaaaatagaaaaaaggaagcaaacagcatcgcctgtgtctcaccgcctgcgctacgtcaacggcaaacaaggaagagcaagaagaagaagaagaagaagagaaaaaggaaagcagcgacggccgtgcctgtggaagccgcaacgacgacgccgagctcgcccaccaagcaatgcccgaacctccgagcagctcgcattttggtccgcaccggctgcatgctcggtcacgccatcccgcaccgggatatatgcccgttgctccgtcgtcggttcccatcttagatgggtcatgccaccgccggtgttgagtgaggggatggcatgggcggcggcgaggggtggtgagcggcaggacgacaaggccgtacctggggggtcaatgaggatgctgcccactctggtggtggattggaaggagagagaagagagagaacgtcaataagagagagaaaggggataataagatagaaattgacagtgatgacagaaaactgtacagcagtgccatgtttatgatttcataaaattttactaacatctagccgatatcgcgaatagtaatggtatttttctaatatggtaaatttgtaatagcatgtataaagtctgaatgacatctattctcaatctctcaattgtatatgctctagacattaagacatatgtacaacacagagtctttcactttacatggctacgcctggagcctttgtgaattttccattatttctatcagacaccggtcttggatgtgcataacatagtcttaggaggcatagggaatgtaagctcaacgatcttgggattgccataataaaacctaccaaggggatgtacaaaacaattatctagtgagactacttgagagtttggatgtccagcatgtgataatgcaacaatagtgagttttatgtgtgtttagcataagaactatatgcaaattttggaaggttggagagcacaagcgataagcagggagggcaggatatataggctgatgtgggtgaaatttgtcgctagatgaaggctttaggttacattgttcaacgagagtaggaggtggtggaggtgacctgatatgaatagtggtgagaaagctcaatttgattgtcaaatgtggtatgtggagtaagcaaaatagaggttggttgtgcaaccgcgatcattttggctcaaccgccaaccaaatgcaacagtaacatttgtgtcgatctgattctagttatgtgattttggagccaatactttggagaaaagatgagtattaaaaaaaactttgcatgcacattcaatctgacgtcaacatttcgcttttggaatataatgttgctttactgagcattatatttgtgtgaatcgtttgtgttattgtgtacattttgctttgagcctaaattcttccgttttagttcattgatgaaccccaaaaaagagagcagctactggacaattaatttatcaagtactagtattacggaactgctattttcaaacatattactgtataccatgctaagcatacgtgcctctgttatactagagttgaaagtttgtgatgttcatagatctacctcccatctctgatgtccatgtaaaccgggactaacgtggttttgcaccacccagcaaagatcagttctccggtagcgatgtgtgttatacctattttaagagggatgactcacagaagtttagatgtgtgataatgtatgagcttatgcgtcttccctgtaatctcaaaaaaacagctatattgatggcaaatattgaaaccatttattttatttttctattttggcctacgtaaagccaacaagactttgctcgtcttctcccgttgctcacaatgtctgttctatttagccttaggcttaggaggcaacgggaatttaggcatcatagaaggaaaaagatgagaacttaactgtaatgtattttctcttcatatccttatggaccttatccctgtcaaacaatggtggcaatgtgtgagaggcacgaaataattggcacttacacaaataagaaagctgccgtggataacataacacctcgatcactagaagaaagtattggctatatctgtcaagtgttgcccgacgggaacaagacaaacacattatttttttaaaataaattgtactctaattcataattcaatcaaaatgtgtgcatcaaatggtgcagaggcttgatataaacttagtgcgcctaggaggcatcacagagatttccattagattagaggggtctgttagtatcagattacaacatttgctgcagatgcccccaccagtacaaaaagggtttttctagacggacctaaacctatgtttgcatgtggaagcctggcctgtcaggccaaaatggtctgcgaaaatccaatttttacgtacgggtaacgcacctgcacacgaaaatcagattttcgcgtgcgggttatgtcaacggcacaaaaaaataaaatttcaaaaaattcaaaaccctagcaatcctagcggtggcgacggcggataggtccatcgtggggccggcggcgccactcccagccgcctcgtcgtccttgtccgatattctattcaagttgatacaagctttgcctatcatatatattgattctatctttaattgcatcattgtttagagtcgtatgggctaagttagaactttttcagttaggttgatattctaactaagttggtatttctctactgttgttttagattgatcaatatatccatcacgtctatgtagatatatcggctaaatatgtttttctcattatcgtcaatttttcgtttaggtccgatctattagattattgctaataagttttatattagtaagccgataggtttttctgcaatgtttcatcgttcatcgggatgtatcagctaactaggcaatatatatgtgaatctacttgcatcagatctctagcaaatgtatgcttttaccttcggacttacacttaccacactatatcagtattagctaactagtttattggttcagttctttctattattcttgttagtagcaggatcaaactaactggcacgtccaaacctcatcaagatttagggcctatactggagctaagcagatgtctcgggccttcgattgttgtgacgcattgtccatcaacgatacgaaagggggtgtggagttggtagctatatcaaggttttttttttagaatttgatcaagggttattgttacattgtttaaggacggataactttatgttgcttttcctgagcattacgcatatttgtgtgattgtgtacattttgtttcgtgcctgaactgttccatcttcagctcattcatcagcaaaaaaaaaaagagcaaacaatagatttatgaaggatcaatattacagaagattaatttccaaaaaaaaaaatcaactgtacactacgcaaagaactagttaccagtgtgtgcattgagggtggggggttacaagatacactctctataaaaaaaatcaacttcttaggattaacctagaaatatacttgtcgagatttgttcctagaaattctttttttttaagacagagggggtgactttatgtgcacatagccttttaatgaaagtgcgagttctataaaacctgttgacatcactaacacataacctcaacccttttttttacaggatgggatgttctttgtctttagcaacacaacaatttattgtgtgcttgtgtatatatgcatatctctgctggttgctacaactacaatgtccatggccagattagtccttcctcgaagactagcctagtttgtactttcttctcttttcttagaccattagatttctttgatttatggggtatcctctctatgataggtttagtaggcatcaggaacgctgggttgagctcggaagtgaatgcttgatatcaatcattcctcacaggttggagatgactataatttctttaggtgaattctgacgaggcgaatgatcacatatcaccctcgcttcaaccgatggaaagaagagctgaagctaaaccaacacgaaaaaatggggccttcaatatttcagcggaaccccaaccaacacgatgggtgtggatcccctggagttacatccaaatccactgggtggatttcactaaacccaagccgtccctttaatttcgatggctttgtttaagccatctcttcttccaccatagttatcttgtagagtctattttcttttaaaaaaaatattgtacagcttataaaaaacattatctcgtagagaacatgttatcttcgaattttctaacatcaattagagaagaacaaacaagacacgaacattgcaccgacaaaagcttgaggatgaattagttcaatgagggcctcgatgccgttaatttcataatagctcggttaagaaaagtttacagataatttcctatccagaatgctcttccgagacgctagatccaaatggacagacttcgcaagaaaaaataaaaagagaaaagaactggctatttctgtcgtaaatgtgtaactaggaagaggtgacatggccacatctagcttgtagaaacaaagtaaggggtcagatcggcccaaatccaccagggtggagttggaaggcaactccagggggtctacgccccaacgtacctattgtttacacttctgtctacattttttttcttttgatgtgcacaataaagtagtaggaacttagacttgagggcatcgagaatttaatgttgagtttatcctctccatcgctatatataagattttggtacaaatatgctaggccatttatctggttaagtatgtattatcctaatgagaataatggaccattaagaactgatggggcagagtcagagtcaatgctacttgaatcaccagagcggagtatgaccttgcattttattcccctaaatgaaatccgcacagtggaaatctaaggcctttcacagtgctcctacgtggagcattacctccttgtgtcagctaggaaagcgccgacgtgtcgagccggaccacgtcctacctgagtcgcttgcccccacacaagcagacgcgattctcgctcgcgcgagatcacacgcggcggagagaacacctggatcctgcgctgtagagggcatgcctccgacttgccgtcccttcgggccctcccgctcctgtgccgctaacctcatcaccgtctctcgctccgcgtcaccaacctcgtcgtcgtccccgcgctccgaagacaccgctgccatggccccgaagatgccgctgtttgccagagacggccccaaggacgtcgccgccactcggcgttggggcgggcggcgcttcccggagacgagcacggggatgccgtcgccgcttcactccggatccacgcaccgccgccgtcgacggtcagtcttctcatcaccggccaagagaggagggacgaggcggattggggaagaagtgccgcggcggatttgggggagaagcggcgcagtggatggcgaggagaagcggccggcggatttggggggagaagcgcgcggtggatggggaggagaagtagcagattttttttttcatttgtgcgtgaggataaaaacgaaggggtaggtggctgtggggtcaaggattcttttgttgggtcacgagcacagtgaggtgcgtggctttcgggccaatttcatcgcagaaatgggccagaggcacgcatagcatgccttgcactgccactgccctaagcatgacttaacataaccaactgagaaatgttagtgccaagagtgtcgaggaattaatggtgagaagaaagtacacaacataaagcggttctttagaatgactctgcttcttctacttattgagaatggtgccaagactatgcatgactctgttggtctctagttctaaaatgttcatggcctctttatccctttcaaggctacttagctacattgtttcgtctattttctcttttcttggatgaatctattggcatttgagcatgtctcatggcctattagatttctttcttaagtgctatcatagtattataataggcttagtaggtatcaggaatagaagaccgagcacattcaggcatggtaggatcaaactctggtacaattgttcaacatggaaaccactgtctcaggcaaagtctatatgtttctccagaagacgagaatgggtattagaagatgttcaacagctaaagaacttaagaacacaaagacaggacagtattgagggattaattgggcaggttttttttactgtattgtacagcaacaatgcagctaagtatgctgatggtagtcctgccagtaagagttagcagccttttttatggccatcatggaactcacctatacatttggcttgagcgatctcccaccctgctcctgatactaacatgcgtctcagtgttcttgatttaaatccatttcactgtgtatttttacgcacatgtgcacaaaaatttcaattttacatgtataggctattattcgggcatttgtttacaagtcttgtttcttagttgtacatatagtataagtaggcttgggatgtcttggatacaaacataaattatattcaaagacaatatttgggtttacactcttatacaatatttgagagatttgaatgctggaataacgtgtgataggctgataggtagcaattctacataatatggcacttcaatgcagaaaactcacatagacaacagtaatgctaaaatattttcctgttattaaacaaaagaatcttatgcacaacgaatactcgcatagacaacagcaatagttgtaagagaataacaattcaatgtgattatcaagatgccaaagccttttgtttgttgcttgagagaaaaaaggtccagactctcaattgatcgcagcagaaaacaatattaggacgaggtagtgagattttatttaagataatagattgaaaccaagcctctacgttaacaagggtgtatacagccacaagtattcccaagcacaagaactcggtccttaccctcatgttcagagccgaaaggcacacaaagggtcaagcatcttacaaagtactgaaaggagcacaaaggctccaatacctttcaaggcaaacagatgaaccaaactaaaaccgcgaccaaatacaaattacttttttctcctctttcctagattgcaaccaactttagcaaacaattgcataaccaccatctccaacaatttgcaatcttccatcatcacaacaccatcctcttcttttaacaacagtacagattaagacagtcatttttctttcaaatcttcgtgttactttatatattacatcattgatgaagcaaattgtgtcagttctagttacagatgaatgtgttgcaacaataaaaataatcgtcatttattatattttctagtgcaatactcctatcacgctaaatattgattaggtcaaggattcacttacagaagtgttcatatatagctgtcatgtacccctgcttagctttgctgctgattataatccaaaaatattattctgattttcacagcttgctttgaagaataactttaggtagtttttttttactttccttcgtggaaagagaaccggtcaaagaaagtaatgaagaaagagctcaaattaaattatggatataactaaattataaatttgaaaaatgagcttcgaattatgatctggatctcactcgagctatctattgtttacatatatatagtctggatgacatcaagtctggagctctcaattgtcatatgctctgaacacatgtatgacagagttagtctctcactttacttgctttggcctagagcctcttagagtttccttgtttctattagacattagccattggaggcatcaggaatgtaatgtctccaataccttgggttcctcgagatagaaactatggaactcatgtgcaaaataatatacctatattgagacttgagagttggattttgtgggcacaccgtacctgcacatcatgttgagattcctgacttgcatcggcgagatcgttagcacctttcaccatggtgcatctagatgtgacaaaagtggcaattgcgtgtttagcttgagaattggaggcagatcttggatggatggagagctagatcatgggttatggttgaagtgaccagatgggagaggggagctgcaggccaacagcgaagaagcacaaatcgagttggtgattgtgacgatccacctgaaatatttggatctaacaggggagaaagaggaagaacaaggaagaacagagacagagttggcttgggagagagacagatagtttctgtgcgtgatggattagttcccaccccacactaacgaacactggagtttttccctgggtgcatgcatcaagtttagtaggcttaggaggctatgggaattcagcctttacattatggatgctttcgagtttcgaattgtcatatactttccctagaaatgattggtcaggaggagcggtgagtataaggcatgtgaggtacggtatgaccggcagtcacgcagacaagtaagttgtcgagtagtaaatgggaaaggataggattaaggtattgcaaatttgttgttgaaagtgaaacacatgcaactcatcttaagaacgtgtggtctatactagacaagtgttccacaatgggaatatgagaagcatgatatttttttaaaaaactatctttaagttctaatttcatagacatatgttcaattgaagtaaattttacagtttgaatccagcccaaatctgaccatatactttattgagaattacaatgacacaaaaagtgttcttgtttggatttgttagttttgtttataacgtaatgttgtagtctttcagttaattcatcgaccacaaagagaaatgctttatgagatgttggcatagattttgcactatggtttatatatatcagcctcacgcatgcacgttcatatcgtttcgtactataatacggggaaatttgcgtagacatgtgttctattgagatgcgtttgtggttgtaatgatcaggttgatgaggattccattaactgcatcatgtgaaatcggttggataagcatctgcatttgcggctacagagaagtgttcgcaattttgtcaattcttttctctcaattcaatccctgaatttcattcagttacatacctagcaaggcgtataatactgcgaatgcatttcatctcgagtgtaaaagtagtaggcttaaaaaaaacccacaattgatgtatgatac

SEQ ID NO: 36791 - DNA, 4425 bp, Oryza sativa
ctgcagccctgaccggtaaccattaccagcccgaataatttaaatatagcttgatagaatgtctcagggactcaaaggtcccctttttttctccaacgagagttggatcaagattaacattttcgtggcacgtttttcaaactgctaaacggtgcgttttgtgtaaaaactttctatataaaagttgctctaaaatatcatattaatctatttttcaagtttgtaataattaaaactcaatcaatataatcatacgttaataccacctcgttttgtgtaaaaaacttaatcttcatcttcatcttcaggagaaaagaacaccacctttgacggcgtagtattagtatattgattgcctctacaggtaatcgccaatgattaggataaatttaaaatttcatgatcaacagctgatcataaatattcactaggtgattccccgtactttgctgcgggaattactaagcgattcttttttctgatagtcaagctagaagtaaaaaggacaaaaataacgaaacatcagggtttatcagtacttatcgtgaaacaaacaaattttaccatactttaatgtgaaacatattgataagaatatgctaaatattataaaataatagatagatttgttaaaatattgtgcaaatgatgtgaggggtgatgattggatatgcttgcatgttgattcatagaattaagtaaattgtagatgatgttgtatgcttgcatgaggttaaatacgtaatttattctaatggatgattatgtggcatggttgcaggttgagtttttttagttagtgggttataacttaaaatataggtactcaccatcaatatttactgttcctattcattcatcctatccgatgatccctatttataaactcttttgcttttctctttaatttcacctttcaatttttcagctcgattaagatttttagcatatatgtgccttgtgtttctctgacaactatagtgcaatgggcgtaggagttgtcgggattgcaacattcacctctgcgctctatccttcttctgcttgacagtacaaagcataaatatttgacggcatgcatgaaacataattccttgctagtttgcccaccttctccgaacgagttagtattatgtataaattgtctgattaactgacatgccatttaatctctaagttaattaatagttggacaacgtacattaattagtatctttttatgggtaccttatgttgacataattagaggcatgtacaaacgtacagtctgatatggtctcttagttaatacatatcacttagagatcatacttatacaatagttgagacaacaaaacatttgagccattaatgcactaacataattttttattacccttattttcttatattatcaccatacaacaaattttttctttaataaatgctaagagccgactctgagccgttgtcatgcctaacaaaaatgtttcccttttcaccctcttctcttttccatgttatcaagtttatacttgaatgccaacggaaatagcacgttaattaacaccgttgtacatgccctaagcaatcaaccgatggtgtgcctgatcccaaggaccctagaaagcttcgttgcaatgagattcttgtccagctgttgggtggtggggatggtagtggtacatatgtcactgtgtaaagctgtagagatgagaatgctaaggtttttgacctgaaggatgggaggaaggaagaaagtcgttattgtttttgccaagagacccatgttttaatagacgattttgtaaaatcaaaggtgtttttgattattattttctgatgaacaattgggcattgtagattattggttttgttatttggaatttattcacgaagtggtttcggagatgattgggtttcacaggtgaatctacaggttatcattttatgtggtccggtcagactgggctctggtagccggtcagaccggcgcagtccgcggtctgactggccgacactgtgtcggtttcggtttcgggttgtttatttggatatccgagtttatttcatgattatggtttctagatggatactatacgtatgtaatactattgtttgctgctaatgagtcaagttggagatagcttggtctcggaatatggtttctttgtttgttccatgtgtaggtaactcgatgtctcgggagagtatttgcggtgatggaccgggagtcggcttggggataagacgacgtccggggtggtcagagatcatgcgggatacttatgctagagttgatgcacatggttaatggagattccatatggcatacgatggagctattgtgtgcacatgggatgcggagtcaaatttggaaggagtccaaatttggtatgtttggttatgtaaagtttctttcttgtactagagggtttcctaaggtgtttaggactcctagtatgagtttggttcatggctttagactgcctacctcatgtataaatagagggggagcgtgaggcttcccggtatcgcttttcagagcaatagagttgagttttgagttagggttttgagtttagtcgaaatttttgtaaggagtgctgttggtgcactttgtaaacacagagagaatcaataaagtcgtcatccactttaagagttcttcgatttgtgtttcactgggtttcgacggtctaaccggcaactcaccggcggtcagaccggcggcggcgacaggcgcggcaggcgatctcggcggtcagaccggagattcaacaccggtcagaccggcggcatccactcggtcagaccggcagatcaatctcggtcagaccgcgatccgtcaattttgagggtaacatttatttccgctaaaagttttcagtttttgggtataccaaccattcaccccccctctggttggcttagttcttgtgattcgatcctacaagtggtatcagagccttgttttcttctttggatttttattgatctagagtttttgccatggctactcccgctaggttttcaactaagccccatgttttcgatggaacggatttttctcattggtgtagtaggatgcaatcttatattatggctgaagattatgatatttggagaaaagtttctcatgcttatgtgattcttgaagctattaatactgctgctgaaaaaactgtttttgaacaaaattgcaaagctcgcaacattcttttgagtggtatttctcgttcggattctgatcgtgttgctcatcttcaaactactcatgagatttgggttgctttgagcaattttcatcaaggaacaaataacattaaagagcttcgtcgagatctttttaaaaaggagtacattaaatttgagatgaaacctggagaagctttgaatgactatctttctcggtttaataaaattttgattgatcttagatctgttgattcttcttatgatgctaattatccacaatctgagatttctcgtcactttttgaatggtcttgacatgtctatttgggagatgaaagttatatctattcaggagtctgttaacatgtctactttgactttggattcactttatacaaaattgaaaacacatgagatgaatgttctttctcgaaaagctgattctaagtctagtgctttggtttcttcttcctcgtctttggatgttgatgcttcttcatctaagtcttcttttcttgctgtttttaatgccacatccgatgatcaactcgaacagatcgaggaggaggatttggctttggttgctaaccgtattgctcgagctatgaataatgccaggaacaggaaaagaggtggtccaaatcgttgctttgaatgtggttcaattgatcatcttcgttcgcattgtcctaagcttggggaggcaaaagagaagacaaagatggtgagaagacaaacaacaacaagcccaacaacaacaagtcgaagggttcttaccaagggaggaagatggagaatcttaggaaggcttttcaacaagtttgcgccgccttcgagccactaagtgatgtagatggtgaaagtggagatgatgacaagggaaagaacgtctccgatgtttgcttcatggcgcatggtgaatctgacacagagtatgaagataatgaggtgagtacttttgaggaagctattaatattttgagtgcaaaaaataagaagtgtgagaagatgtatagaaaacaggaatttatcattgaatctcttaaatctgaaattgataggttaaaatctcttattcctaatgatgatgattgtgaaaattgtgaggttttaatgaatgagatttcaaaaattagagatgttaatgctgcacatgatttgaaaaatagatcttctcttgcttgtagttttgctttgcacacactcactttggatgagttgtgtttaactaaaaagttgttgcaaaaat

SEQ ID NO: 36792 - DNA, 7108 bp, Oryza sativa
  unsure (1)..(7108): unsure at all n locations
gtnnnnnnnnnnnnnnnnnnnnnnnnnnnnnnnnnnnnnnnnnnnnnnnnnnnnnnnnnnnnnnnnnnnnnnacatagtaggcttaggtgtgttatatatatactagtttgtacctctttccaacttctactctctcgtttttcacgtgcacactttttgaaatgttaaatattgtgtttatttcaaaaatattctataataacaaaaggttatatttttaagttttttagctaataattagttagccatgccaactgctctattttacgtgaagggaaaatttttgaaccgctactatatattgaacacatccttaaaagacattgagaactttagattcacattatatgttacagttactattgtaattgtaatgttttttcttcaattaatgccccaacagctctagctagggcgctaggtggcggatcgtctgatattgcgcccaacagcaactcactagaatgctttagcttttgagaaggaaacaaataggtggaacactactcccagtggatgatcccgaagtattggcattagataatgtaacagctttgttgtgatctctagactatattcaatatgtagagtgtgatgctaccatcgggtaccggacaactagaataatcacatcatgtgagtaaagctgtataaactctacagagtctaaaactaatcgattagccatgctcacggttatgagcggcttggtgaaatgatacaagtatagtgttggtgatttactaaatgatttgtgaaatgggtatggtgggtaataatgatgattttgcccggtgcgggctgagaaaaaaagttcacttactgccatagaaggcacaagaatgatactatgatgatatttatgctactattattatggtttactctttgatttaaatattttgttgtaatatattattatttactattgcgaaacaaaattttctttatgctaaaaatgagccacaaatatagtcatctttaatttcagcttgcaatagtcctaggtttcccatggcttgggtaggacttgccaatatcttgtgtattggcccatccctcgttgtgtcttttagtcttatttgtaggaagcgggtgcttccgtttatcggagtttctagggatggttcttttctagggtgattcttagtaggttgcatttgtgatttgatagatacgtataccggagaacttatgtatattttccgctgcgtttgaaactctttttgtttggccaattggtggaaccattttgtaggactgttgccacctctaagttataagagccactttatgtacttatgtgccatgtgcattatatggatttgataacaatgttgtagatgtttatatggctagttggcgggactagtacagggtacgtttctaggtatttgggaattaaatccccaggtgccgatagttttaaagtggatctgataccatggttgaggtaccaaatatgatttattctctaaataatatgaatgaattaaataatcaaacagtactggatttggtggaggtgttgatgggtggtttgaagccaaaccgagctatatatatataacaatcaaggatacacaaatattcaagaaaatgcacacaaatccaacataaaagactcaacttaaatagaaaaatattgagtgttgcacaacatgtaaaatattgttgtgcttcctctgctttggcctatgtaaatccagcaccactttggacatctgctactagagagaggctagagttcatacttatctcattgttttttttaacaagcctatacatgagcatgtcttttgcataaccatgataaatctgtttattattaggtgcattaatacaatctttagtagtcttaggaggcatcggtaagtttgtattcaccgggaaaattcaaacatgtattagattgtaatatgcttgctctaaatgccccaatagctgccgagcggtggatggaggtgaaactgaaggggtgccaatcactagggactaaacatggaaatgtctatggcctttgtcctgaaggactgaaaggagtcttttgtcgatccctgtcttcttggaaaaagatcactgtgttgataaacgagttatcatgcttatgcttggataattaaattggcccctttagccacagagttttaaaagaaatattgtacagttggggctaagcacagacatacaacagtagtagagaagtcttacataaaatacgttcaatggagaatttttgtcagatccatttatttatctccagctaccatccatgtgttatatatatgcatgtgtttattaacgcgtatgtacaattttgcctcttctatgccatcccaaaagtaaccatgttagtggcaaccaaagaaatcatttatttccttcttccctcggttttgacgtagctatatagagagaatccattatatgcccctgagtttactctagttcaatgatttcccatcgactttgtcttcctctataatataccaccgactttatcaattttttctataatatgccatcaggatggataattttcaaaaaatacctaaaatgcccttcaagccatacaaggattgccgattgattggctctttataagttttgaaaaaaatatgaaagttttagtgtagccttcttatacgatataaagttttttttatatattttaagatttttttcaaaatatttttatgtggtatatgaaagatgaatcacatacacaaaacatagctacattagaaaaataattttgtgtagcatatgaaagattatttatataaacaaactcaacgttacagtattttattagcatatgaaacataaattatattttcaaaaaaattaataaatgcaaattgaaaatcttaaaatccacacacactttatattatgtgtggggactatgtaaaaaaatttatattcttacaatacttctggtaggtaaattaattgtcaaccctctatggcttgaagggcactttatgtattttttaaaaaatatccaccctaatggcatattgtagaaaaaattaacaaagttggtggcatattatagagggagataaagtcaatagcaaatcgttgaactggagtaaactcaggggcatagaatagatgctctcgttcctatcatgacttatatatgttgcttgtctgctcagtgcttacaatatagtcacggacagtcatctgatttggtcttgctctaattatacacgaacgtttgttcgtccatccatatcgccagtggtagttagctaggtgcaaagcgtagctaggcctaggaggcgatgggaaattcggattcagcttattcaggatactgggtaatgaattatcagattgttgcacacatcaatacatgaagcactcaatccagtggaatggtttattgttgagggatatccatcaggttaaaagtgacattattattttatcatgttatcaacatcttttccggctaacaaacctttttttgaaaacctttccagctaacaaacctaaagcctaactgaggttcgccatgtataacttcttatatgtacatatggataatgtttgggcatgtctccatgtattgcatacatgccttttaatctttggtatgcacaatatactccctccatattttaatgtatgacaccgttgactttttgtctaacgtttgaccattcgtcttattaaaaaaattatgtaattattatttattttattatgacttgattcgtcatcaaatattttttaagcatgacataaatattttcatatttgcaaaaaaaaagttgaataaaacaaatggtcaaacgttggtcgaaaagtcaacggcgtcatatattaaaatacggagggagtatatattaggcttaggaggcaaggagtgtaatgctgagtctaccctctccgtcaccattgagattatcctatatatagttgaaacttgaaacataaacttgatatgcatttacatcaattcagtgttcaagcatagcaagtgaaagaaactggagcatttacatacgtttacatcaatttcgcatgtactataaaccaaccaggcaaccacatatgttttacgtgtagttagggaaacaccttagctttacttcaatttcgcattcaactacagtccagttctacgtgtagtcagggaaacaccttagctttatcatggtggtgtagttgtggtcgtatgttttttgcacactagaactcaaattttgtattttgcagttgcacacatggaggtccttttttcagtatgaattttcgcttctgtgctctgttccggcctacataaattcagcatgaaactttgcacatctgcttcgattccactgctccatctcattgatctctgcctgacatctctgtttcataggttcctagttattactcctagctcagtaggcttatgacacattgagaactattgatccgtatgcccatctaatagaacacttctcgttttcaccttaagaacaggggagagatggacaactgcttactaactgcagaggagtcttttttatagttcgggggggggggggggaggtgcttctagtaactcccttcctattaaacatctacagtttattttaatgggtagcgtggagattatgggtacccctatagttggccataaggcccgaggcccgaaggcccagcccacggcacgcctttttggcccggcccaagcacggcacggcccgacttgggtcgggcccgtgccggcccggctcgaccgtcgggccgtgcctgggcctccccaccagcacgctgggctggcctggcacggtcgggccggcccggcacgatgggctggcaggccagacccggtacacaaagtatagggactaaaaatagacatataaatgtcaatgtctaaagaatagggaccttaaatagacttattttagctatttatataccacatcacaaagaagagggaggtaaaatagactttttttagctatacaatgtcacagcccaataggagggagaaaatttagacttattctgaggaaaagcacgatggcccatcgtgccttcgggccggcccggcacggcccgaggcgtgttgggccgtgcctgggctgtgagtgcggcacgtgggctggcacggcacggcccggtgtgtcggtcgggccgtgccggcccgacaagcctcggcccaggcacggccgggcctgggccgtgctgtgccgggcggcccacatggccatctataggtaccccatacctacacggtatggttatccgactagttataggggatagcttgtatctatagaatatataacggatcatgacttgggtattacgttaccttgtatattatagaacggcctaaagtcctgatttgataatattgtaaagtaaatttaggataccgataccgtattggttatggtttctatgttgtaatcctacctccatcctatataaggtgggcaggagaccttctagggggatattgacacccctgatcgtcggatctacaatacacttggcggattcaaattctcaaatagtaatagggtattacctctcattgaaagagcctgaacctgtttaaatcctttgtctccgcatccatccacttttagatctcgtacgctacccctttatattgctgaaatattgtttcgacaggtagtttgaattgaaagtagtggctttctacgttgcttggtatgtataagaggcattgatcaaatagaatctagcgaactgtgattaaaggtactagtgagagggtacttaaagttgtggatcgggtacgaaagtggaaggttagaatagcaatcggcttcccattatgtcctccttagttttagggcaaattagttcatctgttacggtaattttcattgaatcattattttatcgtctggttgaatgaccatttgttcgatttgtgtggtttttggctgcaacaattgacgcggaacaaaaatgtgatgtaaattgactaatagatcgaatctgatcatctgaagagtgtgcatgagagatttaatttgtcgttgtcaaatggaactagaaggcatcatctactaagaagagtaattctgcatcatccccacaatcgtgtagcctctgtatggtaaaaacagcaagtcaaccagaaatactcgtgattgaccaaatgaacgacggcatggatgcaacatctgatggcataagcaagcgatgcagagtaaagaacactccaggatctctttgccatctctttggagttataacgcaaaactagttgatcataaaggtatctaacgaccaacgattttttctgtaaacaattactacctgtatttgtgtcattgtttgttaccaatctacccttcgagattcttctgtaatcaacggtggatactcatttctacaagaggtatgggagggacctttcaagcaccgtaaaagatctcgttaattcctatgtttcaacattaggtaacataaacagaaagtaacgggtaactttagccgtgatagccattccaatgtttcaacaactaatccaatataagtaacttgttctgtttaccggttgtctaaaattggactattgtgagagagcacgcatcatctttccgtggaagacaattacttggttgtagtataaatttaataaaaagataagttctctaaacatcatgagcccatctctgtctactgaaccattcagggcatcaaccatgcagctaatactactacggaaatgatttttctgtacaagaacccctataggttgtagatgaaccataactggttgtgtttgcaaaaatgaacccctattttcgcacacgtctacttatgatgcccttatgcaaaaaatcagcttataaatagccttattgttgcttgttatctagtcagatcatgagttatcaaagtgagagagcttctagacgcctagttgattgccgtgcactctctctctatttttgtaacctataatattgaagttggcatgtgtgatccgctactctgctctcaatactaacagttgtctcgatactctttatttaagcccatttcctagtgttattttgctaacaggaaatatgaaatttcgtgtatataaccagggctgcagga

SEQ ID NO: 36793 - DNA, 3434 bp, Oryza sativa
tacgtatatgtttatgccggcctctttcatgtataggtaaacttagttatgtccctaatgtcaatggcaatagtcatagaaaccatttactgcacttcctttgtttctacctacatatacaaagtcatcgtgactttgcttatcttcacacatattgcttacatatagtcatctatttgttttttgtaagttatatggatgttccatccacgtggcacggttgattcctaggtgcataaagcctagcaagtaggtttaggaggcaatggtaacttagaaatctctttgtgaagggaatgaagtactgcgatactttatggtttagcgtgacacgactccgatgagaacgctagggcaagcaacgatggtaaaatatgtaggagaaaggtgcaaatgtgcaattggcactgatgtgttgtaaagagatcatggcaattctaacatggctatgaattttttttttgacctacgaatgggccgggcaattctaatgtgtaattttttttttgaacttgtgaatagggattgcaatttcagaaatttcaaaccctcccggcaagtgattatctcagctgaattttttgttttttctcaattttttgaccaaatatttagtcaaattcagttaaattatgttaacatttaaagaaaaggtccaaaaagtcccaaaaataccgaaatttcagccaaaatcgaaattaaaaaccctgctcgtgactagtataaataggtgaccaccaaactgtgtaaaaaaaccgcatgatgcataactgaacagtgtttgtgaatgccactagctaccactatgatattagatggtgacagccaaggaaataaactgcaaccgcgcacaacacttcatgaaataagttattattattgtttaaagaaactgcaatttgggcatcactttcaattcgatactcgatgtatatgatagtttggataatgatccgtattgtccagtccattaaggccctgtttagatccaaagttttgttttcaaactttcaactttccatcacatcaaacctttcatacacacgtaacttttctatcacatcatataatttcaaccaaatttttaaatttcagtgtgaactaaacacagcataagtactagtgtagtgctacttcatggcctgaacccgcaggttttatgacttttaggtaggattggatgtgaaaaagcattgaaccggtagtgttgccctatcactgttaaagtgttaattcacactgaaccagcagtggtagcccgttccgtggtagtatcacaagtctattatataggttacatgaaatatctatttgtggcatgcatttttttttatttttgctcgatgtatgtctcccttgtaatcgaataaatgggttgtgacaccatatgtatccagctttgaggactatatatataatataagtcgcttgtttgccagtaccatttctggtccagaggactcctccgaatgaaacatatattctcctgttgctcactcaaatgtgaatttacacctcgtcatgtatatgaccttttgggtgtgcatcatgcagtaggtttaggaggcatccggatgtacatcagtaacttaaatggctgaaaaatgcagtagtgaagaacaaatcgcgacggcagcagcgatttgggtgatggcggctagggcttgtagcagctgctgggctatcgatctcttccccttttcttttttttttgttttttttcagttggtttaatagatatcctgatgaagatcgaatggcccatattaattcgatcaccgattactataaacttattgtctattttgcactactcggcgagctctacgcatccgcggttcctgatcgcctattcaaacaacggtttaaaaatttaacttttgtgcgtttgttctaatattccacgaaatatttcctgatcgcctattcaaacaacggtttaaaaattgaacttttgtgcgtttattctaatattccacgaaacatattaattggaaactcggggcattacattcttccccctttaattaaattcgccctcgaattcgtccaaccattctctagaacacagggtattacacgatgatctacaggctttccccaagctaggcgtaatctgaagaagtttgcagccttgtcccagtgtgctaacccattcaaacctctaactcttaggctccataattccataaacttcaatacatatatacactgcactaaaaccttgaaatcagattctccctgcgtcccaaattacaaggcctatattttttctatacggccttcaataacatactagatcattaatatatttcatattatgtttcggacaaatataaaatgagcatcacattaaagtactctaaaatataaatcttgcggtataacatgcataatactttgtgtctgtgtgtaaattgaagatgtttttgccgagattttggtacattatccgtgtttgaatcagattttaagttcgtttacttttagaaatacaaaagaagtcgtataagaaacctctttaaaaaaactcacttactaatttcagatgaaagtcacactcctaattatagctcatgattttctcaaaaaaaaatatatccaagcgaattctcacagtcaagttcaccctaactaaatgtcacgccccgaactagtcccgactggaactagcccgtgacgctccaaattaacctgttaatcgataccagtcccaggaaacagtgctggtatcacaggaagacagaatatcacagcaacagaggtctctttattatagagtaggagtacagtcatgttgggctgcggacagatcccgagctcacaactgcattacaaaagggaaacggaagccaggactcgggccaaacaacacaggcgcgacttgggaactaggccgaaaccctaaaactcattgtagccggcttgctcctggaagaactcctcatcagcaggatccgcttcatcttcttcagcatctgggggggattatttatatagagcaagggtgagtacgagagtactcagcaagccaggggaaataagtgtttaatgcaggcttcaaggagaggcgggtgtttttgcaattgattttatttgaactcttttctgaaacaactaagtgagtgcttcttaaacgacacggatgagacagtgcgtctcgtccggtcggagtatgtgcaatgtattagtctttagattttgaaacaaggttggcacccggccaacagcttttcaaacggccacccgggccaacaacttccaaacggccacccgggcgtagctgatcccatcagctgcagattttccaaacatcgaacccctttccacaacagcaatttcacaagcagtagtcaaataaaactacgctaggaatcacctcacatccgcccatgaccgtgggcacggcttatcgaacagtctgggctgcagga

SEQ ID NO: 36794 - DNA, 1510 bp, Oryza sativa
  unsure (1)..(1510): unsure at all n locations
cggttttggaaattcatttagttcgcaagcaccgacccaggtgtcgggttttccaagtcttttgtaaaacccaagttttacccatgttgtttttcagattttaagtttgaaggcgtccgctgatactcgcactaggtgcgcgaatatcgagacgcaactagatggttgcaaagggacatggtatcacaattaacaaagaaaggatcaaatgcaacaaattaggtaggtctaccaatctgccttgcagacgggacaacagattaagtgcgatcctatcaatgcataatatttttcaagcaacataattaaatttcaaatataggctcaagatgttcaaaggtggcttgccttgctcgagatctggagctcgatcctcgaaatcctcgcactgcgggtcttcgggctccgaaactacacgtgaaacgggacaactcaacaaacggcgaaaataaagccctattaatgacctcgaagcgtgccattagatagatctcaagatttgaggaattttggaagttgaacggagtcaaacggacttacggttgggaagatattgaatttctaagattattggatttttggtctaaaggaaaaggatttaattaaatcctttttggaaaataaaagaaaagaaaagaaaagagggagggaatatagacttttctcgggcggctagggcgcggcacgagagaaagggcggctcggccgggcttaacgggccggccggcccaagaaggcggcccagagcggcccaagacgcgcgcgcgtgggagggaggagagagagagagccggtggaccgggcttaccacgcgcggtcccgggtggcacccgcttgtcagcggctcggctcaccgtgcggagggagcacgcggcgcggcgctagggtggggggaggatgcggtgcacgcgcgtggttcgcggtggacgcagatgcggcgggcccacgcgcagcctcacggctcgcggtggaacgcgcgcacggggaggggctgaccggggtcggctcgacccggtcttggctgagctggcgccgacgtggcgcctacgtagctgccacgcgggccggcgggaggtagacgacgacgccggccggaacggacggtggacgacgcggcgagcggcggagcgaacccggcgatacaggcaaaacgagcacaccgggtggttgcaacgtgacgaggggagacgagccaacggctcggattcgccggaggaagcttgacggcggcgaatcgcggcggcggcaaccggcggcgggagaaggggaaaacggcgacgaggtcacgaggggccaattcccggcggcgagagcatctacgcggctacgggaatccgatgctagcgtcggattgggcggaactacgccgagcgaggccggggacgagcgggtgctacggagctcgagcggcgacggcggcgagcacacggcgagtgacgacaacggtcggggcggcgccggctagggggcatcccactagttnctagagcggcnncgcccgccgcggtgg

SEQ ID NO: 36795 - DNA, 9319 bp, Oryza sativa
cgaccccgagattcagcacctaagggagcagctccgggaactcggcgcggagaagatcttctcgctcccaggttgttttcactggcacgaaatgagccaatttcgtgagtcgatccacgattacccaaatggagtcgtacccgctaggggttcttggcaaaccggtgatgaaatccattccgatttcttcccatttccactcgggaattggtaggggctgtagcagaccagctggcctctggtgctctgccttgactctttggcaaatgtcacacaaggctacgtattctgcgacatctcgcttcattccagcccaccagaagtatgccttgatatcttggtacatcttcgtacttcctggatgaatggagtaggcggactcatgagcttcctttaggatgagatctcttaattccttcttggccggtacacagatacgtggaccgcaccaaactgtgccttgatcgtctatggagaaattggtgtctttcttctcctgtattctttttattaactcttttatcccttcgtcgtctttctgagcttcccggatttgcgactctagggtaggctgtactgtcaagctggcagggacacctgactgtaccacggtcagcctcaacttctccaattctctgcacaggcgatcttggtcaggccgtatttgagctacattgcaataggccttgcgacttagcgcatcagcgaccacgttggctttaccggggtggtaatgaattccaagatcgtaatccttgattagttccaaccatcttctctgcctcatatttaactccgtctgtgtgaagatgtacttaagacttttgtgatcggtgtatacttcacatctgttcccgattaaatagtgcctccagatcttaagagcatgaaccacggctgccaattcgagatcatgggtgggataattgacttcatgaggcctgagctgcctggatgcataggccacaacctttcgttcttgcattaggacacatcctaagccttgtcttgatgcatcacagaagatctcgaaatcttttcggatatctggcaaggtgagaactggggcagtggtcaaccttttcttcatttcttgaaagctgtcttcacaggctgcagaccattgaaatttcttttccttctttaacagctcggtcataggtctggctagcttagagaattcttcaatgaatcttcgataatatccaactaagccaaggaagctgcgaatctctgacacattcttgggcgggttccaagcaagtacagcttcaaccttgctgggatctacctcgacaccgttggaggagatcacgtgtccaaggaatgctactcggtctaaccagaattcgcatttcgagaatttagcgaatagttgatgatccctgagcttttccattattagcctcaggtgttcagcatgttcttcctcattcttggagtatatcaggatgtcatcgatgaacaccacgacaaactggtccaggtattccataaagattttgttcattaagttcatgaagaacgctggagcattggtgagtccgaaggacatttctgtgaactcatatagaccataacgcgttgagaaagcggtcttcgggatatcttcagatctgattttcaattggtggtaacctgatctcaagtcaatttttgagaaaactcttgctcctttaagttgatcgaacaaatcgtcaatccgtggcaacgggtacttgttctttatagttacttcatttagggctctatagtcgattaccattctctcagagccatcctttttcttaaccagaagcactggggctccccaaggggatgagctaggtcgcacataacctttactctccaattcttcgatttgtcttttaacttctactaactcattagctgccattcggtagggtctttttgcaattggtgcggtgcctggtgccagttctatggcgaactcaatctcccggtctggtggcatactcgttaattcttctggaaatacgtcgggatattcacagactatgggcaccgactccaaggaggtgacttgtaaacaggttaagatagaccgacttgcggtaggagtgttaggggtaaagcggacttgctttcctccaggtccttgcaaggtgatggacttttcggcacaatctatctgtcctttgtgctttgccaaccaatccatccctaggatgatgtccaagctttgcgagtctaggactatcggtttggctaggaagtcaacttcctcaattctaaggttaacttccaggcatatttgagttgcccttatatccctcccaggggaatgtactatcattggtacacgtaaattttgggttttccaaccatttcttttcacaaaagcttgtgatatgaaagagtgggaagctcctgaatcaaacagaactattgcgggtatggagttgacagagaacatacccatcacaacgtctggagcatcctgagcggtctcggcttgaatgtgattcacccggcctcgaccaaggttgttggacacacgagaaccttgtccacttgcctgagagctaggacgagactgagctgccgctggagtaggagttctggcagtgctgccattagcatgccctgagctggtgttggtaggattctgagggcactgtctggcatagtggcccatctggttgcaccggaaacactgaactgctgacggtccctgtggtgacttgaaagaggtaacactgttgggcgcagtattgccactaggggcacgctgctgtggctgaggtgccggacagttcatctgaggacgaggggcgtagcctggctggcggttagcctgagtgaccgactggtggtattgcatgggttgaccgtagtgagggcgaggtgcgcctcgggaagaatttccctgatggttagagttgcgtttcttgtattcttcggtagcctcttttctggcatcttcaagtagaagcgccttgttgatcatatgctgaaaagtggggaagtcatgagcaagcaactggagtctcattccaactgcgattcctttcacgaatttcctgatcttcttcttatctgtgtccacttcctcaggggcgtatcgagccaagttgttgaacatacttaggtactcattgacactgctgttgccttgcttaagtctgttgaattccactttcttcatgtcaatggtgctttcaggcacatgagctgcacggaaagacgtagcaaactcatcccaagcaatgttagtgggttcagggtgtgcattgcagtaattttcccaccaatctgcagcaggtcctcttagctggtgagaggcatagagcgtcttctcaaccggagtacactgcaccaagttgagttttctatccacatctttcagccaatcgtcagcctcgacgggctcgacggtctgagagaactctggcggacgagacctcagaaagtctgtcagcttggatctattgttgctcatgtgacggtggccatttccatgcgcagtatgctgaaaaccggctacggctgcggctaatccttgcaagatttgtgtctaaactgccattaagtgctgcatgttgttttccacatgaggtggggaagggaggcgttcttctccagaattgtgactggcagtgcggtgagagcggtgagactgttccatctctacatcacaggaagccgtgcgatgcgagcggttgctgcggcggggttgctcaacttctgcattgcgggaagcagtacggtgcgaacggttgctgtggtgagactgctcatgatttgcttctggctcggctctaccatcttcaaaaccaaagcgggctggtgcacgagctgcacggcgggggcggctagccatctaaactcccagaagagggcggggtaagaatcaaataagcacttaggagggcaaggagcaacgtaaatagcaactcagatagcacacactaggcataaactggatttttcaaatcataaaaacacctgatacaacgggtgtggacaagtcacagagctacgccgagcttgactgtgcgcacaccacctaggagaaccagactaccgaacaacacccacaacaaacacacgcacgcactaccttgccacgactccgaaagagttggcggcggaacaaaagggcctaacacacgggcggctgctgtagactgcctcctctactcctcgtcggcctggctgcctcctgtagtcggctcctcagtcgaagaaatgtcgatcggctgacgcgaagggaccggcggaacctgtcgagggccgacagcagcacgggccgctggcggtgggggagctgggtagtggaaacggaacacggtggaagaaccaacaacacgcttccgcgcggtgcggataaagcgtgggccacggcgggaggaagcaactggggtgtgtccgggggtgtaggaggggctaactgggtgtgggtagggggagtacactggtgagtacggcgcacgcgagctgggggagcgcgggccactgggagtgcgggcagagccgcgggagctgtgggaggacaggtggctgccgtgacagaggcggcggcgtagcggcgggcaagggagcggtaagcctcaaggagtaggtcgtgctgagtggcctgagcctccgaaagctcaaccatgcgagtcagcactggctgagactcgctgtacggacaagggtacctggcgtctgagtggccagaaggaaggcgtggtagctgccggaaggcgaagcccccgagatggtggctgtagtcgtgggccaggtgacgaagcgcagtccaggagaggtcctggtacgcgatctggagagtgggcctggccacggtgaagtggtgtgggcgaaggccagctccgtgtatacctccacgagggtaaaggtacacagagagctcacagtgagggggaacacggtccacggagtaccccgtgtactcgggacacgagaagccaaggaaacgagcgaggtcacgaagctgagcgacgtggtgaccctcaccaaaaccgtgggagctgaagctggcgttcactgccatctacaattttgaaggagggagaaaagatcagtaaccattttagaaacaaactattgaaaataaggaaaccaaagaagccttagcttttcgcaagtagttttgaacttagtatccttagggtcgtcctaaacgtcgggtttcgccctagggccaagcctgtgctctgataccatttgtaacgtcccgcctcccccaggccgggcccacttacatctgatagctttcataggtcatagactgccctcacagaccaacacatgtcttttctgcacactttgtcctcactcgtgtgcacccgggaagaatttcccaatcggtcacccatcccaaattgctccaggccaagcacgcttaaccctggagttctttggagattggcttccgaaaaagaagttgcaacttgttgatatgagtattctattaatcctattaagccctaggccgggatgttacaccctcacccccttaagagagatcgacgcccccgtcgatcaaccctaggccaggaacgtcatctcttggccacgtccatgtgtccagtgccagcgcatgtgccatgctgtgtaaccactcccggtctacatcagccatgcgcaccatgcctgcgcaactacgacacacgcgcccgtgaaaccgcgagagtcggctctgataccatctcttgtcacgccccgaactagtcccgactggaactagcccgtgacgctccaaattaacctgttaatcgataccagtcccaggaaacagtgctggtatcacaggaagacagaatatcacagcaacagaggtctctttattatagagtaggagtacagtcatgttgggctgcggacagatcccgagctcacaactgcattacaaaagggaaacggaagccaggactcgggccaaacaacacaggcgcgacttgggaactaggccgaaaccctaaaactcattgtagccggcttgctcctggaagaactcctcatcagcaggatccgcttcatcttcttcagcatctgggggggattatttatatagagcaagggtgagtacgagagtactcagcaagccaggggaaataagtgtttaatgcaggcttcaaggagaggcgggtgtttttgcaattgattttatttgaactcttttctgaaacaactaagtgagtgcttcttaaacgacacggatgagacagtgcgtctcgtccggtcggagtatgtgcaatgtattagtctttagattttgaaacaaggttggcacccggccaacagcttttcaaacggccacccgggccaacaacttccaaacggccacccgggcgtagctgatcccatcagctgcagattttccaaacatcgaacccctttccacaacagcaatttcacaagcagtagtcaaataaaactacgctaggaatcacctcacatccgcccatgaccgtgggcacggcttatcgaacagtttgttaacctctgcagagggggtacactttacccacacgacattactaacccggatcacccagcccgtggggatcagccacgttgggagacctccaagctttcattacaaggcatttctaaagccgacacaggtttaccatatgccgacgagaggggtcccagaccaacaacaggttaggtcccagaccatactgtgccaggaagcccaggggtcctccccaacaccaccccggcgaatccacatgtctctcggcatcaaggctcccctgataagctagttactcagccaggggtgtcccattccacccatgtggtcgtacttgtcttatgtttggatgaaattccaaggaaacggtctttaagtgcaagagcggaaaaccgtacacccggtacgttccccggtccgcggttttggaaattcatttaattcgcaagcaccgacccaggtgtcgggttttccaagtcttttgtaaaatccaagttttacccaagttgcttttcagattttaagtttgaaggcgtccgccgatactcgcactaggtgcgcgaatatcgagacgcaactagatggttgcaaggggacatggtatcacaattaacaaaggaaggatcaaatacaacaaattaggtaggtctaccaatctgccttgcagacgggacaacagattaagtgtgatcctatcaatgcataatatttttcaagcaacataattaaatttcaaatataggctcgagatgttcaaaggtggcttgccttgctcgagatctggagcttgatcctcgaaatcctcgcactgcgggtcttcgggctccgaaactacacgcgaaacaggacaactcaacaaacggcgaaaataaagccctattaatgacctctaagcgtgccattagatagatctcgagatttgaggaattttggaagttgaacggagtcaaacggacttatggttgggaagatattgaatttctaagattattggatttttggtctaaaggaaaaggatttaattaaatcctttttggaaaaaaaaagaaaagaaaagaaaagagggagggaatatagacttttctcgggtggctagggagcggcccgagagaaagggcggctcggccgggcttaacgggccggccggcccaagaaggcggcccagagcggcccaagacgcgcgcgcgcgggagggaggagagagagagccggtggaccgggctcaccacgcgcggtcccgggtgggacccgcttgtcagcggctcggctcaccgtgcggagggagcacgcggcgcggcgctagggtgggggaaggacgcggtgcacgtgcgcggttcgcggtggacgcggatgcagcgggcccacgcgcagcctcacggctcgcggtggaacgcgcgcacggggaggggctaactggggtcggctcgacccggtcttggctgagctggtgccgacgtggcgcctacgtggctgccacgcgggccggcgggaggtagacgacgacgccggccggaacggacggtggacgacggcggcgagcggcggagcgaaccacggcgatacaggcaaaagcgagcacaccgggtggttgcacgtgacgaggggagacgagccaacggctcggattcgccggaggaagcttgacggcggcaaatcgcggcggcggcaaccggcagcgggagaaggggaaaacggcgacgaggtcacgaggggccaattcccggcggcgagagcatctacgcggctacgggaatccgatgctagcgtcggattgggcggaactacgccgagcgaggccggggacgagcgggtgctacggagctcgagcggcgacggcggcgagcacacggcgagtgacgacaacggtcggggcggcgccggctagctacggggaggctactcgtgctactaccgaaaactaagggggagagatggagcgaggaggaagaacggagggaggcactaccgagatgaggaggggcgctgggacgagaggccgacggcgcgggagtaatctctccggtctcgggccgaggaagaggaagaagagggcgcgcccggagtccccttccgcgtcctagtgtgcaccggctcctccggcacacacgcgacgacgaacggcgacggcgaacaggggcgacagtggcggcgagagacgaaaacgagggagattggagggggaggggcttgggtttaaatgggcggcaatgtcaggttgggagaggggaaccggcattggacagtcaagccggcgagctggcgctccggctagcggccaaaacggcgacaggaggtgacgccggcgagagggaaaaagggaaaaagagggagagaaaaggggagctcgccccttgcctctttgggaaaaaggaggaggggagcgggagcgtcgcggcagagggaggagggctctgcctccgtcccttggcggcttgcgcgcggggaggcggggccgaggtgatgacgacggccatgacggcggggcggtttggagcggcgcgacgacacgagcgacaggcgctgacgacggcggcgaccaggcggtcggccaccacggcacgcgcgcgcgggaaacaacgggcggcgcggcggatttgagcggcgcggctgatttgagcggcccggcttgggcacgcacgctggcttgcggggccgggcggctgcgcggctgcaggcgcggcagggcagcggggccgggcggcacggacggcgcagacggcgcggctctcgtgcacgcgcgcgcggcgcgcgggcggagctgagggggaggcgctgggcgcggctctcacgcacgcgcgcgcggcgcgcggtcggagcggagggggagggagagagagagagagagcgcgcgggggagggaggggagat

SEQ ID NO: 36796 - DNA, 2985 bp, Oryza sativa
ggagatgggccgagagaaattcggcccatcaaccccgggggaggcaaattagacttttgcggaggaatttgatttggagggatttggatttggaattgaactcgacgatagatcggggattgagatcttgagatggcacggacactagacaacaagcgaagaaacaaatttcgcaattagggtttttaagagataattttcccgctatgcgccacgacggaacgggcgctacactaaaccgtatcacaataataagattaaaatattcttcacccgttgcaatgcacgggcatttatttctagtatatatgtgtgtgtggttagtatgattattagttaaaagttattgagtttgatttttcctgaaaaagagggtgcatataatttgggacgaagggagtatcttaaatgtatttaaatgatggcagaatcaaataattaagaaaaagagacacaaagatattttttctgatatctgtaggtttaattatccatgatctctctaaaattatatagatgaaatgaaacggccgaatcatctatttgattaacttggtaaatcaatattttcataaaataatctttatacttagcttataacaagtataagcaattaatgcagtagaagatagttttttttttagaatcgtatttttatttttatttttttccaaacatgcatgacagttgtgaatcattttattgagcaaaaaaattgcaatattataagtgtggagcaaataatcccgcaataatctgagcagatttttgccgatcagaaaatctagatgctgagtttggcgggaaaaccaaatacgccaacttcagaaagattttggcaatggccgtgatttggctttccaatattttgataattttcaaaattgctacaattaataatttaatacaaaagatcccaagcttcatgtgggatctaagatactgtaatctgccttgcttgtagctccgtagctcactgccattttcaaaaactaaaaaggttcgaaaaaaatttaatatatttgggaacaaaaagaaaactgattcggcagctaatatcggctataagaaacaataatcctatgcaagtgatctccctggagaaaaatttcagaagaaatttggttcagaaaacgcttccaatatctcattcattcccttactgattctgcaactaatatatatatggtttgcaatccggccaagagcaaagcattagcaacgaaggccggagagatctcagatggctcacttctgaacatacgattctatatcaacaattcgaaatgctcatatttgttgggaaggtttaagcaaagaggcaaagtcactactggccgttgggcacaaatcaaattaggcttagttctttaatttcagctactgtcttgtcacagatttcaaattgtttaatgatgtgttttgtacaaaagctttctgcatgtataaatttctttcaaattaaattcaaatatttttttttcaaaattataatagttgatactgaattggcttaatgactatattgtttcgcgtgcgtccattaagcccacacgaaacgctattacgaacacagtctaaatttgttgaaagtgagggactgatatatttcaaacatgacgacaaagcgcgacaagatatcatgggatccattccatcaacaatggcataaattgtatccctctttaatgtaagtcaaattaattaacctcactcacctctccatcctttcacggaggagcaaattgttgctgccttcgaacaaagaaatgacatggcctgaacggcttttgatctggcttctattaagagccttgccaacgtgcaggcttgaatgcttgaactgaggaaatttgactgaattttatccatccgaaaaattaagtttgatggccagggtttctgagtttcatgccctatcagatagctataatgtattgtttttaattggatagttataataacaaaataatctatcgatttgaaaccgaaattcaaaagtaaatgcatgcaaataatataatttccgagcaattcgactaatcaacatattcattgtctcaggttatgaacatggtaaaacacaaaattgaatccatgagccaatgatctattataataccagaattaatcaaaggtatatattagtgtttttgactaaaatgcacttgattgtcaagttcatgtacccgtgtactcatttttcaagttcttatactaaatcacacacacctaccaagctcttgtaccgttgcaacaaaactttatggaaattaaaaatatctcttaaaataaagatttttatgtggtatcagttcaaaggagtaatattaacgaaggataatttagcaataatgaatgaattggaatgacaatatgagatgttgttttttaatgaagagtgaaactatacatcatttatttttttgagtgccattgtttgctagattcctgtggagatcattacatatttcttttggtttgaaacctccaaatagtacttctcatgtttctgggaattggcttgtacactttgactaaaaaacaaagaaacacattctactagtagcatctactatatgtcgggttctttggctaagtagaaatgatatggtttttaacaaatccctaatgaaatcttatatacaggtactattcaggataatgtactgctccaattttgaccacaactataaaggtgtaaaggtgtgatgaggacaaggaactaatatatactacgtaccagaagctagaaataatggtcatgcagatatttgccaacatcggatggagatttacaaataaatttgaataaatgtcttctatattttgtgttgatatcattagttattgtctagtcttttgatttttttttatgttccccattcagtaataagtggttgtagcttgtttgaagctaaggctgagaatcttttcattatctaaaaagaagtttcatagaatgagatgaatctattcttttag

SEQ ID NO: 36797 - DNA, 1265 bp, Oryza sativa
tattgccttttcgagtagggtgtctgtttagtcttttgcacttttgttgggctcggatttagctatttgattagggagtccctagccttttgcacctttttttttgtctggtcggccaaccaaattttattaagaagaagagagggttacaaggtttacgagttcgacattaggccgtcgagtcaggcaacaattcaattggctgcagccccaaagaaaaaaaaagactaacagctaatcacattgcctaaaagttctagcctccttccatactatgataacctctctgatgtctcaaatagctaacctgctgtgcgcgatcactgctcaaagatacgggctttacgctccttcgaaatcagccaacaaaccatcatgagtgaatcaaaagctttccctgtagctcgcactgaaattcaaccttgccatcagccacaagtccacaagctgagcaccactctctgccggcagctgaaactacaaaatatttttcttagatgttctcaacactgtagctaggcttaggaggcatcaagaatgtagcgataagtttatcttctccatcgacataatatgattatggtgcaaatatgataggccattgataggatgaagtaagcattatcctcatgcgaataatgggccaataagaaggtgatcgatgtggcagtgtgagtttttaattcaccaaagaatgtggtgcaaaagtcaatgtccatgcatccagtggagtatgacctcatatttgtttctctaaaataaatccgcgcaatgcaagcgtatccatgcatgactaacgcaagcgatagagatagaataatttgtgcccagagcatcgaccaattaatagtgagaagaaagtacacaacataagccggttcttttgcaaagcatgtccttgcttgatcggtgacataaattaatttcctctgtgctgtacatcatacatcacatttattttctaagatagtggacattttttaagaaaatggccaaagcgtacacggccaaaactccatgtacaatgtatgaaaacaaggtgttaatttaagagtaaagtccatcaccggtccctaaacttgtaccgctgtgtcatctcggtccctaaactcgcaaatcgaccatttaggtcctcaaacttgttcgactgtgtcatcctggtccctaaacttgcagatcactcgtttaggtcctccaacttgttcagttgtgtcaccccggtccctaaacggggagtccactagttatagagcggccgccgcccg

SEQ ID NO: 36798 - DNA, 6309 bp, Oryza sativa
tttaaaattctgataaccaattttatgttataataagtttctgattataataattttctatgaaaatctacatatattattttatttgttaaacaaagtatttgagaaattattgatagttgaattttacaagttcgtaagaatattgttcaaaacaataaatattttttttaccagagtaagagttaattaaaacaataattcccaccactgaattcaaagctcaagtcatcttcaacttgaattggatcgggtgcctctttcttctaattaaataaatatcaaacttgattgtttatttttccagaaaagtgaaagaaaaggaaaaggaggaatggaaactagaactctgggctgagctaacatgcaaaaaaggagcttaaaaggtttgggctggccagcccaacatcttcaatggcccaccaccttgctaggtttatgatgtattggtagatatatcgaccatcaacatcttgttacggtgatcattagctatgatggtgcttttgagaggttagagtatcaagtgagtaggttaattaaataaatgagtatatttcccatctattcaaggactagattgtgatggttgtttaccttcatctttggtgtaagatacttataaatgttcagtttatccatgatatgatttgcatgatacttatctcggtagaccacaattgcggtcaacaattagagtctcttgatattaaaagacatttgtaaacgcagtgaggtctttctttttcttatgacaaatgttccggctcgctagtaaaaaaaaactccatgtaagttagacaagcaacggtaagttgttcaaaaacaaaaaatagttttggggtaccggaacatgtaaatgcatgattaagaacatgaaaggaaaaaaggtaggattttaacagaaatataagcgtaaaatatagaattgtaaaatacaacaaaaacacaaaaatattgtttgattgaaccataaggataacacaaaaattaagaagaatttaagggtccatttaatttggaggaaaaacataggaattttggaggattccaatcctatagaaaaattcttatgaatgtctttgaatcaaaggattggatcatttccaatcctttgaaattgatccaatcctttgatattcatatagaataatggacaatcctatagatattttggagaaaacttagcaagagctcttgaaaaatttccaatgagtttttcctacggtccaatcaaacaattattcctatgttttgcaatcatatgttctattccttctttttttttctttcatgcaattcaaaagggcccaataaatcaggttatttggtctgcacgatcagccaaggtaatgcatgctgcacaatcgtagggaatggctgcctagtcatccttacaatccaaactaaaattaccattattccatcccatttactatgttcctctaatatttcatgtatcgcctacaacattttttatgctaactattgtggcaatgaaaattatttggcttgatcccctcataaataactctattttgccaaatattggcatgattaattaatgatgaggtcgacttaaatcaggtatatagcctctgtggtgagaacccacaatctataaaaaaaaattatggctagctagtctcgtcatatcgaaccattgatattagaaaaaaaaacgaaaagggctcataattgtgaggaaaatgatagagggaacaatgataacaagtaagcagacttgattaaatgctacggaagggagaagccttattcttagctcgcatgattgcatatgaagagcatttgctatatgaaaagaacatcttctgatcaagactgttgcttgtccaagatgtggatggatattaatataagccaaacaattggttatgtcttcaaattatttttactccagtttgttgtaaaagaccatatgaaaaacacattaacgataaaccagtcaaaatataaaataaccatacaataccattatatgacttcggcattaccctttcccaacctctacaccttcgttttctgcgcacacgtttccttgactgctaaatgatgtaagttttgtaaagattttctatggaaaaattgctttaaaatatcatatcaatacaatttttcaagtttttttagctaatacttaattaatcatgcgttaataagctacctcgtatttttatgggggagaatgagttataaaccagcactattgacacatccttacttaaataagcccgtaacaatattgctccaaaaatctattacactaaaaccctagagcaacaaagccattattatgcacttaaaatttggagagagttagctaccctcaacaagagcattggatataatgggttactttatttaattgtaccgtttaatttattatcacattacttctctttacatatatatatatatatatatatatatatatatatatatatatatatatacacacacgtaatttcactcagtaataatttataccgtctatgaaatagccatttaggtgatgtgaggtaagggattttctcctatcacctgccctccttttaattttcacctgagcagccagcaattcccctttatccaacagaacctggcaggtagtgtaacctaaagcagaaaaacctctcctttttagtttttctttaattctttttggaaccatcaaaacctttccagtttccaccatcttcatattttttttcctctctctaatctctatcatcaacctcttcgctaggaaggaaaagaaaccaagaaaccctctcctctcttctcctcctcctcctctcctcgctcgtggccgccaccatgtcaggcggcctctacaaccaccagggtttctccccggcaagaaccctctcgccccagattaggagcaaccccgaggccgataggtacggcctcgcccgcttccgccgccgccgtggattgctactgtgtttcttgctgattctttgatccaaggattgcttcttgctcttggttgcgtgcccttttttcgatttgtttaggtgattggttgtgcgatttcttgggttttgtttctttttgcagccagtacttgagcgagctgctcgcggagcatcacaagctggggcctttcatgcaggtgctgccgatatgcagccggctgctcaaccaaggtgagatcttttcttttttttgattgattgattgattgatctctcgcttactgtttgtcacggattggtgggggttgtgtttgtttcgtgtgaggaagaggggggatttgtggtgttagttttgcaatcgggatttgggaatcgggtggctccaatgcgtggaatgatgctgctgattttgcctgcagcttatgtttggatagagttgccgagttgccctcttgttctttctcgggaatttttcgttgccaatcgagataagattgttagaatattttgggggttatatgcacaacacaacagagatgaccgagtgtaatggtataatacagcatgcgaatcaaggcttgttgcgctgttttggtgattgccattgaatttttgccttcaaataatgtagatgtttcgatgtattgagacttgttgagaactgaagatcaatgatgaaaaataaagtggtgatgagaactagtagttgtcaagatttatgtgtagagttgcaatcatttgtccattgcatcagcagcagacaatggtatgcgcattgtggatacaggatgattactgatctgttaggtgcggctagcagcaagtagccaacaagatgtcctggctgctatgtcgctacccaggcaggcaaggtgggcacctaagtgagctataggtggctgcctctcttctagaacagtgggcgtgaatgcatcagcaaatttttgcgcttcaccgtgtgctgttgataggcttacttgataaaagaaactgttgaatttaatatatgaagatgttttgaatgtgtaagaattgcatgaatagttagctcatattggagaaatttgcattcttcttgtgggctgggaacttcggatgttgagtatgttgcctttatttttagtgaatagcttcagactgcatttgatcaggttctatttttagctgcattagtgggaagtcaaattttttgcctcaatttctcactgcaccttttagtgtttataaagtggtctacggcctgttttcatggatttactacatgtaatttagatttgcaatttttcttttatagatgagcaaggcgggcatttaatttatgtttactataggctggaaaatagagcaagtatccacaaataaatacatcctttttttgtcatatactgagagcatgtctctctgtttatctaaaacccactccacggttcaacccaagtaaatgggttggataactatcgataaggacactctttcctggtttaaccctttaactgaccattttcgagaattcaaactgaaatatgtaagtaatatatttgttgttatgaattatgctatggattcaaacctgcttctaattgtagcatatatttgcaccatgtaatatgtatttatcttgatgtgcttcttgatttcactggtaccttaaatgcttctcatagggaagttatgatttgatcatagctatcatctaactcttgcattccaaaaaagtataaactcctacttctaagtaataaccttatttattcctccttttccaatctttgtgttgtttagaaatcatgcgggtatcaagcatggtcaacgaccatggattcaacgattttgacaggcgtcgttatagaagtccgagtcccatgtcttcgccaattatgagacccaacctacatggcaatggatttgggccttggaatggcatacaccaagaggtatgtataatgaattaattactgaaaagtgcaaaaggaaaacaagcttttaattactacaagaatcttcttgtctatacatttactcattgttttcaacttctgattctgaagaaattttcttcaattgtatatagaaggtcatcaaaactctgtaccattgattcttatgttctttggctggcgtacattaggttgtgtctttgtgagcaatactaataagatttgtttatatgacagagattaggctttcctcctcctcctcctcctgggacaagtatggactggcaaggcgcaccgccaagtcatggctcttatattgtcaagaagattgtacgcatggaggttccagttgatgcttaccctaatgtatgtgttcctcttatgcgatttatcatccagcagataaaatgtcttgtttttaatgtctgctattttcgctttgctccagttcaatttcgtgggacgtattctaggaccgaggggtaattctctaaagcgggttgaagcatcaactggttgtcgtgttttcattagagggaagggttctatcaaagatgctgataaggtaacaaacgtttgtaaatgttaattactttacatttatatactcatataacatgcgttatataaattaaaactaagtattacagctagctaggatgataaacttctttgttatgtttaatttaatatcctttgtagaaatcttggaaatccttcattgtactcttccctgattagtaaatcctaactatccattattggtgtgaccatttctgccatggtctatagtatttctgaattctggtcttcaaacttcgtcctaaattgatctgaaacacgaagaaacatgggaaacacacaaaaagaactgtttaaaaaattgtttttatggagtattgtgtgcctcaaggcagattttatattgcctgctcatcagtttgcttaccatataaaccttgtaacaataataagttagtaacattgagtaacgtatttgcttacatgtattggacaaatgtattgttctagtatttcaattttctatttattttttgggttcatgatatatggtggtgagttttattgcatctttgtagaacatatgttagtattttgtactactatattcccatatgggtttctatcttgtcttctgggaatctgtcttgccccttaaacccattaacatgttacatcaataatgtgatagtactctgtctcatatattaatcttgattgctgaaagattccagattgctccttgtccatattttttcccctcatatatcctccaaatatacacagttacacatctttgttttctattttataggaggagaagctgaaaggaaaacctggctatgagcacctcaatgatccactgcatatcttgattgaagctgagttgccagccaatatccttgata

SEQ ID NO: 36799 - DNA, 427 bp, Oryza sativa
aatttggataatacgacttcacaatttagaatttagaaatgggctaccataaagtctaccatacaggctaatggcacaaacttttcaccggttatgtttttttatcttttttttttttgcatgactgaactgaaaaggaattttacatctccatgcttattggagtagttacagctatttgcatctctgtggttttgttgacataaaatttagaggtaccaccccatacaagtcatggtaacttcacctctccctctcattcgcagcccagtggcagcacttttcattggtcctgatgtcctcattgttgcaactggttagtgtggtatgggtgcagatctaggctggagacagtcctcagcgctagtcgctaggacaggaatagtttcctttctctgattgtggttctgcatgtgaccctgtgggc

SEQ ID NO: 36800 - DNA, 725 bp, Oryza sativa
ttatcgatgatatttctcggattagtatgcttatcgatggaattttatggattttcttttttataatggtattctatcgaagcgatgcttataccatgctagaaatgccattttctaattcacgaggctccaaccgcgagaaaggcgagacagaatgaatcctcgccggcgacgaggcgccgacacctccctccggcgactgggtctccgacctcgtcgccggtggccggacggggcagcctcgccgcacggggagccccatcgcctccgactccgtctcggagtcggattcccgccctccttatgggaaaaagaaaatatctcaccccgattcgatcgcgacgaaccctcgcactccgactccgattccaattccaactccaatgtcggtggattttatccctcgacgataaaaagggcgccacatcctccacccgagatcaccaaatctctcaattcccaaaatcaattcgcgcaccaaacctcccaaatccctctcccaccagttcttggattcgccgaggagctcttgtccttccatccatggcggcggggtggcgcgagacgcccgccgcctccgcggccttcccggtggcctacaccgacgtcctcgcgctctacctcctcctcggcgtcttcccgcgcccgcgtggcgccccgccgtgcgaggcgctgctgtgggagctcgccgactgggcggccgtggccgtctgcctcgccgccga

SEQ ID NO: 36801 - DNA, 567 bp, Oryza sativa
gacatcaagcactaccagcacgccaagaatgtcaccgtgctcctctccattggtggtgaaggtgaccagtactccctccccatgcccaggtcggccaagaacgtcgccgaccacctctgggacgcctacctcggcggccatcgccatggcttgttccaccccttcggcgacgccgaatgaaaacaaacaaaagggaaaaaattgcgccacgtgttaggactgcagcctcctcctgcacggcgacctcgcgactgcggctgtgggcctctcctccccctcatcaccgacgcctgcgggcctctcctcgccggcgcctacagcccccgcaccgcagcctgcaaccgccgtgccgtcgcttgcggcctcctcgccgcgccccgtgccacctttaccgcggacctcctcgtcgcgtgttgccgctccaccgccacaccctaccgcgccgccgccatggacctcctcgctaggatcaggattggtagggttagggttataaattttgtttcatctatctttttctttgacagtgaaaattgggtatattttgcactgtgggcaaaatggtca

SEQ ID NO: 36802 - DNA, 1051 bp, Oryza sativa
ctgcagcccgaataatcgtgttttggttgagatggctagaacgatgttggatgaatataaaactcctagaaaatgaggggagggaggcaattaacactgcttgttatatttcaaatcaagttttcttgagatctaaacttggaaaaacttcttatgaacttcgatttgggcatcaacccaaagtttcacatttgcgtgtttttggttgtaactgctttgtcttgaaatctggaaatttgtataagtttgaggcatgttctaccgatggattgtttcttggttaccccgcacatactcgtggctatcgtgtacttattttggggactaacaaaattgtggagacttccaaagtttcttttgatgaggctagtccaggtactagacccgatatttcaggtacactatcacaagttcagggggaggatggtcgtatttttgaagacgagagcgacgacgactacaacgacgaggtcggctcagccggtcagaccaagcgccaggccggtcagaccgccagcacacctccggtcagaccggcccatgaggagcggtcagaccggccagggtcatcggctgagggttctgttgatgctgatcgagatggtcctccggaaattactacttcgaccagtactgatacagaacgtggatcaacttcagaagtcaatgctcctttgcacattcaacgacgacatctgccggaacaaattattggtaatatatgtgagcggactacaaggtctaaggtaacgactcatgatgtttgtgcaaattcagcatttgttgcttcttttgaacccaaagatgtgtcacatgcattaactgatgaatcgtggattaacgccatgcatgaagaacttgaaaattttgagagaaacaaagtttggactttagttgaccaccttctacacataatattactggaacccagtgggttttcaaaaataaacaaaatgaggatggtttgattgtgagaaataaagctagacttgttgctcaaggttttactcagttgagggtttggattttgatgaaacttttgctcctgttg

SEQ ID NO: 36803 - DNA, 2557 bp, Oryza sativa
tatttgcggtgatggaccgggagtcggcttggggataagacgacgtccgtggtggtcagagatcatgcgggatacttaggctagagttgatgcacgtagttgatggagattccatatggcatacaatgaagttattgtgtgcgtatgggattaggagtcaaatttggaaggagtccaaatttggtacgtttggttatgtaaagtttctttcttgtactaaagggtttcctaaggtgtttagaactcctagtatgagtttggttcatggctttatgctgcctacctcatgtataaatagagagggagcgtgaggcttcccggtatcgcttttcagagcaatagagttgagttttgagttagggtttcaagtttagtcgaaatttttgtaaggagcgctgttggtacactttgtaaacacagagagaatcaataaagtcgtcatccactttaagagttcttcgatttgtgtttcaccgggtttcggcggtcttaccggcaactcaccggcggtcagaccggcggcatagcggcggtcagactggtgggagcacagcggtcagaccggcggcggcgacaggcgcgacaggcgatctcggcggtcagaccggagattcaacatcggtcagaccggcggcatccactcggtcagaccggtagatcaatctcggtcagaccgcgatccgtcgatttcgagggtaacttttatttccgctaaaagttttcggtttttgggtataccaaccattcaccccccctctggttggcttagttcttgtgattcgatcctacagatttatcttgcatcagaatgagctgtccattagaccacagaatgtaagaaaatattgtatcagtgtgcttggccacaactgggtcattcaagagggaatgggtcaggtctggacggaagtagtagagaaatcccacaaaaattatcttcactggttttttttgtgagattcattgatttatcactgacattatatatgcatgtgttaattcttctgtctataatgttacatcttccatgaaatccatagaaaccatttatttatccctcaatccagtggaattggcatctggtgatgcgtgaaaggtggagcaatgtggctcaggagggacgtggaaatatattgaagaaaggtattgcacatatggctgtattattgttaagggatcatgagttcaaaagcgacattactatttattatgtttccatgtgaatcagggaatggggttaaggataatcgtatatacctttctccactctccatatacaaaattaacaaattacaagcatataaccagctcgatatatattggacagaaggcactgtgctcatgaggacgatgatctgctttgtgtgatggcccaagagaaactttactggatctgttcttttcgtgtccgtttagcaggagctgctgggatcgtcttcgaattagatggaattcaaatttgggaatttatcaaatgttggtactggcaaagattgcagtttagaaggaagggtttccttgagatcgtgtcctttgcttgctattgttggtaaattgtaagatcaaagtgtgttttgattcttattctgtgatgaacaattggcgtctgtgattattggttttgatatttggagattatcgtcgaactggttttgaagataatcaattttcaggtgatgaacagggtttgctgttttgtcgggaccggtcagaccgggcggaggttgccggtcagaccggcgctatgtgtgcggtcagaccggccaggcccgcggtctgaccggccgacgctgtgtcggtttcggtttcgggtagtttctttggatatccatgattgtttcatggttatggcttctagatggatactatacgtatgtaatactgttgtttgctaacaatgagttaagttggggatagcttggtctcggaatatggtttctttatttgtttcatgtgtaggtgactcgatgcctcgggagagtatttgcggtgatggaccgggagtcggcttggtggtaagacgatgtccgtggtggtcagatatcatgcgggatactaaggctagagttgatgcacgtggttgatggagattccatatcgcatacgatgaagttattgtgtgcgtatgggatgcggagtcaaatttggaaggagtccaaatttggtacgattggttatgtaaagtttctttcttgtactagagggtttcctaaagtgtttaggactcttagtatgagtttggttcgtggctttaggctgcctacctcatgtataaatagagggggagcgtgaggcttcccggtatcgctttgtatcgcttttgtatagcttttgagagctagtttagttagggtttcgagtttagtcgagatttttgtaaggagtgctattggcgcactttgtaaacacagatagaagcaataaagttgtaatctactttgagagttcttcgatttgtgtttcaccgggtttcggcagtctaaccggcatctcagcggcggtcagaccggcggcatcgcagcggtccgaccggcggcgtaagggcggtcagactgac

SEQ ID NO: 36804 - DNA, 9505 bp, Oryza sativa
tcctgcagctcttctgtcctcagctggttacaacttcttgtaatttaaggctttctttctttgttctcctgtacaatgttgtaaatactctttcttttgatatataacttctaggctaggcctggtagtattttaaataaaaaagaaccttcaaaataatattaacccccattagtagatctgacttaatgatgagaccatgcatttttatagacaggatgcaaccctttctcaatcaagtacggccaaagtaacgtgctttattcatgagaggatgcatttttatagacataatgcaaccctttatcaatcaagaacgccagaacaaatcatcttcaaattaatctcgtcgcgccaccgggcagccattctgtcccatcgctgcaccaacgacaaaaatatccgtggccattcaacttgtcaccgatggcctatcgatctgccgcgtcgaattggctgagaagggaaggattcgtcgacttttttgtgcccgagttccattgaacgtcctggaatggaggtgatttggatgggtatctgggagctgcagatcgctgctattaggggtggcggatggagtttatgtgtgtagtgacgaaattgctaatgcgcaaccactcccccccccccccggtggacacgtggcgcgtgcagagagggccccgcggagaggtgaggggctgacacgtcgctggattttccttttttttttgttttctcttttcccttttttgcggttttctgtttcgtttttttctttctggttttttacacttcgggtacgtatacaaagtttgtatacgtgtataaaactttatatacatgtattttttttgtttttaaatgtacatataccaattttatacatatatacaaagtttgtatacacatatataaagtttgtatacgtgtatacaaagtttgtatacgcgtatgtaaagtttgtatacgcatatatatacatatgtagactagtaatagtaatacatactactagtagtagtagtactagtactagtagtagtactagtactactagtagtagtactgtagctgaggcgccgcgcgcaccgggggacgcgcgactggtcgcgcattagcggccaccgtgtagtgatttgggctcctcatgtgcttctttcacaattgttgtattagagcaggtacaatagcaagctataagcctgatataaccacatatcgagaagaaaagaaaagagagataagaaaacggactacagatttatagtcggctgcaacatggactctaagacgttatgtgtgtatgagaggtgggaccgtgtattaatggtgtagtatatttttataggtaactattgtattaatggactattagattagctatagatgatttggagctagcagttggctatgctattgaacttgctcttaagagcaggtataatagcagactataagccagctataaacacatatcgaggagataaaagaggagagagaagagcagcgggctacagatttgtagctagctacagcacggactccaagagataatgtgtgtatgacaggtgagaccatatattaatagtgtagtatatgtttataagtaaatattatatgaattggctattaagttgactataggtgatttggaactagtagttagctatactactaaacttgctctaagagcgagtacaatagcaggctacaagtcagctgtaagcacacgtggaggagagaagagaagagaagagagagaaggaaagggggctatagatttgtagccagctgcagcacggactccaatacgttatgtgtgtatgagaggtgggaccatatattaataatttatatataactattgtataaatgagctattagattggctatagatgaattagagttagtacttggctatactattaaacttgctctaggtagtttccgccgtgattatcgaaggggcagctctttgccttctcaacgcatggagtgatctggaaagttcacacggccttctgggttttaggaaatatttctgctcgcgcgaccatgaatggaatgatgctccatcctctctaccacatggcagattttcagatgagtacacttgatttctaggatgccacgtgggccaatcaggtaccagggatggtaccctgaaatcggtatttgagaagctctacacacggtgccatgtgccccaatcaaaaatcggggtttaaaccctgaaatcggtattagagatttaccctgtttcgaaaaaaataactaaaaaattataaggcgcgcatgtgtttttatgcatccatatgttacgggcaaagattatgtggagaagaatcaacatgaatagggatagattggatttagtagatgaaataagaacgtgactataacacgcacggtatcgcgttagcgctaaccagcgatgccctcaatttccaaaaatggaaccgcgttcttttccccacgcgcgcttagaatttccgaaaaaggtactgcagcccacaacaacaccttcgcccctgaacccgtggacagcataatgaagaatcaaacggaaaaaactcacgaacagctgaaggtggagagaaaaatcaagaacaagttgagaagaactaggtcccatgccctaatccaatgtagaaaacaaacccagacctatccaaatcacaaactttgtaagaagtttacatcccacaaatttataatgctatgtcaaattcataaaataaaaagagcacaaacaagcatatcaacttggaattcatgcactaatctgcagttcttttctctcagaccccaaaatccaacaagttactttgaaacatataaaaatgaaatacatgtaaaagttgtaaaagttacttcctactaacatgcaagttacttttaaaatttgtgcgctcattttggatctcttacatgatatattttgttaagcgattttaggtccattgctgccgtcactgcagcggcggcctgatagaacggacccttttggaactttaccatcgacagcgacagatgaaatgagacacattcttcatttaatcaaacaagttcaggctttcagagattctttctttcataaggaaatggatgaatcatcatttgcagaaaagctaaatacaaccatgaatcagttctgaatccatccatccattcacacgtgcatgatcgatgcagaattggattatacagggacacagattgcgcatgcatggagaagatagacatatattactaacattactgcatatacatattccttcttctagctagtgaaggagagggggccaaatgaacaacatgaggagaggaggcattgctaatgctaatagtgtctcatggcattattgaaatatgccaaaacaataaattgacagaccctccctaggggccacttttggctagctttcagttagtagatgttactttccctagctgagaaacaaacttacatgatcatatttggcttcttggttatatgtaagttacttttgaaacatatagaagttacttttaaaatataaaagttgcttcccagtaatacttaagtttcttttagttttattgatcactttttcatacttgcaggggcatatctaaagtgggtacttttagtaataatttggataaaattaagcttccatacccaaatccttttaattagaaagttatgtataatccatcgcaaagcttagtacctgaaatagttatacagaaagttacttttaaaatatataaaagttacttcctagtaatacgtaagttacttttagttttgttgatcacttgtttatacttgcaggcacatatctaaagtgggtacttttagtaataatttggataaaattaagcttccatacccaaatccttttagtaagaaagttgagtataatccatcacaaagcttagtacttgaaacagctatacaagctatacagaaatttacttttaaaacatatgaaagttacttcctattaacacgtaagttactttttaaaatatgttgaatttatgctcatttttcatcttttaattgattacctgtttatactagcaaacacaaattggaaccttaagtttcccaaaggatcattgtttttgttgtggatatacgttggtctgtacagaaccaataatatcccctagaccaaacaacaaagaaaaactaattgctctagtgagtcagccgtgctcatcatgttcaatcatactaatgtcaggttcgaaactgatgagttaggacagatagattaaactagtgttgcatgcctgcatatagttagtaaaaacagtaatctatcattctatcctgaatcaattgatgaacatggatgaagagtgatcgagccttggagaacgagatgacagtgaaataatcaaagttaattaggaaaaagggaagaaaattaccagtcaacaaatgaattggaaatcactgtactactgatcccgtttccatccatgacagtatgacacatgtattttttttttcgagcaaccgacgacaggagtttctcctgccggaatttatagaagaagagaattgacctagttaataagggaaacagggcccgaaaaccgaacaagcacggttaattagacaggaaaccggcaaaacctatacataaaaggaaaagaaagcaactattgagacctcacagaagtcgtcattgccgagcttaccaaaggcaagcagctttgacaacataacacgaggtctccagaactaccaaacgtctactagtggagcagaaaccttctaagcagagcctctaacaagggaacaacatcaaggatgctatcaatgctcattccgaaaggaaccgggttttcacctgaaggaagagagagctagcatgacgatacctccaaggagaaaacggtgcccacaggcgtcgatatcgtcagcctaggaaagcactaggcaaggttttcacccgaggctctctcaaaatgctccacctccaacccctcgcctcgttgccgggacgtttgttgagggtcatcgttgccgagcttgcaacgacaagcagctccgactccgcctcaatagacaatcccactgcagctcgaccagagaccacctcacatccagtaacccagctgcaacaaaacctatggcacggccgatgaccagagagaagatgtcagaaaacaactccgcacgccacccctaacgagccaaggagctacccggcatcgactggaagcagcctagcctaagaagggaggagcgcctaagaagaggggagcggtcgccgcaccgccagtgagcacaggaagaacaaccactgaagaaggggagaaccggatctgagaaagaaacaggagggagggagatggatgcgccatcttcgttgccagcaaccgcaccagaccggctgcccccggctagcagatgcaaccgccgccgccagacgaccaccggggtgccgccgccgccattccccagcacaccgggtgccgcccgccggggcgccaccgccagatccaggcgcggatctggcggcctcttcctctgccaccagcgcctccaagctctgccgcctgttaacgatgaaatttggtaaatcatgcatcggatttggagttaaggccgaagcggatctgagaggaaatcgataatggaaacaaggtatgaatcggcttcagaaccgcatcgactacagtgtgcattggcagttaccgaatcggacaaggcaagccgttgtaaccgattccggcaaggtggtaatggagtcattgtcagattgagttgacgtgcttcatgatgattgccacgtacggatcgagtccgaagaaggcagttgtaactattaattaggaatagtttgttagtttcctttttatccttaggaaagtgtgtttagtgtccgattatgactttatgttttccttttatctttaggaaagtttctttcttgtcctacaaggactagtatctacccatgggtataaatatgtacacccgtggtcattgtaatctatcgctacgatcaatacaattcggcgcatcgccaccctttttacttctacttttgtttttacgttccggcagaacttggcacccgacgcggggctgcatcgtcttcgatctccggcgaagggataagtctaatgttccaccggtccaggcaattgtatcgtctacgtcggcatcgttcaaggctgcatcagtacattcgacctcttggattactctggtttggataatatatttgcctagctatttatcatatgtctatgttaatctagtcctagcatctcaatttagctctatcggctgtctctcgctttagggtttctgccggtatcggctaaatcgccttgctagattagattagcctaggcatctaccaccctgaaaatcagtcaacggcttgattgtctagatattgtgtttcttttcatacttagtgctgcatcagttaagtttgatctactaagtcgtgcttagaaccataatctctagcctgcttcttgattgccaataagggtttcatcggggtttcagctaatgagttatctggacgttgtatcggcttacaaggattgcatacatattggatttagccgatcgcaacaaaggttttactgtttaatctaatcttgtggattttatgatatcggaccaccagccgatgtatgctttaaccttcagatcagtgcttattatatcttgtttctagccaattggtttctactcgactatattgttattacatcatcaacagccgattgcatttatatcattatctacattggacatatagccgattgcttaaaccctatcactatcggctggtatcggcgtcggctggaatcactacatcggcttgtcagccgatcggctgttttatctgttgtttacatatattgtcagttgcaggatcaaactgactggcacacccgcatctcatcaatctttggacctgcacaggagttaagcagatctcccaggctggtgttttcgatttttttcgtcaacaccgccaccgccgccatccccgccactcccatcagaacgccgccgccccaatgcacaaccctgccgccagcttcctcccctccggccagccagagcggatctgggcggccgccgcctcccgtcgccgagcagcccgcgaagcgtagccccgccgccgctatccttgtggccgtgcggctttgccgacggctgctcgggcggcggcgaggcggaggaggaggaagggagaggcgggcgatggcgggctggttgcctcccgtgtcgcccgagggtaggcgacacggagggaatacataatgaagttatgacacatgtatgcatcgatcgggcatcgcttcaactattgacacgaataggtgcccattttgctgcttgcctgcctactcccactgcaaattagcatccaccgcccagatggggattgggaacaagaaggatctactattgacgtcgtcctcagactcgaacaactcctcttcctcatcatcttctctgtccttgtcgctgatgcagatggcttcatcgaacaactagagaaccccacaccggaattgctgccgccattaaggagaacgagggcctcgccaccacgtcgctggagcacttccgccacttggcaccaggggcgccggataggatggcgggcaccttgcacttccccttcaccgccatggggagggaattgggaaagcgagtgaattgggaggagtggagaatggagatggagaagagagagaggagagggccacgctagcccaatcgcatcggcaatcagacaggcgtgttgtcgatcacatggatcaccatctatcggacggccccgtacagcgtcgcgcgaaagcgcaaaaacgagagcgatctcgatttagattttgcgatgaaataacaaggaacggtcctgaacctaaacaacgcgacgctctccgtcgcactgagaaggcaggctgatgggcactaagataaatctttatctaatgcctaactgacctaggatagtatccctccttatatagatggatgactccttaatctaatcctaacaaacctcatctaatcgtaacaaaccctaatcctatccaatgggcctaggacgtccgacccaaagcccatggcattactcccccccccccctttttgagaaggtcgtcctcgagctgcaccacaccctgctagacttcaaacgaaacaccataacctaaactaaaactcttaagccttttgcatctcggcttttatgaaaaaacagaaataaaaaacaatttatgcataggaggaccttagcctaaggcactgaaggagaggaaaagcccattccatgatccaaatcgaaaggcccagaccaaaattgcttggctcaaaatatgagaatgatccacctttgcatcataggccaacgtggaaaccacccagcccaactgagagagggtagaaaccctatctcctttcctttcaggagaccacgccgctaggagcgacgcagccgtggttgatccgccaacttcgcaaaccagtgtgtggggccggtgcgatctgcgccatagcgacgcgtgaatgccacgcccacctgtcgcacctacgaattacaccacacgcacgccgccaagctctgatccaaccatcaccggtatgtgcgcctccacctgtggaaacaaagccgcatcgctggaaaatagcgcctgaaaatcagatgcctgtaccgagttgtatcgctgtcgaagtggaaatcgccatcgtcttctccgccaccgttgagggcgccaatggcaacggcgccatcgccagtcccagcggcgaggtcgaagatgcactgccactcccggacttggcaccgccggaagaggaaacatgagcgcctcgccacgagtcacgccgtccccgcgtggttgcagcgtcaccactgaatgttgcccccatccgtgctgcttgaagacacgccctcgcggacgcaaggtcaccgcatgccggtataatggttcggcctcctcaaggaaagccgttggatcggctaactgagccgccaaggcccggagttgcgccgccaagtccatcatcttctttgagatctcggcaaggccttcactgatgttgggaaccgcagcgatctcagcacccatgggcacggaaccgaagctctgataccaagttgtcacaggcaaggattatgtggagaagaatcgggatgaatggggatagattggattatagtagataaaataacaaggaacggtcctaaacctaaacggcgcgacgctctccgttgcactgagaaggcacgccgatggacactaagataaatcttgatctaatgcctaactgacctgggatagtatccctccttatatagatagaggactccttaatctaatcctaacaaaccatgatcctatccaatgggcctaggacgcccgacccaaagcccatgacaccatgcatgtattgtgtatgtcatatgcctcccttctaattaaaatagaagttcacttttggtctcagcatgggtagttacaacatgcagcc

SEQ ID NO: 36805 - DNA, 4234 bp, Oryza sativa
tttttaatataagcatctcctactattttcgggtaaataagttattgaatactttctttagctagtacttcctctgtttcacaatgtaagttattctagcattttccgcatttatattgatgttataaatgcggaaaatgctagaatgacttatattgtgaaacggaggaagtagaacattgtgtggcagtgcgtgcaagaggtgattgttaagcatgcatgactcatttctgcgattagaacgctagcgatgatgagaaaacgtgtatcgaatgcacatgtgaagttcattggcttgtgtggatatcccttgcatccaaaagtggctgcaatttcttttgcacatgtatggatctagctatggtgttatagatcatagatggtcagataaagatttctccgacctctacagacaaaagtcttgactagaagccattgccactacataacatcgtatagttacatgacatcaaagaaaacaaccctaatgagactaagtatggtagtgcacctcaatatagttttcctctgatattgtcggtatgtcaatgatgtctatgcagttgtactatttgttggccacaaacacatggatgtgtattatcttaagacaattaatgcgataacattatccttgtctctacacgccatgctcttcctaactactacaattttgtagcatttctatgttataggttatgaaacgatatcggattcataaaaataaaaaatatcacaagcctaagatatagattacaatttacattaacacttgtttgtaatgtacatggtttttccgtgtgtatgtctcccttataatcaaaataaaacttcactatttttcacagcaatgtgccctgacactgaatttatccaggactacagggttgagatactgaatttcttcaggcagtattattgtaaaccaaccattcattaaaatagctagcttctttgcaagtaccattgcggcctatatgagtatcagtgcactcatcctcatttgtgctgaacaaactgaatcatgcatggttcagcggaccccttccagtgaacacctctcctcttcaaattgctcactcacttagagtctctagactcatgctattttcttttcctgaacctctgaactcacacctagttaatacatttccgggtttaggctgtgttctccccccaccccccccccccaaaaaaaaaaaatcccaatccacctctctcgttttctacacgcatgctttttcaaactgttaaacggtgtgatttatgcaaaaaatgaaagttgttttaaaaaatcatattaatctattttttaaaaaaaaataagttaatacttaattaatcatacaataatacgagcttcgttttacgtgccggggaggaggggttcccaatccatcctctcgaacacagcctaaggctatgaaaaaactttctatatgaaagttgtttaggaggcatcacgattaatacatcataagcataaattcaatgcggttagaaaattgaaggctatggactggattcggtggacaaggatgatctcttggttgtagtgggctgtcttttgtatctagtcgtggtgtactgtgtcccagagcatatcatgcctcagattgcactgtgagaacaagaagaatagattcctctggcctatgagggtgcagccgactacggatccggcggggcgacgacagcgggtgcctcggggggggggcggcgacggcgtgcggcgtggatgcgggcggcagtggcgggctagggtttgggattttttggattttatttttcttcgtttgctgaatttattttcgcatgcggccggtataagcgaccgcttgtgaaaatcccatcttcacatgcggatgcgtcggccgcatgcaaaaagggtgtttttacagacgatttcgtccatgcggttggggcaatcgtatgaaaaatgcatcccaaatacatggaaagacccttttttagtagtgcgttgcacccgtcgtcatcgtggtgcccggcaactccgccagaaacgagaggcaccagatcagatcattaattagtgagtaatgcaaatgtgctagtatcaattactactagagttttctgcagtgaggcattactgtgcaattgaggtatatatatgctcccacatctacaaatgatcagttccacgaactagaaaagttagagaatttagatccaagagcttggattagcactagcaaatcctagcgacgaatgattcgtgctgcagggtggtggcgatgcagagggtatagacaccctccctcgacacgattgaggtcgaggggttgccaacatccgcactaacagttgagaattgagattggtttttgagttttggggcactggtgtgaacaagctgagcgaatacagtactacggtagaacctggctgaggtggtgtttggatccagagacttaactttagtgtctatatttagacattaatttagagtattaaatatagactatttataaaactaattacataaataaaagctaattcgcaagacaaattttttaagcctaattaatccataattagagaatgtttactgtagcatcacataagctaatcatggattaattaggctcaatagattcgtctcacgtattattccaaaattatggatgggttttattaatagtctacgtttaatatttataattagtgtcaaacatccaatgtgatagggtcttaaaagttttagtcccatctaaacagggtccaggtctgaggacggacttgtcgggcgggccatcgtggttgtaactagaggacatacgggcagccctagcaggtggggatgtcgagatggagagtttgcttgccatcgtcaaccatgtatatacagtggaaactacggtatcatcaatagtatatacgtatgagatttagctatatcatcaatagtaaatgttttagtcccagattcaattgtaaaacttttaatatcaatgatgtgatcaaatatcatgtgtccttttttttaatccaacaatatttctatgtttttattatatatatggtttgcgctatatatattcccactttagagtcactaacatgtaagtccacagcaaaaggagcccatatgtttagtgactcaaagtcatgtgagtcgcaatcttgcaatccaatgtgggggatagaagagatgaagagagagatacagaggaggggacactgacatctgctgagtcagccactgacatctgctgagtcagccagttggaccatatcaataagcctcgtcaacaattaccgttgtaattactgtcttggaagtcaaattagactggttttaatagttttagggtattacggttaaggtatataaattatatcgaacataaatttgagcgactcaagttggacttatttcttcagaaatttggttcataaatgtaaaagaaatgtgtaatgaggcccattgctgcagcccaagcatgaacaagcccaacaaatcagtgccatccattccatccaaattggacatctactatacataagaatggtttagctagaactattattaaaacgggcttcactagaataccattgtcaacagagtgcagtttgatattttgctatttttatcattttgggttaatgatgaaaaagattttgctctcttttagaaccttttgtgccgaaactgcccctagttttttctttcgtcctctctctatccaaaccgagcggcatctttttttaacgcacgttttttctctcgcgtctcttctgtcgacggtcgaccacctgtttttgtcgctcgctgaaggactgagccgaccgagtggcgctggaggcggaggtgcgagcaccaggcgctcgcagtggctacgagcgcaggtggcagcgggatcgggggtggcagggagcggcgaggttgggggtggcggtgaggaatggggagatgtggcgcgccggccgacaaagcggtggtgggcggtgaggttgggggtgagcgccgaggataggagtggcggtggggagaggtggcgcacaggccggcagagtggtggtgagcggcagcggcgtcgccgcgccccttctctcgcctattatgtttcctctctcacgattcaacaagttgacctagggatataatcatctgagaaaatgtgtaatttacaaaaaaaaaatgaaataccatcgacaagcaccctaatcctaaaaatgtcattgacaaaggcaactttctataaatacc

SEQ ID NO: 36806 - DNA, 3100 bp, Oryza sativa
ttgtcacctgttctgctagtattactttctgcagttaggatgatttctgttgtactgtagttgttagcaacagtcttgaactgaaaccttggttagctagctgtgaaagtgtctcagccaattttctctcctttcttaatgaaacaacagagttcctgctttagtataaaaaaataccaaaaaaaaatggttagaattaggaagatttccaatgtagtgtagtgtccacaatgttcttcatgctgcttcaaaatcgctacttttactacagtcattatgtgattaccttttgtcttgcaagtttctgcacttaagtaggaagatttctgatgatattagtcattagaatctagttctattacatatatcaatgtcggaatagcatgtgccatgtttgtgttcatatgctcctacacatatagatcaaattgtatattctactatcatctgttctgcaagtcttgaacttcggtttttatcatagagcaaaacaccccaataatttccttttgggaaaacggttgagtgatcatgaggtcgagagttcgagcctctgtcaccccaaatattgagtgatgaggaaatgctcctgtgacaatcgggttcgtcacattcatctgaccatcagatattaagagctagtctgaactcaattaacttgaatcttctttttgtaatgcatatactgtactccacacatgtcgatcaaattgtatattctattttcatctgtgctgcaagtcttaaactttggtttttatcatagtgaaaataccccaataatttccttctgggaaaacctaactgccaactagatgcactagtctaaatatacagttaagggctggatatcaccattgacttggtctcttggttgatttattgctctgatgactaccaattcaggtcgcattattttgcacttgtgcctgcccccacatatttattggtcaatttagttggctccaaaagggtataaaatactagcagttactctaacatagttctgtgttttgcagtataaatccaggcacaccaagtggacacaaatatatagaatacatcatgacttttcaccatatcattcagtatgaatatgtaactagtaataaaaatgttattgatttgaatgttttcaatcaccatctatattttacctatctcagtaaacttcttagttgtatttgaccccatgtcctttagaattgcatattccttaacaaagggagcagttgatgagtgatcctttctaaaacagttatttggatttgtcttattgtagtaatattacttgatttgtcaccaaaagcacttccatgtgtaatatctttatactgaataaaatcgaaatagtaatgatcaaagcatttactgaagattgtgtcaatggtctaagacgacaatagatgtaattcaattaggtatgcctgcattctattttcaatggtttcttaatcttgtgcttaactttgctgcagccaaacactgtcgtagatgaagtggtcaagattgtctggaaggagcaaaacatgaagtcaattgctctccagaagacaaggtcaatcactgctgtgctgccaaacaaatcagttgttctccagagcgccaggtcaatcactgttgagttcgagaacttgagcgaaaactgaagttcgtgtatgcttggagctgcagtgttgagagcttactaacttcgtggctcactcatctgaactgagaagttacaaaacccagtggtggaaaccaaactacacaggtgtaaacctggagtagcagtagcactaaagtaattctggtctaacataagttacttgtatcattagctgtactgaatcattgtagagctaatactaatatatgaatggtatatataaactaatacgtgtactaagctgtaccaaacgatgcacctatactgttgagaagttcatatatgcaatgaatgttggttgacattgcttaatgttatctgcaaattcttggctttctctatgtaccatacacatggatcgaacgagtgattcaggtcgagaattcccttcttgattcgttctgtttgtagttctgaaccaaatgaaccgtattggaaacttggaatgtgaatatcacatcccatttcaaaattaattatggacaaactgtcacaactataatcaacctccatttctcttatcagatggacagtagtcaaccacaaattcattcatgaatatgtgcaccggactaagtacaccgaaaattttcaggtagttttcatcaataaaagagggcattgactttgatctcaagaactcctcactaatcactttcaaacagcaggggaaggaagtagttgagatatggatttgtacaaaaaaaattatccaacttgtgcatttggtttgattcgacttgccggtgagggccgtccaagtgacatgtgggagtttcgcctttactgcaatcgggccctaccccgccaggtgttcgaccagtgccccgaccgccgcggcgccacgagcctaactgtcgcgccgcggcggcgtggccatcgcttcggtgttcgccacggatgacgatgtcgatgggagcgacgccaggtccggggtggcggtggatgatgacgtcgaggcctctgatcggtcggcgccgccgcctcgtgcggtatagtcggcgagcatggccttgagctcggcgagcacctcgcccatcgcggggcgctcgtgcttgtatgggcgcacgcaccggcacgcgagcgcgaacacggcgcgcacggtgggcctgtcccagtcggcgccgaggcgctcgtccaccatggactccgcggcggcgccggcctcgccgccggcctgggcgacggcccagtgcgcggcgtgcacgatggactcggcgccgcccgacggcgtgggcacgacggcgcgcatccccgtggcgagctcgagcagcacgacgccgaagctgtagacgtcgccggcctccgagacgtgccccgccgagaagctctccgggtcgacgtacccgcgcgtgccgcgcacctccgtcgacacgtgcgtcccgccctcgggcacgatccaagacaccccgaagtccgacagcttcgccgcgccggactccgacagca

SEQ ID NO: 36807 - DNA, 2013 bp, Oryza sativa
agcttggcgagcacgccctcttccgcgtagaactccgacacattcttcgacctgtagatcttcttgatggccactcgctgccccgacgggagccgcccccaggtacccttgccggcgccgccgctgcccagcagaagcttctcgtcgtagccattggtggcctgcttcagtctccgacttggtgaagatgtacaggccctcgcgcggcagcggcggcagcgacgccaccgactcgtcgtcgctgacgtcacctgccgtcgtcgtcgacctacgccggcgacggattgttacgattgccagcgcggcggaggcgaccgccacgacggccaccacaaccgcggacgccgagccgacggcgatggcgacggtgttccttctcgaggaggagcttgggagtgggcgcgatgcggtggtcggcgacgccggcggcggcggcggcgaggggacgaggtcgctggtgccgaggctgttgacgttctcgagcacctggagcatgcagagcgcgtaggcgcggaaccgctcgagcggcggcggcgcgcgggaccagacggcgacggtggcggccatcccgcacggcacgaactccttggtgcgcgcgctggccagcatctcgtaggtggtcgcgatcaccgcgccgcggcacgcggcgcagccggggtcaacgggcccgacccccggcgcgcgcgccgcgcccggcgcggcgcagagccgcgtagcgttcggcagcgcgcgcggcgccatcgcgcgcgcggcgtcgatggtggcgagctggcacggccgcgagcccgccgcgagcttccccgggtcaccggtgaggtcgcacgacccgttgtttgcgaggagcgacggcgacacgaggccggaggagagcagcctggcggcgaaggcgccggagcacgcggcggcgggctcggcggggaggaacgcggcgccggtgcggttggcgtggtcggcggcggcgaagatgtaggcggcgaacacgtaccagcagcagccggtggcggcctggccggcggtggcgttggcgtagcactcgcgcgggatcatccgcgtcgccgtggcgaggtcgtaggggcacgccgtggggcctctcgccggcgccggcgacgccgccgccacggcgagcgggaggaggaagacggcgaggcgaagcatctggcggggtggtggtgaccggagtgagagggggagagtggcatcgataaatgcgagcgggtgggagttttttttttaaaggtggggcccacaaagtgatttgacgatttgacccttggagtgtattgcagctacagtgcaaattttgattatgttgataatctctttttttaaaaaaaattaatgatagagaattatagagcctgggactgggagatgatggatctcacaaagcatccatgtttagaaaaaaaacatcaaatatttttgaagttttgtccacctaaacatggtatgtaccaactagggagtgaactattgacgtcaggtactattgtgaagtgttatatgtttggaaatctcgaataaagtaagtagaacatatgtagcttgaccagaaaagttgtgaagggtaaaatatctttatgccatggaaggaaccaaaattatagctcacctctaagatcaactacagagtacctccgttctaaggccctctttttttaggcttattggcctaaacttttaaattagcttattggcttatatgatttataagccggtggatttaatatcctaagtttagtggttgagtcatacatctacctcacataagccaaaaaagcttctccaacctagcttttggcttaggccctctttgtttaggcttaggcttattggcctagacttttaaatcaccttattggcttatatgatttataagccagtggatataatgtcctaagtttagtggtggagtcatacatatatctcatataagccaaaaaagcttctccaacctagcttttggcttaatagtgttagagtggcttatggcttcaaaaaaagccaaatgaa

SEQ ID NO: 36808 - DNA, 1780 bp, Oryza sativa
tgtttaggcttaggcttattggccctagacttttaagtcagcttattgggttatatgatttataagccagtggatttaatgtcctaagtttagtggtggagtcatacatatatctcatataagccaaaaaagcttctccaacctagcttttggcttaatagtgttagagtggcttatggcttcaaaaaaagccaaatgaaaaagctgcttgtttgttttgacttagacttttcgacttataagtaggcttataagcctaaacaaagagggccttaatagtgttagagtggcttatggcttcaaaaaagccaaacggaaaagctgtttgtttgtttaggcttatacttttcgacttaaagttggcttataagcctaaacaaagagggcctaaaataagtgcagtcatggatatccatgtccaatatttgaccgtccgtcttatttaaaaaatttatataaaattaaaaaaaatagtcacacataaagtactattcatgttttatcatccaataacaataaaaatactaatcataaaaaattcaaataagatgaatggttaaatattggacataaatagtgcaaaacaatacttattttaggacggagggagtagtaaataagcgcaatgtctaattgataaatgataggttttgtataagtgtggagccacagcccagctaaccctggacagatgcctaggagtggtatagttgagtttgtctaggcctgaaaatatttttggctctatcattgttttgcatgaagaacaacaattgatagccactaagggcctctttgaatcgcaggattgaaaaaacagaggaataggaaaaacacgggattttggtaggaatgcatgtgtaaaacagatgattgcaaaacacaagaaaaatatagggacgaccgtttgattagaccgcaggaaaaatacaggaataagatgagagagatagacccaaggaaagttttccaagaagttagagtagatgttaactttcctaagtttttgctctagaattgtaggaatagggaagtttcctacatttttcattttctcattcctacgaatcaaaggcatgaatagtgtaggatttcaattcctttgtttttcctccattttccctccaattcaaagggggcctaaattcgctatgtaacaacaagtagttaattgtgtgatgggttactaaggccccctttgaatcaaaggaaaaaccataggaattctagaggattttatcctatgggaaataatcctataaagtcatataaaacaaaggattgtttcctatcaattcctttgaaattcctatggaatgaaccttactagagcaattttggagaaaaataagcatgaggtctcacctcatattttcctcttcatatgtctaacgtttctgcgtttttcctgtgtgctaatcaaacgacagtttgaagactttcctgtgtttcgaaatcctgtggcattcaattcttacattttttctattcctctgttttcttaatcctgctattcaaagaggccctaatttttagctcttggactcttggttaactatatatacgactcttgtcgggatctatctgccccacacaactaaacatggagaataaaattattttcactagaaagtcaaaatgtttattggttaaacatgttatttacaacgaaaatcatgctcgattatttgactaggtagaatgtgaataggggtatatatgaaagcaagattcattcccaatgatgatcagatcaagatcaatatattgcaatctggaa

SEQ ID NO: 36809 - DNA, 805 bp, Oryza sativa
caatcattaaaccggcacctttagcattgctcgaaccaaaaaaaaaacagagagccggctcgaatggagccgacctcactgagcaccatcgccatgcgcccaaatcaaattaaaatcctcaagtcacccacaaatctccaccaaaattgattgacatcacaaacatactccaataaaatcattcacaaatccaccaaaacatctaaaaaaatcttgtgccggcggcccaaggcttatctacttcgtctgtttcatcgccggcgggccatgttgtgcctcccctcccgccggatcgggcggaggggagcgcgccgctgcccgccgtcgcccgccgcctaccctcccgccggatcgggcggaggggagcgcgccgctgcccgccgcctcccctcccgccggatcggacggaggggagcgcgccactgcccgccgttgcccgccgcctcccctcccgccggatccggcggaggggagggcgccgtcgcctcccatctcgccgccgctgacgcctctgccaggacgctgccccaccgctgtcgcgcgctacagagaggcgagagagagagagaggcgagaaagaacgagagggatcgagaggcgaggcgataaggatgagacgtctgaggctataaggatgaggctgatgcgtcggcctgatcggctcggctcggtatggatagatgtcggttttttaaaaaatccggtacctataatttattattagtatcggttttaaagaagaaccgacacctatagtataggtgctggtttttctttagaaaccgacacctatattgcattaaag

SEQ ID NO: 36810 - DNA, 750 bp, Oryza sativa
caatcggctatatgtccaatgtagataatgatataaatgcaatcggctgttgatgatgtaataacaatatagtcgagtagaaaccaattggctagaaacaagatataataagcactgatctgaaggttaaagcatacatcggctggtggtccgatatcataaaatccacaagattagattaaacagtaaaacctttgttgcgatcggctaaatccaatatgtatgcaatccttgtaagccgatacaacgtccagataactcattagctgaaaccccgatgaaacccttattggcaatcaagaagcaggctagagattatggttctaagcacgacttagtagatcaaacttaactgatgcagcactaagtatgaaaagaaacacaatatctagacaatcaagccgttgactgattttcagggtggtagatgcctaggctaatctaatctagcaaggcgatttagccgataccggcagaaaccctaaagcgagagacagccgatagagctaaattgagatgctaggactagattaacatagacatatgataaatagctaggcaaatatattatccaaaccagagtaatccaagaggtcgaatgtactgatgcagccttgaacgatgccgacgtagacgatacaattgcctggaccggtggaacattagacttatcccttcgccggagatcgaagacaatgcagccccgcgtcgggtgccaagttctgccggaacgtaaaaacaaaagtagaa

SEQ ID NO: 36811 - DNA, 1623 bp, Oryza sativa
caaaaattataggtattacaaccttagagagtcgtaactaggaaaaaggaaaaaatataccaccacccacatgccgacatcgccaacacacacgcccaggagaaggctagcaccggctcggccgccgctaagcgtgaccgaccgctaataggccaacaaaggggcacagatgagatcccgaaaccacggctgatgcaccgatgctccaccaccacacaagctttgccgacatgtgagacccctgcaccgacgtcccccgccgaacagccttagtgcgccgaagaccgcgccacactcaccgacagcacctcctcacacctagatcgcctcctccaccgccggccgcgcctctctgcaccaagccggcctccttcaccggacgcgcctctcgcgccaatccggcctccctccatcggccgcgcctctcgtgccaagccggcctccatctctaccgcccgcgcctctcgcgccgagccggcctctgctgccatcggctgcgcttctctgcgccaagctggtctccgacccctccaccgaacgatgccgcgccggccagatgcagctgtctcccacgtcctcggctagtcaaccgaggccgccatgcctccggtgaccgcaaacatggtcaccaccaccacagccgccgctgcctaacacccaaccacctcgccgtcgtcatcctcacctcgcacccgactccttccctgccgccgacgtagccaccacctcagagtcgcagccgccgtcgccgctgccgccgtcgccgctgcctccgcaaactgccgctgcgccgtcgtccttcaccaccgagcagctagctgcccgacgccatgtctttcgccaccgccgccagttgacacggcagccaccacagccaggaccgccgccgccgttgccaactgtcgccgctgccgccatcaccacaccacggctgtcatcgccaactgctgccggcgtccagatccggccgagaccgccgttgccaactgctgccggccaactgccgccaccaccgtcgccacaccaccaccgctgtcaccaactgccgccaccctcaagatccggtcgagaggcgcggatctgtggagcaccgccaacgccgccgccaggcaccgcgccgtcacagccacgggacaaccgccgccgcctcagcgccctcggccagctccgtccccgccgccttcagccactgccgcccagcgctgcgcgcccccttcgcctcgctgcctggggtcggagctcggcctcccgtgccggatccagacaagagggggccggatccggccaccccgccgcctccacgctcatcaccgccgccggcaactcaggatccatccccccgcactagatccacgcaggagagcataggagccaacaccgccgcctcgtcgtcgtcggcccggccgcccacctcttcaaccgtcgtcggcaccgccacctcgccgacgccatgcgcaaccgtcgagctcgacgtcgcagccgccgaagtcgctgccccagagctaggtcggggtcgtgggctccgaacactgtgaccttggggggggagaaggccccaccgccgccgtccttgcggccgcgtggtttccggcggcccgctcgggcagcggcgaggtggaagga

SEQ ID NO: 36812 - DNA, 4362 bp, Oryza sativa
ggggcaaagggtttggcctagcccccgagagaggttttcgcagtgaggcttccttgacgacatctccagtgagaaaaacgatgatgaacaccgacatcgccatccgtcgagatctcaaggagaaccaagacaataggttttctcctggtagcccacctgaggaagaggggtggctcgacaatgccccaaagatggaaaacaatgcctaaaacaccattgttgtcgacctggcaagaccaagctgggctttactatgtcgctcggtccatgaagacctgaagaaaaagctccaaagctccaccacctaccatcctctatcggtacatggtcaccactgtactgacgccctccaccagatagcctcaccgacctctctttcgtcggccctccgcgccatcgaccggggcggcctccctgccatcgcccgaaccaacctcctggagcaaccagcatcagccttcctgaaccactgacgccacctgcgtcgtgctagcctcccttcgttccccgccggatgcccctcgtcagtcagcctcagcccacccatggcatcatcggccacctccacgcatccttcttctcgctgcctccggcaccactcgctaccatcaagacgggcctcactagccaactcgtcaactctcatccacacgcgtgtgacaccatcgccgtggggcacctccaccgcctgccccttcaccgcatgccaccgcctccctgtcacagggagccattgcaggggagtcggcgtccctcgcctaagaagcctgatccattaggggggtttgccgtatctagcgaaggggagccagatccggcgacgcggtgcacagacaagcctatagccttgccgccatggcctctaccctgtcagtcagcggcagcggcatggagtgttcgacggcctcccggagctcctacttctgcgcctcacaaccattatattgatgggtagcacatggagtgttccatgtgttcttgcacggggtagatttaattttcaacatgattttcatgagattcacataattacctctactgtgcatccatgcactatgtatgctctaatatttgtataccgaagcgtaaatcatgtaatcccccaaaaaagacattgttaatggcaatgatagaaactatttatttccttccttttgtttcggcaatgataaaatcatcatgaccttgctcatctgctcacattgcttaggtacagtcatcttatcttatcttatctctcgatcctgctcttaattctctattgttccatttcatctacctctgccttagttggttaactagctagtgcaaatcctagtaggtttaggatgcaacaggaacaaggaattcacccattgtagggcagtggattaatttgtcactacatgatgccacagtttagcaggcagtgacggcggcaataaatcctggcactagggaacggagtggaaaacggcgctaggtgtatggaatagacagaggtgtcaattgcatctattgaaaccatttattttcttcctctgctttgccctacatataaggcatgtgccattgctcacacagtcatctacacatctaattggtcttgctctaagcctattagaatttttgtgcagtcctcctgcccaagttgttccctgggtgcatgcatgaagtgcagtaggcttaggaggcaatgggaatacaggcttcatagcatgaccacattcaagtatcaaattgctatatagttgttctagtgattctgaagagggtacagtactgtctgacgatgcgtgctagaattgatattctcacacacactcagagaccagagtgttgtgtaatatggtgaagagagaaatgataagaggatggtactgcaaattggtgttcgttgtcgtctcgtcaaagtcaaggtagatatagacaatcacactggaagaatatgtgagctatggcctagcaggaaaagtgtttgcccgatgggctcatgggggaagagatggatggtttttatataccggcctgaataatttgaaatgcttcttctagtatgtgttagtcatacttgcaatgagccgaattagattatcgcacagttttatatctagtatattcactggctctaaaagtagttggcattgacatttggagttcaaagttgaaatttcttgatcaacagccgatcagaaaacagcaggggctcccttgctgttaagaactcttgttaataagaaaaaaacaaaaaacaattacagcagtataattcagttctgtactacattctaatctctctcattaagtctgaaaagaagcagcaagaggtctcacttgaaaaggtgtgtccaagaaagcaacgtaggtgaattatgattgaagatcgaaccattacttaggcactgtttgaaagattagcccagggctaattttgagaactaattaatgtttagtcataaattgttaggctaaatattagtctagggtggtatgtttggatccattggctaattcaaggctaaaaggtggagagagagtagaaagagaggagagaggaagagaaagagctgctttttgatggtccctacacaaaattatccccattagcaccccatagaggggttaatgttttgaggagggctaattcactttaacctcaaattagccctcctgtttggatccttgagggctaattcagggctaaaaggtgagggctaataattagcccatagaaccaaacagggccttagcttccaaatgttccacgcaaccaacaataatttctccatacttaaggatgtgtcctaagttattatttccacaatattccagcaagcaactgaaaaagggtattggaagaacaaccaaaaattagtgtctctagagcttgatgactacagaaaacacatgccaaatcacaatctggtggagcaaagttcttatgatccaacatgacatgggctggggttcagtctatccatcaaaaggagtcataaaaaaaccttcaattttaagttacacttactcttccttatccatataaggtgttgtggtggttgactgttctgaaattgagggcatagaatttatgagaagtgtatttcatgcctccgcgtactgttctgaaattgagggcatagaatttctgagaagtgtatttcatgcctccgcgtatataactacattggtcattatcttgggacaaatataattcattaaccatgtctttcataaccagaaattcatcatagctaggcatgctgtgataaatgcaaccgaaatctatcctgaagttgttgattcatgaagctttgaactgaggaatttgtgttaatggcaaaggtaaacactcaaagcctcgctacagtacgctctactagtagtagagaggtagagagtaaccaatcatggttcatcgttcctctttcatctcaactaatgtttagggcccgtttagttccaaaaagtttttcccaaaaacatcacatcgaatctttagacacatgcatgagtattaaatatagataaaaagaaaaactaattgtacagttatgggggaaatcgcgagacgaatcttttaatcctaattagtccgtgattagtcataagtgctacagtaacccacatgtgctaatgacggcttaattagtcttaatagattcgtctcgcggtttcccggcgagttctgaaattagttttttcattcgtgtccaaaaaccccttccgacatccggtcaaacgtccgatgtgacacccaaaaattttcttttccccaactaaacagggcctaacacttcacgttgtttggagcttgtctagtagtggtgtaaatggaggtgcatgtggcccatgtggtgtaaattgggctgtgttcgttattgggggttgggaacccatctcctaaaaacggagcaatccattagcgtctgattaattaagtattagctatttttaaaaaaaatagattaatttgatttttttaagcaactttcgtttagaaactttttgcaaaaaaatatattatttagcagtttgaaaagcgtgcgtgtgaagaactatagagaggggttgggaagtggctgaaacgaacgaagccaggtgatggagttcatatatagtacctatgcaatatgctatgtgtgtatgcagatcctactccttggaacagttgagttaatgtgcacttttgaggcgtgtctttcatacaaagtcatttatgcgagtctacttagggtgtgttcggatgcccccttttcctaaccctctttcttgttttccacgcgcacgttttttaaactgctaaacggtgtgttttgtgcaaaaagtttctataagaaagttgtttaaaaaaattaaattaatccatttaaaaacggggatcca

SEQ ID NO: 36813 - DNA, 1434 bp, Oryza sativa
  unsure (1)..(1434): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaatgaaactgcccaatgcttcaccgcctccttcatctcatccttatgagcataccttgcaccctcaattacctcgtactccttatactcccagggtacatgatcaccctctgatataacaagaccagagaagtcctcatttgcccaatcagtggccattacatcaccttcctcatcggatgatgcgtcgtcctccgcttgctcattatccgaatcttccctctccatttcatcaacaattataccgactctctccccctcatccgccatgcccatggcctgctcctcccttggttgattttcctcattttgcatcgatggtccaacaacatcccctgcattgctaggaccctccacatcttcggtttgcattgaaacatttgtatctttctcttgtaccgacacaaatataacgaggggccatgaccgttcaaaagccatttccacataccgtctccaagcagcagtgctgtccatcggcattagttcccaaaaataaccttctattgcacgactcactacaacagatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaagtaggttacattctccagatcaaactaaactacatcttacaattaacactactgtctatgtctcaattcatactatttttatattctatgctctggatctacacatatgtgctgtgtgctacagatctgctaaaatatatggaactaaaactaaaacgcaacatatgtactcaaacgt

SEQ ID NO: 36814 - DNA, 3523 bp, Oryza sativa
cctcccagagggcggtaggcgactatttccgtcaattttcaaaatggaaaattatttttgtaaaacttttaataagaaaaattataaataaaaaaaattctgattgtattgtggataaaataggtgccaatttcatagaataaaagtcagtatgtggctttttggtgtgtctggaactaatctctatgtgtcgttgatattgatgtttcatcattggtattggtgaaagtaccttcatgtttaaacaagaggtataactcttagtatccttgttactactatatcgaaagaactaatacgttatataaccatcattctcatcaatcacccactctaaatattattggttttgtgcggtgtttaacaccatattgtaagccatggttaaaaaaataacacgattccaccatataattattagcaggaatagtacattgcatcagcaataatagccgcttattgtaatgtctattttagaacgtatttacatgatagttgttctcaagactaagtatacataagattgatataaccacattaatttgtgagattattaatatcaccatgatatcaaccatacacaacaattaatatatagttgcacatagctcatactatcagttactcctacttaatgcgtattactttgcaaaaaatatccataagtccatatatatactacatgttgcctggagctacggtgacaaggatgatgaatagatgaaacgaaagccataagtccattgcttgttaccgttaataatgaaaaatatatataatgaaatattagatgtcgttttatcaatcaagagtaagaaaagtattgacctactagtatttttttagactagtccatctacaaagaaaattcaactatactcagatgtcacttgtacaaatagagaaaaccgatattatgtaatacaactacgggtaaaccttaaatgcaacttttttactatgattcctctagaacgtaagattcttaaagtataggaatagagaaaacatagaattaaaaatatcatgccatgtaaaatcctacaagaaagaaagctacagaatttattcaaaacatgtatttggtgtaccatagaaaaaaacaaaagaattttaagattatatgttgatttgctagagagataatggagagagaaaatgccttaaaatatcaaaggaatttgaaataatgaggttgaacctaatgctaaaattcatcaacattgtggaggaatttttcctatcctttaaattgccttaatttgaagcaatcctgcaatcataaggactcattcctttggattggatcctgtcttttccttaaaaaatccttcaatcccaataagccctatatgtttacccattaaaaattactcctacctactttctccgtcccataataaatttattttgcttgtccgaaaataattttatttttagagtaactattacatcgaagtttgtgaaataagaaataattatattatgagtagataaagtgaggaatagttgtattgaaattcgataaagtaggggaattctagtttttttattagtatgtgtggaataggtgaaaataatgaatttattttagaacggagataggacataacttctgcatgtatgttaatatagtgtctaaaagattaatgtttcttttttctggtccagcagctaccaatctacttctactataccatcacatgcctgcctatctctgacaataccttaccaaaatatcagaggcaccattttacagaaacacatggataggaaagagcaacttggagaaaggggaacaaggggctgtggctcaaacggagcaacctcaagccgcggcttttgtgtgtcgtttgtgtgctcaattgttgagagatcggcttcttcttcttcgtcacctacaaactgctgagagggagagcacgtaagtacgcaatcaaggctgacacgctaacggccgacatcgcctacctgccatcaattaagctttagctatatatactaccactgtatagctaggtcccatgttgcgttggtgacactagctgctgctgtcatcacgcattccgaggaaacacatgtttttaattattttgttaattacaacagctttgatacaatttcgatcattttattcgttttaagtcactgagcgtttcaagagttgtccttccggctaggacaaattaaaatggtagtataagatattgttttttaataaaaatgaaacaatctattatttatttattaattgtctttttgttagatttctctggagatcagtacaaacttcttttggtctatatcctcgtataatatactccaactcatatttttggaaactggcttgtgggtattgataaaaggaccaataaattcattcttgtaggacaaatcactgtttaaatcttatatgtaggtactttttggaggcaacgcactagattcggttttggacgtaactacaatggagtgatgaggacatcaaacttattcacactgcatgctgcaacctaggggcaatggtttgcagatttttttcaacttcggatggagattcacaaatagggtgcaataattgtgaagtcttttgtctagtgttggtggttattagtgggtgcatcacttcatgttttcttttggaggtgccattatgaaattgtttgttgtgtgtgcttatcaatgaactgattttttaataataagctgtagctcttagagcaaagaccgaaattatattccattatttagaaaataatttatggtcagagatagatgtttgacataggataaatctaaaacgacaaataacaagcagtaattcaaaacgatgagaatgttcattcgatgcgtttgtaatgccatttggacttctaatacctatgtggtggtttgtttgcacattccaacaaattttaatgccatgaaagcattctttacatggatgtcgttgaaggtgtatttttaatacatccaatgtgaattaagatattgatactcaaaatttcaatacataatattgacattgctgttgttttgtttgtctcaacggttttcaatgcatatactagcttctcgaatactactacattttggtggtcccacggtgaaagaccagcagatgcctgcattggagatttggagctgaatctgtatttctagagacagaatatgctctttagtagatttatgggctacgccgtttgcttacatccataagattaattggtgagtgtataattagtgatatgtgtttttcaagctctttaagtagcttatggattataggcacacttctcaagcttctaacgatactccctccgttccataatataagacacaaccacttttcttagatgttacataataaaaggcatgcatgcaagcatgcaattaactatagcatcttctccattaaattattacttttttaaatcctccactctcatgttatctaattctattggatacatgcattatatttattaggatgatccaaactacaagatgataataattattt

SEQ ID NO: 36815 - DNA, 242 bp, Oryza sativa
ctacagcagccctctcacgtgcttccttttgagctctttgaacagcagcccgctctgcacgctggcgtgcctccctctctgcttttgcacgtgcttctgcagctgctctttcccgtgcttcctttgtagccctttccacagcttgcctagcagccctctctctttctctctgtttctcaagttccctctcctcttcaagtcttctttgctctctctccttttcctccctttgtctcatctct

SEQ ID NO: 36816 - DNA, 2776 bp, Oryza sativa
  unsure (1)..(2776): unsure at all n locations
tcaactgaattatcacatggttctctcgttgccgagttggctcataccgacaaagcttccgcttgatccaaactactactaaatttactcctagaatgcacatgtagacaacataatgcccgaaattcccatgcaaaaagggtgtgctcacctggcacgcatcgggatcctcccgccaaaccctgggatcaaatcatccaacccagccgatgaagcggccgggtcagggttccttttctcctccggcagcacctccttcacctccgggttgctcccaaaaccccccagcagatcatcgtacgcaggtggcggcggggcgtggctgcccccgaatacatcgtcaaaccgggccgaggaggtgctcttcaccccgggaaccccctcgaagaagtcgtcatcgtagaccggcttgtccaaccccggcaagacgaagggcttcgggttgggtggggcaaccggggcggagggctccttgaaggagtcaaagaaggcgtcgagggaaggcgaggggccgcccttgggcggcggggcggagggccccccggccccgaagaggtcatcgtacgnnagnngcnnnnncggtggcggcggcggcggaggacgccgatgcggatctggagttggaccaggcggatccggaggacgcggcggcgcgggcggccgacatgggcgccgccttcccctgcgggcgcagcccaaagtcgcgggccaggaggccctggaagtcgtccatggcaaccgcaacagcgcacagatcaccggatctgactcacgagctcaccccccgcccacaccaccaccacctcccgccgcggaggctaagagcgagtacgcgagggggggggtgtggatctggggaaaggaagaggaggaggatcggggacggcgacgagacagctaccgatctggggaatgagggggagcgctccttggcggcggcggggtggcccggtcgccggagacgccgccggagagatcgccggagacgggaggggagagagagagacggtgagtcgaggaggagagagagagatggggagagagagaagagagagaggtggtgtgtgggcgatatcatcgggacccgtgctttccccactgccacgtggagcccacgaggaaagttggagatcgtgttacggctacgggggattcgtccgaaccgcgtcactgacaggtgggtctggtttttgttggtcccacctgtctgtgaggtgtgagggtggtgaggagggcttgaacgtgggagtgccagcgcgtcggtggcggcttacgcgctgtgcggggggattcggtgtgtggggccgggggatgtttgggggtacgtggacggatgtgattggtcggaccggtgttgtgtggtttgtgcgatgcggtgtggtggacgaagtggatgggcccacgggtgggtgggtccacttgttcggtttgttcctttctcgcgctcgtccgtctccaccgtgctgatccgcctgaaggcgtaaaccttgaggtaccgcgttgctgtataaaaagcgtcaactaggtttactaaaatgaggtgttccgtttggtctatgcatgtgtacaccggtaacatgtgttttgaatacaaagtgtatcatttgactttttaccgtaagtaagccagtaagcctcatgctttntatactggacggtcgtcagatgccacatatacaatatgggctaaagagtttacataacaacgggtgaaatgagctagtactatataaaaaaaagtatattacaataataattttgttattgacctccataaattaggtgtaggaataagcacctcggcaaccactggacaagtgggcagtgtggaggaagcagtggcaacaatttgacttacttttttctgcacgtgaaataaaaacatttaacatattattaattaagtattaaatcgataagctagatttgtttgattttttttaaaataagcttttatataaaaatttattttaaaaatacaccgtctaataatttaggaaacatactcatagtaaacgaacgagttgcaaaagctaaactcactttcaaattggcaacagccaataagatgaccttttgttggctctaaagaataatcacctaaatttgaaagccatatacatatacaacaatatttctcaatgctttctttaaaaattattttatcttttaccgagtctcaaatctttctcttttactttggactagctcatgcacaacagctagtacttggtggctatgcgctcacactcaacgaacatatgattacttctttctcattcatgtaggatgtaggttgatatggcttgagtgataacgtttgcatgtaaactaaggttattatacttgccgtacatatatgatactaggatgaagtagatatacatttatgatagatgctcacaatttttctttgtggaatcacacttttttggatggcaattgttgattaagtatgcaaccataaggggtgtaaggaaagtcaatcattgtgcagctatggtttattgggcatttggatggagaggcatcttttttctcttctaatgaagtgaacattgaagaaaagtatgttattcttcgctccaagtatcaatgcatatacttgtaaaataagcatcacatcacatgtatatacatgtaccatgccaagaaggtaagcatcaccgtttagcgatgattcgaggaccagcatagtgtagaagagcggtgtacatcttaccttaatttatagaagaatggtatctcccgatgaataaaaccatatagaacacgg

SEQ ID NO: 36817 - DNA, 1233 bp, Oryza sativa
cacactgccgccgccgcctcgcttcgccggagccgtcgccgccgccgtgcgcccagggcagcgcgcccctgcgttaggccgtcgcgcctcctcctctcctcctatagggcccgcgcgttcccgcgtcctccctcgtcgcacggcgcgtgggcggcacgcgcggcaggtggtggttggttcgggagggcggcgtcgtcgccggtcaccgggtggtgcggcgccagggcgcagattggggcggtcaacgtaagttaggctcatggcatacaagtaactccaaaattttttgtggcacacaagtaaccagtaaattttttaatggcatagggataaaagacttttagatgtgccttcttgggaagttcactgggactacggttatctgaactgttgaatcatcaacaaactaaagtttggtgaattatgctttaccatagttttcgtatcacccacgtaataaacaggttcagaaaagaaggctaaacttcagcagaagagccatttagtgccatttttacactataatggtaaatttcacatgcagaggccaatcctaatgggccaggggatctgtggataaggcccaggtgcatggctggggatggccagtggctgaggccccctcatccgcaccgcgcagttccatctccccacttatgttttatttttgttttctccatcgcgcgcctcatttgctctgatcggccatcgcatgtatgctcttattttattgatgtgaatcaagtttgaattgatgaatttaaaccttgtttgcatttacgtgcataaatgctttggaactttactctcaagagatatatatacagacactgaggcaggtgaaatgagtgagaccaaaatcataaacatcctcacaccgatatattttcggggttctgtatgacggttttacagttcaccagcacacatgtataggattgggagctgatctggaaatgaaaatggtgcaaattatattgagatacgtatataggattggaaggtattagagcaggtacaataatcctatgtaagcaggctataacaacaaacaagttatatttatgttgagaaaaaagagtgtgtgcgtgaagagagaagctagtgtgggcacttattttgtcgccagagctaacaccggctcccatgcatgctgtggggtccactagtgctcagcttatgtgggtgaccagctaaccttcctcccgctagtgtgaaagttgctcattcagg

SEQ ID NO: 36818 - DNA, 129 bp, Oryza sativa
aggcggcggacgtcgccatggccgtgtccgccgcctacgcgccgttcgccgccgcggtgtcctaccatgccgccgccgccgcgccggcggcgctggccttcgggctcggccacggcgcgctcctcttca

SEQ ID NO: 36819 - DNA, 380 bp, Oryza sativa
ccaaataattcacttaaaaaggttgagatgttttactctagactagttagaatttcgaaagttctgcacttgtccgttctattgatgcatatccacttcaccttaggatgcagagcataggaagaagaggcgaagctgcagcctgcagaaagtgcagagaacgatttatacgtcgactaccgacgacgacgacggtgactacgtccttgccggcttatgatttgactttggattttggattagtgtcttgtcgtcggcttgatttgttcctgttttaattagtcccttaatttgaagttgaagttgataaaatcgaattcacagcgcgcatagcaataaccacgtttatactgaagaaagtgttcatatgtatgtgcaat

SEQ ID NO: 36820 - DNA, 147 bp, Oryza sativa
cattgcaccgccagctttgcgttcccctgaatagtgaatgtcccttcggtctcggcatcttaagcacttaatatgcgtagtgagatgcggccatgaacttcgcaagtgcagttctcccgatgatggcgttgtaagctgtatcgaatt

SEQ ID NO: 36821 - DNA, 757 bp, Oryza sativa
gaaaattttgtagaaatgccatcgaaatttgtggttaaacctggtttctgctcaccgtcagagcatacagtattatctttgttttcacatagaagggaatcccaggagtatattatgtttaatcaacgactgctaattctctcttatgtgcacaggagcactacaaggatttgaaggaaaaacctttttttcccggtctgatcgagtacataacttctggccctgttgtttgcatggtatatatatttgtaaagaaccaaacatatttgtaactctgcactttgatcagtaaactgttttcaattaaatttattgttgttctgttctgtaaggcttgggaggggaatggtgttgttgcatcagctcgcaagttaataggagctactaatccccttcaagctgaaccagggaccatacggggcgatcttgcagttcaaacaggaaggttggaatcaaacaacctttcatgttttaacattattatatctaccacatctttcacattttagcggatatctctgcatatatatctctgtcaaagaaattaaatttcttatggactctgctttccaggaatgttgtccatggaagtgacagtcctgataacggcaagcgtgaaatcggtaagttctactccttttcccagtagtcatggtataacaatataaggtgcatagaatcatgagttttaagtactacgaagaatgaagtagttgacacagtgattaggatcatgttttttttttttaaaaataat

SEQ ID NO: 36822 - DNA, 1862 bp, Oryza sativa
  unsure (1)..(1862): unsure at all n locations
acgattagtatgaatatctcagtgataagcttcaatgtgttcaatctgttcactatagtcaccttactcttcattgacagctttgtgaccatcgattggagctccgttaagatgctgaagccgttggctgccctgttaattgcatcgataagaggaggcaaatcttcagcatccattaagtttcgtgtcatcgtcacaatcagagataaaactgccgccagcatttgtctgtccacagattcggcacgaagtgttcacaagcacctgcaacattatgtttatctcagtatgacaagcgtaacgatccaacacaaagactaattatcaccctatatatgatgctgataaaaataaagcaagtgtttcttttcttgcctcaaaccagactaaacctttggacttttaacctttaagggttccttgagggtctggataaatttcttcttaccagtgtgatgaacacccagttgttcgaggatttggccgggggttattttgtatccctgggaaatttgtttggaccaagtatttttgtgagatcaccaacggcatcatctttcacttgtaagattaacttggcatttgctttgccatgggaacatagcgtcgcaagcttttcacctaccactgccaacccaaaaatgatgttggcctccttataaactctgtgagtgaagatgagtaacaatttctcaatgaaatattccccatcactatgttagaaagcatgcgctcttgcattcatgtgtaaatgtccaatgcttgcataaacagggaactatgatggaacgatcccagcccacatccttggcaacctagaatcctctccatactatccatggcgttccacagtatcctgagatattgcggcagacttcctagccagtctgaccacagaacatacacaacccggacaatcacaaccatcaaaccatgcactgttctgaaccacgcactattagggtcatcgttgtggttgagcaggccgaaccgcaaaggcgccatgatcttggctagcaggccctccgtcttgttgatnnnnnctgacagttcctcgtgtgcaacgagcttcatgaagatactcaaggcctggcacatcagttcttcgtaattaacagggatgttgccatcacaatccgtagggggaccttcgagcagaaaagctgtgcaatggatcccttgtggaaactgctccaggtggaggtcaccagcaaggtgcgccacgatccttgcagcgtgctccctcgcctcggcattgtatgccctcgtacaatcaagtgactgcagcagtgtgtgcaggccgccatcttggctgtaggatgccgtaggaggagctgctttaccattgctttctgctcttcgacctcgacctcaacctcgagaaagaaattgtacttgtacattggcgtattcaggagggagtccaggatcctcaccccagagaggaagccatcaggggatccagacttggttaaaccgacggcatatgtgaccaggttccttcctttgacgaatgacgggtccttctcacacccgatcatcgtctcttgcatgtacgccatcactgactcgctcaaactagtaacaaagcgatatttgttaaccaccaaatccaccagccttttctgctcatagcacaatgtgaaccggtaacagaagagcacaccctgtagcaaggcgatggagtagacgaacttcagcgcagatttcaggttggcgccgccattgttgacctcacccccgtagtcatgctgtatcagacgacacgcggatatggcagtggtgatgatcagcccaaacatgtagagcaccgctagagggcagatgatggtggcaaacacgaacaaatggagcagccatat

SEQ ID NO: 36823 - DNA, 1115 bp, Oryza sativa
aatcggagggataagttgagtcggatgaattccgcatgaaaattaattaatctgaatgaaattaatagaatgacgcatcagcataaacaaattcagcatgaacattcgctattgaaatttttggacagaattatcctgagttttcaaaaacattggccacttgtagacatgttcactactaaaaaatggccaagggggccggttcttaaagggccataggtgtcggttttccacctggcacctatgggtcagcattgatactagcaaccggcacctataaaaaaaataaatcggcacctttagcattgctcgagccaaaaaaaaaaagagctggctcgtaccaagccgaactcactaagtgctatcagtgtgcatgcgcccatcccaaaatcaaatcccaaaccccaaaatcatccacatatcgtccccaatataaattgacatcacagaatgaacatattcaacaacaaattcacaaaaacatgttctacaaatgacatcacagaataaacatatactagcaaccgctagccgcctcccctcttgagccgccgcctgccgctctccacctagcggaatcggcagaggggagggcgccgccacaacccgtcgcccgccgcctgccgccttccctcccgccagatccggtggaggggagggtgctgccgccgcccgtcgcccgccacctcccctcttgcaccgccacctgccgcctcccctcctgctggaatcggcggacgggagggtgccgccgcaacccgttgcccaccgcctaccgcctcccctctcgccagattcagcagaggggagggggccgccgccgtccatcgaccggcacctcccacttgcgccaccgcctgtcgctacccctcccgccggattcggcggatgagagggtgccgccaccacccgttgcccggctgccagtctcccctccagccaccgccgtgcgtgagagagaagtgagaagcgagagagagaggcaagagagagacagacgagagagacgagagaggtggagtattagataaggttgagtgcatggttgactcatatatccgtagggtataaggccaatgcgttggcctagatcagctcggaggctcggctcggtt

SEQ ID NO: 36824 - DNA, 1879 bp, Oryza sativa
tcgtgcccgtctgctaccgaaagtaagtactcacgtgtctatatatatgtaacgtgatatcatggatatttacgtgctgatcgatgtcatgctcacatcgtactaacatcgtcccaaaatattgctaccctagttctcgataggacatttcaaatccagtcttattataaagttataatccactaattctaatactcaacatgtaatcatgacacctcatcatccgctagcattaattaaaaataaaacttacgcaagcatgcaacattatctataattcattgaactctacaaatcaacatccaatcatcttcactcacattattcttcacaatatttttaacatatatatatatatatatatatccattatttttataatacttaacatatatttatccatataatcaatgtgcggaatatcatatttcatctacaaatctcatacagagtctactatgtattaatctcttaccatatagtttgacaaaccaattttatttgttgttaataactaatataaattttacttttagctcgattattaaaaaaaactttaaaagctctttattaattttcgcagcaaagtgcggggaaatgttccatcggaaactagcgcttagtacctagtattatatactacctccatattttaatgtatgacaccgttgattttttgtccaacgtttaaccattcgtcttattcaaaaaatttatgtaaatattatttattttattatgacttgattcatcataaaatgttctttaatcatgacatacatattttcatatttgcacaaataatttgaataaaatgaatggtcaaacgttggtcaaaaagtcaacggcatcatacattaaaatacagtgggagggagtattgaataggtctgctacctatatttcatgctcgcatactctctccggtttcattttaattaacgttttggacaatgatatggtctacaagatacatttttgcttatttttctattataatatatataataataaatgcatgtttacttttattatagcctttttaaaagccaatttaaaaaaggttatttaattccctttaaattaaatatttttaaagttattgggggccaaagttataaaaagtttgacttcaatcttgtctaaaacgtcaactaatatggaaccggagggagtaccattttctcaacgtcatcccatgcgctagcactcgtccttgcgtaataatccctttgtattactcgatgattaatttgcacatcggtgtgcgtgcatgcagggtggcgtgcgtgaggcagggcgggataaagtacacgataacggggaacccgtcgtacaacatggtgatggtgaagaacgtgggcggcgcgggggacgtggtgaagctgacggtgaaggggaccaagcgggtgaagtggacgccgctgcagcgcagctggggccagctctggaagacggaggccaacctcaccggcgagtcgctcaccttccgggtcatgaccggcgaccaccgcaaggccacctcctggcgcgtcgccccccgcgactggacctacgacaacacctaccaggccaagaagaacttctagctgatcgatttttttcaacttatttacttataatatttttacctctccctccgttctctccctacttaattgatgaatttttggaagtgaaaactaattaacactgaatttttttcttacgaattaatcctctgcgtatttactaatttgagtttgaaagaattcgttgatagtgatatttgatggatattcatgtaagctttggaatcttaaattttgatgtactggtcgaaaatgccattagcattgcatttattctggttttattattattattttggcttcaaaga

SEQ ID NO: 36825 - DNA, 637 bp, Oryza sativa
gcgcccgccaccgcctgcgagggcgggacagctcgccgccggcgccggcgccgtcgtcgtcgtcggaggaggaccaggagaggagactcgtggaaggagccatcggtggaggaaacaatggaggagaggcatggttgcggggtgatatagaggagaagagaatgggagggaaagctcctggaacgagctgggaatgttcgcttgagctcacattttgttactgtgttcgcgagcgagtgcacaagtggagtgtttttgagtaatccatgacgtgttttgagtaatctatgactctgttggctcgtaattgtcgattggttttgggtttgatcccttcttttgtggcaatgggtttttgcacttttttttctttttcagtttgagatgttaaaagtacactttagatagcataaacttttattttgcatatttgtgctcatttaaaagaagacagttgtggtggactccgcctactcttattacagtaagtttttacaaattaccccttgaactccttaatattaaaaggatccaatctaatggatagccacataaaattagattaagatgaatatttcgtttagaaaaagatgggtaacacattaatacattttctttaatccatagcaaagcaccg

SEQ ID NO: 36826 - DNA, 612 bp, Oryza sativa
accggatgcatggcaacactaagcagattcgttgctaggatgggaaaacgaggacaacctttcttcgctctgttgaagaaacaagacaaatttgtatggacacaggaagccgaagaggcattcattgcactcaagcgctacctatcaaaccccctgtacttgttgctccccaacctaatgaagaattattcctctatattgccgccacgccatattccgttagcactgtcattgttgtcgagagagagagagaaagtacatcgaccagtttattacgtcagcgaagctctccacgacgcaaagacaagatacccatagatccaaaagctgctttacgcagtcatcatgacatcaaggaagctacgccactactttcaagcccacagagtcacagttgtctcctctttccctcttggcgaagttgtgacaaacaaagacgttgtcggccgcattgcgaaatgggtagtcgagctgagccagtttgatgtccactttgtgccacgaacagccatcaagtcccaggtactcgccgacttcattgccgattggactatgccagataacaaatcagacaaccaaggcgacaatgaaacatggacaatggcgttcaat

SEQ ID NO: 36827 - DNA, 1513 bp, Oryza sativa
  unsure (1)..(1513): unsure at all n locations
agggagagaaaggaaaagaaaagaaaagagaggagaggaaaaagggaaagaaaaagagaaagaaaaaaaaattaagagggaaatttaaaatatttacaaatattgaatttaattgtaggattaatgaaaatatagttagataaactcttactaattaaatacctaaaatactagcatttaaatataggattaatgaaaatataattggataaattcctatagattatagataacttttagtactctccataagaaatcaattcgcggtattaatttagatgtagttaataattaaacaaatgtatgaattctcggaaattattgtggattatttgtgggaatctctataaataatcgatcaacggtagcattcggatttaattactagggtgttagccgtgtattatatttaatcatagactaaattgagtcgtataatattataagataattttaggattccgtccgacatttagctcgcgataagaaatttctaacctaatatatggatataatgctagggcnnncaaattaaaaacatacgaacaacaaatattggaaccggcaaaaaaatttaaaccaaaatgggggtttgccatagttcgcggttagtaaaataaataaaaaggaattgactttcgcattgaacttccattgggatttactgggatttttatttgaattctaaccgaattcaaatcaattttcgcacgtaactatagagaccgagggagccgcggatccaggtgaaagccaagaccgcaagacctcgagcaaggcaagtcatcactattccttgaacatgttgatcccaattgcgaaattattttgtttataaataaaattgcatgcaatgatgaatatcctacttgggattatgccatgccttgattattgtttacccttaaatctttgtaaccatgtctacgtatgagtccctagtcaattatgacaattgcttagaaatgctattctagaatcatgcatactcatatttatcaaatgctatatgcttgggcaattacctttgggaaggtaattgagatgcggcatgtggagacatgagcaccacattgccatgatgttgatgacatgatttgtgaaaggagaaataaaattaaacaaatgttttcgactggggcggctggaggacttgggtggtgtccggtaaaggctagtgccgtccctggtcagttaaggactgagccatgaagttaaacatgaaacgacctcagtacagccgtacttctcgaatgggtatagacctagcggagtagatagccgagcggaggcagtatccctgcatagtggtttcacttaggtgtgtggacgaacaagcagtttgctggcggatacccgatacggatggccaatggcggatacccgatacggatggctagagactgacttggcaagactacaagactacaaggagataccccaaaggggacagcgtggattgggttcaactacagaatgcgatgttaggcttgcgtgagttttccccctcggg

SEQ ID NO: 36828 - DNA, 499 bp, Oryza sativa
cccatcgcgtccaaagtgctggcgaaaagaagattgattgagctgccaccgtcaatgagaactcgcgctaccttgatgttccgaatagtgggttcgatcacgatcggatatcgtcctgggataacggcggtcttggggtggtcttcttccgagaactctatcttctgctcaaaccacttcatcttgggtgcagccccctgccatgtcgagcagacttcacgttccactttcttgtattctcgcttggaggagtacgttgtggaaccgccgaagatgtgtgagacgtgcaggtcagagtctgaatatgctgaatccgattcgtgaggagccgtctcttcgttcttctcgacaatgcgtactcgcttgcctttttcaaatgccatgtgcttctcgagcgactttttgaaaacaaggcaatcttccagagaatgtttgtccgtcttgtgtatggggcaccatgatttctttgtgtcgctgctttgtgggtctgggcttttgg

SEQ ID NO: 36829 - DNA, 708 bp, Oryza sativa
tcctttgttttcaatagatacacatagcaaaatctagtgcaatcatctatcagtgtcatgaaatatttctttccccctttatcaacacgccgttcatttcgcacaaatcggaatgaacaagttctagaggtgccaaattcctcgcctcagatgccttgtgaggcttacgaggctgtttcgattgaacacaagtatggcacttggaacctttgaccaaagtgaattttggaattaaactcatgttagctaagcgcatcatacaaccgaaattcacatgacagagtcgcgaatgccacacattagactcatcattctcgctaatatggttcacagcgttatgattattacacatgtcattcaaagaaaagcggaacaagcctccgctgtcataaccttttccaacaaaagtctcatatttagatacgacacatttattggactcaaacacaagtctaaaaccttctctacacaatagagagccgctaactagattcttctttattgaagggacatgctgcacgttcttcagctgcacggtctttcccgaagtaaacttcagatcgaccgtaccaacaccatgaacaactgcaagcgacccgtttcccatcaacaaggaggaacctctcccgacctgataagaagaaaacagagaaatgtcagcacatacatgaatattagcaccagtatccacccaccaatcaggtgaat

SEQ ID NO: 36830 - DNA, 727 bp, Oryza sativa
tcgccggggagtgcggcgtcaagtccacgatcccggggaatcccgatgagttttcgctgacctcctctctcgcggaactggtgacggcgatgggggaaatcccctccaacatgcggccaggattgcggaggagacgtcgaacaggatctacaccggggcgtgtcatgtcctcgcgtgtgtaaggctgtcgcgtcctgactcgatctgcgcgagatcttggaccagagggcggccagcgacacgcgtaaggaggtgatggaagaagtcggtgatctaggggagtctgttctccccctttttgaagagtaggacttcttgtatttcctagataatgtgtaaaacttgaactctgaccgccttcgtgcgtgcgattactatcccagcttactttggtatgctgacctcgggaacttttgtcctttctagagatgctgatgacgaggatgtccagcagcgcgggcagcctgagtcactggcaatattccggtactcgagtttgaaccacacgtctcgcctgaccatgtggatcaaccccttgatatagaggggatggcgacgacttcctcaggttagtagtcccttcaccccttaatgccctcctgactaggttagccatgttcccgaaagagatgtatagcttgacttagtggttattacgtttagtagatctcgagggtgcccttgctagccaagatcgtcatatccaatactggaagacgaagtttga

SEQ ID NO: 36831 - DNA, 324 bp, Oryza sativa
acactcgtgccttcacgggtgaagttagacgatccgaatcccaagtcagggcagtttgcactgtcccacccactgcagtccgggctcttcctccaccgccggcgccgcaagatgcaaggcggccgtcggggtctctggagatctcctactcaagaccccttgctgtgcaaggtatgggatttttcccctttttgtgcctgtgattggtttcttgcatggtttcctcaagggactgatttcattgagatgggattgggtgtagttggcaaattggaacgtggtgcatcgcggatggcgaatacatgatgtgcgtgttctgcagtg

SEQ ID NO: 36832 - DNA, 1100 bp, Oryza sativa
cgctcctagtagtatctctatataattcatagatttttcttttgttttgtaaggagtactccctccatttcatattataaattgttttaacttttttgggtttaaccaagtttatagaaatattagcaacatctataataccagattagttttattaaatgtagcattgtatgtattttgataatatgttgttttgtgttgaaaatattgctatatttttctacaaacttggtcatacttaaagcaagtttaactaggaaaaaataaacctacttcatatataaagtcacaagaccttttatccaaaaattgaaactttcaactaaaagttcaaaaaaattatactcttggctcaaactttcaatataaaatccaaaaactgaaacttcccaaaaaaaaatcaaaaactttgtgctcttggctctcaatctttcgatacgaagttacagaatttgagaaaactttcaactgaaactcctcacgagggtgtcaagtagggatgaaaacggtcggaaacaatcggaaaaaaggctcacccattaccataaccatattttttctcagaaacaaaaacgatatcggaaatatcgaaaaaccagaaagggcagcttcgctggatgggctctccaattaatcttaattaaataattccctcaataagaagaaaaattatcctcagtcaatttcttgaccattgttctacaattttacttataaccaaattttacttataaccaaatattacttatgactttatagtaataaatcccgtaggctgcagcaacgtgctggatatcacccaacaaacataaaaaaaaaacatgccatgttctagtgagcatcttgatcgcggtaggatagctagctaaataaagggtcggatgcgatatggatgctagcgaatagagcttttctgaatcgtcattaatacaaggaaagagggaggaggaaccagaaggagaggagcaatagtttgggggatgatcccctccattaatttctcattctggatctttgctagggatggataaataatcttatcccaaacagaaaaggctagagtacgggtatgtgcttcacgtgaaatgggaaatatatat

SEQ ID NO: 36833 - DNA, 1421 bp, Oryza sativa
tttgtgcacccctggattcaactcccatgggagcgattttttcaagatttaacggctttgtgctttcaggggtaggtaacgtatccgtcgacagcgaggcgcctgtgatgactttgtccactccaggatgaattggccggcccagtcttcaaaaatgctcatagggatagggtttgcgtgcgtgcgatcataggggtgattgtgcgtgcgttgtgagtgtctgttttgtaccatgtaattctaaaaaaaaaccatcaacaagatccaagtgaaaaccgaagagaaaaaatgaaacactaaaaaaacccattaaaacacttcgatctaactaatgaaacatccaaaccatttttgttcactggcatcgagtttcgcaagcaggcgtgctaagacagccgctagcaaaaataccatttttgcaggtggcaaactaaagaggatagccaatgaaaacatgttttgggataaaaaaaatttgaaattcgagatgtcatcgtatgagggtagggtagggtcgacgacagcggtcggcctgcgaggatcaacggccgtggtccagaggaccaccgctgcctgatctacctccttcaccgcccctcatcttcgccgccgtggaggcggatccagtggtatcgaacaccaccccagtcagatctatcccctacactatcgccacccgtctcctttgccgctatggaggaggatatatgccaaggggaaaccatagccgagaggaagtcgttgccaccagatccatgccatcgtcaccccccgccatcgaattcgcgcggccgcaacccactgtcgccggatccacgcccccgtgactcgtcggcgccggatccgtgcccccgtgacctgctgctgccgaatctgcaccctcacgacccacgatcgctagatccggaccgagccacccctgccctccagccaaatctaggagggaggggagagccgggccaccgtagcttctccttgcagcgcgaccgtctcgttgtcgcggccgcgtacgggacagaaccacaccaccgcctcccctccgctgccgccgacctccactacgtggctctccttgccgcccccaagcatggccaagtcatgtcgctgccgctgagcgccgccatcgttgaccgctgctcctgcaccacttcaccgctactagctatacagagagagaaatcgcgagagattcagagagagaaaaataaagaaagaaagaaagaaagaaagaaagagagaagggttggatctggggggttgagaaaaaaaagagggagcacgtgctgtttattctctcccactacttttgcaagggagctcccaacaccccgccagtaaaaattgttttttttactggcagcatcttaagagcaccgcctgcaaaaatacctctatttttgtcggcggccctcttaacccgg

SEQ ID NO: 36834 - DNA, 733 bp, Oryza sativa
atcctaatgaactgcgataatcaaacagtgattattaaagtgaacagttcaaaggacaacatgaagtcatctagacacatcaagagaagactgaaatctgtcagaaagcagaaaaactccggagtgatagcattggactatgtccaaacggctagaaatctggcagatcagtttaccaaggggctaccacgtaatgtgatagacagtgcatcgagggaaatgggcttgatacccacctaaggttgcataatagtggaaacctgtccattgtgatcggagatcccgtgaatttggatggtgaaacaaattattgtgtgactgagagaagagacccttgaaaggggctcattttcatgatgtgcttctcttctttcctgcatggtaggatggcttatgtcttaatgtgatccgagtggcttttccaagcagagatgttgacctgcagaacatctcagaaggaacacacctatatgagttcgactgctagtcacagtctatgaggtttgggcaatctctagatactcatgaaaggcctggagtttgacttatatgctccaaacagaggggatgcgaacggcagcccagtaccagtcaaggttctgagtgaaacctgatcacacaaaacttacaattcaaggcatagtccattgttcagttgtggtctgatgtaactcatttcctaggtggaagttcaacttaacagtctccaccaaaaccctggtatatcaaacag

SEQ ID NO: 36835 - DNA, 714 bp, Oryza sativa
agaagcagtgcctccgaaaccacaccttcgcctgatatctgcaccgggtaggcgggtgatcatgtttttggggagtgcctcctgcacgactgctcatcgccatgtctggattgctgccgccgctattggcggaggtggtgcgccgccgccgacgccgacaggagctggatccggagctggtgcgccaggaggaggtgccgtgaacgactacaacaacggaggcaattctgcctcaccatccagtggagggccattctcggggtataatcttctccttctactgctgttagcgctatactgtgtgcgctatgttcttggttctgttctacatgatgcctctagcatgttatcgcattactggtatgttcctgtttctgacattcatgatgcgcatagtatgctactggttatgttaagatcaccctacactgcttatgccatgatcatagtttcaatttcttggattaaaatatgccgaataatgactatatttccaacacggtctagggcgtccgtgatagagatgttgggggcgagttgcatgtgagaacaaggcaaggaacagttgaaagagggcgccgcctaaaatccaattatcaaaccagaagaaagtggaccgaccatctccaatgatggatttcgaaacactacggaagtgtgtaaggcccgcgacgatgtccttccagatgatcgtgtcaaggcgcaaaagatcgc

SEQ ID NO: 36836 - DNA, 1514 bp, Oryza sativa
  unsure (1)..(1514): unsure at all n locations
nnnnnnnnnnnnnnnnnnnnnnnnnnnnnnnnnnnnnnnnnnnnnnnnnnnnnnnnnnnnnnnnnnnnnnnnnnnnacctggtggggatgtggggggccttgccccctgcctggggtggcgcgacactcctgaggatactgcgccttccccagtagcggcggcgcgacactcaccacgccggcgctcgaaagaacctcaaaaatcacgaacgtgtcccctacctggcgcgccagatgtcggagaatgaactcctccatcagggaaccgtgaggcccccctttgtgagttcggccgggggcagcgggtgagattcgagggcttggtgagcaaagttgtgtgatcttgagggggttagcccccccaagacgatgagacaaaagaggtttatacaggttcgggccggtaaaaagggtaatgccctaatcttgtgcatgattgattgaatgtagaacacaagtgtttggggttgcaaaacccaaccgctagttggttggaaatttccccttccaccattaggctgcccttcttttattacctcaaggggttaccacatgggcacaacaacctaacctacctccgttggaaaagtattataatctttgcattaaatgcatgtcttgtctctgtggttgggaagctaagcacacgtcgtcttgatgattgggcctgtcaaatcttgccgcctgacacgaggggtgcccctgtcagtcaccatttaatgggtgaagacttctgggctcctattacaccgggaaacgggagccttgctttgaccagagcgggaggaccgactccggctgggataagaggatgagaacctctcaccatcactatttgatgggacatgtcaggctacacgccgcctgacacacgagcagcgcacaggcgcactagccagtcccatcggtcattcgaccggtcacagaccggttgagtgcactgcacgccgcacggcgtggcgcgaccgctcgggacgccataaatgcgggtaggtgggcacctagaggcggacacctaacccaccatacgtggtgacctagagaggtggtcgggggagcccgacccctagtcacgtgagggggcgtccgccgcccgacctcgggcccgatcccccctcgggggagagccacgtggagcctggggcggccttctccctctagtctcggccagggagtggccgccgccctatctcgggcccgacccccctcgggggagggccacgtggcattggagtgcagcctcctccatccagtctctgggaaggagtggccgccatccaacctcgggcctgactcccctcggggaggaccatgtggcatcggggggcagcctcctctgactagtctttggggaaggagtggccgccaccccacctcgggcctgactcctctcgggggagggccacgtggcattgggggcagcctcctccctctaaacttgataccccggacctatatcaccgacataatccgattaggttagcaataaccatggaaaaaattgcaaaaaaaaa

SEQ ID NO: 36837 - DNA, 15939 bp, Oryza sativa
gcccctcaagttgtcccggaaacttactaaggccctaatcagtttatttttcagagcaactgatttaatttttaaaaaatctacaaaaatttgtttggaactattttaagccatttaaaattgctaggaaattataatcaattatttaatcactcaatagattcagtagattttttcatgtcaaaataattattatttccttaaatattaaattatttctaaaattcgaacatattttatttcgatactacaaggtgcgtgtttcttttccattgctgccttttacctttttccttttgcactaaaaattacatatgccttttatcttttttcttttgcactaaaaagataaaaacatataataatagagtgcaacgaaatcccgttgtaaagcagtcatatttcatatttgctagttaaattaaataaatttcaacttattttggttgggtgcgccaggcccgggcagcagtgcaacgcctgagcgacgcgcgagggccccagtggcaagggcttgccactgtgatgagccctcccccacaaataataaatttaatatcgaagccctcccccacaaataataaatttaatatcgaagtgagcatatggcccacacatcagatattagttaaactgatgagaacagttaatcttgtttagttcccacgtttaatattttcttttcgcgaactaatcacacccttagccaatagccaaatagccaaaaggctgagaaagatatgggttacaatggtgcaacctcgccctattttatagcgttcctcccgcctggctgcggctcgaattggcgagtggtactaaaactagcgctgcttcgctactcgctgcacgctgctgcctgtcctatttaggcttgtttggcccatcatccatcacgaaagcccattatatggcccatgcgaggaacgggagcccagccgtctaacgcactatcggccatggttgggttaggtttgggttttgttcatcgccactgctgtccattttgttggttgcaaattcagtctttcgatgtgattttacttcagaatgtctccatgcaattggcggattaaacaccagcaatttattttgatcttttttggagtgccaagaagaatatgttaggaaataatacatgttcatattcacaaaaattgcgatgctaatatcgaatcccgtggcttgttttcagttgttacttttagcctagcagaagcagcaatcatggataccagtacttggttttttggttgttatgcctgatcaggaggagcaaagtaaaactgcagatgaacaggacagagtatcatgaaaggtcattactgttgttcttcaggtaagccaaactgtatatgcacatcatgcattccggtcaataaattatcatctttcacaagaaaattgacagaatgctctgcactatcagagttgatattaggagcctatcacaacaccagttatattgatcatacaatggctgatacctccactcttgtgtataccatagtactgctgtgactagtaatgacatggattctagtggcactggcggagctcctgcctttctttctttttttctttcttcctagcatataaatgtacccatgaaaaggaatgtgaaagaacgaaattgttattcagcgacatactgatgaaagtgtacacggaaagatgaagaatccatattctttcattgctgagaatcaagtgcatagcattaaaatcctctgctgaaagctgaagaacaagcatccttttttttttcttttttctttttttaaaaaagaaaggcataagaataaacagaccaaaatatgtcacatactctttaaagctatctagtttagatgcttggatattatatggtttttaaattgtatcgaagctaatcaattagtagcaaatataaaagagctgcggattgcagcgctattgtatccaggatttataaaatcatagacggccatcaaaatgttatttatactttgtactagtatttattatcatcagtatttattcttaagctagtcgtaaatgttgtttgcatgaaatgttcaattctgaaactaactagtacaacgtacttgcttaagtactgtgaaacctgtggcctaagacttggacaattaggatctcctgatttagcattcatatctttgtactacgtatgttgttattatgatatctattcatgaagatccatacagtcagaattctcaatacgtgtaatattgttagaaaaaactaaaagttcataatcacgcggcattgtgtaataccttttcatatttcccctgttactaaagcaatactagagagaaggaacaatttgtctaaaataagataagatagtaactaaaaaggagggcaacagggtaactcagtaacaaaggaacaaatttataaatctcttcacaagaatgaagaatatcacacatttcccctcattcttgaagctaattaacattcaatacaacaacaagcataacaacaaaatgataaaaccatgacgcctcacattatacctgtcagctacatgagaacgcctaatattcgaggataactcatctagctgatattatatagcaagcatcattcagttctttgcactgagatcagtcattttgcacaacggtactagtgttagaatccttcttaaaaatcaattcgtcccaaacttcatgtgcattgctgaagtaccgaaattctgaaactttcagagtttagcaagcatgtgggccaactcctcatcggttacctcaatgtcctggtgcttactgacggcctccgcaagtcgggctgctaactggtgcttgcactgaagaaaaaaaaagcaattagtccatgaaaaagagatcaacgaacatctcaatactcagtagtcacgagccgataattgcaattgcaatagcgcgatgaagaaacaaaagcaattactccatgaaaagagagatcaacaagcattccagtactcagtagtcacgagctgataattgcaactgcgatagcaccatatgaagaaacaaaagcaactagtccatgaaaaagagatcaacaagcatctcaatattcagtagccgcgggctgatagttgcaattgtaatagcgccatgaagaaacaaaattaaagcaattactatgcaaaagagatcaacaagcatttcagtaaccagtcaaaataaaacagtaaaaaaaaagcatttcagtactcagtacttcagtagtagctgataattgcaattgcaatggtgccatgtttcttttgtgtttataggttatccgtttcttgtgtccatgaaattcagtgtgcctgattgaaagatgtacggattcagatgcagtaacagcagcaggtcagaatgccacacttacgcagagctgctcgccgcggccgacgatgtcgtagaagaaggagtagcaggtgcagaggtgctctgggaagcagatgtactcctccttcctcctcgactcccccatcacctgaatcgccgagacgcaaaaccctaggtcaggcaaatcctcactcactcacttttggctgtgacacgaagaagaacaggaggaatcgagagatgggggagctgacaaggaagagcgagcggccgctgggcgcgccggtgacgcggcggacgccgccctcgtcgaggatcttgcaggcgcgcaccatgttcttgccgaacaaggcctcgaggctgtttcgaagcaaccgaggtcaaggaagaggagggagcgaggcggcgggcgcttggttttactcacatggataggtgctcgtcggaggcttggcccgcggacctgatctccgcccacaccgcgtcggcgacggcgagggcgaccccggcggtgacggacattgcggcggcggttgcggtggcggtggcgcgcgcaaggtgttcgacgttttgacgcagtgatagaggaaggatggagacttacatgtgggctccaccatgtcagggcagttcagttcatcaaagaaaatcgaatgcaaaagcggacaaaacacgcaaaaatcttgattaatttctgattacaaacactcgaggtgccaatcgaagctagataaaaaaaaatcaaaatcatgtacttctatacgcatttcaattctctgaacaaacatagtgccatgatctacatcataaccgatgttatgacaaaaaacatggagaatctaacgcaagaaacgctaagaacagagtggcaatcggcagagaatgccgtaatcacatcagcggttgtggagagggtccgacgagttgggcactcgccgcgcgctgccacggaccagctgcccgtccgtcgccgggaaccgcggccacctcctcgcccgcacgtcgagcttcgccgccgccccgtcgtcgtccggcggcttcgcttcttcggcgccggcgacgtcgtcaccgccgtgtcccccgacgaccgccgtcgtcgcggcgagcaatgtcaggagcaggacggcgaggaggagcagtagcctttggctggccatctcctgcatggagggacagagtttactgtatctatcagagaagctgcacttgtctgaatcttctaatgcagagtagcagtatcagtctatctatcagaactgaagtactactaccagtgtactactggttactgattagagagcagcagcagagagagagttttattactgggatgtttaagcttaacaacttggcaaagtggtgctcacattggcacattgaagattagtaatggtgattagagcaacagtcaaaaaaattcaaaggtgaaaagcccttttctgccctagtgatgaggtgtaggagctaatgcacaatcatttgccattttgtcaactttgcaccgcatgactcgaaaagacaaactgcatgctactcctagcagtagcagtgccatctttgaaaaaaaatcagaagcagagaaagaaagaaacacagtagcagaagattcatcatttcatctgcttcttctttctgtcacattctgaaaaacacaaagaacatatacacgctaagcttcagaaattggctagtaacaaactgatcatatacattaatcttcagaaattgaggcatctgagtcccaaatgacgcaacctttttggcgtgtcattacttttagaagggggttagttagtgcagaattggaggttagcgacagatgattagtagtaattgggagcaggtgaattggcccgggaaacaggggacacggctttccacaagagaaaggccttgagctccaaagcctatgccctgcatgctgctgcactgccatggccattttgccctgccattgcctgcagcttcttttttctcaacttttaccgaaccaaacaaccagcacgggcagttcctctgcttgctgcaccgagggctcagctttccatttgcatcgggcagctaacgctgggagttgttttgtgcacttgtgcgtgttggattgtgtccactgctgctggagagcggagaggagacaggaacacatgaatgcctggtcctgtcacaagttttgtttgctgaatcttattatgcttgtagtagtagtacgtgattagagtgacggtatgtcactgttgcattatcagtggagataatgcattgagaatcactggggttttcagcttgccaatgctgcattatcttctttttcttttttgaaacacataaacttttataaagcaaggacaaagttgatgggattaaatcccgttacatcgccgaatgataagaactgagagcaaagagccatccttattgaaatgaaggttaactaagtgtccttcctaatgaaaccgaacaacagtaaaacggcagatcagggagctacggtattgcaaagtttgggtctcctttgaactacactccacttgatagaccgataattcttttgggctgcctccaacggaaacaacacaaaagtatacgtgatcaaagaaaaaaccaatgctattggaaaacgagagagagaagaaaagtgtactccctccatccgattttaagcgcagttgtgaatttccatatccaacatttgatcttatttgagattttttagactagtatttttattgttattagatgataaaatatgagtaatattttatgtgtaacttgttttttaaaaaaatttaaataagacggacgatcaaagattgaacacggaaatttgaaactagacttaagatgagacggagggagtagtagcacagttcaaggtagtatcagcccaagtccagcctggcatgatactgggcttcctttcttcctgtaaggtctgcatattgggccaggcccatcccatccatggcccaacttaagcccatctcgaaatgcgcgttcaccttccggagatcttctagaagcgaagcgaaccaaatcgaaccccaccctccaagtctccgaccggcacagcctcttttctctctctcggtctctcccctctccacgccacagatctctcccctctccatctcccacttacccgcagccatggcggaggacgcccccagcgccgccgccgccgaggggagccagcacgcgtcggccgcggagggaggctccgccgccgccgcagcttccgcggcaccagccgccaaggccgcggaggcgctgctcccgtcgctcagcatctggcccccgtcgcagcgcacgcgggacgccgtggtgcgccgcctcgtgcagacgctggtcgcgcccagcatcctctcccagcgctacggggccgtcccggaggccgaggccgggcgcgccgccgccgcggtcgaggccgaggcctacgccgccgtcaccgagtcgtcgtccgccgccgccgccccggcctccgtcgaggacgggatcgaggtgctgcaggcgtactccaaggaggtcagccgccgcctcctcgagctcgccaagtcccgcgccgctccgtctccggcagcggcggcgcccgcggagggggccgcgtccgagtcggaggctgctgctgctcctgctccagcggaggagtaaggtgtttggtttggccctgcgcttagatccaccaaagaactgctgctattttggcatttccttggagattattcatgatttcctccgcttatgatcactagtacctttatataagtattaggaatgtgtgcttgagatgatgaattgatgtttgttacttgaacctggtaccttgttacaaatgtttaagctatatcataggtgcatgtttgccctcgcatatgtgatatgtataaggctattcttgaatctgtttgtgcatggttgcatgagctcatatgttctgattatttagctgaatgcagttgaaatgtaatactagtggttccagagttccaggagtatgcagtattattgtgcatttaatttaaacctgggtacttgaactctgccagttcttacttcttactatgatttggtttggtatctggatctgtagttgtagactggtagcagaagaaagggaactacctagttcaatcttaatgatctaaacaggcctatgaaatcttataacaagttacgtggtccttcataaattggaagaggtgtttatcgaagttgattcaacgagcattggatgttaagctatgcagcgggtggcatttcaatgaagaatatcaaactgcaaggacatgaaggcatagtacatttctctctccaggggattgttactctcatttgcaaagttagattacataatgaggatttgaaattataagacagttttgggcttatggtttgtcctggatgaaaactacagtttgccatctctttttttttaccctctgctattcttttcacccatttttgtgctgtctgaaatgtggaacgtaccaccagcaaaatgaatttcaccacatggacctagattgcattactagattggaaaaggaaccaattctgtgggcctgactatctgttatgaatttcagctagagtccataaagcacaatggtatttattctgcttgtatttactttggatgatctgagttaaattacttgatattatgaattttccctgtctgtaggagtgtagggtatccattttcatgatattctgatagactttcaagcagttgcattgcttaaagaattgtttgctgcaatgggactagtatgtagtatcagcacctgtaaatactgatgatggctacatcttatttgcatgcactgcttatatttacttgaaggtccattctttcattgtactacctgcctacctggtgctgtgtcatattcatgaagaacatggtatttgaaaagaagaaagaaaaaaaggaaaaggaaaaatgccagcagtcatgtcgaagttgttctcacttcacatgtttggtagctcaaatagctgtgtgcgttcttttggtttggctatttttagatttatgcagtgcatatatatatatattactctgaaaaacacatttttggtcacatctgtccttcagtcaccaatctctcattgctcatttaaaggtgctgatctggatgcctgaaggcctctaaaagttctcagctgtgctgagcaagatataacacttgaaatcttcagttgttatgttgtgttgaatggcattccggtcatttctgccatgtttttccacaagtgtgagctcatgataaaacaagacaattgcatatttgcattagctattccacttactgcagtggttacctccgtggtaactctcaaagggcttgttattacctcataaagggattaaatgaaataagcctgtattaggcacataactaccatctactcccttcatttcaaaatatagcaacttaggatatgtcctaaccaattttattctaggttattatatatggggacgaaaagagtacttagtacttcacgtggatggagaatagtgcgtttggatgttgcaacctgtttattcctagtattgggtgttcgtgttgtagacgcttggcgtgactgtttatttcccgagttattatattgtattttttctgctttatccataaaatacgaatatatagctctatttttttagggagtattttgggggagggagtatctcccggtgaccgtgaacgaaaaccaaattggtcgactcttctgtcgctgttactaatcattagaggtgacagttcaggtgttactttagatttcagcggagccaccgtttcgcttattttagcgaaacgacatatttataaacggaaagtaatttgtaaataaaacttttatatatgtgttctcagcgatctaaaaataaagactgaaaaataaacttcgatgaaaaaaaccttaaaatcagctttaaatttaaagttaaaaattcaaattttgaatgataagcataagcataaacgaagatagtccatcacccagattccattgccggagctaagcacacgtgggaaaaggcgtcgtcctccaaacaagcaaaaaaaaaagaaagtggtccacgtggacctgaagccattggccaggtgccctcatcgatcaatcgcaaaatgcctcaggcctaagaaatctctaatcctggtcctaaacttcacgagcaagtcactcggcatcccggaagattccagtaggcgcggacacaccaacgcaaccgtcgccaacgccgccgcctccgcccgggtcgggtcggaaactcggaacccggcgcgtccgatcgaagcttccgacctcctcgcccgcgccgacccggccacgtcaccaccacccggtgcaataagaccctggtcggcgagcgagttcgaggcaaacggcgcccccattcgaaaatcaaaatctcttcctcgcctctctctctgctctctgctctcctcgccttcctctctcgccagttgctccgcgtcctcgctcgagtgcgcggcgatccatccgggagggagaggtgcgtgcgctctgatcgctcgggaaaccgtcgtcctgctcgatcgcgctggttgatcgcgattcgccgcagcggcattccgcgcgagtagttcgattaactttttttttgggtgctttgttttgctcttgcagacggtgacggcgcgggttgaagttgaactcagcggcgggtgggatggtttccttcgagatgagtgaactcaagagtacgcgactcgacaaccaccctcctcctcctcctcttctccctttgatttttcgcgcgatttgtgagcggtttggtgtaggatttggcccgcgtttgcgtcgctttccgtttttttcccgtgcgatttatgaaccgtttggtgggagatgggaacgtagtactccagtatttgctttcacgttttcccgctgttctctacgagttgtttggtggaagatgcatatgccgcgtgtctccttgtagctttgcgtgctcgatcatgcgctaatctgttcccctgtcgatagccttgcgaaatgctgtcatttttgcagcatgattggtcgtgtttgatagtttaaaatgctgaaaaaaaaaaactatgtccgatcgaatctgtgactcctgggttcaaatcaccggtaatcggtgtttgtttggtgagacaaacctcgccaaatttccggagtttcgcttcaagttttgtttacaaacataatgtccttggttactgtggactgtggtgaattttccattactgttttttttaagtagaagcaatttgttgtgctactattgtatatggcaaataattagcactgcctctctgcacaccgaagttaaatttctgagcaaataagttccggttagcaacttgaaatctattcaggttgggaaagtttcaggtgtcgatattttcagaactagatgaaatttcggtcatggtcgtccatagctgagatagcatattgtcagtttatcatttcatatgttttatatcaaattcgcaacgcgtcatgtttttgaacaggaggtccatctaatagtagctaaataatacaatacacgttcttcaatttacctgcctaatttaactttttacatttttttcttgcaactgtgaggtattgacgtattgtacaatgtgtatgcatctcactagctcaaccatttcatcacttttgttttcaacagagattgggctgggcttatctgggttcggagttctgttctcgtttcttgggatcatcatgctgtttgacaaggggttccttgcaataggaaacgtaagattcactttcctgaatggctgaatcctgattgatgcttcactgtaacctcatcctgatcactaattggtgtgcgtatgccatgttgcagattctgtttgtgtctggtgtttcactgaccattggaccgaagtcaaccgtgcagttcttcaccaagcctaagaatcacaaggtctgtaccattgcaaactccattcatcatgaagactgtgctatttcagttcccagttctattagaggtccattatgatatgaaaaatctacctcattgtacagggctcgattgcttttggaattggcttcttcctggtccttattggttggccgttctttggcatgctggcagaggcatacggcttcgtcaagctcttcaggtcagtaaactctatggtgtttccattctgaaacatgatcataataatcacctgtctctaggtcatgtgcattgtgaaatggaacacctggagtctgtatccgaatctgactgtgtgtgcttctgaattttcatcacagaggcttctggccaactgctgctgtttacctgcaaaagagccccaccttcggttggatattccaccaccctcttgtgacttcggtacggctataagtcaccaccggatgtgcttaaactccctgcttgtcgtcgtagattcatagtctctgttcttatggttgttcctgtttacaaatttgcagctgatcactaggttcaggggaagacgagtcccggtgtgatcgtcgctttgctgctggagctggatcactccaagggatgccgggtcacctccaaagaaacttagagcgatacatgcggttttttctggttagcttgtgattcgttggtgctgctggtatgtgaatcttgtgtctctgctaccagtaccctgcctcaaagacctcgttactacgctcgccagttgcccagttgttcgtagaaactagaaagactttcttgcttgttaatgggtagagagggtagtcatcgtacatatggctatgctcattgcacgattggttgattgctagtaattgatttgtaggtcatcctacgggaatattactgagtagcaaaagctttcagttccggtgctacgtatgacgttcatgtttttaccttatgacgttcatatttttactgttcatgtttttaccaaatgacttttagtagaatcatatttttaccatatgactttcagtagaatcaatctgacttaccgttcatttttttactgtatgacgttctagaatccttcgagtttctatttttctacgcaaataattcgatcttttctgcatgaatcttttgtcgcacagaacaactataatagtataattgagaaacaatagagtgaaatatcacaaaatgaacaaggtaaactaagaaatcaaaaatcaactaatccatcagcaccacaacgtatataggataataggatactgacatcagtggaaagcagaatgtatcagtttcagaaagacctgagttcctacgtgttcaggcttctgaatgctaaaccaatcttcctcgaccagttccttggccataccgtgctaaaaaatgattcccttggccataccaatttgctccttattacaccaatatcaactatagttggtaaagaagagtaaaatgccacaaaatgaacaaggtaaactacgaaaccaaagtcagctaaaccatcagcgtcgctggggaatttgaatgacgcatacagaattgaggaaaaaaaatattaaaatatacctttctcctatgattttataggaatatacttatttttgaaggtgattattttgcatcctaatagtaatatatagagaaaaacgtgcattgcacgtatatgtactagtatactcatgattttacagcctgacttgaaaaccgtgccatgaaccaaaaataactagcaaacaacagtgcaacacatgttgacacgagatagattatcactttcaaccacatatgactcgttcttccagcacacgtcgcgcctatggcttctcctgcaaacataaaaggaacatagacgagtaggaaataccaccactcctacaaacagacaaaaaaaaataatgtcatgaagtttggccacgcataaattagataacctttgtgtatttgtaatttgtaaattaaagattcggaaaatttattttatttattttgtaaaggatgtgcagtaatggcgtttattatactgtaaaggttcataaatttcatttatttatcgtatattttgtataacaagaccacaaatcgaagtgattaacttttccatattattagttagcagaagtgctaaacaaagattaattagtgattaatctttcattaattactatctcaacaacaatttaaaggacgtaccttgggcttataaaaggactttttaacgcaagcaatcctcgccaccttgaattgctgctcatcggcgaagtaggccgccgtgtcgacgttgaaccagaagttgtccactctaccctgtctagttatcatggacggtgatgatggcagctcagcgaggatatcggcgccgttgatgcagtgccccttgatgacgacgacgagaggacagggggctctgcacacgtgacagcgcctgtcctcgctgacgaagcggacctggacaatgcatctcgcgcaaacacagcggtggccgcatggcccgatcgccacccactctaatggctccacacacaccgcgcagcagttggtagtagtagcagcagtgccgccgcgggctacgtcttggagctcgatgtcgacgacgacatggcacactgccttggtgctcatagtattgggtggttgtttcacgtggtatatgttggatcgaacacaagtaaccaagtctatgagagagatgttgaatggtagattacatcagcggaagtcaaataattgaatcttaatagatcaaaacacaccccaaccttaaaaaccaatggaacacacgtaatccagtctatctgtggagattatgggtaccccatacccacacggcatggttatccgactagttataggggataacttatatatatgaaatatgtaacagatcatgacttgggtattacgtttccttgtatattacggaacggcctaaagtcctggtttgataagattgtaaagtagagttaggaaaccgataccgtattggataaggtttctatcttgtaatcctgccccccattctatataaggtgggcaggaggccctctagagggcatgagacaacctgatcgtcagatctatactacacccggcggattcaaatccccaaacaggagtagggtattacctctcattgagagggcctgaacctgtctaaatcctttgtctctgcatccatccactttaggtctcgtacgctacccccttttattattgccgaattcatgtttcgacagttggcgcgccaggtaggggttgcgtcgagtttcctatcaacgagcgcgatggaatcaatttcatgagtcgccgacttcgctttcgctttgggagttttcacttcctttccgtcgaccacttcttcaagctcctcttctctgacttgatccaaatcagtcagggggaaactcaatctgatttttatcattatttatcatattgatttttaatctcagattaatttcttgctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcaccgccggcctacctccgtcgccgccgactggtgtcatcgcctatacggttggtcggtcacaccaccgttcatgggcgtccatgtcttcaccgaccggctggccttcgccgccgccgactggtgtttccgcctgcacggctggcctattatgccgccgctgttgggcgtctacgacttcaccaccggcctgcctccgtcgccgccgactggtgtcctcgcctatacggtcggttggtcacactaccgttgatgggcatcgtcatctacaccgccggcctgcctccgtcgccgccgactggtgtccccgcctatacggtcggttggtcacaccaccgttgatgggcatcgtcatctacaccgccggcctgcctccgtcgccgccgagtggtgcctccgcctacacagctggcctattatgccgccgctgttgggcgtctacgacttcaccgccggcctgcctccatcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgttgttggatgtctacatcctcaccgttggctcaccttcgctgccgtcgactggtgtttccgcttacacggctgacctattatgccgccattagtgggcatcttcgctttcaccgtcgaccgccttcgtcgccgccgactggtgtcttcattgttattgatggacgactttgttcccacattggccacttccgccatcaccaaggggaatattacaaagctaagtcatcatttattttattctttatatgatatttttccttttcctctgcctcactacaccaattggtcttccattgagtagtgagtcgggggctacagatgttatatc

SEQ ID NO: 36838 - DNA, 3386 bp, Oryza sativa
ccgactggtgtttccgcctgcacggctggcctttatccccccgttgttgggcgtatacgtcttcaccgaccggcttgccttcgccgccaccgaatggtgtttccgcctgcacggctggcctttatgccgccgttgttgggcgtttaagtcttcaccgaccggccgcctcgtccgccgccgactggtgtttccgcctgcacggctggcctattatgccgccgttgttgggcgtctacgtcttcaccgaccggccgcctcgtccgccgccgactggtgttttcgcgtgcacggctggcctttatgccgctgttgttgggcgtctacgtcttcaccgaccggcttgcctttgccgccgccgactggtgtttccgcctgcacggctggcctttatgaccgctgttgttgggcgtccacgtcttcaccgaccggcttgccttcgccgccgccgactggtgtttccgccagcacggctggcctattatgccgccgttgttgggcgtttacgtcttcaccgaccggccgcctcgtccgccgccgactggtgtttccgcctgcacggctggcctattatgccgccgttgttgggcgtctacgtcttcaccgaccggcttgccttcgccgcctccgactggtgtttccgcctgcacggctggcctattatgctgccgttggtgggcgtctacgtcttcaccgaccggccaccgcatccgccgctgactggtgtcaccgcctgcacggctggcctgttataacgccaactgatgctatcttcttcacggctggctacatcgctgtcactactaataggcatcagtatcttcaacacaagctgcctacgtttgccatggctgccgactggtttcttcacttccatggctacatgattctaccagtgttgattagccttatcttcttcaccgccggtcatctcgtctgctgttgactagtgccctcgcctctacgtctggtttatacagctaccactactgatggacatcatcgttttctgccgccgactcgtgttatgccgccgtcgactggtgcttttatcttcacaactgcgtcttcactaccagtttgcttctgttgccgccgactcgtgttcacttcatcacggcgatgcaactttgtcatcatggtagagcgacttcatatttattatcttcggcaccggcaaactctattgctgctacttcgcaagttttactacttcaccaaccacgacgtctttgtgaacctcgacatctcggcatgcaatgccatgttattttactacaacaagtggctctccaatattcaggatttctacttggacatcttcaacacataccttcaatcaagtaatgactattcgacgacaagaagctacagttctcgactctatgttcagttgtttcccaactaatcaaagagtcgggggctacacaaatacaaggctcaaaatttgacaaattttatgtcaagctgaagaaatcaattcatcaaccaacgagtcaactccaggagtcattatcttcatctttgcttcggaacagacattctacttcaacaacttcaaatatttcggtttagacgagttgggcaataacatcaactctcctccaattatttgtcttcacggttggctactacgcaactgccgatagaggatctcatcgttatcatcggctgctacatcgctattgactggatcaccgacatcgtcatcttcatcaacatcttgtcaagcctcatcaacatagcatactctgctgccgttgatgggaaacttcgtcatcatagtcggctatctctgttgccgctaatcatcattaccgtcggatgcgtttgtcgccgccgattattttcttcatcttcatgattggtggatttcgccatcaccgttgatgcgcgtctacgtcttcatcgtcggtttgcttttgtcaccaccgactgttctttcgttgttgttgggcgcctacatcttcactgctagctgacctgactgttgccgactggtttcttcgcctccatggttatgcaacttcattacatttgattggtggcatctttactaccactgacatcttccgttacttctgatgagcaatttcgtcttcatgtgtcatttcatctccatgccgactgcgtcagctattgccaatagacaattttgactatgacagaaggacaagctatatgctcaggggctcatcaactcaagcgtgaggattatatctccaatttggacttgttccggatacattccacatggattcatagtcatgagtctattttctatgctcaaaggctggaccaattattattccccgtaagggctatcaaccgaatacttgcgccagtcgggattcaattattatatttattttggagtatcccataagggataatcattcagatcagaagctattcatatgagctacacttggtctatattacccggaagatttattacttgggagcatgttacatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctgcccgctgacttttttatataagtcaaggtgctgtttgggtttttaagcaattgattggatacaatatcattgctttttgccacgtaagtgtgtatttttattgaccaatattatggcttaggctgattatatattatggtcattttccaggcggttggtaaatcctttatgagtttatttactcggattttacaccacatatgccatatatttccgggtgtggtgaaaccatgtgtcttttagggacttaagcacatctgttaaagcagtgtgcgcatggcgtatgcccaatactttggaaatttctttattcacagcattcaagcttctttatagttgttttgctatgtgaactttcaaaaatgttgtcaactttaggttgtacgcattatattttgccaagcagtcggtatatcacttggatcatattattcggggattcacaccgcatatgctatatgttgatatcaagtcacttggttgattacaattatcaaaaccactcggttggttagattatttattccttgactatatgtttggttggttcaattaaccacatagtcgggggctacacctattaggtgcatctattcgatgcacctgactttatttttcagccctccacagtcttcaaatttggtaaaatacccgggagaccatggcgaa

SEQ ID NO: 36839 - DNA, 747 bp, Oryza sativa
cagggtgatgctgatggttcgttttattggatcaagcgatctatcatcttttgtcttgttgattttcgttttgcccttatttcttcgttccctgataatggttgtttcttgtttcttttttccattttaggaaaagaccctcctgaatccgatcttcctcgtggcgcttatgatgtactcgcttctcatcgggaacagccttagcggccggacggctaccccacatggatatggggctccacccccatctccagctgggctcgccacgttcatgggggtcagcttcatgtgcctctcattcgtgacggtgggcatggttcaccttgtgcttgttcttcatcttacgatggtgaggggagtcggcggttttccaaggctgacgattctctttcgttggttcatgcctgcttgcctcctggcgtccacctttgtatactttgtccagtccatgcacacaacgcggtaccaaccttttgttctcgttcctagctatttacttcctgtttatctcatactcatcaatttttgttgtatgtttcgaaaatcagttatggcatatggaggagcgagtggataaccttctgcatcgcgggggtcatctttgtcgtgatcaatctctcaatgatgctggtaataagttcggttacgtgtcttctgaattggtttttttctcgatcgtctgaatctcacatgttatatactatatgtttcttttctcagaggccattgaggcaggttggcttgact

SEQ ID NO: 36840 - DNA, 778 bp, Oryza sativa
gtaacatggtcatttacaaagtctaataaatacaggttcttgagactgtttgcatagttttgtgatatgataatgagatcatgtaacacatttgtcataacttaaatgtccaacaaatctagtgtctttctgaccttgatcactgatacaaattagaaaggaaattaaaattagcatgtacttactaggtgaactttttctggctttgaaccaagcgattttctacgtgaatcagatttagagctgtcattcggttttggaacagctgctggaaaaaggctttccagctctgacaaatcaaactccgaaacactgcagaaaagaaattgacaaacattaaggcaaaacctagtaaaaaagcatcacaaatattgagccagtctttgtggagtagattgtacgagatattagcaactgaattgtagaaaattcaatgctacaatcatgacaccaaattatttacaaatcctggatgaagccttacagcaatcagccaatcacatcattgaaatttatgtgcatatatcaataagcatggtcaaatggaggaagaattttaatcaaaaggatatacctctgtgagtcatcatttcgctgtaattcttcccatagacttccttgcaaagctctagtcaccttgatccaatgtaatggctttaaagttgatttacgtgcagctgcagccccaaaacctgatcctgaagcacgtaccaccccacgccctctacctattaaactactaggattgcctcctggagtggtggtgctcctggtcctc

SEQ ID NO: 36841 - DNA, 7303 bp, Oryza sativa
aggaggtggtggagggggtggaggaggagggacaaaagttcgtgtttgtgctccaaaagacataagtggaggtggagggggaggaggaggaatgcttgacaagcctgatgaagctggaggaggtggcggtggcggcagtggtggtggtggtggcggcggcggtggctgctgctttgtagctgatcccatgtgcattgataaggaacttgaagaagcatagggtggaggtggtggaggtggaggtggaggtgcagcttgaatttttggcacagcttgtgcacctgatgatacaagaggtgcatctttgccaacattgaatttgttatttgtatgcatggaatggatagctagtgcagctggagaactatcatatctagatggaggatgagatggcctatgcacagaggtagtttcagattctttattgggtgaaatccatctgcgtactgtcttaggtttgactgcctttggttgttcttgcgattggtcactattgcctagcttttcttccaataaaactgcctcaggtgcatggtctactggcatcttctttgagggcacaactttatcaggtatttgccttctgtcactgcttatccgtgggctcttagccctagcttctattttactttgaggaagagatatgccaacatcccgtctgccaccagactcttctctcttggttttgatttttgttgctatttcagtggctgtaggacaacaatgctaccctgcacagtggttttctttagagatatggcatcttcaagcccagatttcaatttagtttgctccattttgctatcagttgtatcagcagctttagcgacctccatcttgtatttttgttatcttgtgagtccacactctcgataacagatctatctaatttaggtgtagtgctctcttcattgacaacatttttcacttcctgcggtaggttcgcattatcaactatagttttctcttcatagatcaccagctcattgtccacgattactgtactctcggtaataatcttgacatcagcattctgcagtgctacatttggtatagttcctaagcgggtatcctcatccacactggataaagttctaggagagctgaatccagtatagtccaaattagggtatttcaatatttttgcagattcgtctggttggcactgaacttcatcactgcaacttggatctattgcggtgactaaagtttgtgcaattacacctttcatgtcctccttctgacagatggatccaaatttgtgcccctctgaatctacagaggcagcaaccacttgtatgtcctgcacagcattgtcgtcctggtcacttctgttgcttaatttgggcatctcctcattctcacacgcctgctgcaaacctccagggtttcccaaaatttctgcaggtgcacttactggtctatcactcatgcaacctaaattctgggagataactatcttcacatcctcatcagccctgtgcttctctaggcttccactgtcttctcttgatactccaccatccagttctgcatcacctattgatgttctgccatcagtcgactgtgtttctggatctcttctagcatcatgccaatcctcctctgcttcataaaactcctctcctgtatctactgaagcaacatcagtctcatctccatcatcgtctacctcctccacggtagcagcggcaggcttgaaagaaccagggtctgaaaagactacctggtgcagaaaaggaattcattttagattcattgtccataggagacactaaagaaactaagtaaaaagagtagcgtacaggcagctgaatttattacctcagctcggaagtcccttgggaactgattattagaattccatgacacatcaatatcgtcacgattcaggccaaggatgttggattgaatgaacgcagtgttgaacatgaccctgaacattatctcctcatggtcaaggttatcaccaatatgaatgcactcaagaacaacatctccttgaacacggcaaaaagcaccaacttttactgggacttccgcctgcattgcaactattcatcagagatggttcagaataaggtaaattatttcataacttaggagttagcattacctgcccataacgctggagatgtttcttggtctttggcatctcataaagtactttggcgctcttgttactagaacttgaatcttgcccatgtacacgcaaatatggcctacagcccccttcggcatcaaacctcggaacaacgtggagaactattgaatccaagatgaggggtcggctaataggaggcttttctggaccacttccttgtcttgttatatagtgcaaatatctcatatgtgaagactgaggattcaaaggaaagaattgttgtataaagtccctacgggcctgtttataaaccatctctagagttttctgctcgccagtgtatgttttcctatatagcagcagtccagccaacatgaatgcaagcacgggccacccccctctttcacagtgcatcaaaagcatgttgtgctgcccttccactgataaccaattttcacaggatttcaagaaatgatggatcatctcaagctgaagcagtgggcatccttcatactgctgcgggtagtccatgacagtcatgtcatactcagacaggatatctgaaatccgctcctcttgtccccagaccagaaattggacaccatgaaagatgcatccggaaagtagtcctgcagctgcgcaacaatgccgctcaagtaatccctgtactcatcctcacccatggaatcagttgaaaagcagcagtcgaacactgaaacatgtgttaatagaaattagccagaactggtataagcaacttttcatctttcgactagaattaaagaaaaggaaagcacatctagcactaaaaggctaccagcatctgatttttcacactgcaagtgtgctaaaattcatatttccagttgaattcaagtatttgatccaagtggtttcaatataaaagtacaccattataaccaaacattagattcgcagcaagcagaaattaaccatatgaacatgcaagcaggatatggtgggtctacggccgatttaagccaaatgcagctgagcccaaagcttcccgcagagcaaaactccacaatcacacaagattcatagaaggaaacaaataaagaaaaaattaagccaaaatgcagctaaatctaaggcttattaaacacatgcaaacccagtatcagaccaaatgcatgacccaaaatctaactcagaaattactaaatatagcgcttacgccctgcgcatgccctaaattcccgcttaaatcaacaccccagtaagcaaaaccttcccaaaattcgagccccccaagcactccaaagccacaaatccccctcggaacaaaaggctcccccgcaaatctcacacccccacggtcccaattccacccagaggcgagggcattataccatagacgcgctcggagatctcgagcagccgatccggcgtcttcttcaggaagaatttgcggaagagcgccatccttcccctcctcctcctcccccttctcctccgccgccgccgccgcctccgcctctcctgcgcccccctcgccgggcgagctgctctgacgcctcacgcggccaccgatcggctccgatcggggcgccaaaggcatggggggccccacccgcccgccgcccgccggcgagctcagcggaggagggcccgcacccacctccccacccggggatctcgggatcgacgccctcccgccgcctagggttccccccgcgtcgggggcgcgcgctccccggcggcagcagcagcagcgagcgagggcgcggtggtggtggtggtgggcgtggagagagagggcaccgtgggattgggacttcgtttcctctctactgcctcctcctcctcctgctcgcttcgtttgaactccactttagtaaaatctttttttcccctttctttcagctccccccaagtttttactgctttttttttctttttctaatctgcttctcaattttttttcgctgccgcggtgaatgttttttcccccggataacagtgacagcggtgaagccgccgcgacgacggatactcttgtgccactgccatgcggggccacttaaagtggggcccagcgtcagtcacgtggggtaggggtgggttcgttgcgagggtagaggaaggctggacctcggcggctgtgtcggtacgtgcgtgtccgggttttcattttcttttctttctctttcgttttttttttacttgagggagacgggatctcatctggtgagatagattcttttaccgccacccccctaagttcgcgggaaatgcgactatttttgggattatcacgtgttgctggtcattttctttaccgttaatttgtactgggaaggaatttaagcgcagcgcatgtttgtccatgccagtgattagcattgacagatgttttctagtaatagatgatttgtgaaattgttggcattatgttattttcagtaggaaaaaatgatgatggtgacagctgtgtcctggatgaactgggctttattcattgtgctctcataaacgagtggaagtggaatttttatgaattcaagtgatctgctgtctataaggagaaaaaaaatagcatgcgcaaaatgcactcggactaattgctgttatatttgaagtaatcattaataccctctcctatctaaaatacataataatcttgtcctggatcacacacaaggtagtataaacttagctagagtgttttttttccttttacacgaactagctagagtgttgctacttgatctgcttgtatgtcaaaaaaaacaaaaacaaaataaagaaaaaaattaatgtagcagcatgcgaaggaaccaagaggacgaaaatgtacattggatcctatccaacacaaagaacccattccaaaatgggccgtacatccgttgcccttggcgtggtttgtgccgtttgttcgcctcacgagtgacctcaattcatttatgaatcccattgccaaatcaaacacaaccccggccacactcccttctctaacaatttcgtggacatcatcgagcatgtgagcggccgccatcacaaacgtgcacccaaattaaaccaattaacaaacaaacttaaggacccatacaaagaactccttcaccgaaaaaaaaaaaagaagaagaagagagagctgcgtaatccaaaccgacgaccacgatcaccatccagcaaaaaacggacggctctcgtagcggaggccttgccgagcgcttggggacaagccgtggtggaggcccccgaaagtgaccgcgcggcggtcgcgaaaagggcgcagcggcagcggatcagcacggtgcacgagaccgttgccgaggcgcgcgcggcagaaaacagtaaaagcgcacccgtgttttcttcgccttcgcttcgcttcaccgcgcgcgcgcgaggcgacgtgggtgggtggttgactggttgcgccgcgcgcgcgcgggtgtgggctcgagtcgagcgagctcgaccgctcgaggcgacgtgcagcgacgggcgcgcggcttggacgggagctgtgcgtggcgacggcaacggccgcgggggcctgtgtctgtctgcccgagcgtgttggacgcgtccgtccgggccgggccgggacggcgacggcgacggcgacgggttggttcgaccggtctccgtggatattgttgttgctggtcttttgttttgcttttctcctatccaaaatgtttggcgccgttgattttttaaaaaatatttgaccattcgttttattaaaaaaatttaattattaattctttttctatcatttgatttattgttaaatatacttttatgtatatatatagttttacacatttcacaaaaatttttgaataagacgaacgatcaaacatgtttaaaaaaattaacggtgtcaaatatttagggaatgagagagtataaattaaacatgcgacgctagctgtggatagcgagaaatgtggcgtgtggcgtgcatttcatcagggaaacaactgggatattttctatttttttcacttttacggaaaaggatgcgcctggagtgcaatgttgttggagttttcctccgggaaaagaaaagatattgttcatggtagccagctagttcgactataaggagatccaacggttagatatttctaactggctactccttctgagtttgttcttttctgtagaattttcactcgcgaagaatactcgtgtaaggttcccattgtttgctccatatagtatctatcgttgctaaaatttgaattttcaaactcaattttaaagttttttcattgtaatttattttccagcattaacatttaaatcactaaaaacacatataagaaaattttatatataaattgttattattttgctaatacgctgaataacgtaatattgtatttagcctaatgctgggagcctagagtatctgcatggacggatatatccacttggcagccgcccaccatcgtactatcccgtatgttcggtggcacggcgtcgcgacccacttggcaataaaaagcgcggaaaatacacgcacacgccgctcggcccatcgcatcgcgtatttcgcgatttcgccgtcccataaaagcagcgtcacgtatgcaatgaatcagcaacgccgtgatgtgagcctagcgcagtaacgctcgcagttaacggcgttcaattgtgaattatccgcggcagtaaaaaaatgaagtagtaaaaaactctggacttgtaccgctcgtactctgcttctgctgcctgcgtcgtttcaacggtgcggttaatgatcgcgataaaaaaaagggggggcttaattattcgctcatcagcacagcacctggactagctagaacgtgcaataataacgacgttattactaatttttacgtcaattagtagtagtaccactgattgatttatcgatcgcgaccgttagaaaaggtgaacagtgaagagtctaatctgatctaatctaatgcatggccctgaaacttccctttctctctctttctctctctcctatcaaatatcaacagtacaatggttatttcagttctccatcatgggatcgtactctgtttagcatgggattaagctagcgtacgtacgtgcatccgtgcgatggacacaactactacagctgcaagacagtcggcgaaggccagcgatacgtgaccgtattattaattcgagcccaatttatgattgatttatactagtattcgtgcgtatagg

SEQ ID NO: 36842 - DNA, 4860 bp, Oryza sativa
  unsure (1)..(4860): unsure at all n locations
cactacttcactcattcactcgcaagtcgcaaccctttttatttctctttgagctacattgctatggattatacacgctccgtggcttttttgtttccgtccgataccagcatcattgtaatcattttcagtcgcgagaaaaaaaacctgaatttatctctaaataatccaatactattcgacaatacgtaagacaaacagtacggtccgtttctaaatatcactcggattggtcgatggctatcggagccactttcacccaggatttataatcccaatagctacgaatgactcgaaatatatccagatttattggatcaagttcaagataccaaccaccccgtttttcggtttttgtcaagttcaaaagaacccaaactgaaatttagttttttctttgtcaagatttgttataattttatcggtttatgggcggtttttgatctggtatcagaagtgtgaacccctacgcatgggcagacaaacggggtggagcgctacgaattgccgtcgagtaaaaccatcgtctctcgtaccgtgcgcgacgacggagatcagggcggacggcagctgccttgcaatgcggatcgatcggaaagtgggtgctgctggctgctgcgtggatgcaatgatagagggaagagcgtcagcgtcccagcttttcggtcgcagtcgcaggctcgcagcagcggcagccgggcaggtcgcgaggcgagagagagcacatgcgtgcgcccgtgccggtggcgtcgtcctcctcgccgcgctaccttttttcttcgcggagatgggaggggagggatagctagctaggcgacaggcggaatattagcccactgttcgtgcgcctctcgcgcactcgcggaccagcgagcgggggcacacatgcgtccgtggccgagagagattgagatcagtggcagcagatcactgttgttaaattaaacgccatgcaagatgcaacagtgagagtgtgacacaatcatcgccatcggtttatttggttggagtttactagtaaaagcatatcggttttgttaggtttgttaggttctgatcgggagggaaaggcccgtttattcgatcgatctgaagtccacatctactagtagcagtactagtaataatttcccataaaaaaagtactagtagtaatttgccattttttgttttaaataaaagtacgtaatttgccattttagtattttcgttgctcgtgctgtcatgggcggagccatttggactagccatccaatctgggcctctaggttacacggcccaattgctcggcccgtgcgcgaggcgaccgcaatgcacacacgttacacgtttcacgacttcaccccggcgtccgggatgcacgtacgtacctgtacacagcacacgtaaagcaaaccgtactctttcttgaaattaaacacgacggcatacaaccgtactctattatagtagtatatatcgtttctatatatatatgttctagttctttttaagtcaaacttaaaaggtttttttcatctctctactgcctctacattattaatatgttaatcccgcgcagccatccaaccgatatctagatataccacatgaaacaaattaaccacccaatcccatgagcctgtgtttccgctagtctctgccagggaaggtctttaggaaaatcaaggtgcttttgctaggacactgctccttcaagggtgttgcgccggtctggcttttttttcttttgtttttgttgttgaactctttgtactcatcgtatcgtttctagtaatggaaatgtgggctctcacaggctcacagccctagttaaaaaaaaaaaatcccatgagcaccgaggccgtctgccatgccgtcatcgacaacgagctccaaggcgtagcccgaagctgcgctgctactgcgcggtgtgcacggagccattagagtgggtggcgatcggcccgtgcggccaccgcagcgtttgcgcgaggtgcatcgttgacatccgcttcgtcagcaaggacaggcgctgccgcctgtgcagagccccctgtcccttcctcgtcgtcgtcaggggagactcactgtagagaaatcatctttgtgtggagattatgggtaccccatacccacacggcatggttatccgactagttataggggataacttatatatatatatatgaaatatgtaacagatcatgacttgggtattacgtttccctgtatattatggaacggcctaaagtcctggtttgataagattgtaaagtagatttaggaaaccgataccgtattggttaaggtttctatcttgtaaccctgccccccaacctatataaggagggcagggagcccctctaggggcatgatgagacaacctgatcgtcagatcaatacacactcggcggattcaaatccccaaacaggagtagggtattacctctcattgagagggcctgaacctgtctaaatcctttgtctccgcatccatccacttttaggtctcgtgcgctaccccgttttattattgccgaaatcaagtttcgacagttggcgcgccaggtaggggtaaacgccgagtttcctgacgacgagtgcgatggaatcaactttatgagttgccggcttcgtcttcgctttgggagctccttgattcctcgccgccgacgacttcaacaagacgaatcgtcgctgctattctctgcctgatcttgttcgcatcagcacgacggcaacgacggggcaacgacagttcgacggatttgatggtcgtcctcgtccaccaccaagcctactggtccaatctacccaacgaggatgccatggtgttgcaagatggatctacaaacacgaagcatgccaaaaccgatctaatcggatgcataggagacggctgcagccacgccgatgccttcctgccgtcctgcgtcgtgctgatggacaccaacgccgcccgcgactgcgacctccgcctcctccgctccgtctcagaattaatctctcttggtattttctgctgtttgcatgtaacgccgcggcactactcttgccgactggtgtttccgtctgcatggctggcctattaagccgccgctgttgggcgtctacgacttcaccaccggcctgcctccgtcgccgccgactggtgtccccgcctatacggtcggttggtcacaccaccgttgatgggcatcgtcatcttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggtctattatgccgccgctgttgggcgtctacgacttcaccgccggcctgcctccgtcgccgccgattggtgcctccgcctacacggctggcctattatgccgccgctgttgggcgtctacgacttcaccgccggcctgcctccgtcgccgccgagtggtgtctccgcctacacggctggcctattatgccgccgctgttgggcgtctacgacttcaccgccggcctgcctccgtcgccgccgagtggtgcctccgcctacacggctggcctattatgccgccgctgttgggcgtctacgtcttcaccgaccggccgcctcgaccgccgccgactggtgtctctgcctacacggctggtctattatgctgccgctgttgggcgtctacgacttcaccgccagctggccttcgccgccgccgactggtgtctctgcctacacggctggtctattatgccgccgctgttgggcgtctacgacttcaccgccagcctgcctccgtcgccgccgagtggtgctccgcctacacggctggtctattatgctgccgctgttgggcgtctacgacttcaccgccggcctgcctccgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttctattgagtagtgagtcgggggctacagatgttatatcatattttttataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacctaagtagtaaattctgatccgtgaaactttgttccattaatgacgaactcatgtcactcatatgcatgtttgggaaatgcctaggccgactcccgatgcttgggggctatgactagtcggacagagtgtttaaacgtacagagtcatctgctcggggaaatcaaaattgacaagaggagaaatacatatttatcaatattttaaaatacttgattttttctcgagtattatatttatatcagatactactcatcctatatgtttgttctgcaggatccagatccagatatgcataaaagggattcatggctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 36843 - DNA, 7892 bp, Oryza sativa
aagaggaatgcatgctattaacccacattccttctggccttgattatttgttgcattattttgtcagggaaaaaaggctgatgcactgattaaatatttcggcgaagatcctgtacgctgcccttttgagcaaggtaagaatttttatgatcaatgtgacttatttctaaggttgtgcattcagcattttctttttccgagtacctgtcaaggatcaagatactgtcagtcgtgtgagcaccccccactataagcacaaacacattatcatgaaaatcattcttatttaaaatatttcaacccataaatatgtaataccttgcaaagaaacaatttaggataaatcattttctgtagtttgcagctgattgagcatatcttatttctgcattttttatcatcaacatatgtgtttgcttgttttggtatgttgcttaactcttatgttgatcatgatgttgcagttatctccaccctcttaacatttgtaacaatgtttcggaaagcacatgaagagaaccgcaagcaagctgagctcgataagaaaagggctgaaaaagaggcagaagcagaaaagtctaaagcacagttggctagtaaaaatgtattgatccttgacctgtatctttggcaacttcagccaacctcttatatccatcgtatttataaaattcaaaatctgctcacaggactctaaaccatcaaatccaagccggcaagtgaaacaaacgccagatactaaaacaagagctgcaagcagacgaggaaaagatgtaggttgatctccacgaccaactctgttgttgcgcttatgatctgcatgctgggcgaatgcatgacctgctcgatgcacggggagggcaagaaaagttgtgtaaatgatgcagccatcaatggaaacagcatggctgcaccatagcaactgtacatgacgccctttacggtaatgccacatgtgtctgttgcttaacaatacattgataaatgaatcgtataattttctgacaagtttttttttttcttattgcagttcgcactagcgatggccggttttttctcttcggccagcagggccgcccagtggcaacttctgactgctgtaaagaactaacactaacagcaaagctaacatcattcgttttttcctttgttttttatgttacttgtccattctttctaaccccagtggccaagtgcagccaatgcttcaggagtagagcctcgtagtatcgtagtaggtaggtagaaattgtacaaataggaacagggaaagggtagggaaaccatgtggggcggagaaattgtagctgggatctatacgagatgtaaacatgcgtgtgcttcacgaatatttttttttgtagtgaatgtaccaaggttttcataattagtgaatgcagcagcttttccatgatcatagccttgtgtcgttgagttgtgactcgatgagctaaatttcacccttgctggcgcagtcacctcatctgtgctgcattagcttccctaattactgtgggcttgtttggcacagctctagctccacccctcatagagctcagctaaacagtttcagctccaccaaaactaagagtggagttgggtggagctttcttacaaaatgtattagagttgtggagctaggtttaggcagctctacaactccattccagactcaactccagttatatttaggcagctctacagctgggtttaggctggaagtagcatccccccaccaccgcgccttgcagcagctgcgggatgaagaaggcctggaacaaccgcatcgtcggtcgcaccctaatgaacatctcgcacaaatgcgcgaagatggccagcgtcatcacggcattgggtgcgagatgcaaggcatgaatttcgtagaaatccagaacctcatggaaaaatctggagaacggtggaatcaagcccgtcatggcgaaggacaagaggtgcacggatcgctccggatatcacggccgcggccgcgactctcccgcccgcatgacggcaccgtccgacatgatcttgcggggaaggctaaggtgcctgtctgttgtgatgcgggaggaagggagcactgcgtcaccggtgtcttgggccatggcaaccggcggagaggtggcggagagcatggggcgcgagacggaatggggtggcgagaatgttagggttcgagaagcgaaaggacgagtgggcggttggcgaagggaagggggcagagtctccgcctccgcccccttttatcctcgcctcatccgcgctcgcctcctcgtttcgcgctcccatacttgcccccacgattctcacgcccgcatttgtctcttcgcatcctgcgcccactcatcacatcgcctgttgtatccgctcccgcctttagtgcgtctgttagtggcacactcgaggtggagtgcgcaatggccatgagcgcaggttgagcaaaccgtcaccactaccgccgcaggagtagcgagcgagagaatcgaggcgtggtctgactgaccccccccggttatcgcgcctcaagcatcttcatcatgagggcggtcagtggcggtcaaaccgttgttatggttggcacgccaacctggccacgcggccatatccttttggattccctgccgggcccacaaccccagcttgagaagttgtgaggcgccatgtcagaacgatctcaggaaatcgatatccgatatagcgccgggggctactgtcggagatatggactcgggggtatgtgaagtagaggggaattactttccctccggccacgtgactctgcaagttagccccattcacgcttcacgtgagtcatggaagcggcggggggagggggggagggagggcctcggggcatggcgtcaccccctcggctatcccgcggcttcgccccgaggccctcacccggctgccacgcggcggagggagagagcgagaggggagcacaggctgaacagccataaatgtgcgacgccccaactgtctctcaccgcatttaatgcggtaagggcagacgtgcggcgcgcctagctaacctctgtccaacggatgtgaccggtctgtgaccggcctgtcaccgtcacatccgatggatagggcaaccatgtcctcacgtcccccttgttcccggtggagtgggggtgggtatgacccgtcacgtccgagcgtcactcgaggaagggctgtcgcaagtcatcgttcatttatgagggaatgacagggctgtcccccgtgtcaggcggggggcggcgtcgggttccactcgagaaccggttgttgcttagcttccgggagaaggcacggtttaaagcccaggaaaagtggagtaggatccccctccgagagagggtaggtagaggcggcgcatgtggtatccccttgagctataaaaggaggaccctgcccactgagacaaggggacgacgcccagaaaacctgaactccagaagagaggaagcgagcgcgctttctagagtgaagaaacctttgtaaaactcatccataatcccaaatacaggagtagggtgttacgctccatagcggctcgaacctgtataatccgactgcgtgcaagcttgccggtaatcttagggacgagcgagtgatttccgagagacgagcctccgcccccggccgaactcacaaatggggggtctcacgattccccgctattgaggatcttccctcgacagattcttaacatgatcttcaagctcttggaaattttcctttgtgtctatcttacttctaaatcatatgttttctttgtgctccatccaaacagtttcttgtgttttcatttcttaggattcgaggtgtgataacatttgaatcatgcgtatttcctatttgtgtgttttgagaattctgagttcgaaaggaactctaaataataattactaccgccttccaaaatacaagagattttgctcatgtaattatataggcaaaatccttaatattctcggacataggtagtatttacaaacagagcaatggtaatggtgcattaaactgtcagacaaacaaccatgtagaaatgaacaatacgcattagtacaacaagaagtggcgtgagagaagcaggggagctcatgctgaccagtgtggattgtctacagtattactgatgcagtagcagacattgacgtgtagccgggacctatatatcagccactgctactgcatcagccgtactgcagagtatatgtatctcgtgctgaccttcttcgccactggtgagggtttaccttacggcgcggttaccgggcttatcgcggggtacggtaatataaataccgcggtaacctccttaaattcaaataaatttaaaaataatttaaatttttgataaattttacatggttttatacggtttttcgcggttaccacggttactgcacggtaaccgtgcttaccgccggggcgcggtaaccccggccccggcggtttgggaaacctggacaggctgcagcaatgggaggacgatgcctgcaatcagaataacttgatgatcctattactgaaaactttatcggtaggtcggctcgccaccacttctagcgatcgtacaaggtccgtcttaagtacttattttgtagccacttttaaccctattaaaatttggtaatgccaaattttgacacattttagggttggtagcattgtatatgtctggtttgaagccttactaaattttggtagattttttaagtgtgaaaacttttaaaatcatcaaattttggtagggttggtaaaatatatgttcagtttgttagggttgtaagcggcaacaaaatgaataggcactttattaataaagagaaaatggcatatctaccatggcataagaggggattccctcaaataccatcgtttaattgcgcttcgctagaataccatcgtcaactaattcaccttagccaaaataccatcatggatagaaatacccttacctttacctcttccaactccggaacaagaaaacggcggcggcggcgtcaaggcgcggcgagcaactccggcagcgccgccacgtgagcacgcgggggaggatgaagtgaaggtgcaggcactcgtcagcgtggtcccagggcgacgaggacatccgcaccacctcccatctccagcaagctcgtcctaccacgatccccgccatccgctcgctccgcgcggcgacggtggtcgtgtctatgcctgcccacgccgtccatggccgtcgtcgctcacgtcgtctcggtcgccggtagctcgcgtcgggagagggggtagcacccaggatccgtctcgcgttgacgtcgcttgcgtcatctcgaccgccagcccaccccgactcactgccgacgatgatctcgccccgattcctcacctccgctggcgcgccggtgaaaccggcgatggccgccggcaaattcttcaagcacggaacgaaggaggaagaagaaattggggcatttttgtccggaatgctattttggcaaagatatcctgttaggggtggtattctagcgaagctcatctaagtgatggtagttgagcgaatcccctcttatgcgatggtagatatgcaattttctcgttaataaaagggttctttcagaaatgtgcaccatgttctcattgctccatctgagccgcctatgcgtgatccactgatcagggtgctgagttgctgacaaccgaggtgggaaccaggtactgagctgcacacgaacgacaataagatatagtaggagggccttttcgtaaaaagttagaagtagaaaaatttggaaatatacttttttttttaatattttacgtttatacagaaaaagatttacacaaatatacctccaccacataacaggggtatatgggaccgccttgggactgtttcggcccacgtgccacctcggtgccgctctctgggctgtaagagcgaggcggtgccgcacgtccatcctgcgtgaccgctggtcccgcggaatggaagtgtggtcccgcgcccccgttatagggtggaggtagttatgccaatctttttcacacatgtatataaacctaaatatatttttcgggattctccggcgtcctccccggccatgcggccaccatagccacccgctgcggcggcgacggagcattccggtgagccgcgccgacctcgcccgcatgcgccgccgcatcggcgacgacccacgccacccacctccaggtaattccacccgcattttacgattccccagatcgggctagggctagtgtatactactagtactactgaattaccgatcgctgatgattcgatgaactgcttgcgttaaacctaatctagattccattctcttaaatccccaaacaaagcgcggattagcggaagcggtagaaaggcgtcctcgggagatgagacgaacggccggtgtcagaacgggtccatggcggcatctgcattgctgctcatctccccctccactgaaacaagccgcaagaggacaatggatttaggtgaacccgtcatgcagacttgcagaggcaggtaggtcacaggtgagtacactccattgtctggggtaaatcggccaagcaaaccaatcagcaatgtagtatcagttattacattgttcccaattgccaaatcaaagtccaaccacatgtgctcaactctccattgaaaatctgaaatccatccaaacaaaagtaaaccaaaccaaagaagttgctcgccataaaaagtcacgagccaactttttttttaagctctttggatggatgtcacacagtggctgtctcacaacacaagtgatcactcacaaaggtttggtactatcttaccaaatgccaagccctaaagacaggtaaagaactgaagataccaggggggcagtaaagaacagagactagatgttgataatacatgtggccatgatacactatttccagttaattaatatggttaggttgatgcccagcctactagtgggaatgtggcattttgcttcagtttatcaggacactacaacagtagcacttttgtggataggatatgtgaggcacttcacatttttttctcttcctcctcaaatgattgagaggagtaggttgatattaaattgccacatgacacaagattcccaattgattaacggcaagggccctttgcaatagtatttatcaataactaatttaccttttcctttcacaatcaagtaggccctgcttgctgtatatgtttccaacctgtttggcttagctaagatcagtatgcttgcattgcattttctatttttccttcttgccatttctgatcctcaccatttctgcacggttgattgtgtcccctgaagcaaaagctgttcatcaatttcttgaagcaatgcaattgtatctcgtgctcgtgcagttcatggtcaggtccacaacttcacatgcgtggatgcttaatgctttgtgtgcacaacaaagtactagtagtatgttgttgattgaggatgcacgattcacgaggtacacaaaaagttatactactactccctctgtcatgtaatataagagattttggtgggatttaacatattctaatactataaatctggagtacattgtatgagcaatcatagcgaggatgattctttgcttaaggatcattcaactggttatggtgacttcatcatggggctatttgcatcctggctaaaagggcaggcaaaatgagtagctgaaatgaggcgatccatatgtaatgtcacgcgcagttttccaaagttttcctttgtaaattcagagttgattagcactgtttttcctctgtccttgtgatcattttggttcattatggttctaatcatgtaatcttgacattttgcaggagcattccttttatcacaattcacaagctcagattgcccccacaa

SEQ ID NO: 36844 - DNA, 1992 bp, Oryza sativa
cttagttttctttaaacgaggtcgctaactgccgtgtacggatgtcacactctgttgaattttgatatgttggaaaagataattcagcatcttcttgggagtgaaaaaacaaagatgaaattccgctataatttggcaccttcttgagagtaaaaaaaaataaagatgaaattccgcatagcaatttacgggaaagcaaaatcatgttacatattgatttgtgcatcatggagtcatttgaagtagccagtagccaagtattagttttttcagattatttaccggattagtgaaacgaattatttgctccacactttataaaatagattttattttttaaaatatatctactatatttcttaaacaatttattttaagttatttcgtaagtttatttattaaattatttaatttgtttctataatttattaaataattcacagcaacaacccgctcaattatctgtctcaaactgaccgctcagatcaaaaatagggagaaagtgagtgctaattttggctattgcatggtgcctttctttgccacattttgcagggtacattggagattaagtagttgcattgacttgcacactttatgaagatttgtatcttagtacactttgcagattgcatgtgtcttccttgctatcatagtttgagtatttcttcatatggttgagcattgatagtgatagagttataactcatgaaactgaatttggagctattattatgtacagtagcctttctttatttggtttggtggcttattgcaatttatcgtttcctcacttttgtacgcaagcaccacattatatcgctacatacaaactatacatcaccttatgatgaggacactaaagtaaggatacttaatacaaaatgttttgtagtctattcaaaccaatgctattattgcacatttattttccaactggcctctatgtttttttttttatgtcgaagatttaactcctacgaaataagtgcaacactttcatatacaattatatatatattttttaaaaaatacaatggtatgactctcaacatacggttaaaaaaaagtggcttatgccatattgagatagtcgaccacatgtataaagtgttagaaactaactccatgaattttttttccctcatgtagtagggcttaggactgaatttacatgtacttggactaaatttgaactgtttgtcaaaatttgttaaattttcaccagtaatcagccgtatccaaacggtttacgtaaaaacttgaacgacctgtttggttggaaggagttggtgatggggaatgggagtttacgatacttgggagtttaagtctgtagtttggttggaagacttggaattcgaggggtttgggatagggaatttaggggtttaattcccaccaagacatgttaattcgtgagactggaagaggtttttccgaccggctgttgggttatgtttaaagctgtaaactctcttgtgtatagagaggagtccatggatgacaaagaggttaaaaccgggtcgcgccaccacatgagcccccaccgtgacaggctgcaggtccagcagcaacactgcacagtcacagtcactgtcctctcctccactccactcctcttctctcctcgcagcctcgcagtgtggaggaggagtagagcttcacgtgaagcgaaatcccccctcgctttgcttgcttccttccctcgctggctggctactggctactggcttctctccagtaaatctgagcagagctgcatttaatgcccccctcctcctttggtctctcctcttctcttcttccttcccttttttttttctcttcccctcctctcgtagcccacgacggatgcggttgcgggtagcaggggatggagggcagatgaaacccgcgagttcttgattcttgggagaatcaccccgtgctcctcctcgcattgatcgcgagaaaagttgttcttttcttggtttcttcgttctgtttggg

SEQ ID NO: 36845 - DNA, 4258 bp, Oryza sativa
cactaaatggaagtcaacatacctgctcatatgatctaaggtaggaatagtattcatttgtcatataaaaagcaagggttatcagattcaagttctgcatcgataaagcatcctgcttaaagaatccatatgcaaaattctaataatccaaatgatgcttcatatgcaaaactctaagctttagaattgagacagtattttcccagcacaagcaacactaataattcatggaaagagtagtccagaatcaacaaagattactatggtctattatcaatagattgcttgtcaatggacaattattgtctgctgcagtgaaaggaaaaggaaaccatccatgcaccatgcatcatatagatatcaccattgtaaatactttttcttgtgagtaggtgatttgaatatagcagtgatctgaaatgcagatctaccaaacttctgaagtaaagtgaatgcaagtaaattagtttgacactcaaattgcaaatataatatgatggggttgacagtaccttctgatgagattgccaacgaacatcatccagaacataattttgaagtaattggaagatgaatttggatttaatgacacatcaagaatcatctgttagaatctttagtatttccagagtgacacaatgcttcattcagtataaccaaaaggctgttgaagagtagtacaaaattccacaagaattgaattggtatactagttacatcatttcaaatgaatgctacacaagttaccagcctccaatcactgccaaaaacttgggattggttaagaacacaacccatcatggatctcctattctccttcccgtcttctctcgtgaatccgccatagcatgaggagtggggaatccaaatgcttgcaaagttctttcaccatcaaaatcaaccattcaaacacaatgcattgtatagtcatggcgtgcgatccaccaccagtcattcttcgccgaaagcggacactgcccacctcacttattccccagtatgagcagatatacctatgactctgagaaattcttcatcacctgatgactgaattgctacccaccatcatctcaagctcctcaatcgagccgccctcatcatccaagatctccatgctcgatgatcggcaagtgaagtagaacacgacactcatcatcgagtcgatgagcatcacgaaggagtacatgaggacaagcaatggcccctcccagagccttgatgagccatcaccatagctcagtgtcttcaccctgtgctcaaacagcccctccacgaaggcgaggccaatggtggatccaaaaaagatgagcaagccgacatgcgtctgcccgcgcatcagctgcactgaccggcgcagcgcgctgactccggcgatgtcctcaagaacggcgatgacaccgccgaggttgcacactatgatggtgtgcgcgtacgccacggagaaggcaagaacggtgaggaggccggcgcagacgacgatgtcgggcgggtagagcatgaacttgagcgtggaacacgcggtgacgaggagagcgaggaaggaggagaggcaggcgatgacggcggcgcacgcgagcgcgtacgtggcggcgaggcgcggccacgcgcggcgcgcgaggagggagagctccgcgccggcgaggagcggcttgcccgcgtagacggccgcgaccgcgtacgcggcggcggcgcgggcggcgaggaggagcgtgaacgtcgccgggaacgacacgacggacgcgacgagggtggcggcgaggtggtgcgccagctgcctgacgaaatgcgtgagcgggagccccgacgccgccgcagcggcgagcagcctccgcgcgagcgggagcacggcggcgccctacaacgcggcggctgacagcaggaggcaccccgacgccgggcagagcaggaagaagagcaccgacgtgaacgcgtgcgggtcccccgcagcacccgcaccgtctcccgcaggatctccagcgcgttcatcggcggcaaccgcaccacccctcctccccctcctcccccccgcgccatcctcgccgccgccacaccaccctctctcacttcttggactcgccgcctccgccgccaaacgcgacgttcctccccggtcagatccaacgcaacggctcgagctccaccaaaccccgtcgcccaatgcgaggctcccgtggccgccctccgagttggttccagtgagcagaggcgagatcttggagagcggcaatggcgtgggaggaggaggaggtcgaggaggaagagaagtttcttggagcagagatcgaggtgggttttttgtgaagggagacggcgacgccgcgagctcgcgaggcgagggggagggtctgactaccgacagttcacatgtggtactgacatttggggcccaccaagttgaggtagtttaggtttgttaggatgacatgcgggtcccaccaagtggaggtagtttatgtcagttaggatgacatgtggggccccctggaaacccatccctccggtacggaaaacgaagcagtccattagcacgtgattaattaattatttgctaatttttttttcaaaaatggatcaatataatttttttaagcaactttcgtatataaactttttacaaaaaaaacacaccgtttagccgttcgaaaagcgtgcgcgcggaaaatgagatgggggagttgggaactcacagtgaagcttccacgggcacgcttgcatatgatttttcttgggtcgtgcttctgcaaattcctcttgtcgtaggttccattaaagatttgaagttgataatagcgcattgacaatgagttatatgttcgttttgtcaacctactaatgacaatgtgagattgtgattcatgtttgtactattgccatttggtttattggttgccaaagtaggaagaaacaaatactatccatcaccattaagaccattttcgaatgcaaattataggaggacaagcgaaactcaattttgttgaaacgagatccttcgcagtgacatactatcacgcctaacatgtaggatccactttctcatgggaaactcatgagcatatatgtcagcgactctaaggcttcgttcgttcctgggcgatctgggggattgagggagaaaagcatctcgttttctgcacgcacgctttccaaactaataaacggtgtgttttttacaaaaaaaaatttcctataaaaaatttgctttaaaaaatcatattaatctatttttaaaatttaaaataattaatactcaattaatcatgagctaatggctcacctcgttttacgtatcttcccaatctcctcgatcaccttctcctcaaactcaccctaagtgcataaacttcccaatctcctcaatcaccttttcctcaaactcaccctaagtgcataaactgtattctcctcaatcaccttctcctcaaactcaccctaagggcatgtacaacggtgtgtaataacggtctctcttcgtttccatgtaagtaaaattgatgacgtggaagagagagagtggagtaaagggaaacatggttgctacgcatgacaacgggtcagagtcgactcttaacgtttattaaaggaaattttgttgcatggaggtggagaaaaggaaagaatggtactaaaaaaaatattttggtgcattaatggttaagagtttttgttatcttaactattgtaggagaatagtctctaagtgatatgtattaacaaagagaccattctaagctctacctttatacatgccctaagcgtataaactgtactgtagaggaggataccaataaggtgcattaggacacattatgtcgtaatcgtccgagtcatgatcaaggctcagatcaaattattacgatagtacgtgtttcacgaattatcctctaacttaagtaatgtgtttttagagtcactgacatgttcagtgactcaaagtgatttgactttgagcataggatctcaatcggtgttttgctccacaaaaaactctgaaaccttgttgctatgtgttccctgtactctctccgtcccaaaataaaccaacattatacgtgatgtaatacattctattactacgaatctagacatacacatgtccagattcgtaatattagtatgtgtcacatcacgtatgagggttttttttttttattttaggatggaagaagtatacaacaactacagtaacccaggtatattgagttgcatcaatacagagaaaagagggtcaaacaaggccgagcaggaaggaacaaaa

SEQ ID NO: 36846 - DNA, 19928 bp, Oryza sativa
gagcaactagtttagtttttttacataccaacttgatctgcgcttttatgcttgcgatgagatgagtgtactcatctatctgtctgcaaacatggaaatatacaggattagtatgtgaattttactacagggagtcaggcatcaaataaaacaaaagcgtaaatataaaagggaaaattacagcaccaacatattgacatacaaacaaatgtagccacaggaaacccaaaaaggaaaattagagaaataggaaagaagcccagatcacattcaaaagaaatcgggactaacgacaatatgctgcagtgacaatatcgcagtcgatcctaaacaaaacatagtatctgtcaaattgaaaacctgtaacatagtatctgtcaaattgaaaacctgtgttttatgaacgggaagttgacacatcaaagcagcaaggcacaaagcaatatgattaattgctaaggtctgctaatcttcaactgtaatagtttttgtcccggaaaatatggggttcggtatattagatgatataaaggcaacaaaaaaagtttgccactatacagtacacactatgactatgatctttgaatacatatcatattgatgttgatgcttcagtattattagatccaagtatccagcgcagactgagtcaactatatcctacacctccgtcaaaaaaacaacaacttctagctacgaacctagacataggcagaagttggattttttggggacggagggagcatgcaacatcaacagtggttgccactatacatgagcaagacccagcctgtctacctatatacccacacaggcacacacacacacacacaagaggcctatatatctacggtcaaacatagtatactgcaaaatcagcaattgacaaggaaggcttccagagtagcataattggatccaagttagcataacatcattgaaacagcagtaggaacaaactcatctgagaattgacacatctaagaaaatacagagtaggtatctattggctgaatcagtgaagtgtgaagagtagcagtttagaatgctaagaaatgatacagtgaaaataggtcattttagtaaaattttctgaacttatcaatggagacttggagagtgcgcgcagaatatctgatgcacaccaatagcacccaggatcagcacactaaaatgtcaaataaatacattcctttcgtccttgatgcctgggtaaacgtcaacctccaaaaggatacatatagatacccagggttttataaaaaacctactcaagaatataatatgttcctgagtttatatgtcctctcttgagaagaagaaaaaacaaaacccacattttcaactataaataacattatgaggggaaaaaaaactcaaaccaccttttcaacaataacaaaacaggacatatgaaatatatgctaattgtggatactgtgttaaaagaagcataaagcacatcaaaacttccctcaaccatcaagattcctattcctcaacttctttgacacaaaaaaaaacatgatcttcatagccaattctaagaattgagttaccttgccaaccttgattctcttacagatataaactgcaaagcttcctgccaagtaaattccacatggaaacctagaccaatatccacaaaaatgtgtcttgtatctggcctgcagaagtcaccacaggtacacagtaaggaaccaaaggtaaatctggaaagatcaagaacaataaagaggatatatcacggatatatcactcatgttacagaagggtaagtttttctgcacttcatactgattttctgtaactatccaaactctccagagctaggctaaagaccttgaaatatcaacatgaacaaactccaagtctacttgttatgtagtgtgtcaataaccaagaatattttttttatcagaataaccagtaaaaataaaaatcaataagtttgttatactatgttccatatgctaatactatttttccaaccaggattgtcaccctatttccactatttagatggaaacgacacagtcatgtagaaacaccacattatcccattgccaatggtctatcaactgcatgtgcacttccagaaaatttaacttgaataatgtagtatccagctgttccgatataccgcgtcagtgtatattgttaacacatggtgactcaattcatcagtgaagttatatcaaaactcgttgagtcttatccagaactgaagatgtaaagggaggacgagggtttacacttctgcctgggcgtacacctcagagccaagattgaccatggatcgcatactggtgactccattcttctccaaattttcgatgttccttttcaagtccaagctgagaccatccaaaaaccgaaatcaacggccataataatcagcatcgcatcaacacggtaacccggaatcacaataatcattgaggttttacatacaagattctacgggaagcgaatcttacaaggtcttctgctgctggaacaccttgtcccgctgcgcgatggtgttcacaaggtccggcttcagtctccggtcgacgaagtcctcgaacttcttcaccttctcctgccgcacccgcgcctccgccgcggccatggccatcgcccccgcaacccggattcccctcggcactgttctcgatgagccagacacccccgccttcctcgacggcgagcccaccctctagccgcgacgaccccgtgcggcggagccctcggaagcaagggagagcaagcggaggagcggccgagcagccaggcggcggcggcggaggggttcgagactttgaggctgaagcggtcgccgcctccacgcgaaggagttgggccgcggccgcgccggggacgatgggccacacggaaactttcgaggcccaattggtgggaaactgcttacagtacgagcgttgttgccacgtttgctttgctcctcccgatggtttagtaccacctcgcttgttcagctcgatgaggcggtcgcgcgagctataaaatgagtcgcagggctccgtcacaaagcatacctttctcggccttttggctaagatcaagtgtagtatctgttcttatcagtttaatatctgatatgtgggccatgtgttcacttcgatattaaatttattttttgtgggggagggtccaccacagtggcttgccactggggccctcgcgtgtcgcccaggcgttgcactaccgcccgggcctggcgcaccccaaccaaatcaagtttaaattttgattataagcaaaattgatggcccacctcaactaaattagattcaaactttaacctgaaagttgtactactagtagatttgttgaaataaagggcttgtttggtaccccagggtccacttccatccagttcatccagggtccacttcctctacccagctccacttccatccagttttggttgagctgtggaggtggaaactccagaaggggtggagctagagctgtgtcaaacagactcaaaatatcgatatcgagaaaacacgcttaaaaaaaagattttagtcgcgactaaatgtaaacacaaaccaaattaatctgaaattccaaattaatactccctccgtcccataatataagggattttaagtttttcttacaacgtttgatcactcgtcttattcaaaaaattatcaaattctttcttaataatctgcaattcgtgtgaaatatgtataagatttgaatgcatgctagagatttcaattgaattgggattaaacacatcgctgtcctttcaactcggaccattcagtacaggtggagtgaaaaccagcagcagtcgtcatcgatctcgagcgccacatgaaagatcatccagatccaaacaaaccatctgcaaatcgaagcggaatccgccggtgagccgcggcaaccgcagccatggacaaaggccagcgctgccgccgccgccgtcggcgccgcagtccccgccgttctccgcgccggcatcgccgtactcggcgctccacccgctgctcctcccctcccctaacccgcacctcctcctcaagcccaagacgctgaccctctcgctctcctcgtcatccctcggctcgatgccgtcttcctccccgcctggccccgccgtcaccgacgcctgggagctcgtgacgcccaccgccaccgtcgtcgccgtgggcgctgccgccgtggacgacggcggcctcgacgactgcgacgtcttccccccgcgcctccacgaggggctcggcgtcgagggggaggcggaggaggctgcggcgaaggaaggggaggaagacgacggcgaggaggatgatgatgatgatgatgatgaatttggtgatggggagtggctgtgggggtgggggaggtgccgcgcggcggcgaggcgagcgtgggcggccggggtcggggccgtgcgggaggggctgatggtgcacgggacgtgcgggtgccccgcggtgaggcccgccgtgtggtcggcggcgggcgcggccgttgtggtgggagcgctgctctacgcgcgccggcgggacaggagggagagggacctgctcgtgctgctctcgcaggagaaggataaggtttgaatctctatataattctataggttttctggtttaatttcatcgtcggtattctggtatcatgaacaattacgctagagaattgggtgatgaggcgaggaacatgtgggttttagatgtcttgtagatattcaactacatcttccaagtatgatccgtgcgcaatatctatcggaactttagaagttaaacaacgatgtgataattcgagcttgttactgtggtcatcaagaaattgatttttttttctgaagttaagatgatcattttttagggaatacgatctgtaattggcaaaatttgtacagttacatgttgtatcactggaatttgggtatacggttcagtaagcgagtatcatgttctatcatcgcagaggttgattcggaacatacagaatgagaacagggttaaatatttggttttcctatagttaaggtttcaactttttagggaatacgatcagtaattggcaacatttgtacagttgctacttgctattctgtttagttacatgtatcactggaatttcagtatacagttcagtgaatgagttataactctttgtggtgatcatagagaagatttgagatattatggaaatgttttgttttactgctgtcatgctgtagcagtagtaccagcagtgtcttttgatagtttcaccattagagtgttaggaaacccatcaatgatgttcttttcacttgtcgtatcctcttgatgttctttaaattagtgtcttttgatagtttcgccataacatgttgtatcctcttgatgttcttttcacatactgatactgtttcttgaggttggagaatgttaattggctactctttgttagtgtaggtactgatggtgtaccattgtcaagtagccttgaattgaaaatccatcaatttgttatacttttcatgcattaggttgagtgaaagaaattggatgctgcacattgtacttgaattctaaaaatataaattggatagtttctgctctaatttgtctttgccctttagtgttttgcatttctaattattacaatatgcattagttctcaacaattttttagtcatcgtcttatgaggcaatgtttttacatggggaaattatgttcaaacacaaaaaatcttgtctaaattggagaaaagtagtatatctttgtactcatatatatagatgttagtcttgtgtcatgtaagctacgtagtattatgttcaggcgtgcattgagcaacagtaaatattcacaagacagtttatgcattgatgttctctcattagatccttgttttgccttttgcagaggattgcccaacttctgcatcaaattgctttaatgagtgacatgagaagtggaggggaagcaattaaaattatcaggaccccgtgattattttttcactgcagaagaggtttcgttgcattgtcgtaccaaatgtgtcatgtagttacagaacagtgtacacttttaagtctggaggatcatcacttgtagcttgataatagtttagctgcatcgcataggcctgatgtttacacggttagacagcaaaacctcctactagacaaactgaccttaagggttcaatatgtatgttatgtatatagttcgtagataatttattaaactatgaatacatccaaagtgttgtttatgtcggttactctagactggtggactcaattctgcatgcgtcattcaaattccccagcgacgctgatggattagctgactttggtttcgtagtttaccttgttcattttgtgacattttactcttctttaccacaactatagttgataacttgatattggtgtaatacggcgcaaattggtatggccaagtgaatcattttttagcacggtatggccaaggaagattggtttagcattcagaagcctgaacacggaggaactcaggtctttctgaaactgatacattctgctttccactgatgtcagtatcctattatcctatatactttgcgatgctgatggattagttgatttttgatttcttagtttaccttgttcattttgtgatatttcactctattgtatctcaattatactattatagttgttctgtgcgacaacagattcatgcagaaaagatcaaattatttgcgtagaaaaatagaaactcgaaggatcctagaacgtcatacagtaaaaacatgaacgataagtcagattgattctactgaaagtcatatggtacaaatatgagcttttgctactcaggccatgtttagttccaaactatttcttcaaactttcaacttttccatcacatcaaaacacacacataaactttcaacttttccgttatatcattccaatttcaacaaaacttccaattttaacgtgaactaaacacaccctcagtactcagtgatattcccataggactgacctacaaatcaattactagcaatcaaccaatcatgcagtgaacatagccatatgtacgatgactaccctctctacccattaacaagcaagaaagtctttctagtttctacgaactgggcaactggcgagcgtagtaacgaggtcttgaggcagggcactggtagcagagacacaagattcgcataccagcagcgtcccggtcgggcaacgtgctcttaattgggctggcgcagctagaaagggaagagagaagggggagggcgtcggcctggctgggatctgggccgagcgcaagggatgggctcgggttggcccagagggaaagagaagtggagggagagaaggatctttgtctagaaaatgtacataataggtctctcatcttgtcaccgaattacaaaatcatctctcgactgaaaaatcagatatatagcatcctcaatttataaaccgggtcactctagatccttagatggtattgaccccggttttatctgacgtggtgcctgaatcagtgtgggacatacataggcgctccacatgtcaggatgaccaagtcatcaccccctttatctctaccctctcctctcccttcctccactctctcatttttctcctcgtctgggccggcgggctggcgggaaaaggcggtagagaaggaggtccagcggcagcgacgatgacgtgggagaagaggagccgagataggagagcatggcctggtgggcttcaggccgacgcgcttcttggcggtgagcgcaggcgcggagcaggccggcacgaggtgcggaggtagcacgtcggctgcacggcctgcagtcgtcgttgccattctctggcgtcgagctgcagtacgtcggtggcgctcgacccgtttcgggatgccacgttgctatgctcggagcagccatcgccgacatcagtgacatgatgacccacgagttcttggcgatggaggaggggctcagggcgctcgcgtccctctacaagaacgcctacgagtcctcttccaccaccgccgccggcacatcccctcgcaagaatcaccactacaatgactccgacgacgagagtacccagttcagcatgggcgacgtccccgtcaccactgctaggctcccatcgcacctcctcctcctccgcggcaatggcatcgccaagagtggagcttctctatggcggatcaaggtgccgccggatgtggtgtcgtgcgaaaaagcatgtcgttcaaggtgttgagcgcgtgaggagtgggcggtgttcctggaccggttcgagcagctcctatcggcgatgctcaacgccaagaagcacgtcgacctagagctccaggttgtgcttccctgcctcggctcctcttctcttgcgtcaccgtcgtcgttgtcggctgccggaccttcttctttcccgcctcgcaccgctggctggcccgccgaaacaaggagaaaagcgagagagtggagcaagggagagaagaaaggtagagagagggggggtgatgacatggtcaccctgacacgtgggttcccacgttcattcagccaccacatcggacaaaactgaggtcaataccaataaggacccagagtgacctagttttataagttgagggatcacatgtaccccgttttttggttaagagatgattttgtaattcggtgacaagataaggaacctatggatggcaatttacccggcctgatgagcatgggcatgggtgttatattttgcccgtgggcatacccgagaacgtgacagacagcaaccgggtattgttttttgctcaagtgtaacccatgcctgattcgatacatatgtattagctaattttagctcatctcttgttcctcgtacccttttctcttaaaccatttggcccactaactagagacacaacatatatagtcagctaataaaatcctaacctaattccccactcccctcttgtaccccaatccccacggcgcagcggcggtgccggcgcgacgtggtagtgcctggccacaaggacgcaggcagcggctggcggaggctcgcggcgccactgcgcacggcagctggcagcggacgggcgcagacggtgactggcggcacagcggtggatggcgacgcgacggcgcacatgagcaggcggcgggtggtgacacagcgacgcacggggccaagggcgcatgcggcagtgtacgatggcggtggtggcgcaggtgtttgatgaatttttgtgctaaaaattcatagaagaaataataaattattgggcatttaattttatatgagaatattatttatagcataattttactgaatatatacgagacgtatctatatgacatgtgggtccagaaattttaaatgtcacggtgtccgaatatattcgatattggactcgttttgttgtataatttgaatagaaagtgatggttcaaatggattttaaatccgatatacgattcaaaagattggaactattaaaacaaaagaaataagcaagtgctatcgttattacgtgagcatgcatggtcattggctgtggcgattaaacatatggggcccactgtcattagacatgttaatcacataattatctccagactgcagtacacgtcgacggattggctcgtctctgcgtcggcttatcacgaagattagcacggggcgctggaaattcggaggccgtttccgtcgccgctgcctatataagaagcagaacctatctagagcgggggacgccgaggacgccacaggagacacccatctgcccattttcattcatcccattcttcttagtagattaggaaaatcaggagaggagattgaagtcgcccggtgatagcaaaccggcgccgctacggagagaattaaacaccgcagccggcgtccttcatcaagtcgagtcatttatcgacaacataccgccattcaggatatttgcgctggatggtgagcacattgaataaatattaattttctagattaaacacaatagatgttcggtccttattggcgatcgcaacatctgcatgtttttaatctatcttgatctcgatgattaaagccagatcaatgagagccgaagcacggttatcatcaaactccatttatacaatcgatggtataaggctggtttggtcctcattggcgatcggattatctgaacactatttgatatattttctatgctcaaaactagatgtccggccctcattggagattggatcatctatttgttactatgataccgataacaacggcgctggatatgtccaactttcattggtgattggacaatctaaccgatgttttacaaaatatattttgataccatgcacacacatgggagctattcgtgatctttgtaagttaaaaattatggccgagtatttatgaggccggtgtcatgatattattaacatgtccaaacagataggaacggatacatgttactaggttccaatgaggcaaaagtaacgatatatccacatctaataaaggctggcatatataaatgggcaccgacgaggcaaaagtcatcccctttgttatgatacctgactcatgtatggacatggtgataatatattgtgaccaggtttcggcgaaacaaagccacctatatcacagttatcattaaatctctgcaccaacttcaaccttcggcgagcaatcaattttgaagacgacgatcacaagcgcagcttaattggaggtgttccataggctctctcctgtagatgtaattaaccggccgcctcattgctaggcgccgggaatcagcagactacacgcaatctctagtcagcatacctttctattaagtattcctcgcgaaggcaaaagacgaactcctgcgggagccctcatatatttgtaaacattcatgttaatgaatcgtgattaataaaatacagggtttccctattttctgtgtgttcgttgttttgtttttatcaaatagcaggcaagcccgatggggtacctacgctcgacgggtatgggcacgagcatgagattttttttcccatagaccttgcgggcatgtggtctcaagtcaggtatggattcgctctacccgacccaacccgttgccacctcttaagttgttcctctttgcctcgatcagaacaactgaccgttcgcgtcgacgtggttaaatcggaccatcaagtgaacaaatggaaccgtcataatgcgcaaggaagggttcaaaaaagcaaaaaagtatagagtaacatgggtatggtgtattccacccgaacagagacagggtgggtacagagctccgtgtgggtcccgctcgtcagtgggaggtgcgtccctcccacgcaacctgcgcttcgctgtgggtcccgctcgtcagcctaacctgtctcgtagtcgtagggtagtcgtagggagagaccaggtggtcgtcgtgcagagggcgaaagaaaccgcgaaagccaaaacactttctcaggtttcattcaaaaaaaagcaaaacacccgctgctctttatattcatccgcctccaccctctccgcctcctcctccacccccactccctctcgtcctttccgccgcgacgcgcgggtcgtccaagggttgggctcgtcgctgctgctgctcctcgtcgccggcgtcgtgctccacctccctccggggtccggacgcgcgcgcgatgggtaaaaagttttctttttttcatctcgatgtcgtttcgctttcctgcatcaccactgttaatcttatggtgttctcttcctgcagagcaagatcacgccatggaaaatcacattatggccagggtaagttacactataacccatccagccagtctcgcgttcttctgattcaagctacttgttttttttgttgttcttggcagaccaaatttgtgttcgctttacctttcgcggcatccaccctcggatactccgtcgccatcgcctacagcctcagcgggcgtgcagcgaagatgtcgctgatcaggccgagggctgaccacgtcgccggcacaccaaccaacttccgcggtcccgaccgctgggagacgggagatgacccccgactacgcatccacctgccttcagttcgccaccgtcatcttctttcacattgcgatcatcggccatctctgcctcaagcgtccccgtgatgtgtttcagctcaccaaggtggcctcttgcttcgtcccgaccggtttcgctctgtgcaccgtttcctacttcttgcagttcttgtgcctctcgaggtataagatacttgtcaaggtgtgggttgctttgccatagcgaccgtcatggtggtccttttcaccttcatcctcatctgggtgaggatcctcctccttcttcaccttccttgtttttgatccattttgtaatctctatctatctaactattttttcccctttcctttttcattcacagggcccaccgaagcaaaaggaccttatgcaccgcgagatgaggcaacgcggcggcaatggaggtggagatggaaacaaccgcgtccaagaaccgtaggaggacgttgatgaaccagagttcacattccgccgccgagtatgggaaggaggtcatccgcctgaggcgctttttgatggaataatagctgtagttgtcgttctcgttcgtaggttcctgtatcttgatggtgtctgtggtagattcagatcaggtagttttatcttcagtccgtgcatcctgtccaacaagaaacagagttttgaacagctggatcgtttatttgcagtcattcagtaactttgaactgctccatctatcgcctgcttgcaatgagatctatattttgtgccccaaattatctgttttttctgcttagttgcaagtttcatgcagctagacgattattgttttggtttctctctgaacttgttcgcatgttgttcattttggttgggcaacagcccaagatttgcagcatttctcaattctctgtgctccactcgatcggccatatttcccttgttcgtcattttttcatgagctgcaggttttgggatacctcttcgcttggattaggatgtgagctacattagatactgcattttgtttcagagatgcatggactgatctctcagtatgtttgttctgctgcttgcttaaataatcaaattccctgtatgtgtgaaggtagtcaggcactcgctatttgaactgtttcaccgtgtccctgtggatttaggttgcataagttcacaactgttttcatcttagatgatagagtacgatgagtcttaatctttatattatagttatatcctagctaaatccaggtcttcccagctctctagatgtccatcgagattccgctcaagatgagcactgtgagtaaataaaaatgaagggagaaagtgctctacttcttgagcaaaattaattcaatcctgccgaattgtgtgaactcgtggcgtccgtacatttacatggctagatcaacttcaaagtctgtaatatcaaagattgccgaatgatcatgtatatgctttttttttttttaaaaaaaggataatcgcagctattgattagctagcattagaacggggcacttcccggatacattctagggttatagaaccaaagacattaaaagctccggacagcaagccaaattgtgtgatgctacattagacagtcgattaacatgtgaaaaggagcactccaggcgggtaggttgcacgcttcttcatgtcagcaacaagggctccccgctcccgccatggatcaatcccgtgttcccgaccaaattctctggatgataggatagacaatccgaggccataatcaccttttggaagccctcttctgcatactagttgggagcccatgtgttcctatgggaaaaatatacacaaactcaatgtggttgtgcaaaagaacaacaaacttgtattgtccatccaaaatttattgtagtacacataaaaattatgatctatttaggattcgcgcaaaaagaaagaataatggcaaacaaatgggtgactgaagaaaacatatgcagttatcattattataaatgcagtgatcacagcagtgcaattcaagcaataaaacatgtaatgcaaaactatatctaattatgtctttccaataaaaaactcactggtgtgtgcagcgaaagattcaagctttctttagttcaattcaagaccctccagcccttaaaaataattttcaagactctccacaatgcagcaagtcaaaataaaaaataagcccaaagaaaaagaatggtcagaatgccatggttcaaccattctgatattgagttttcaaccagcaacagaatgtacaaccttagaaatttttttttgagcaactgctagtctatgatagctatttgtcaaagataaatagccctgtgtctttatccaccaggtgaaatggcaaaaacctgtagagaaaccaatcagcataataggcagcaaaatcaactacaacatgaccgtacacaaaaaagaggatgcgatgatgcaatgtgcaataaatggaaaatggataaaggaagacaagccattcacaaatttcttgatcatatcctctgcaatatgattaagatgtgaatgatcttcagatttgaatgaggcatctaatgattttacatattaaaagaatatggcaccagagatctttcagtaccagaaaaaaggactgaggcaaagacaagaataggtgaaaagatggataaaataactggaatcttttgtttctgttctgttctaaggcatcttttgatgattttcccatcaaaagaaatgatgccagtgatctagtgtcaatagcaggtggttgtgatcactactcgtttttccttccctaccctctagaaaagggcagtgtcaatagctgtggcttgtgttttaaaaggagtgcagggtgagtatataggtattatttcttctgaaagtcgtaagagaagatggtcctgcctatagagacatctgaattgcatataccatgtgctataaagtttgagtacaattgcctaattgctgcacatgggtagtgctttattagatcatgtgtacatcatattagcagcagtaggacaaatgtttataccatatttacaccattttaacattttaggtcatgttctccacacaattacacaattcatagtgcttctatctggttagaatgaaacattttacagaacatggcatctgtttcataaagcaaagggaaatttcgagagaataggaaaattggcttacatgctgagtattcggacccgtagccaccagaaggaactcgctgacaatttcctttgattagctgaaatttcacgctggcagcaacaacaaagcatttgatgttaaagcctgacgaaaaaaagggaatgtcagatataaaatataattattaaaacacaatggggcgtaagcaagcatgctgtcgtgttgtgcagttcagaaaatctaccgagagacttcatgtagataatatttgctttaggcatttagtccaccatgattgaaaagaggctgcttatattcggtggcaatggtacatgaaaatgataggggaacttctatcttatgagatcttacccaacaattctgagctgaagtagcagtaactcctaagttgcgcaaataaccgaagccagatagctttctaaccattgctatatgtccaaatatgaaagaagcatcattttggatgttagtaatcctgtgggagagcatgaaaacagttcataaatttattgtgtcactaccactatgccgctgcagctaggctctatgtctctaggatttggcatggccacaactcccttgcaggaccacatgttaagaacattaaaaatggcacaatcataacaaatgcacagtataacaccataggcataacaataggctttaactgatagaattggatggtctattggaaacctattgagacggtaatagaatgcaattgcatcatcttaatctcaatttctgtagcgaaaagtaagccagccagctgaataaggcgtagctttacttctacattgagacttaaataaggaactctcatttttttaggatgaattatgaatacacccagaggcctttcttggaaggaattatggtaagcaaaaggctaactgaacaattactaaaatttagcaaaacttccttgatacaaatggtttaactatgcatgtaaatagctgttagagaatgctggtaaagaactgttcagcaataatttctacccacaaacaccagccgaatgctaagatatgggtctgaatggaaaaaaaaatccatcattgttgcaggcttgcagccctgaaaaaaatatggttgtacttagaagtcagaaaaatatagctaccaaaaagcagcaccgctagcaatgactttcttaactcagtgtatcacgtgacaaacaatacatactgatcagataaaattaacaaacaacacatactgttcatttaagaaaaacaagggtgtgggcaatatatattgtgaaggttaggaccttttgtacctgaaactcacagtaattaaaagcaagtgcgggcaatatgcatgtttcaaaatagttttttctttcaaaggaagattactgtgatctcattaagaaattcagcatgcgcatatttttctcaaatttttagtttgcatgataattatcagttataaatgttgataattcaaaaccacaaacagaactatatatttatgccgtacggctgccctatcaggtcacttcttgctacttcttgggtttaaaaagaatcaacaaatgcatggagggtctatatccttattattatgtgaatctggaatgtgtttcttatcctacaaattattggatataaagcattttatttgcagtgtacctcaactatgtagccaagttaaacaaagcaggcaactaaagaagtagttcagacagcaatgaccttctcaatctcagagcttcgagtacaggagtatttcagatagcaatgaccttgtcaatctcagtgggaatggtggaagctgaactccttgtggacaccacacttgcaggtgcgcaccaccagctcgccgctggcaagcaaactcggcctgggtatctctctctcctcactcgatactcaacctctagctcctgaaaggtacaaaatgttcaggttttttttgaatgaacacaaaaatgttcaggtttcagaatggcagattgccaaatgacaatgacatgcagagaagctgaataaaacatcaatcgccagtaacagaggtgtccaggcaatcacagagatgtgattcagatgctgaatgtgaatttgtggttcatatgaaacaaattttgctaaaatttgggtgtaaacaatgcaggtattttggtgcgtcaaaatgtgcaagcagagcatgtgaattcgttcttctttctttcgatttcatattatgctaaggacgaaaatggactggggagaggaggctttaccggcgtgatcgtcttctacccatctccactgaggaggacggcctcgccggtggtgtagccccggagcgggatgcctcgctggaagaattcttggattcctgctgcgactaaatcggagcatgagatgcgcaagaattgtcgacagaaataaagaactgggtggtgattcagataaagaagagtaaggcggaagaaatagaggaggaatacctgcttggccgccttggccggcgaagcgaagaacgtgcagcacggcctgtccgcggtccgccgacccggacaggatggtggagcgggaggcctcgccggctgccgtcttggcaagttggcaaccttctgcggcggcgggctgatcggctgctgctcgtcccgcggtcgcgtgctccctcgttgcggggacgcgacgcggaggttttgccgcgaccttctgctgctgcttcggccgccggatttgtgcgctggcccggccgcccgtgggagacaatgcttggccgccgcggaccccggagaacctgcgctctcaaacgtggatgtgggaggcggcgcagagaggaggaggagtggatggcggcggtgtggggcggccgggacttgggagaacgcatcattttgtagagctccaacagctccacctctttcattattcgtctgtttggcagaacttttaactcctaaattctgctccagcagttaggtctggagtgaagttatgaagtagtctaaacccaactacatctctctagtttattttgtgagagtgttccacccaactccactcccatttctgatgaagctgaaactgtttagctagactctagctctaagagaggtggccgtggtgttggagctggagctgtgccaaataggcaacgtagataggctgttagatttgatgtttgtacgactacagttggtgaactataggtatataagatagatgatgaatgaggtttgtagtactgcagttggtgatgtataggatagatagatgatgaatgaggtttgtatagaactatagttggtgaactataaggtagaagaagaataatataaatcctacgatattagactttttagggaaaaatggatccagtaggccatcaatccagattttttaaaatttctttagaaaagaaaccccaatcccatgtttctccctctccacaagttaggaggaccatgggctcccatttcgttgatcccaaaaagttcgtgcatgggagagcgattgtcctacgatgtgcggtagctggggcagaattttagaaatatttttttaggtttattttgggcatgctttcagcaaacacatcaaaatgctaatttttgtaacatacaaatttacttctcttatcttatctgaggctccatttcgaacatatgattgaatttaacagaaacttagaggaagtagtttatcccagaagaattagggactgaatttcaaatgtaacttgattaattcatattaagctcttgattctcaaaaggaaaaaaaaatgattgtcctgaaagacttcagatttgtcagtgtgtggcctaaactgagtctgagaagacagaaatcttcatactgggattcaaatgatatgggccaagtgttaacgaggaggcattttgggccatcagattgggcttttttgagccgtcagatgtagatcggacaactgggtttctcatacggttttctataggaaaaagtacaccgaaggtccctccacttgttgtcgagataaaaaaacgtccttaaatcacaaaactagatatgcggggtcccttaactatacaaaactggtcacccgaaatccttcaatggttttaagcctacgtgggacccacgtgggccctcatgtcatactgtccacgtcatctctctctttgccgcgattcccaacttgattgctgcgctccctcagatccagcgcctgccaccgcccaagcctacgcgggatgccggcatgtcgccgcctccgcagccgcagccaacgacgacgacgatgatgatggagttcatccaattgaggtttggggggaggtgaccccaaacctgacgatggacgccgagggcacgcggctgctcaacctcaccgtgctgcagcgcctcgaccccgccgtcaaggacatcctaacatcgacctcaaccaatgagtgagcaatccctcctccctccctcctcgcggatccgattcggttgtttgcttggttggtgatcctgtgagctcactcatgcgctgtgttttttctttttcttttttatgtttcagaggcggaaggatgtggagggattgctcttcgttgtgaagaggtgattgtttagggttttggttggggttttgataccgtgtgagcctgtgatttagggatctgattgcttcgggggtggttttgtctagtaggaatactcagccgaggttttcccagcttcatcgtcatgaacaggcgtaaccgacgagctcgaccgcgccccgctgctcgtcccgcaccacgcc

SEQ ID NO: 36847 - DNA, 6267 bp, Oryza sativa
acctggcgaagaagatggtggcgctgggcgtggcgagcttgctgcaggggttcgcgtggcggcggagcacgtgagcatggaggagctggtcgggctgtccacacgccggaaggtgccgctcgtcgccgtcgccgagcataggctgccggcgcatgaacgtcggtgagcgaactacctagggacatttaacttttggccactttaaaaatgtggtaattaattatttgccacattatgatacgtgggcccgcatgtgtttatgacatatggatctagtggtaaatcatttagcacgtaagagtggcaaataattaattattccgaactaggttgctgtgaataagtaagaaaaagaagagaaaaaagaaaggggaaagagagttgacgtggcccgctgacatgtggggctcatgtgggtcccatgctggctcagctgccatgtagactaaaatcggggtcaaaaccactgaaggatctcgggtgactggttttatacagttaaggggacctcacatatctagttttacggtcttgatttcgggtgaccggttttatacagttaaggggacctcacatatctagttttatggttcgaagacgtttcattgtcccgatgacaagttgagggacctccagtgcactttttccttttctatacggcctcaaaacaccaacccttccgtagttctcgaactctctcggcggcggcggcggcggccatggagaacgacgacgagtgccctcccctcgccggagacgctgcacagtcctccgccgcccggtccctccgcgtcatcgcctataggggtcaccgtcatcactcatcaccgtctacctcggcgccggcaagtccacggtgaggttttctccgtaggctacgcctttaccgcttccgcacccactgccacttctggaaaacactctgctcggagaattgaggccgaaagattgctggcgctaagtaggatacgactcacgagattgctcaatggaagattcctggaggactggagcctgggggcacttgtgactggaagtttgatccgatcgggtttcctgtcgccatagctcttgctgttttttttttcttaagtttaggtagtttgcctcatgctgtgttggttggagcagtccccgtatctatttaagagcggtcttgtgagtagaactttcgtttcgagggctctgtttctcataggagctcattttcaatttatttgtagttgtagtagtataagaaatgattcgtcgaccgagctagttagctatcaattttgacctgtagttgaatgttatatccccaactgttgagttactagtttcttgaacaaaaaaacttaacgttactgaggtactcatggtcatggataaccttttacacagttgatgatatatttaggatttatacatgtgtttacaattttatcctgtgctttttagcagaatgaagccatatttttaggatatttcttatctcacaacagaattccttgtttgatctatcttggtccgtatcttgatttgaaattctaacatcagattacgttcaaaaaaaattctaacatcagaccattagtccttctgtcagttggtcatttactatttagcttatgttgacattgcttctactatgtctcaccttaccattttcctagcagcacctgtacttattaaccaagtgttctgtgaaatttcagtttgtaagttcaattaattggtatgttatgggatagcttatctcccgcgcatcacttttcagttagtcaactacattctgagtgcgcaacatgggaagagaattgcagtggtattgaatgagttcagagaggaaattggacttgaaagagcaatgatcaataaggggcaaggtggcgcgcttgttgaagagtgggtagagctggcaaatggatatgtttgttgcacggtgaaacacagcctggttcaagcacttgagcagcttgtgcagacaaaggaaaggtaagtacgaatattgctgttttgcatggatatgtagcatacaacatatggtcctactattatgttttcttccctcatattttctgtacaaagccttagtggcatgttctgatttgctaccgacattctggttttagctctaaaactatgtttaccctgtggcattttttcgttagttgatgtgattgcttgtttgttctagttcttctggaaatactaaaaatttgattcaaaactttgatgcacttacctgtgtacgctatgcactgatgcaataaagtggatcatgctcttactttgatctttcattaaaaaaatattggttttttttaataatattactagtttattatactatagtgccttgtaaattacgacggtacggattgaagattattatcctaatttgttaggaatcattctatgtgctgcagaatggattacatattactagagacaataggattggctgatcctgcacctcttgtcacctcttgtccctattctgtggctagacgaccagttggagtcatcaattaaattttactctatcgttatggttagttcaaccttatgttcttatttgttagtctggctgtatcacaagttcggaaaatgtgcctgcttctttgctccttactgttactctttggataaaagtttgaaggactgtatattggacatttttcttatatttattttttactgatcaggttattgatgcaaaagccttcaggctgcaaattgatgagcacaaaaagtcatcatcattccctgaagcatttcatcaaattgcattttcggtaacttggtccttggtgttatcatatttgtaccattttgtctttgctacaaaatttggaatcctttgtgttgattctgctgtgctgaaatttgtcctgctgatgaattccaaaatgcaaacaaccataataacagaaagcgtcaaactttccttaacaggatgttgtgatattgaataaagttgacttagtagaagacaatcttgaggatttggaaaggcagattcttgaagtcaacgctcttgttacagtggtgcagtctgtacgctgtcaggttgacttaaataaagtatttgatcagcaagcatatggtgccaaaggtcagtacctagctcagaacttgcattttgttatttcttttctttgtactcaatgcagaggaatctgtctttgattttgtttttggacaaaaaaaaactaacttcgattaattaattgattaagtttgacatcaattagtcatgtcaaaatatgggcactaaatctagtcatgccaagacatggaaactaagttattctcagaggtcattaaactctatagccataaacttcataacaaaagctctactcgttcagcacgaaaaattagtgttggtgagctattttttgggcatctgcttgctcatgctaactagcaatataggaatttgcttacttgcttttggtacatcttttgtagttattgcttttgctggcaatggcaccttgtgctcaaaaaaatctgaacgccttattcagggatttgattcttacatgtttttaatttactttccatagaattcatcgcagctgcaagaacttctggagtacagtaaatcagtaccacctaatccagtatttctaccttgtgcatttgtgagcaaggatccagtttcccggctaaggtattcttccattagatgaactataagaatagagttttttttttaactgcagttaacatttagaaaacactagaaaacacgcgtggctttgccatgcgcgagtgaatatattacatgaaagattggttccccattgaacattgacaccaatacttaatattcacgttagtgcacatcatattacaaataatctgaatatgtgcttaaaagaaaggtacaggagagaattatcacactgaaatggattctaaaactcctaccatacataaaactgaattatgctgccttcagatagactcatacattgctaaagatcagcttaactaatgtcgctatattatcattttgaagcttggaaaacatatctcagattcatcctaatagttgataatacatgcccaagcctcctccggtcctcctgctatcaccctgaatcattacaaatgcgcacggaactgttttaacagctctatgaaccaataacgaactaagcaggtgttctgtaaacaaatgaaagcagaaaatatgcatatataccagctactacccctatccaaaaatgtagctatttctagcacagtaacttatcctaaaatgaagctatttctctacctacactctcctctcaaccaatcacaactatagagttctcttcatgcagagcaagatcacgccatggaaggtcacatcatgaccaaggcgagttattcttctttcttgctgctataacccatccaggcagtctcggcgttttctgattcaagctacttgttgtttttttgttcttggcagaccaaatttgtgttcgcatctactttcgtcacttccaccctcggctactccgtcgccatcgcctacagcctcagcgggcgtgcagcgaagatgtcgctgatcaggccaaggcctgaccacgtcgccggcaccccaaccaacttccacggtcccgaccgctgggagaccggagatgaccccgactacgcatccacctggcttcagttcacccccgtcatcttctttcacatcgcgatcattggccatctctgcctcaagcgtccccgtgatgtgtttcaacttaccaaggtggcctcttgcttcgttccgaccggtttcgctctatgcaccctttcctacttcttgcagttcttgtgcctctcgaggtataaaatactccctccgttttgaaatgtttgacaccgttgactttttagcacatgtttgaccgttcgtcttatttaaaaacttttgtaaaatatgtaaaattatatgcctacataaaaatatatttaacaataaatcaaatgataagaaaagatgtaataattacttaaattttttaaataagacgaacggtcaaacatatttaaaaaagtcaacggcgtcaaacatttcgaaacggatggagtatttgtcaaggagcgggttgcttttgccatggcggctgtcgtggtggtctttttcaccttcatcctcatctgggtgaggattcttcttcttcttcttcttcttcttcttcttcttcacattctttgtttttgatccattttgtaatctctatctgactcttttttttccttttcctttttcattcacagggctcaccgaagcaaaaggaccttttgcaccgcaagaagaagcaacgcgaaggcaatgaaggtggagataaagaaaacaaagatgcagaggcaaataaagaggaagacgatgaagaggaaggcgaagaagaggaagagaaggcgaaggtgaagaagagcaagacgaaggtgaacagctaaagcatagaagcaggaggtcggcgctgcctgaggcctgagtcatattggcgcattttgatagaataatagctgtagtcgtcgttgtaggttcctgtatcttgatggtgtctgtggtagattcagatcgaatagttttatcttgagtccgtgcatcctgtccaacaaggaacagagttttgagttgcttgatcgtttatttgcagtcattcagtgactttgaactgctccatctatctcttgtttgcaatggaaacaatgatttggccccaaattatatgttttctctgcttggttgcaagtttcatgcagctagtccatacaccaaatcccccatcacctctccgtccacctccacacctatcttcaccatttcagcgaacaccatctgcgcgccccacattctctcttccttgcacagccatgacaccactgcccgggcccctcaaccgcattccgtcgaacaccttcatggcgtccgcgacaaggttattcttgaacaacgtcaccacgatctccttgtatgccgtggcggccggctcgagcccgcgcctctccatcccgttccataccctgcaggcctgcaagcgtcagagaacatctccacgcggcagtatcctacgaccagcagctcgcagcacctcccggtccgcgacacgccgtacgcccgtaccggtgctcggcctgcttgatcaccttctcggcgacatcgggcatcttgcagacggagcagacgacgtcggtgatgaaggtcagcgtgtgggggtgttaagaattggttgggctgtaaatgggctgggttgctatgtttccaatcagggcccaagtcagctc

SEQ ID NO: 36848 - DNA, 1621 bp, Oryza sativa
aaagagacatacacttgtactacggaagagggagatattatgcgcaggaaggcgaaatggctaccgggcgaacgttcgccaacttataatctcgcgaatcactcggaaaggaggattagaggacgtgtgatggagcgatatccgttcttcctttctaattttccttttatttacccgattttccgggtaatatttccttctttttagatttccttttttttccctagtcctttctatagttttattaacggaaacttttctatatcaattattcacgtggaaactttccacatataaactttacgtatataaaagttcaatatatagactttttatataaaaaaatctttatatggagttaaaactttatatataaaagatttatatctagaaagttcatatatataaaatctatatgtagaaagttttcacggaaataattttttaaacaattctgcatatgaactttatatagaatttatatatgcaactagaaagtttggtttataaatttcaatgaaaataaaaaaaaaatatgttaatcaacgctggatatttttggaaaaaaacagaaccttattatcaaagcaaacctcgtaaccgaaaaaggagaaagtacgtgtagatttggttttttaacagaagatcaacgctaatcatgattaggggcgtaattagacgtattaggcatggagaacgatggaaacttatcggttcgtgagattgtcttgtcgcgaacattcgtgggctagacccacccgcaggaaggcggaggaaaacaagaaagaaattgctagactcgtagctcttgaggggcttgagcttatatacagatgaaagtgagaagaaaaagttctcaagtaaaatgtatgcaacattcttttagagattccatccacttttttcccggcatatacttcaacgtttcaccgaagttccatataattaagaagattaacagcacgaaacgtagcaggcaaaaacagagaattgagttaattaattaactaaccccaaccaaacaacagagagaatagtagatcctggatcactgctaaaaatgtatccagataaggtgcaacagcattttatcttgttgcagtcaattcacaccagaatcgatcgaagcaaattagaggcaatcccatactggcaacccaacaaaatctcatgaacagtaaaaactcggtcgagcaaagagaaatatttgcaaaaccgaatctcttggattggaatactagatatcttaaaggtgctagattaaccggcctcccagcgatttggctactgttgaccaaccgccttgcgacacgttgctgttggctgggcgtcttgcgggccgtccgattctgcgtctgggcttcatccatccgtccgtgcctccctgttggtcgtccttgccgaggcgtcgatttggtggccgctgagcctcccacgtcgcccattcctcctctctcgccgtctcgcgcaatcgcactcgcacacacgcgccgcctgaattaaatttaaaaatatactgttcattcaatttttttcccataaatatccgggatacaaaactttttgtgtaaatataccgtcgatctcgcacaaccgttgcgtgaaaccgaggtgggtgtga

SEQ ID NO: 36849 - DNA, 1438 bp, Oryza sativa
cacgctctccactccgtttggtgcccgatctggttcgagggcggctggagctgatggtctaggcctccccaccggtggatctggctgcccttgcttcgggctccggcatcggggatggtgctcgtgctccctcgacttctccgtgcacccctaaccctatcctctgcacgatgcggtggcggcgggagggcgggtgaggcgcatgtcaaatccaccaccggtgctcccctctttattctctttccctctgtggcggcggtgacgggggacctacgggggcagcggaacccgtcgcgcatccgccgccgatgcccctccccttagggcggcgtcggaccggccgccggcgcgggactgtcgtctgccctcccctgcctcgcgcgagtccatggacatcgcatagccacgggagccaagggcgatacatccaaagaacagctggtatgccaggtacgtgcatcactgcgtctcctctggttcgagggctgtctaagctgatggtctaggcctccccaccggtggatttggctacccttgctccgggctctggcgccggggatggtgctcgtgctccctctcgacttgtccgtacaccctttaccctatcctctgcacgatgcggtggcggcgggagggcggagagaagcagctatgccgcattagctcttcgctggtttcagaaactcaacttgttccaggtatagttccaggtgctccgtgctcgtcaggactgaaagagattatagatcttatttggtgattcgcaggtatgataggctttctcccacttttgttttcctgtcatgacatagaattagtgaagagaaaaataatgcatggcggataaatgattgcaacttgcaaggcagcatgctgaacatgcccagctcagctctcttttgcttaggaaattcttggactaggagatgtgtttacggtgcagttggcacatgcgttcagttgtcaacgcacctaaactcttccccttttgtttggatcaaatgaaggattgaaaatatgtgactcttcctatcttaattccatcggttggctagctccttctagcccacatatttttaaaaaaaaaaaattcttggactggcgttcccagccttgagtacactgaatcgcatagaaagtactcatctcatattttcatgtcatgtagcatcgaatcctctctatgactttatggatctacggtttttgtttaggtttcctgttggtacttaattagagttgtttcttgcatattttacttcagattcagtcaagatttgaagagatcttatgtgataattaacaggtctgatgaccttgctcccagttttgtttttgtgtaatccgtttactgaaaagtaatgcatggtggatgaattgttgcaagaagcatgctaaatacgcactgtactgtgcagaagttctgcagtgcaggaca

SEQ ID NO: 36850 - DNA, 1522 bp, Oryza sativa
atccccatgaaatatgtaacagatcatgacttgggtattacgtttccttgtatattacggaacggcctaaagtcctggtttgataagattgtaaagtagagttaggaaaccgataccgtattggataaggtttctatcttgtaatcctgccccccattctatataaggtgggcaggaggccctctagagggcatgagacaacctgatcgtcagatctatactacacccggcggattcaaatccccaaacaggagtagggtattacctctcattgagagggcctgaacctgtctaaatcctttgtctctgcatccatccactttaggtctcgtacgctacccccttttattattgccgaattcatgtttcgacactatccgacctactagagtcgttctgaccgagcctagccggtctgactgcaggtcactcggcagtgaccgttagccctaaaaacagcctgataatgcttctgtaaaaacttgatttctcttaaaccaaccgttggatcgaattgcaaacttgacagaataaactagacaaaccaaggaacaattccaccggagggatttgcaaagtaataaacggtttaagagaaaacatcctcgaaagtcagctgtctcggaattttagcaaatctaaactaaacctaaaacttaaacaaattcaaatctacaagaatcaatcaccaaaactttccaaatctgatctataaagtattagaaagattttgaatagattaacttgaacaaaatcgtagcaaaacgaacaatcacaagctaatgccaaaaccaaacataaacgtaaaacttacaaaactggaatagatcgtctatgccttgatgattaaatatgatatttattgttcaagtatattgttcacaaggtgcagccacaacacctcttacaagtttctcatgaaaccctctctaatctttcaaacttggcttaccctcaaggcatagcctctctctctatttataccgacaacatcctacacaaaataggaatataattcctagttccacttaactctaacctcaattaccaaatcacctaaaacctgcggccacacctgccgctatagatggccatatggcccgaggcccacggcccggcacgaagcccgcaattttggcccggcccaagcacggctcggcccgactagggtcgtgcccgtgccggcccggcccgacagccgggccgtgcctgggctgcaccctcggcacggtgggccggcccggcacggcccgatcaaataaaaaaaatatagggacaaaaaatagacttatataatcgtataaggcatggcccaagaaaataggtatacaaaatagacttattttccagccatttaaacacaacccacagagttgagggaccaaaaatagacttatttccagccatttaaacacagcccacagagttgagggatcaaaaatagacttatttccagccatttaaacacagcccacagagttgagggaccaaatataaactctttctgtgaggcagcacaata

SEQ ID NO: 36851 - DNA, 7177 bp, Oryza sativa
tgagccgactgggcttgccacatccaccgagccaacacacatgtatcaacagacatgcatgaataccacacgtatatgcagacacactacgcacacatgcccatactgcatgatacagacatacagtaccatcgctacagtacatcgagtactgtagcaccatatcctcctcaccaatttctcaaccaatttccttcgcgaacaccgcgcacacctcgtgaagcccattacgaagatctctcccacacggtatccatccaccgtatgtcatctcgtatccaacttcgtcacccggcatccttgaccgtctggatctcaactcctccctgagtctagtcccgatccccaccgttgaccgaatttgacctccaagaatcctaactctagtcacattctcacatggtatcccgaccacactagacctctactcctccccaagcatagtccctgtcctcaccatgcattgaccaaagctaacctcaagtcacctgcacacaatcagacaaaacaaccgttcttgagtacatatatcacaacctgacccacattagtcaaatatactcacaccaacatctatatatcttttcaaaaccaattcatcgaataaatcatttttcaaagccaattatttatcacataatattaataatattaatcatgacaatgattttacagcatagctagagatcggttggatgactgtgctagagtaacagattaatctagaggcagtaaagagatggaaaaaaccatttgagtttgacttaaaagaaccatattcatacactccgtagtatatacagaagcagtatatagagtacggttgtattgtatgccgtcaagtttcaagaaaagagcatggttgccttacgtgtgctgtgtacacatacgtacatctcggacgccggattgaagtcgtgaagacgtgtcacgtgtccgtgaacgcgccgccgcagtgtcgtcctgctcggctgctcctctcttcatcacggccacgcggacgacatcgacgggcgcaataccgtgagatattgaactatatgccacttttagacgtggcaattaactatttgccactgaacccacatgtcatagacacatatggacccacatgtcattgagataggtgtggcaaatagttaattgtcaaatctataagtagcaaatagttaaaagccccaataccgtcagagggcttcggaaggaccgcccggcacccgtccgcctcctctacctcctctggctttgggccacagccgtggcgcaaatattgtggaagtggtcaaccgcaacctcgatcgtctacccctgtgttagagcaggtataataactggcgataggggttccacttaaaatttttcggtgacgtggagtggaggagagagtagggggagagagagaacgaatttgtcgcccggctctacgcatgacccgaggtcgtgggcctgcatacccacttcgcacgcgtccgtcgggacggcgccctcgtcaccacggtcgttgcctgcgtccgccaccatcgtcctctggcgccgccgccgtcacttgcggccaccgccgtcgtccgcctacgtcgaccaactgccctcgtccggctcgactggcatcgtcgcgtcgtcatcctcatccccctgtggctgccgcctgccaccgtcgccctcatccccctgtggccctcgccgtcgtgccgtcgcttgcatcctcagtcgtggctctcgtccaccgcagtcgcagccatcatcgccacccacgtccgcgcagttgtggctctcgtccaccccggccatccccgtcgccattgcttgcatcctcggccgtggctctcgtccaccgcggccgcagccatctcgtcgcctgcaaccgccgcagctgtggccgttgtccaccccggccactgccgttgcgccgtcaccatcacttgcgtccacctcggtcatggccctcgcccctgcggccgccgttgccgtagctctcgtcccgccgccatcgacgttgctgctgctctcatcccgtcgccgccactgctctcatcccgcatccgtcgcacaacctagctgtctttgtctcccgcgttatctacagggtcatcagcccaccagcttcgtcccgttcctctcaggcgtatcctcacagccgccgtcgttcggcccaactgttgacgtctcccgtgtccgccgtatggatgccctcgttctacacagccactagcgtctcctgtacgaccgtatgcccatctccatctccctcacccgatgggaagacaaacacaggaacggacggatggggtaggaggaagaagagaatgagataagagaagatggtgggtcccccgaagatagtaaaataattgtgttacagtgtttctattgtagatattagctatactacttactatagatgacatggttattttttttggagctggcagcgggttgtattataaaccttgctcttaagaggcaatatatcctatgcacacatgctctcacatgtacacacatgcacaccaactaacaaatgtcactaaaaaatctagaaaaattcatacatgtattttcaatagtattatacttagggttaaaatcttaacttcaaattcattatattttatccataacgaaaaaaaaaatctgacagttttaaggttataattttgtcagaattttatttttttgttactctttatgtagaatgaatttgaagatgtgactttgcacatagatgtaatactattagaagtacatgtatgaatttttttagatttttttatgataatttttagttggtgtacacggtgtgtacacgcaaaggcctgtgtgcataggatacgctcccgtgttgggatcctgcaatgggcctgcctagctaagtgcatatgagctagtttaaccactcttcaagcccagcccaagaaagcactcttagttaatgtcaaggaagattggccaacatcaatatatatacagctgtagaggatgaggaggacatcgaagaaacatgcaacggcggcggctggcctcggcggctagacgaacggtggcggtagcttggttcggtcaaacctcgtcgatctctctatccttcctcttctcctctatcatagaaacttctagtacttgtctccttagcagcttcttcttcttcttcttcttcttcttcttcttcttcttcttcttcttcttcttcaattccaccatcaaacactgagagttgagtgaatattgttgtgattcgaattaaggattcgggttgctaacaatctggtatcagagctgtcgattcgtgggatttctagcatggagtcgatgggggagtattgccacaacgccccatgcaagtggttgccaaatttgggcaagggtggtgctcatggccccaatgcccacaacatgttcgatggaatgcatagccaacctgagatgtccaaggaagatcaaaggatatctgaccctattcccattaattccaccatgaccaaagagagaaaatggctagccgatgctttagattggatattggagaagtttgaataaatggaggccaagtgcatgcaagaggaaaagatcaatcagatatttcaaaagttggaggagatcgaggtttgtaggagcaaggcttttgaggaaatgattgtagctatcagggcaaccaccgctatcatcaagggtgcatcatttccaacacccatggcaccacctcctccagcgcccaccaactgtttgatggaatgacccaacaacaacatcagttgggtggcaacgaattcaagtctcattggtgaggtgctttatctgacagctacctgggagttaggagacagaaaggacatggaccaagctccctacattgtcaccaaggacctccccaaggtcacgcccaccaagtgttcaacgctatgttctagctccgacatcaagcctgatcttatcgtggatgtggtgcttacgtgtgccaccactgctgtagcctccagggagtttgtattggctgatggtaccatcgataccatcaacattagcaccccagttgttccaaagagatgcacaccaagtgttcgacgttgggccttgacatcaagggagactctaaccaagttgtgctcgcgttccagaccatgatgggtatatctaaggttgttccatcatctgttcagccagtggagaatttctcatcaagaacagtcaccgacataaagctggatacaccaatgctcaacacgtgttcgttgaaatgccccagtagtgataagaggccgctgatagagcatactgagagaaatccatggccacctccttggtcagctggagtgactagaaggtggaggtgtggcatgtaccttggtccgtattcaatttcttttggaaaagagtatattttttgaaagaaatttgaaaagagtatattggaaaccaccatggcctccacctaataggaatgatattatgcacctcctgactaattcacacacatttgtaaattagagaaggcaaatttggctaaatttaaagcaagggaatgtgaaatattattagtgactgagctgtcttaatctgatgagcctattcaagttgggtgctgggaacattttgcatgcgctgcaaatttcagttggcaaggtaccaactaactacaatgcaaggcaattacatgatcttgtcagttatcctctcaagacaaggttttctgtagtgacaagaattgaatgccaaacacactgcacattgggactagcaaatggtaagattaaacatgagtgtttttgtgatgatgagagatggcttcatattttggtactcctaccattgattatggctacatggaaggttgacaacagtgcaattctaactagaaatgttgtccggatggcttttccttttgtgcaactccaaacaaggcaaggaaagatggaggatgatgtcaatatggacataaattcttcaactcaagctgtcaattctctgttctgttgcaaatcatctattaggagttcctcaacttgttcttccatggtacaaattcatgccagtaaattgaaaccctgtgatacactcactacaaggttttcgggctaatgccacaaaattttgggcaacaacgtggttttcgttgcaatacataggggttattgctaccgaagtctaatttggttgcgataggggggcatattaccactaattgcgtagtgttgcgattgtaatttgtttttgttgcaataagtaggaagtatcgcaacgaataaatttgcgttgtaagtagggtgacaatattgccgcgctttttgttatcgttgcaatagttatccatgccgcaacgaatttggaccgttgttattaaagtcttgtttataccaccacaaacctccttttggcaaataattcattaggattggcaccttaaccttaattcgtgccaaataaaaaaataggtttggaaccccaaccttaatcattgcaatcattcttaaattttgcaaccaacaacggaaattcgtgccactaaccagggtcttttccaaaaatttttgtcattgctatagtttaacgaaatcggtgccataagtgaaaatggtggtgccaccttcaaatatgtcatgggcctttgtattggtaaactttaagttggttacatcaatggggcttcggtcggggtcatgaattacgtaattaagtcgacccggccaactagatgggttgaatcgtgtaaaaaaacaggtacgattaaccctacccttagtagtcgatagatagataaccatgatcatagactagctgggcgccgacgaccctattatatcttacacaatcgccggcgacgctgaagcactcgacgctggcgagaccacaccctgtccctatctcccaactcgatatctcgacgccgtccgaatcgatccctatatttatatatattcaggtacctcttcgatcacgagtgcaatgaaaactgttgattctttattttctatatatctatgtaattaaaatgagttagcaaagaatttttttagattaatggaagaagcttggaaagaattatacccagggtgcaaggaggctaccaaggtatctttcattgtcaggctatttcagattaagtgcatgtatagtatcagcaacaatgccatggagcaaatacttcacttattctgtcttttgctccctgagggacattgtgtcccaaatactttggataaagttcgtaaggtactccaagatcttaggttggactaccaaaagattcatgcttgtgtcaatgattgtgtgttacttcgtggagagtatgataagatgaacacatgtcccacatgtggggagagtaggtggaaaaatatagattcaggagaactcggggaagggagtggcattggaggagcaaagaaaaaggccttcgtcctcgtaaaatacttaggtattttccacttattcctcgacttcaaagattatatatgaatgagaccacatcgacctatatgcgttggcacaaggaagaattggttgatgatgggaaagtgcggcacccagcaaactcattggcatggaagcacgtagatgaaaagttcagggatcggtttgcatctgatccatgcaatgttaggcttggacttgcatcagacggcttcaatccatttgggatgttgaatgtgacttacactacatggtcggtgatcctaattccttataatctgcctccttggttgtgcttgaaacaatcttattggatgatgtcgatgctggtacctgggcctagatctccagggatgaacattgacgtatatttgcagccgctgatcgatgagcttaaacagttgtggactgaaggagttgaaacatgggatgccaaggtgaaaaagaattttacgctacgtgcaaatctgctctagacaataaacggttttcctgtgtatgccatgttatcaggttggagcacaaaaggcaagtttgcgtgtccttattgtcacaatgatactgaatacttgtggttaaaatacggcaagaagcactctatataggccatcgccgctttttggcttcataccacaggtggcgaaagaacaaggttagcttcaataacaaggttgaaatgagggggcctccagtggcactcaatggtgacgaagtattgaagcagtacgagagttttgagcaagtcaaatttggcatgacgtcaaggaagagg

SEQ ID NO: 36852 - DNA, 2928 bp, Oryza sativa
  unsure (1)..(2928): unsure at all n locations
taaggatagtgagaaggctcgacttgatttgcaagaattgggtattaggaaggatcaaaatttattggtccatataggaaaatacactttgccggcagccttgtacacgttaagtccaagtcaaaaggaaattctgtgcagatttctacaacatgtcaagatgccagatggttatgcctcaaatatcaggagatgtgttgatgaaaatggttggaaggttagtggacttaaaagtcatgactaccatgttttattacaaaaatttttaccattggtggtacgccatattttgcctgaagatgttgtgatcccattaatcgagctcagcaggttttttaacgaactatgttcaaaggagcttgaggtgactgaaattgaaaaactatgcaattcgattggagagaccctttgtcggcttgagatgatattccctccatcattttttgatattatgatgcacttaccagttcatattgctttggaggctagaattggaggccctgtttgttatagatggatgtatcccattgagaggtacctatgtacccttaaaggctatgtgaggaacaaagcgtgtccagaaggatcaatagcaaagggatatatatcggaggagtgccttactttctgtgctcggttcttcaaagatgttagtacaaaggtgaataggccagaacgtcaagaaaatagccaagtcagtgcaccacctgctggcctaagtatttttgggagcatgcagtacagtaagaacaaatttcatatcgagactgcatcttattcagacttgcataggatgaggcactacataatatccaaatgtgatgaggccatgccatgggtaaagtaagatatatttatgtctgttatgagtgcagagtgactaaggaactcatcattctgctaatattttcaatgttgttgcagtgagcatatggagaaattgaaaaaaaacccaacaggggtaatgttgataaaaggcacaaggaacaatttgtatcatggtttgagcataaagtgagtgtttttttattaatttcatcaaactaattgaaaatgtgactgatcatatgatcgaaatttttctgagtgcagatgaacattcttcatgcagatggaaaaacagatgaagatgtatattctctatctcgtggtccagatcatcgagttcatgtagctaacaggtgctccatcaatggatttctcttccgcacaaccaatgtagagaaaaacctaaccacacagaacagtggtgttgttgttcagggcgaaggcatggactggtacggagtgattaaaaaaatcatcgcccttgatttccccaacgacaaagaagtcttgttgtttgagtgcgactggtttgatgttccgggagcaaccacgaacaaatccagagggtacagtaaagatcaatatgggattattgatattgacaccactcggtttcgctttaaagacgagccttacatactggcgtcacaagctcaacaggtgtgttatgtgaaatgcgcaaagaaaaataattggtgcagtgttcttagaatgaaacctcggaacctgtttgccatgcctgaaagggaagacggtgataataatgttgaccatgctgatgttgactcacttgttgtaggagtggagcagatgaatgtacaacaccgacatgacgatttcacaaactggagaaggtctgacattgaaggtgttggtgacatggagccgggggtatcgtgactagaggcttgggtagccgcggtcacccacgtggcctgaccccctcgggggggtcgggcccgagggtgacgtggccacccctccctctgtctccccgaggggtcgggccgctcccgtttcggccccgagggctggggcgcnccgaccccctgtggttttggcgccacgtgtgtgggttaggtgagcacagtggggctcacctaaccgcatttatagcaggttggacgagcgcaccacgccgcatcaatgcggcgcagcgcacgcttatccggtccgtgaccagtcgcggtgtgtgaccggtcacagaccggttagatcgcgggttaggtggcaacaggcggcctgtcacacgcctcgccccgtcccgtcggaatgatgagagcttcctgactctcgtccctagccggagccggcgtgctaactcctggagttggtatgtcagtcccggtcagatccattccagggttcagcgcaagtatggcaaggaagtcgctggccattaaatgaaggttgaaatgggcgtccaccggaaaagcaggcgaacggggcaggaggcgcgggctttgcttgtcacaagtcacttccggctgtagactagccctcattgtaaaaagcatgtttccctttttaggcagctagaggcccctatggtgacccctgacagataaaaagaggcccaggcctaaaaggaggaaagaaaaaagggctctagagcctgaactctcgctcgctttcgagctctctgtattccctcacgcacagatccaccagaacacaggagtagggtgttacgcttctcagcggcccgaacctgtctacgtcgcccgtgtcttgtgcacttcctctctcgcagacgttcctcagatcgagggcgaagaacctcacttagcgcctccggccgaaccggcaaaggggggcctacgcggtctcccggtgaggagccccacgctccgtcagaaggtattagtggtgatgctactgtaattgaggaggtgcgtgctacatccatgcctgaacctgatgacgatgacatacctgacgaagatgatgaatcggacgacacctacattgctgacggactccaagacacaatgtatgtataacatgtgggaccatatagtaatagtgtagtatatatttatagataattattgtataaattggctattaaatcaactatagataatttgaagctaatag

SEQ ID NO: 36853 - DNA, 2060 bp, Oryza sativa
caaacatttgacactgaaacccataacaacccttaaaatggatggggggagtagccaggaaagtaaggaaacaatcctcatgggttcaataattcctatagttcaacaaatattttaactcatcactcattcagtcattatttcattcctcatggagatcatctcaagaataactcgcttaggtccaatgttggagatcggcccctccaatcctctatcattccccagtccaaatcccctctccaaatcatgcctttatccaccaaactctattctcatctgtcccctcaatgccgcctcttcctcgccccgtcggcctcctccccacccactagccagcctgcccaaagaagagtgagagacaggagggagataggaggggaaagagagagtgatgacgtggtcaccctgacatgtggaacccatgtggtttccatgctgacttaactgccacattgaacaaaaccatctaaggacctcccatttttgttagttgaaggatgacatatatccgtggtttcggtatgattttgtaatccgatgacaaggtaagggacctcatatatactttttctctcggtgcatcctgcgcggctgcacccacgtgctacctctgctttccggcctagcccgtaaacctaaagggccgcctctactcccattggatatagggcgggccaagagcgagagtgtacgagtacgagaagtagagttttccacttctccttttcccttgtactccctccgtcccaaaataagtgcagttttacactatcacattcaacgtttgaccattcatcttatttaattttttttatgattactatttttattgctattagatgataaaacgtgaatagtactttatgtgtgactaaatattttcaaaattttcataaattttttaaataagacggacgatcaaacgttgggcacgaatatctacggctgcacttatttttgggaaggaggtagtacgagaggaaagcaaaagcacagaactgggcaacatatactactacgggacaaacttgcaattgaccagttctcattcacgaggacagacaagagatagagcgcgcgcgcgcaaagaacatatagatgcagattatttttcccttagtttttagttagctaaatttttaaagtgttaaacagtatgtttcgtgtgtatatatatatatatatatatatatatagttttaaaatagtaaataaatcaatttcaaaatatgtaataattaaaacttaattaattatacgttaatgaatacgaactggccatatcatagtagagtgatagcaacatattccaacatccaggtgtgaaaaaaaaatccaatgtcggcacctaatactaccagtaagcgagtttaagttaactactggagtacttagtactaatcctacataggactataggagtgcctgtaattattactaggacgagtattgaggagaatatcaagtggtttctgtgtgttttgttttcaaaggggaataaagttattcttcttttaaagttgatcttgtactttctaaaagctgaatccaaaagatagttgatgagatcgagtagcagcgagccaaccctgactagtaactccggagaggaaggccaagaatccaatcatgtgtctcgtctcgtctcactctcgcctccaatcatgtttggttataaaactggccccaaaatcacattggaaaccaaacgcggaagaaaataccataggagatccaaacacgatgacgacaccgaggcacgatatttaataacggagttcagccgaggcctacatctccggggcactgattacgggcgctcctccccgatccagcatatacagcgtatcagagttacaacgactcacggccggtcgccgccggcagccgctacctctcgctatgctaagtcgccatgcggttacaacaggcacgcccctttattttatgagagatcctaggacagagtccgactcttactctagtcctatacctagtacaactccaagtcctaaactgtaaccgactacgtacacataatcgcacaaactctaaca

SEQ ID NO: 36854 - DNA, 4364 bp, Oryza sativa
aaaattagcaccatagcgtatgacgcagattccatatatccccatcatgcaaaccccgcagatcctggatatatcctgtactgccagacagcccgttgatgctctcaacgattttcacccgttgttgcccgggactttttgaattaccctattcaaatcagattcaaccaatcggaacacactgtcaacatgaatcatgaacagtgtcgagccataacagtaccaccgtgaacagtaccgggttgcaaccaaaaccgacccagacactgctttctttgtcggtgaaaactccaactgccaccaccgagtacaccacggcgaccacgctgtctctgctcaccgataacgccgtgtcgcctctcctgcaagcagctgcaccgctgcatgttccaacagagtcaccgctacctccgatctgaactagccggtaaccgccgcctcctcaccggagccggcccgcatcgaactcgccggcacctgcacaacgactacaccaagtcatgctcctgccacccgacgttcgtcgccccaaatcactgccgccaagaggtcccagtccgatctccttttgctttgatgatttggttcgattggaatatctgcaatcccgtggattaattcctgttgctgagtcctgggaatttgttgtccgattttaagtccaaaccgaaaccctcttccttttccctttcgtgtgtgtccaactaggcctcctctcctggactacttgccacaaacgccgccgtgaacgaacaggatacaactcctgtccgtgttcaactccaacactgtggctccgtcctgattggagtcctgtgcaaccatgactcctcccgagcctgcttcctcttggcgttgcttctatcaatgccgctagcctggtctcaacgtgcggtgcacgcacaccatcgcgacatggacttccaagccttaacgtatctcacggcttctgcaccttcgcttctgcacttccggccaactccgctaatgacgcatgccatcagtttgtaaccaatgcatacgattgtgcaaagcctctcggttgaactgacatttccacgatacagtcagcccaatttgccgatctggtcgtcctcagcccgatccgcacgtacgccgccctcgaagcaattctgttgcacaccttgtcgaagacacatccaaaacagcctctagcatccacgcgtggcatgcgccaccgttgcggctccacctcgagcccgcaacccgctccgacctccgattgaccacctgtcaatatagtcgcgagccgaagccgacaaatcacatgccgtcttcccagccgccgaacgacccgagcgctacgtctagccgtctccctgtcgaacgcaactcatcgaaagacccgggacacccggcccagagtgttcgattccaccgatcgagaacgccgatcgcctccagcttcaatcaacccgagcgtgcggccgcacgtctccctgtcgagagtagctcaccagaaagttcgagccacctgcccgaagtgtctgacccaccgattgattcgccaatcgcttccgccgccaccaacccgagcaccacgtctggtcatctccctattgaagtagccatcgaacggtttagaccgccgcctgaagtgtccgattccactgatcaaaattccgttgatcgccgccgtgctccactttgcgtccatgtctgtccctggacaccctgtgtattcgtcgcagcgtggagcacctctctcgtacctctaccatggatctcccgcaggctttgataccacttgttataaaactggccccgaaatcacattggaaaccaaacgcggaagaaaacgccataggagatccaaacacgatgacgacaccgaggcacgatatttgataacggagttcagccgaggcctacatctccggggcactgattacgggcgctcctccccgattcagcatatacagcgtatcagagttacaacgactcacggccggtcgccgccggcagctgctccctctcgctatgctaagtcgtcatgcggttacaacaggcacgcccctctatttatgagagatcgtaggacagagtccgactcttactctagtcctatacctagtacaactccaagtcctaaactgtaaccgactacgtacacatattcgacacaaactctaacatcttccacgtggcggcaggaggatcgatcacccatgcacccgcgcggcgcgacacaaacgtactccaacatcactaacatactccaacatcgacagggtcgcccaacatcgtaacgctggcacgtcgtcgtcccctcccacggtgcaccacagccgctgccgcgccggactcgacatgctaaaatgcttttatgtgttggcgtctagagtagtggtagtggttaggggtagatagaaagctcgtgactcgttagctctgcttggctcggctcggctcggctcgtttgaattttctaacgagccgagctgacattttagcttgtcagagataacgagccagctcgagctagctcgtgagccttaatgagctaggactccatcacagcccaaaagcccaatacaacaaaaaggcccaagcccaagacactgcaaaccctagtcctcactcaattccccactctcccccagccaccgccgccgccgggagatcgagcgcccgtcgccgccggtatctgcctctcccccgccagctcccgccgttgccggtctcctcctctcccccgccagctcccgtcgccgacggtctcctcctctcccccgccagtgcccgccgatgttagatcgggcgcccgccgccaccggtctccgccaatccccccacgcccgccgccgccgggagatcgagcgcccaccgctgccgatctccgcctctcccccagcgatccagcgcccactgccggtggggcccgcccccagcacccgacgctgccggcgagctcgagcttgtcccctccaagtgctggcggagctgcgtagagttcatcccctccactgttgagctccttcctatggtcgccggcgagctagagctcatttcctccgccgttaagctcctcccctcctccccgtgctcgccggctacgtctcttgccctagctcgcgagcttaacgagctggctcgagcttgttgacgagccgagccgagctagttttctagctcattaagataacgagccgagccgagctagctcgttattctaacgagccagaccgagccgagccagctcgacatccacccttagcagtggtcctatacgagtatgcgactcgtactcctaattgtctccatatggtagtggtccctagtgggcagccaaacgtctctcattcttttgcagccttaccactgttgcaggtagagcgtcctccttgaccaagcatctctctcggcgtttctcacccaccacaaaaatcgcttctttccttcctccctcatagagaaatttttatttttactactacttagtatatgcacaataattagtactacaatagtactgttttagttgtttttttattggagaacattaagtgctctatattcgtcattatgggccggctgataaagtttttttaaataaaacgaaaacgattttgctaaacatctcccgcgtgatttttttccacatttgacgtacatttgacgtttttttgccacatgatctttgcacaaggcatagaagcccacgaacagcccagcagcccatcatcatgcctaaccctgattgctaactccaatcccggtccactcactgccccacacgaccacgcccgcactcgttccccgttcacatcacatcgcacacacgccacgccgcttggatccgggtccgtggccagcacccgcaccgccgcagcacgcgatgcatttgataaaaaaaaatatgtaagtaaatatgtacttattattttctttaaaatataaaattacagttctatataactaaatttatatttgtaaattcagttgatttgacatgtaagtgcactgtaattttgataaaaatattgtgtaagtaaatatgtacttattattttctttaaaatataaaattacagtcttatataactaaaattacatatgtaaatttagttgatatgacatgtaagtgcactgtaattttgataaaaatattgtgtaagtaaatttgcattagttattttatttcaaatataaaattacagtcctatataactaaaattacatatgtaaatttagttgatatgacatgtaagtgcactgtaattttgataaaaatattgtgtaagtaaatttgtattagttattttattttgtagtccgttggatgcaaatccaagagaagaaaaaaatctgggtgattttttctcaaaaatcacccgagtgat

SEQ ID NO: 36855 - DNA, 638 bp, Oryza sativa
agaggagaaatacatatttataaatattttaaaatacttgattttttctcgagtattatatttatatcagatactactcatcctatatgtttgttctgcaggatccagatccagatatgcataaaagggattcatggctttaagcttatctcttacgctctaggaatggatcagtcagaacatcaccaccggccgcctcgtccgccgccgactggtgttttcgcctgcacggttggcctattatgccgccgttgttgggcgtctacgtcttcaccgaccggccgcctcgtccgccgccgactggtgttttcgcctgcacggctggcctttatgccgctgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccaccgactggtgtttccgcctgcacggctggcctttatgccgccgttgttgggcgtctacgtcttcaccgaccggccgcctcgtccgccgccgactggtgtttccgcctgcacggctggcctattatgccgccgttgttgggcgtctacgtcttcaccgaccggcc

SEQ ID NO: 36856 - DNA, 514 bp, Oryza sativa
caaaatatttgaacaaatatagtggtcaaatatgacaagtatactcaagaggctaagcattatgatttcctatgtatgcactgaatttcgtgcaccacatgttattctgcgatgctttgtggctcctagattgtgtttgattaagattgcttgataaaaaaaactataatggtaattaacatagaaacaaccatccaatcatgaaaaaggaaaataggtctgactggcaggtacattgtacataagctgattggctgaggttaattaacttatttcccaatgccttgtttagtgctttcttacctctgtttgtctgctgagccaaccttttggggcaaggttttagttggcatcatgccccaggaatagatagctgacaatttatttgcacagttagttgaatgtggaacacttcagtttcacttcttacctccatgttgacatgatatatatctttatcctgaagcattgactttggaagttaaagtgatacccaaatagtctgagaaaagat

SEQ ID NO: 36857 - DNA, 1121 bp, Oryza sativa
acccttacgatatggtaaagaccaagtcttgtacgagtaggactcctcccatctgtggattctgttcctatcacgtgatagatttccttaacgtatacagtaactatccatatacacgcgggtataccgtatcagtatacaacgtacatccaagaatagagggtataccttatccgtgactctgacaatttccttcatgcatcgggcacccattgataagcattttttctttcttaaacaaatatctatgaatatgtgttgaaaaaatcatgtgacttataggaactgaagtgtgccgtatatgtgcctaataataagaccaaatatttttcgggttttttgcaccaacaaaaataaaaaacaggtacacccttacaagtgtcgattctatattagaaccggcaccgtgccgttttttgacaaattgatcctttataaaaacttattttgaaaatagcccctgccaaaaacttcaaccaaaactaagccgtcggctcaacgccatcaaggttggcgctgaggtataacgtctcagcgccgataatgttggcgccgagatttttgttgagctggcattgagccacgtggcacggcctagaattcacttcaaattcctgtgaaaccatagacaaaattcaaattcaaattcctctcaaatatcctcaaaattcaattctacaaaccttgagaaaataagaaagttcactgttcattttgggcctctcttcctttctctcccaggcccaactctcctcctccttttctcggaataactgcactttgactccctcaaaagtgacctgaatctaattcatgaccctaaaccgcaaaaccggatatctcgacccccgaactattaaaaccggtgtaatttgactcctttggtggttttggaggatggtttcgctgacgtggcgctgacgtggctgtgttgacctagtctatgggttaacgtggcgcttaggtggcatctaaattaaaaacatataggtgggacccgtttgtcattcacacatataaaaatttgtgggggccattggcatatgggccccatatgtcatcctctctctttctttttcctcccctcttcctccattctctctttctctctttttctcccc

SEQ ID NO: 36858 - DNA, 1628 bp, Oryza sativa
  unsure (1)..(1628): unsure at all n locations
aggatccccccgcgctgctcgccgccattgttggcctactctgagaagttcttcatgatgttttttccgtcaagagctacaagactagaagcggagccactgagacgtatgcccctgtatgcctaccgattttacgttcattatcgaagtaccaatcattctccggtgcgttggattctactccactatgtatagatggccaaaatgagtcgcccgacacggcctggccgggacacgactaaggcacggtccaagatcagtcggaccggctcggcctgagattaaccatgtcgcgccgtgcccatccacggggggcgcctacacctatatcccaggcatggcccaataagactcggatcatgccatgctggctcgaaggcacgactagcataccggattgatccttggaataagtttattttgcctacctaatttttttaaggccgtgccttatatggctagaataagtatattttaccccctcacatctttatatcatgcattatatggctggaataagtctatcttgtatccctcatctctttgggccagccgccaatgggctatggcgcaagctaccattgagcccgtgcggcctgcgggagcgaggtaccgttgagccgtgttgtgcccgggacggcacgacgttgtcgtgcaaaggaagaggcttatgcgtagcccaatagtcgggtcagactggcacggggccgacaactgtcaaaaaataccatacctgggctgggccaaatctttgtgccgtgtactgagctgtcgagctgctggccttttggcccactatactatcacccatctatggctgacgcnntantntgtactcctttcatactcgtaagannagtcgtttaggacagcgacacgatctccaaaacacaactttgacttcttgtttctataaaaatatttattgaaaagtgatatatgtatactgttatgaaagtatttttcaagacaaatctatacatataatttttatattttcaaactcaataatttgggagttattcatgatttatattcctaaggtttgacttaaacattgtcttaaacgacttcctttatgagtatggagtgagtacataagattggttgcgaagcaccccgcctactagcatagaagaggaccccgaaaagttggccctaattgaacaaggtaacaaaataaagattacatgcttttgtttggatcatgtttcagaactggttgcaaaaaaagattgttgtacttccaagcccccccatggctcctgcgtccaagcctagttctcctaatccctaaaaatcttgtacgtatcaggattcaggagatatcattttactagcaataggaggtggaacatagtttttctaatcttgattaatttctttggttttcagctttggatgtgagctgtggtatgctgaatttggtgggcagctgattgcgcagtcaactaatcaagtctacttttggccaatacttaagctggggtttcttgtaacccagttttgctgtaacttcggcgttcaaaaaaaaaagttttgctgtaacgttgctggtctgctgcacatgtattgcagtatgaactattgatattcatgttggacgtttgttgttgcttgtcagacag

SEQ ID NO: 36859 - DNA, 265 bp, Oryza sativa
aatccaagatgcactaatccgcgacggccgtacagtcaactagtaacaagaaagcatggtggcgcggcggggggaggaaagcacgggcgcagcattaccgcacgatcttctcgacgtagtccgccacggtgacgggccagtacggccccagcgccgccgtcccctccacggccaccaccagctgcctctcggccgccgccgccgccatccccccgacgggcggccccgccgccgccgcacccggggccaccctgccgactccccg

SEQ ID NO: 36860 - DNA, 923 bp, Oryza sativa
aaagaggccatgacaggacccttggcataaccccctctagccaagcacaccacacctcaggtttcacccccgtccccagcgggcaaggggcagtcccctctcgtgcgtaggtgaatccggaagcgacagaaaccgtcgcagggcccgccccgctccatcacgcccacctttgcctggatgcgtcggctagagaaaagctacactacaagtccagccgttgcccacgctggcttgtggtaagtacgataagttcttccagggcatcccgcgaaccggtctttaattgccatgggtgcgactagcaaaaccatgcacccacagcccatcattcagtcgcattttagttggataattacgaccatgaagcatggccagatgtctcgagcacgcagctcattctgatactaaaaaggtctaatactgtaattatcccatcaactgagctagtgctaattaagcatggctaagcatatagttctagctaggtcacataagtaatatgagctagtcgatttattacccaaggttgacaaagaacagatatcaagtaaacatggcacaagcaagcagataggtaatacccggatcccatgtaattagcaaaacatgcatatttatttgtaaacggtaaaccatttataaattgggatcaacatgttcaaggggaatgtgtgacttgccttgcttcttcacttggatcttctgaactcttatccttgcgaacgcgatcttccgaaacgacgggaactacacgctggcacgcaaaacgaggaaaaactctaataaaaactaaggaaacagtacataaaaagtaaacaaacatgtagagctcaattttagatgaattttgcaagttgaatggctcaattcggagttcgaatgaattagatatgaattttagaagttttgagccatttaaatga

SEQ ID NO: 36861 - DNA, 570 bp, Oryza sativa
cggagcggcgacagccgcgtccagctcgtcggcatcggtcgtgctgctgctggtggtggtggtgatggcatcgtcgtcgctcgtggcggacggctcggatgtggcggtcatggcgtcctcggcgacaatgtcgatggcgagtggaaacacagacgacgacgactcccgctgctcgaagtcctccaaagcccgcgccacggagcgctggacgtcggcggcgctgtggagggtggccgggggcggcacgggcgaggggcgaagcggcgaagttgaggcacgcggcgcggccacggagcgcgagcatggcggcgtcttgtgcgcgcgcggtggtgtcggcgccgtcgaacgtgccgagccagagcccagagcctgcagccgcggcgcccctcaaaatcaaattcatcagttcttgtaatcttgttctcctagaccctgacaaatgaaaactcgcagtggttcatctgaccaaaaaagaaacaaacagtgtattggtccttggtcgaattcagattcggatggattcacgagtcgaataatcaaatcaaacgcatgactagagtagactcgatc

SEQ ID NO: 36862 - DNA, 2444 bp, Oryza sativa
  unsure (1)..(2444): unsure at all n locations
catctacgagacacaagccatgccattattctatggcgcaaccggtacatcatcctccctgtgcgacaagcggcgtctcgtgcaccatgtgctccggctccgccatctgctgctcatgattctgcaccggctcctcctcatgctccgccagcaccgtctccacctcaggctccagcatcgactcctcctcaggatcctgcaccgactcctcctcgtgctcctacacctactcccccgcaagctcctcttccggcaccttcaaagtcaagggcccccccagctgcaccgcctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtccagaaaagaagattcttatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaacaggagatcgagccgttggttaccgggaaagaaatgacgatagaagaatttattactgacaccgatctaactacggatcaattgataggagtcgcaccaatcgaaaaggcggaagtgaaatacatgtacgaactcggtaaaccgcttgtcaagcttgagctgctgcagtccctacccacacaaatgtacaagttccatcagctgtacatggagatgagcgccgccggtagagagatgatcggagcgaggatcagggacacggacttcttgcaaggagatgacattctctggatcaatttcaagggaatctacgaactataccagctggacgccctcgacgtctctattatgagttgctggattttgtaagtatatcgttcggttagatttctactatacngtctcctttataaataggtcccttgtatataagtagactatagaaataatatctcccttttatcgttgtagaatgnagatcaaaggggcccgacgncggagggttttcgatactggattcatcgaccctcggagagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaactttctaagtgtttcatatgtaatgcatcccacgcacattgcagattccactgggtgcttttactcttcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatatctttaaactccatgtagggcttggtatcggttccgtcatttggtccgcggcaactaaagagaaagacttaggcggaggttcaaatttcctgtgagtacacatgctctacatttatatttctccgattcaaattaatacatacaactgtatattaattagatctcacgccgttaatttgtcatttatttgtagtgcgcaaagcaaaagcagggaactaacttgtgcggctactacgtgtgtgagtattgccactgccttgcagaccaaatcatctccacaagagagctcgatgtacgtacaaataaattcaaaatttcattacgtaacgatttcttgtttaattactaatcaatttcatacattcatataatttattcgcatgagggataacctgaccacacacaagaaatttatcgcagcggttcaagaacaactcatgggattcatcaacgaagaaatccttgatcccaagggtgaattctactacgacggaaacacaattcaccggtccttagcttctgagctagcagcgactactactacgtcgaaatcgtagctagctaggacatataatggattgtaattaatacatgactacatatgtttctatatgcatgtgtacacattttctataatgtaaatatattttggtcatatatatatctatatacatatgcatttgcataacatatatatgtataaatacatatatattatgcatgtatatacatataatataatataatatatatatatacatatatatatatatgtatgcatatatatgtattcaaacatatatatgcatggtttatatatatatatatatatatatatatatatatatatatataaaccatgcagcaacagggccatgcaaaaaaaaaaaaaaaggtcagctcgatctttagtcccggattggtactcccggtttggaaac

SEQ ID NO: 36863 - DNA, 2072 bp, Oryza sativa
gatttacagagagttacttctcaaccatgcaaaagttacttccaattaacattgaagttacttttattaaatgttaaacttacttgtgttggtgggtactgattaaatttaatttctagataaaatcatatttttatccctacaatgaattacttctaatatcgtgataaaattacttttgtgttgttttaagttacttttataatatatgtaaattacttttagactttattgaatttatttttatatgtctaagaagtaatttagtcaaatctaaaagtaacttatatatatatatgataaaagtaacttacgtatataataaaagtgatttacaaatataaatattttttcatcgtaatataatatgtaagatcttgttgtgaaagatttgtcagggttatggataccacatacctaacagtagttgactaaatctcggcaggacccactacatatcatgtcctatacggaagcaaccttcggatataggaggagttccggataaggaaagacgaccaccacgatcaacacacacaaaggatcaacacccaacacaatcgacatagaagccacaacatagaagcctacatacgccaagacacgccgccggatatcgacttcagggataagcacggctagtaccctacggtgtctcccgatactgtcaggagagaccgaagcgctatctttgatctcgctaggcacggattcaaggaggaagactaccctgttgttgactacgagtcagatcttcagaccgccatgtcgacaacagttagataggctaccccaaatattgtactggtgtgattatggtgaataagagcaatactggcttcggccaacaggatgtaggttaattacctgacaattcaggggcccgaacctgtataaaaatccttgtctccatctcttttacctcagtctcgtgtatatcctagcaccgacgatccccatgccatgcaaataccgtagtcgagacatcgaatgtcgacagatttaattgtaataaacataattgtaatcggattatagatcagataaataatttgagagaaacttttatttgaatgaagaggaaaaaggcatacatgatctattaaaaaaaaggcaggcaggcactacgttgatccttctcattgagccattagagcgcggccacgcggatgtacgtcaggacgacaagcacgatcgaacagctgtgaggcgtgtcgcgtgatacgactaaagcgagaagcctcttggtttagattttacgtaccacctaaggacctaaactaaaccggttttgtaagttaaggatctcatatattgattttctggttgagagacgattttatagtttgatgacaagatgaaggacctcgtacgtacttttccctatcatctaacagagcagcagcatgagatgaacccagtagattaaaagcccgcatgaaattaactatacagcgaccgaaacatttcggccgtgtttagttaaaaaataattcttcaaacttccaacttttccatcacatcaaaactttcctacacacataaattttcaacttttccgtcacattgttctaatttcaaccaaactttccaattttggtgtgaaacacagccttcgctcattggccggagaaataagttcatctgaggtcccttgacttgtcaacgaatccgattttcgtccttcaactgaaaaaccagatacaacaggtccctcggctgtcaaaaccagtgacataggtcccatagcggtttggacggtgtttttatctgacgtggtgcttacgtggcaattcgaccgtgaaaaataacaaaacctctgggacccacatgtcagcttcacacatacaataatttcaaaaaatggtggggcccacctgtcattctcaaatcccctctcttcttcctcctctctccctcccatatcccctcttttaatatctcccctctaatccctcctctcgccggcggagataaggacgtcctccattcccacccccatgggcctaccgatggcggccggcgcccctcttctcattgcccgctgcgcctgcctccgcctccggataacc

SEQ ID NO: 36864 - DNA, 661 bp, Oryza sativa
ggtgtccggtatctggttttgcggttgggggacgatttcgtaactcgatgacaagttgagggacctttggtgtaccttttccaaactaaaataacctcctctccatgtggatgggtcggattaggcccactaaaggaattaaaatcgacgatgcacgatggatgatggatatttcattagggcgaagctatagcaatttattggggttaggagaccccgatgatttcttatgagtccccttatactccttcctattttatagctatgaccccggtcaaataaaacactagaccccggtgattgtttcgttaaagctcatttggtggcaaggaacgatactattatcaactagcaaatagaaaattagttagcaattgtgattatacgtcagtctagatagatatacatatatgttttagactggcgctcataaagtggcccttatttaggataaccaactaatcctattattatttcctaattatcatcacaatttggttgaacctggtctctcaagtttgaatttgacgaaattagagttctgaaatatgaacgtttgatttttcaagttcaattacatgatcatgaagcatgagcctgggaaatataacaaaggtaattttcaccatataagaggttgttatattcttttccccaatat

SEQ ID NO: 36865 - DNA, 2680 bp, Oryza sativa
tgggcgtccaccgggaaagctggcgagcggggctggaggcgtgtgctctgcttgtcagaggtcacttccggctgtagactagccctcattgtaaaaacatgtttcctttcttaagcagctagaggcccatgtggtgacccctgaccagataaaaaggggaccaggcctagaagggggaaaaagaggggaaaaaaagagaaagaggggttctagagcctgaactctctctcgctctccggctctcggtattccttcacgcacagatccaccagaacacaggagtagggtgttacgcttctcagcggctcgaacctgtctacgtcgcccgtgtcttgtgcacttcctctctcgctgacgttcctcagatcgagggcgaagaacctcacttagcgcccccggccgaatcggcaaaggggggcctgcgcggtctcccggtgaggagccccacgctccgtcaaacccgtttttgaatcgggagtaagaataatatttagttccggttgaagtactgtattttcaaatcgggactaaatatgtttttactcaaaccgggactaatgtgattttttagtggcccaacaaagatcatttctccaggagtggccagtttcaactaaaaaaagatttaccccatttacgatgatgatgtgcaaaagtttgattcgatttgtctacttggttttgagattatcacctggtgacaattctgattaacattttctgattggcggagtcaatacaaaagagaatgctttattttattacagccacagtgtatttgtggaggtactaaaacggaattaggatggaattagtgtctttttcaacagtacttcaatgttggtctttcctgtcacattggctccttgctatggtatggtatatattgttaccttatactccatatttgaaggttcatggtgttgctattaacgccctgaactccactggaatattttcaagtgtccaacctatggttcagtaatcctaactacccctatatacaagcatcatttgtttcttcctttaaaactgatggcagatatatagaattgtgttttttttttacctaacaagaccaccaaacgactttgtttgtcatccattttcagggtgtgccctttaaagcggcaatcatgacaatcaagtccttcccctgagcaaataccatgagaactgatcgtcaccgtcgccgttctattgattgacaaagcgttgcctggagatatctactatgctcatcagttttaaagtaacttttgaatttgttattaatttgggttgtatatatcaaggccgatgaaatttttaatttttaacgtgatcatctgcatcgtatgatgcatatagctaaaaccgcttgatgtatgtgcacgattgcaatgttaggtctatgtgtatcatgtttcatggaaggcatttttcagtaatggggatgtcatatttgcaattatcaaataatgtcgtagcattaaaaggatgtccaagtaataaaacaaaagccagttgtacgtgggcgggtagattgctgattgagatcaaactggttgattttatggttaaaattattatacttgctcgataaattcacgtgtcagcagaaatccaatatacatacatgcatgtgccagtgtttgattagttttgtaggcttggttttagggtatattatgtaattattggtcatgttattttaatgtttttgttgcaacaaatttacctcaatgatttttttaacatcatttttctcattgagattttaatttactatttttttcctgcagcaacgcaaggcactcaactagttgttgaaaaaacgtgagaatgttaatgagattgatcctttccgatttactccattcgtctcaaaatataacaatttttagcttttaagatttgtcccaaaatataacttctccaccaactctcttcctaaccaatcacaaccctccaccattcacttttcctacctacctccactacctatttaatcacaaccctccatcacttatttctatctatttttttaataactatgtcaaattctaatacttcttatattctggatcgaatggagtaattagttatatcacatagatgtgttgggtctccatcgacacgacaagctttcccccacactcgcatcacctccaggtcagcacgggttgccggcaccagctgagcagccaaaaacccccgcccgcagtttgctaagacagcagcagtggcttctcgggtagttagcgcgggcggattaaatttgtgataaatgtatagctagtcctactatagctatgggatttagatctagaggtgtaaagttacgacgtgtttgggtgtttggacaataataaaaaaaactaattacagaattcgtcggtaaaccaagagacgaatttattaagtataattaatctgtaattagcaaatgtttactgtaacactatattgtcaaatcatgaagcaatctatctatctatctattatatactaaaagtctattaaacttcctataaacactctcaaaccgccaagtggcaccctataaacgctctcaagttgtcaagtggcactctaataaataaaaagaaatccaaccatctatttttacttgaattggtagacccattattttggatggtttgatctattttgtaaaaaaacatccgaaaccaacata

SEQ ID NO: 36866 - DNA, 638 bp, Oryza sativa
cctatgcatcagtgttggtgctgtacccaatttttctctgaaaaatggtgtgttatatttcaaggattgtatgtggattggtaccaatacagctggcaccagaaaaatttaacaaaccttcatactgctgcagtggggtgggcattcaggcattcatgttacttatcaaagagttaaacaattgtttgcttggcctcgacttcgctccacagtaactcaatttgtcaactcgtgtgatattggtcagcatgctaagtctgaacatgtcagatatcccggcatgttacagccacttccagttccagaacatgcttggcaaatggtatctcttgacttcattgaagggttacctcgctcagattctttcaactgcatattagtggtgggggacaaattctccaaatatagtcatttggtaccgtgggctcacccctttactgcccttgatgttgcagaggcttatatgcagtacattcataagtacatggtcttcctcagtctctcatttcagacagggatcggatttttactagcacattatggacttccctctttaaattggctggcacccaattaaggatgagttcctcttatcatccgcaaactgacgggcaaactgaacgtgtgaactagtgctt

SEQ ID NO: 36867 - DNA, 730 bp, Oryza sativa
atgatgggtagtacaagcatgcacaccatcgatttaatttggggttaatttgtagcctaattattaatcttaattagctgcttcgatggattaattagcacggtaagtagttacttattcgtgttgagatcactggaaagataataattaatagggtacatagagatatatatattagctatatatgaatatgggtgatatatatataatatagttcgaaattaataaacaataattgacttatatatagttgtctgtttgatgttcattctaattgtaatttctattaattggtgaattagttgctttgatgggattagcacagccataagttgtatttttcattggtaatatgacaacgacctggtttttgaatgtcgatcgatgttctacaaacgtggtgtgtatagtggtaagtaatataagagcagaagtaagcctttgatatgacccccggacttaagcagatttgtgtgatgataaaattaataataaaataattcatgctaatgcatgtttgactctaaaattaaatttgatcctacaatctttgacatgtaggccacattatcctagtttcctcccacacacatgttcatatctcttctttctataaagataatacccactaaacacatgcaaatatagtatttattagcacttcattatatctataatttatttcattctaaagctgagcataccacatgctaaatcatcaatcttaaat

SEQ ID NO: 36868 - DNA, 6495 bp, Oryza sativa
  unsure (1)..(6495): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagccctaactttggcggcgatggcaagtgaataggagcgcgaagaggaatttttgtgaagatgaagcggtggacaagacgatacacagtatcgtgttgttttttaggaatctttaagcttttttttgggctgaagtccattaaacatttactgaccttccacgggtttttagggactcaagtatatttgtctttgcagtatgcacgtggaaagtatccaataccttgaaaattctcttttcttgctgttacacaaccttttatttagaagagttggtacaatgtgatttaaataggtggtgaacagtgagctttatagtttacactttaactttttttacattaaagataagcactgtttagcgtatgttaaacaaatgcaatcagccaactgctgcgtcattgtttttatttaacaaaaaccacatatgtgtgcaactttttaagaccaatatctttggctttatgatgttcatgatatttcttcttggttgttaatagggagttggtaaatccattttgagtattattaattcatatttgacaccatgtttgccaataattgtttaataaaaccactcgactggttgatttatctactctctgagtatttatttagttatattcaactaattacatagtcagggctatacataattatgtgtataaaaaaattcttcatcagttttaattttttttcagccctccacaacctcatatttgggtttgaaagtattcaagagactatggaagagatattaaagagaacgaggaaagagggcgaggaaaaagaaaaggagattagggtggctgacatatgaagattaggatgactgaacatgtggccgtgtgagattaattttttttatatatttatcattgacatgtgggtcttatgagcggcacataggttgaaaccgtttttgaaaccaccgaataggttgatttacaccggtttttaaatatgaggaatgtattatactcggttttacgattgaaaggtgatttacacaggcaagagatggaggagggagataaaatagacttgttcctttcaaaaagtagcccaacatcttcattctctctcctaaaaacgaaacaaagggtacacacgaaaaaaaacaaaaaagtctcctcgtcgttgtcgtcctccttccgcggcacgattcgccggcgggaggcgggcgcgaactggaatcactgtagcagctaggctaggctagaagaggcgaggcgagtggtaaatgcttgcctatctaggccacgcaaccctaatctcaaatccgcccttccgccgcaattcgaattccaattcgaattcgatcccccacccctcccctcctcgaatctagggtttcacctcccctcccctccgctccgctcgccggagccccaccatggaccccggccgaggcggacgccggagggccggcttcgagcgcgcctgccgcctgcccaacaccgtccactccgagatcgcctccgcgctcccgctccccacgctcccgctcaacctcggcgccggcctcctcgacgacgacgaccccctcgccgaccccgaccgccccgacatgatcatgcaggccgccaacatcgcccgcatcctcgccgacaccgacgtctcccacctgtgagtacccaatccccccccttcccttcacttctccgcacgcctccacgctgctcatttcgctcgtgccatgctgcaggggcttcacggaggcggacaacgtcgagacggaccccagccagtgctcctggctctggagggaggtgctcaagcataaccccgacgccttcaccatcaaaccccgccctctcccgccttcccaaggtaaacgctctgcaaattgagccttcccctaggacctcagcctccaattgctccattctgccttgtaccatcgaattcaaaatggactggatagttacttacttctctggacttagatttttcttctacatgtacttattactgtgtgctaagcttctgttctagctttgccagcttcaaaatgcctgtatgaacagtagtattcacagtgactgccttggactaaacattccctgtgttgctgtctcgtgctatcatttagcaccgtgttgctgtgaaccttttagtacagttgcattgcatctcgtttgttaatggtgtgctgcatgttggatgagttgctgctctgctcaaggttaaatttgctttcaagtttcaacgatcgcagttccatgccacgaaaactgaatttcgtccattgttattctgagggcttttacaatgcttcagaggtactggaggtaccttcttctgtgttgaatatctacccttgatttaaaaaggtaacttagaaatagaaaacacatagacatgggcagttttgtaattgttctttgccaacaaacttctctccttgacggtcacccatttagttgctccatggtgatcagctcttggttcgctatttttcatcaatacctgtgcacagattcctgtaactaaattcaaaagtaatattctctacccttctaccccttcgtatgatctgtaaagacaagagacatggacctggcgatcctccttttcagaatatttcaccaatacgtgttgtgaaagttgattacttggttctagtcttctagtacataattgcttggttcccttcttggtcatgcttagttacatgaatatgcttttattatttacagagccccatgcaagattactaaatacagttttgttactaaatacagttttggcctacttaatcgtgcttggttctcctttatctattttcaagcaacagtaccgagtttattcccatgttttttttaatcgactgccgccttctaatttgatataaatatacaatcacgtatctaaccctccacctttttttttaacttaatacctgccccacatttttaataccttaccatagctacctttccttgtggatcattcgattacaagcgatgaacggatgtagcgcctccaaagcatcctaggtctcttctatttttcatgtggaaagcacttcagtgttctcttcttggttatctatgttgtacatctctgaatttagtttacaacaaacatatcatttttaaatacttctgtcagtcggtctacactttacaatgtaacctcccatgtgggctaagtttccttgtgatgttgtgctaaacttgtgtctacctgtcgaagctatgtgcctgccagtgagtgatgcatacaacagggttgctgctgcctatgtctttgggtccagatatgtctgcattgtagtgccccaaatagctctgttctgtgaatggccaaaggcattaacagtcagatgagacacggctttgaatacatatataacgacatgcagctgaacatacatgtacggtttggttcatgattgtatagggcgtaacacctttgggccccctaattttgcctaagcccgatggcttattgtggtttgtccattagagaactgctaaacttcgtatctttacttatggtatttgtatgtttatgagggctttccatttgtgatttcacgctgattctgtttaggccttggtaggtttagtttgcacaaggttcaagcttattttcctaaatagttatgctagaaatggatgattctctactatcttcaggccccttcattattgtctctttcatgtgcaaacctcgcagtattgtcatcctgcagtccaccattgcacagatccacgttccattaacggtgcctctgttactattcttacactacagagaatattgtcatcagaaaatttcacccaattgtattgccacctttttagtgagctgttttcagttgttgttgggtggtacttaatctttcattctacatgtatgctctgctatttctttctaccaatggaaatatttcataccaatgaatttgggctacaaagatgatgtaatctttgttaggttctatattttacattctaggcacataaataactaccttatctccccgcttttgccggtcgagtcacagtctttatctttggatgcttgtatggtggtactcttggcgcaacctaataggatagtttttcgtacggaactatgggtatcccttttgatccctctagctggtcctattccgattcattcacccagcgatcagtaatttggcaatgctatgccatatcttatcaatagtatcccaagtagatggcaagatgcaaatagaggaaccaattaaagatgtattggagtaacaggatcaaacgagaacacaatgaaagtagagaggcttaaattgttaggtaccctgaacttagtaaattctatttaaaaaccactctgttccttctcttagttcgcccacatatgtaaagtatactgcattggggaccgtatgaaatttttaattttaatctgaaactgagaattggctgtaatgagtcagatagttgtgggaaataagacaagatccacttggtagctgcagggactgtatatggaaggatagaattgttgacttttatttgagcagcactaaagaatgattctcaattatttgggtaacaattaaatataacctaaataataccggagtccctgttttcttaagaattaagaatttcaatgatactcaatattctaataagatgaacccaagaatcacagcggtgagagcatgtacttttgtacctcctgctctgagtcgatctctggaagtagtgggcgaaaaaagtccttttgtaaaaatgggtaaaagcgtttgtttggattctgtttttgctgtttacacctcctgaaattcctgcattccaaagaagtccttggccttgttttttgttaataacatgagtgttacatggctctatagaagttgataaatttgctgctgtactagcgctgtaacgtgcgaaagggcttgcagcctagcggttatagtgctcaagtagcatctctaggtcctgggttcgactccccatgggagcgaatttcaggccttgcttaaaaaaggtcactcgttggccctttgtaaaaacacgtgttaagaatcgacctatgagggcggaccctcgtgtaggaggtaggggtcttgaagcacgggttaaggactgtttttacgcgttaagaatcgatctacggagggcggaccctcgtgtaggaggtaggggccttgaagcacgggttaatgactgatccatagggagcgagatcgcatgtgggggatcagggttcgtggcctttcttggccggtttggttgaggcttcttcttaatgaaaagtcgtgggggtggtctttcccccaccagtcgagtttttttagtgctgtaatgttcttttctttttctgcacctccatgtatatgtaatgctattaataacttaccgtcaacatggaaaatgctaagataagaatttgtcatatttcctttttctcattttggctgcttttgtccttgcaatatagtgaaatattgtccttccaatatagtcaacatggaaaatgaattgatagcagtgctaattctacactgaaataacactatcaatatagtgtttgtttttgctcgacaaacacaattcactatgtggcttaccattcaattatagttcaataatctgcatttttggagttgtgaatgttttggactgtgttactctatcaagctttattgtgcatcatatctaacttttagttacattggtcaagtttttcagatccccttgaaggccaagaaaatcaaaatcaggagcatgagaagcattttgcgcatgttgcgccaaactttaatagcatgcgaaaggaccatggatttcctcgggatgaccctatcccacatagcgagcatcttaatgtatgcagtatgctagataccatttgtttcttactataaatgtgcatagttcagcctaattactttgtctttgtgctatgctattttctgttgtagaatgatctaacacaagatccagttgcttcaaagaagccaaaagttaggaagaaagaaatccataattctgcttcaagttctgaccctagcattcctaatagtcaaggtttactcttgttatctctatatctttctccatctgccttcatttttgttctcaaacactcagtggattcctgtttgaattattttttgtagaagttatcgccaacttctgtgagatggtagaagatttctgtggaagagtagaaattcctgatgatgcagatggtgatgagtggctatcaattccactgaatgatgctaaagttcttgtaaatgaaatcacatttgttcggtcaaaaaagattttgcatgagattccgatggatacacttacaaggctattacatgtgatagaccgtcagatccggtgttctcaaggtttatcaatagacgtgaaggaaaatgtcagcgttgggctgcagg

SEQ ID NO: 36869 - DNA, 1324 bp, Oryza sativa
ccttcccattattttggtgaaatgacatggctgaggtatctgacccttttgtttatgccagcttattgagagaattcttgatttctcacgacatcagatcattgattgtatggctgcaagtaacccaacctttcgagctctttacaaaccagctgaaaaagtcacaaatgatggtagtcctgaacttcttttttcaatgtttttgcattgttggtcttttactcttttgtgatctgtcagcaccttactcatttgtatttctatgcttagtgtatggatggatgtgttcattgtgcttttcatacttaatatttattactgagagacaactttgtattgtgggactaaaaatttattatttcctactggcctgtaggcagtaatttatttctgttaccgagctgactgtttaatggttgaaccttttatacatcacacagatttgcatttatatttttctttttctggttgggttcaggggatgaggatgaagaagtcatgggaaatggaccagctaacaaaaggaggcgtactgctaatttaagcatgagaaaatcttctacaaacaagtatcaaattttgctgttttagtttttctattttttgtgggtattcctgaatcactaatggagttcaattttccttttacatatcagagtttctgcctctatacattcagctgtacagaaactgtgcttgatattgggctttcttacggaactcctgacaacagtgcgcttatcagatagttgtattttgcaattagcaaaaacatgctttaccacattcctggtggacaatatgcaacttttacaattgaaagcaattggtgtcatttgcacggtattttcttttcctatttgctatatgttctgctctttcagttttcaaacaattttggttccttatctttcaagttcttacacaggttttttcatcatacacacaacacaggacatacttggttgatgaaacacttgttcttcttcgtaagctacagttttcaaaaaatgctattagaacttaccatctagcagatgaagaacatagccaaatccagatgataacagcattgttagttcacctggttcagttcagtgcaaatgttcctgatggtttaaagggaacggtgaactggagcactattgttgatgcatcgatagacgctagttatccaatcaaatgctatgaagcagcaacggaggcttgctgccttttttggaccaatgtgcttcaacgtttcactgctgctaaatctcaggatatgtcggaagccaaagggattatagataatcgtgtgcaggacttgctaactatactaaat

SEQ ID NO: 36870 - DNA, 3803 bp, Oryza sativa
atgtttccattcagattgtgtgggtgttgttagtcaggaaaacctacagtgtgattatgcctgtccattatgcttttgcaaacggcagctcagtgtgttacagtcatattatgagttgcaaaataaagagaatggcaaaagaaatgctgcctctcatcggaagaaatccactgtacctgatgaggtgacagctgtggatattgttcaacaaatacttttgacttatatccaggaaggtggtccacaagatgatggaaatttgtttacacgatggtatgttttgttgagtcttgctcttgtcttccaagcgtgaatggagattgactatcattttgtgtgcaggttctatctctgcatgtggtacaaagatgatccacattctcaagagaagatcatctactatcttgccagactgaaaactaaagacattctgcgggattctggcaatggtttggtattatccagagattgggctaagaaaatttgtttggcacttggccagaagaactcattttctagagggttcgataaaatcctttccctccttttggtatgtgattatgtggctgatttcttatatttctgatctcttttgagtttcatgttctggagttgatgctttataccctatctttttcaggctagcttgagagaaaattctcctgtaataagagcaaaggccttgcgtgcagtgagtatatggcttatgaaactatgccgccattcaccattttcatttaaacactagccttcattaccatgttcacaatttgtatgtaggtcagcagtatagtcgaagctgatcctgaggtgttgggtgacaaacgtgtccagtctgctgttgaaggaaggttttgtgactcagctatttctgtccgtgaagctgcgcttgagcttgtgggtagacacattgcttcacatcctgatgtcggcctgaaggtgagtagactgctgaagttaatctgtgccatattcttggatcgaaaaggtattaacgttggcactttgccctatgccgtaacagtatattgagaaagtggctgagcggataaaggacacaggagtaagtgttcgcaaacgtgcgatcaaaatcatccgcgatctgtgtgcttcaaatccaaacacggacactactcgtgcctttgtggagataatttctcgtgttaatgacgaggagtctagtgtacaggtaagttaatataaaaaaacgtttactggtgctcttgaaatcaaattaatgttgttatagcatatttcatattgtaccagaaatgtttggcatctctcattagtttcattccgcaatgttgtatttataggttgtggatctattgtgatgtgtatatggatttcatcattacattttgtacacaaatgtcgataacggtagctattagttactgttacttggcaaattgtctttcatgttaaaaaatcaaaaccataccgcctctttgagttagatagggtaagttgtggatacattaagaattaagactattttctctctttctttgcttttgcaaaatgttgaacctcctaatctaggttccttttattttcgccctttatgcatgtgaagtttgaacattgtgcttgaaggtccactggtggtcccttcattcatctaatattttttttcctgcttgatgtcttaaaagtgaagctaacaggttgaggcttatgatatatagcaattaacaaaatatgccatgtacatctttggaacagcaatattttgtcttttttttaacatccatgataattaattcaggtagatcttcatttccttctctgtaggatcttgtatgcaaaacattttatgagctatggtttgaagaaccaactgggagtcataagcacttggttgctgatggtagttcagttcctatggagattgcagtaaagaccgaacaaattgttgacatgttgagaaagatgcccaatcacctacccctcattaccattgtaaagcgcaacttggctcttgatttccttccacagtcagctaaggccacaggcattaactcatcatttatggcatctctaagaaagcgttgtgagttgatatgtaagcgcttgttggaaagaatactgcaggtaatttctgatggagtttgattaacaagatttcgcattatcgagattggttctcacacatttgttattatcaaggtggaagagggagctgctagtgagactgaagtccatgcacttccttatgttcttgccttgcaagcattttgcattgttgatcccaccctctgcactcctgcaactcaaccttttcagtttgttgaaacacttcaaccataccttaagaagcaggtcagcatgaatttccttctattgaactttatgttgccatgtgctcgtgtctgagtaacccacgtcaatctcatgaacttcctcatattaaaaaatcatttcataagcaaagattgaatgattagctagcattagtatgcatttataaatggtcatatccttgagtctacgacctacaagccaaccttttgcaatacattagcactgtatagatttctaacttagatcatgtaggtattctgttatgtgtagtaacctgtacgcctgtttggtgatgattaaagtttagcactttagctccccgttttgcctgtgctttttatgggcaattcgccaattcctactagttgtgactgcctggagtctagtgtcttgtggcttcacaatgtgagctctatgttgctgctgacagaacctaactctatggtaaagacttccagtgtcatgtttgataggtattgaactgttctaatagaagcagaacttgagttttgattatgcttattagaaagctgatgcaattggttaatgcacccagtgaattttgtacagcatgagttgttaatgtcttttcctgctgtacataagaatcttttttagtattttatttagcttgttagccaattgtactgtggagatatttatgttctgggtgttaatgtaagtacatttatttcatgtgaacaaactacaaattcctttgtttatcattttccctacagctagattttgcactgctcctgatcttgtatattgacaggttgacaataaatcaacagcccagttgcttgaaagtataatttttgtaattgatgctgttcttccactcatatggaagccaccacaatctgtggtaatagagctagagcaggatctgaagcagatgattgttcgacactcctttttgacagttgtgcatgcctgtatcaagtaatcatattccatccttctaccgtcagttttatttgatgatcatttgtccttatgtactacattttcacacactccatgttaggattgtttgctctttattttaaaagaaattttcatacaatatctcttgtatgggttcatctggtgactttctttattgactggaatactcgatgctagaaaactgtacatggcctatatgatttgcatagccatgggatcacatatggggtttttggtaaatatgatgcatatctggtgtgtaagataaatatccctacagctataaatagggcgatgctgcatatgttaatataatctgttaatagtttaatgttcataaaattgaaatgcaattataatttaaaacattttgtttatgaatcatcactatttgcatgtcacaattgcacacccttattttgttcaagcatcggtttattgaacttacagtcttatgtggattatcctaccttttatttattttaatcctttgctttaaacgctcttgttgaattatttcttcttgttcactttgatta

SEQ ID NO: 36871 - DNA, 14630 bp, Oryza sativa
tatattatgggacaaagggagtacctctgtttcatattatgctttgacttttttcctagtcaaacttctttaagttggaccaagtttataaagttggtcaaacttaaagaagtttgactaagaaatagtcaaagcgacttatagtaggaaatggagggagtatgtgtaaagcttaatggagtttttttttcctattctttgcatactatttattactccattctctagctgcacgtctcaaaattaaaaccaatgtcacaactcacaacatagtaaacagtcctgtatgaagttttattcaaggaatagttttaggaattcaaggacagttttgcatttatcctgtatgagacgtggaaactgttgtttcttttgcttccaatgctttgtaggtttgttattctgacaatctcttcttttttctgaaactcagcttttgggccgatcattgttttgtcttggactgctccttaggtatggttctcaactcatggcagcatccgaaaatcaacttgatttcccaaagattatcagcttgctgaagaaggaatatcttctcaaggatgatttcagcttgaaggttcgaggtttgcaggtgtgcacacttggaatcaattactgcacttactggcactagaaaaactagatggatggatggcatgtccacctgtctagataacagaatgttgctttagtttcatttatttttcatatttagaaactattcagtactagatgatatatttttctgtgcatgcaggctttgggatacatacttattgcaaagcctgattttatgctacgtaaagatatctcaaccctaatagagtcatcattgtcttctgttgttgattatagattaaaggtatacactctcttttagtaatatgtaatggcacatgctctgtatagactgtttaaaatggaccctcctgtccagattcaaggattgcagaacctttttgagtatctacgtgatgcggaaagccagctcaatgcagagagtactggcaagcctacacccaatgcaacaaacggtggaagtgaagtgcctgttgctgcaggtgctggagatactaacatatgcggtggtattatccaattatattggaattctattcttgaaagatgcttggatataaatgatcaagtccgtcaaactgcactaaaggtgaattagaccaatgtgcatacttttacaattgtcctttatattttacaatataaacaataattgtttttttttagattgttgaaattgttctccgccagggtttggttcaccccattacttgtgttccacaccttatagcactagaaactgacccactggaggggaactcaaagttggctcatcatctgctaatgaatatgaatgaaaagtatggtgacctaccttctcattcttatgttccttttggacataatcttctgattgttaggagttgtttgcaggtacccttcattttttgaaagccggttaggtgatggcctgcagatgtcatttcgatttttcgagtccacaatcagcaatcatgatatggtggccacaaacatgaaatctaatccaattgcgtttgttaaacctgggatatctcgaatataccgcctcatccgtgcaaaccggaattccaggaacaaatttgtacactcaatagtccgtaaatttgagggtgataaccgcagttaccccacaattagctttctcatgtaagtagccagattaaattatgcttgccaactctctattactggataatgtatttgactacaaagttgcataacaattgcaggtactgtgctgaagttcttgcgtctctcccattcacaagccctgatgagccactttacttgatatatgatataaatcgggttattcaattaagagctggagcagttgaggcaaatttgaaaaattggacttccatgtatcagcagcaagaaatggtgggtatgccaagagacactggtgatgttatgcatgagcctgggggatgctctgaccaaaatttggttgatgtctctcaaatgatgcttggcaatacatgcagcacgccagttgttaacatggccaaacttcaggtgagttagagagaactatcggcgtagtggctagtgagagttcatcaatgcatagatcggtgagccttttttttttttcatttcagtttgtttttgttgtcaggaggattgccatggcgcgatagccctgcagctccttctcaagctgaagagacatctgaaaactgtctatagtttaaccgatgcccggtgtcaggtttgccctgccagtcccatatttgaacattgttaatcctaagatgattttactgacacaagttctatttgaactttcaacattacaggcattttctttgaaggatccaccaaaatctggcgaaacaatctccaagcagaatatcccattgaacattagtaataccaacaccagtttgccgagctgcccgcaggatgcagcacgtgtataccaggtagcgatgctgaaaaattctggatttgtggggaacaaagttgtagtagcatgttttattgtctggggtttggcaggcgctgctgtgtgtgtaacatttgatgtgaatttggacgtgatggacaggatttcaagacagtgctgcgagaagacaccgtggactacgggatgtacaccgtttcggcccagaaaaaacgtccgactccaagaagctcgtcgagagtaagaagaccggcggctgttacaaaagcccgtggtggtggtggtggtggtggtgataaggacaccgatgacgaagattggactggtggtggagcaagagtgctggacttcagcgctcagggtgggcgagtaacaaggcagagggtccaagtctgactggctgctgactgactgttgttggtgcttcttgtgtacattgtaggaaattttataggtaacaggggaggtttaggtcgtcttaggggccattgttagtacatagaagcagaaaaaaggaaaggaagatatctagcttttacttagatgccattaatttggagcactccttttcttttgcttgctgttgcccaatttagatgttgtaattgctctcgggctctggcaatactccaacaaacaggttgtgctcctttctaattcaatggaaaagaaatgctttcttttgcttctcacttgagtgtttccactgtctttattctcgacaacacactgcattttttaaagtgaagacagaaagtggtcaagaaaaaatgagtgagtacattgctggctggcataaacaatgaggcgtgtgtgatttacgcttgaatcgtgctagctccagcattttctccttgctattaaagaaaattgggctgggacttgggtgcctggtttcgttgggtttgacgaggaaatcaccaagacgaattcaaaaatcgaaacaagacgatgtgtcaatttttgatagaattagtagttgttgactaatctgattgatggcagatgatgtgtcaatttttagagctatagtagactagtagtagactattacgaatcattaaggccgagttagttacaatttttttcttcaaactttcaactttttcatcacatcaaaactctcctacacatataaatttccaacttttctgtcacatcgttctaattttaaccaaactttcaattttaacgtgaactaaacacagcctaaacagctcttagcctaagccaattattggctatgccacatactcccttaattattggctatgccacactccctctgtccctaaatagttgacgccgttgatttttttaaaacatgtttaaccattcgtcttattttaaaaaattaagtaataattaattattttcctatcatttgatttattggtaaatatatttttatgtatacatataattttatatatttcacaaaaaaatgaataaaacgaacggtcaaacatttgctaaaaagttaacggcgtcaaatatttaggatatacccctatgaacatcacgtcgcctaccactgaaagaacaaagtgctaaatcctaaaaaaattgcttccatgtagagttgaacccaggatctaacgtactactaagattcttgtaaccaccaggctagttttggtttgcttccaatttatacccttgctattacaaattatatatgttatataaatttagtagtgacaaaacttaccaaggtttaaacactttctaaaaataaaatattagtagggcaagaattgctagtaaaccaaaccagctcgtaatcaattcatacatggcaagggttaaaacgtcttttctccttaaattattggggaaaaataaatgaaaaacaaatgtaacggaagacagagttgtatataaactctgaaacatttcgatctcggagatctaaaaattacgaaataataatattacatatagttagatcgtgatagattctgacgtgtgtaaagccgtgctaaaaaaaatcaatatagcagactcctctctcggtctcggtgctcctcaaaaaaaaaaaaaaaaaaagcaaaccctaacgcctgagaactgaggagcgaaccggcgggatggcggcggcggcggcggtggcggcggctgggagggcagtccggtacggcgtgttatcgaaagcgctgccgacacggctgcacatcaacagcggccgaggtctcgacatctccgaggctgagggccctctcgataggtacatccaggtgttgatggtgcgtactcctctctaccgcaaacccgctactttgtatgcatacttcgttctttacattcgatccggtttacctcaagaggaaggggattaaaaaaaaattctgttccaaattaagtctctgaatagtcaagtcaaggttcccggctactcctgatctggctggctttcagttgagcaaatagcctcctttctaatcaccttagcttgtaatcaaatcttattctacctagggcagctgctgcttaattttctgcttttgatcatcctgtgtgatgagtaaccaaccaaatgttaaccaattaaactcactggaatcgattgattgttctttaacttcctcaattcacgttcttgttctcttcgactacgaagagtcggatttttttacttttagcgaaccattcgactccgcttatttgccctggatggccctttaagaggggataatctgtttcgccaagattaatgcaatgattataatgttgtttttagaaagattgagaaatctattgagctaaaactctgctagctttgtttggggggaattgtgaaataccataggttccccaacatacttgcaggttattattgttctttctattttcttagttataccctgtgattaggcctggattgaaatttacttctgttttttttggaccttttccttgaattcttgggattttgggtttataattatcgtactaattttatacatttaccaagtaaagtctgggatggctctgtatagaactatagatatggttagcaatatattagaaaataaaggggatttgaaagatgagttgacaccatgcaagggcctattgataattgaaatttgaaaacttaacttgagtcaacgagtcgtggcttgcatgtgcaagataatggggtgctcttcatgttaatgtcaaaatgtcactattctaagtgattcttgggagatatgtcattttaacatatcacatctagttctcttttagttcattgagctcagtcgaaagaattgacttggtaattttcagtatttatccaaagttcccaacataagggtggaagtccaaaatccaaacctgcctttttaatgtatgatagctttctgaatttatcaggcgacaagaaatctctgctgagttgatactcatcataaaccaaatcgtattatatcttttagtggatatggaagtttgaattagccgtgtcaatatgcaaactcgactgtttcagaagctaaggatgtatttggttccttgcatcaatatcatcttggctcagatcatgcagtagccagcagtttggtttcctgcataggccaatgagcctgtctctgtgcatgcaaaaagttagctggagcatggcctggagggaatgagttttagtttcattacttaccggcttggtttgcttgagtcaagaaaagcttcccatgagcattgtcccctctagataccttgaaaaatgtgcagatgcatgaaaccaaagtacttcagtcgggggattgggcaaacaaactcaactagataaacagtttcaacatgcgcgctggaccatttgaaccaggtttaatgggaccggccaggccacccagcacccaggcaaccaaatgcaccgtaagtatacatgatagattttgtcaggaagggtgcttatcagggggtctgactttgtcttggctgtgaagttcttctctcattgatttggttgcaaacttttgctagcatatatggactgagttttatacctgccttgcaaatttaatcttgactgcttgggatctggttttattacaaccctcattaattttatgcaagaccatactatgcatgaccaagtatggtcttgagtgttgaaatgatttgcaatggattagaaaaatctagagactgaacaggtgtgctgtgattgtgcaagatctatcggaaacaactgacatgattgcaatgggcattcggccatttgacaacaaatttccaatagaaaaggggcaatctttcacttctatcaaatccatttcttccccttaagactagggactataaaaaggaacttgagtggaaagctttcaaatgtaactatagcttcattataattgtaagataatcacaccataaatatactaacttcattataacttttatttactgtatataacttgtatgtgagtattaaaaaaattcatgcaatttcatacatatgatatatagaggttacaatgttgttatattgtaattaaactacaattatactatagttgtaatgtagttcaactatactacagttatgtttgaaagttttataccaaaaatcatgtgactgttttttagcagttccctaagactggtatttttctgaagcactatggataatattagtatattacatctgttgcttaactggggtatccattatcataaaacaaatcattatacagcttgaggtatagaagttttgtattaaccatgtcaatttgcagaatgaaagaaaccttggaaaagtaaggagtatagagaagattttgtcaaaaagagatatggtgagagaaagctctgagaggtacttgggatgcgtcatgtatttttcctcactaatgtacactctgcactcaccctaatcccttcgaatatactgcagcctgatccttgagcgcatgaagaagattggcacacacaatacgaaacatgcgtggatggttgctggcgtcactatttccgggtacttgtttggggccgcattcgttgcccttcttacagagtcccaactgccaaagcgtgaagaggagaaagaggcttgaattctgccaagacaagaagcttggatttgaagagtgaaagaagagtacaagggtttagaagtaatgtagtaccttccatccatgcttaaattgttgactcagacctcccttcaacatttaactgagacccttttccttttttatatatttcatgtaactgcaaagtatgctgtgcaaatgcttaccggtgtttccttttcgaatccctaatagtagaattactcttaatatggttgtcttgttttctggatgtggtcattaacagtagcaacaggaagcccgggtaaatcatgtcgttctgcagaatttggtgcatattgagagccaacacacaaatagtcccccgttcccccgttctatttaacttgtattatcacgcacgtttatgagctcttaaatggtacgattttccaaaagaaaactgtttaccagcatctacatctcttagagaacttaaattaacttatcaactttccaatctttaatttagtcagttaaggctctgtttgaatctcctgaagataaaaataaaaataaagattaaatgttttacgtaaaagataataacttatgattaactgagttttaattattataaatatgaaaaatagattaatctgatattttagaacaactttcatataaaaaattttcgcataaaacgtaccatttagcagtttgaaaagcgtgccacgaaaatccaaaacttaatgttcactttgttgggttctcgaacagcgcttacacccacaaaataataaagtaaatttcatccataatcccatcatccaacagcgctttaaaacaaattatgccataattatttgcgagacaaacaatatttagatattccaatcatcaaacttccagaatcatcacaacaaacacaatcatcaaacttccaaaatcacatttccttcacagtcatcaaacctcctttgggtgttcctctagaagtaacagaagtatcaaacaaactagatgcgcaggtatcaaaagtgctcctccagaagtaccaaagagtaagtactacaaaatggggctacaaaatccggagtcactctcttttgccctgctgaggagcccatccctgtgactgcgaacctctcactcgctctaggacatcaatcttaccgaacactttctcatacgcagccacaagccgaagaaagaagtatccaactgtgggtatcagaatgataacgagcatggtgaacttccccttcttgtcctcaggaaggcggtagccgatgttgtccaacacgccagctatgcccttgggtttctcaaggctacaatgcaaacaaaaaaaaaaggttcaaacgtataatgaaaacaaataccacagaaaaaagaacaaggtaaataccaaaaagccataccttttaattattgtgctcatagacttggtaagcttggttaacatttccacattgccctcgctcaaagtaatcatgtgctcagccctaagtaacaatacaaagaacattagagtttaacagcctttcatgagaaaaaataactcttaaacttgacctaatactaaccaggtctgcatggctctagcaaaaatgcgcttttccaagttggacatcggctgcacaacatgaataatattcagaacaatggtaggtgaatggccgaaggttttctatttgctgattgctaccattcaacaatgttttatgttagttttgacatatatctgaaaacagcagcctgtatccacacattagatgtcatggtcgggattacgtatcgtcgcagagggcgtgtggttccgcaagcgtcgccgggcggaacggcggagtagcgcgcggaagctgcgtgccggatgactacagtgcggcgattggatgagttcagattgttagtctgtttatcagtttgttagcttgtttttagcacattggttaattcgtgtacgcctatttagaggcacagtttcggtggagtttaattaagcagattcaatctctagttctctcatctcctattctctatttgctcatcccttgctgttcatcacgggtcgtcgttccaccaaaccccctcgtccaccgccaatcacacattcatatcacatacgttcttacgccggggctcgtgacaacttggtatcagagctcatggcaacggacgaatcctccaccaacgcagccaccgtcgcagccgcagctgcggtcgcagctccggtctccaatgctgacatcgccaagctccgcgagtccatggccgacgtacttcatggcatgtcgctcctcgcatccaaaagtgacttggcggatctcagccgctcagttgccgtcgcctcatctcgccttacatcgctggagcagcagggtgctgcatcgacctcaactccgccgcgactcggtggcgacggaatgttccggcgaccaccaccaccaccaccaccaccaccatcatctggctctcccccaccaccaccaccaccgccgcccccgccgccgcctccgcctcctccaccgctgttcacgagacggtctcatgcgccccaggacaacagttctggcacgggcgttcctcgcttctataaactggaatttcccaaatatgacggcaaagacgatcccctcaattggttcaatcattgtgaacaattcttccgaggacagaagacaccggatggtgatcgtgtatggctggccacgtaccatctcaccggtgacgctcaggaatggtattttcactacgagcagcatcacggacccccagattggtacgccttcaaggaattgtgccatgcccaatttgggccgccaatccatcgcaatgccctgggcgaactgaagcggctatatcaggcctcctcggtggctgcctaccagacaaaatttctggcattggcaagccggacgacggagccgctcactgacttgcaacaaatccagcttttgatgacaaatacaaaaatacttatgttatgcttaaagaacatttgatgacaaatcaaatcacaataaaataaataataattacataaattttttgaataaaacgaaaggtcaaacatttgttaaaaagtcaacagcgtcatacattaaaatacggagggagtatattccagtgcatgggtttgctgaaccaaagtagttgaaagcttagaaagtgtagagaagcatactataagcatgttaccatatttgggaaactagacccacaaagaaatttcatgaaccatgcatccaaagaattctgactcatattccatcagcgggcaaactttgacatcctgaaaggaaatcaggagaaaaaaattatccccatgtggtatgtgaagtatatatattgcattagtgcaattatgttctatgtgtatcctttcttggagatgcatttagtccaagtgacagcacatgggaccgcccgaaaagtcgattacccagatgaaagaacattacaaacccaccaaaaaacaacagaataatataaccacagtccttatgccaacaatgtgtggtcaataagaattgaattaggttctgatattgcaaaagaagtgaatcaattatgatgagtcaatgacccaattgtgtttattctcaacaaccaccgcagactattttggacaaatgagtagaaatcttaacaaagcagttatcttattcactacagaccaacaaaatggagtgatatacagcaagaaagaggaggaagaatgaaataaacatgcccaccttcacatcagttggctggaagtagatgaagagtactcaataacaatacgaattaagaatccaataccaaacagagagatatcaagcaacatgataactatgcccatctcagatttctataccaacctttaactctcccatagccaagcacgtaagtggatgaaacagaaaggcttacacaggtaaatttatcaactgatgcatgtcaccctgctaaattacaagggaacgaacctgagtaagctaacctactagaataccaaccacaggacaatttggagatattccaccaagataacttgaaacaactattaaggaacaccctaaaacaacatctaagaaagaaccgagggcataatcatgtaatagaacaagtggtatcacacagaaaaagagaagagagaatgtaattgattttttcatgatttcctgttgctttagtgctttagtatagtatttctatgccctagcaacatgcttcaagaaatattgcaaaagatataaatgcaaggactagggagcaacgtcataggtttaaacagcaaaattaatttatcaaatactcatttgagatcaagatagtgcaaaccaggccaaaggcccaatttgtggcaaagaaacagagggagtacagattagtaaagcagtagaggcatcaacaggatatcctattcacaattaagacctataaaattacaaagtaatagaaaaaggggagtatccagagtgctttcgttgttggcctatgccctatgaaggtacagaacaccaggttcattacaactgataccaaaacctaaataatttagggagtggggaaggaccatgagaactttgtattaaaggtaccaacagtaaaacacatagattaacataaacatagctaaaatatgaaaaggtctggaatataagaaaaaatgaacaacttgcatgggggcatatgtgggctgcataaattacaaactttggtgcagcatctgcggtttaaacaaagaaaatgatgctacacctacatagataagatcaggtttgacgattaacgaacgaaaatctagatcaacctcatctactttcgttcattcatggatgtctacaaagataacgatcaatcattctctgcatatttaagatatggttccacttcaccatgctaaaatgttagcatcaggcctcacagatggattgtaaatgttccatcccatacatatatatatatatatatatatatatatatatatatatatatatatatatatatatatatatatatgtgtgtgtgtgtgtgtgtgtgtgtgtgtgtgtgtgtgtgtgtgtgtgtgtgtgtgtgtgtgtgtgtgtgtgtgtgtgtgtgtgtgggtgagggtatatgaggcagttctgaaggcgagtttctaactgggattggattggattggattgtcaatgtagcatctcaggagtgtccatgaatgattttggcctaaatcaacagttgaaacttgagggtttaattggctatttctcccacatcaatcaaatggacaaggcagacacaaatatataatgatactttgatgtgaagccccaataagagctcaagtacaggcagcaaacatgtttttcgcaggcccgctgcacattccaaaaaacaaaagtaagcaaaataaaggaataccacactgcaaaatgtcgtttggccaatgggccaaacaaacttacatatcgccaactagacaggacagaagaaaatatacagttgaatatgaatagtactgcacaatttgaaaggaaatgttttcagcacaagcacaatggaggttctaatttttgccagacttaatattaattgcaccctagatggtactttggaaaatgaagtgatgttaagtcagaaaattataatgttaagaaaaatcatgtgatctccatcaaacgaaaatgcaccagaaacaatggcatacaagagaatatagacccactatcttacaggacggcaacattcaaacatacccaaagtctaggctgtctttactctgaacacgtgagtctagaatgcagaagtctaggctgtcttacaggacgccaatattctaacctagattagccctcttctatactatctattggctaaacagcctagacctcagttcagagcaaagcgtgaattctgcttctatcaaaccactacagcttttgtgggagcgggtgcagaacacaccaatcatccctaacttctctttttgaggagtataaatataaagaatggttatctcaaattccataacatctaataaggaacaaacagaatggaaaaaaaaatacggtgtcaacacagaggctgctaaaaaggaattcattacagagctcaatctgcattaggatgatattgggaaaggagacattgcccaatcatcataatactcatagtaaaaagtctacttaaccccagaagtattatgattcgttcccttttaaccccctattaaaatataaaacggattattcaacccactaaagtatgaaaaccagttcaaacaactccctagtggtttggccatgtggactacgacaagtgatagtgacatagtgatggattcgatttaaaaattaattaagttcagttatacagcttggaaaagaagaacgttaatgtaaataggtattcccaggctcactgataagtgaacaaagggagcgattgggccagcttgagtaaaattagctaacatgggagccgcataagcaataccacccgccatggttgagtagactttctcttctatagtataatataatataattcaatggctcacccaggacatatcaaagcaaccatcagagctaaaagtgagttgacattatgtgtcttgtcattcttcataaagtattttatacaagtgtaaaaaaaaaggagggcttgtatcatttttttcgcatgggcacttgtatcatgtttctagttcaatgtctattcagatgtataggaacttgaatagaaagctaagaaaactgtgcaaaaaaaaatcacatgtatcctcgggggaaacttcaaagaggaattttagaattaagataatttgttcacaaccgtgtgcaactgattggtgtgcaccatatagtgctcatgcataggttgatttcccctctgtagggtacagagagaataaagttatagcacaagttactccctccgcattttatagcgtgtattttgtgtcacaagtaaaatgatttgaccaacagttactctattaatattttaataattatgagccacaaaattataaccagaagatatctaataagatcaattttgtgtcacaaaattatgtattagtagagaagctattggtcaaagtcctgtactgacaaaaagttaaatatgtcctataacaaaaagaaaagaatggagttaggatttacaatttcctacta

SEQ ID NO: 36872 - DNA, 26197 bp, Oryza sativa
agggtgaatatgtataccagacataaggaggaggagttggttctcctacgagcgttgacggactggcatgagtcatctagttatctgcgccacaaaaggctgcagcagccagcgaaaaggaattgcctctgctgctgctcctgaatcgcgtgaaatcatgggggtcgcccgctcgtctcgtccgtctcatcgctccccctcctgtactgacagacacgacgagattcctctcctctcctctgctccccttctcttccttccatcatcgatccgccgcagggaggagggatcaggcgacgaccaccaaaaacccacaccgatccgatgagagagagagagagagttgggaggccagatccgatctccccattagtaacttatccctggaaagaagaagagagggaggggcacgcgaaattccatccctgcccctctcccttatctgactcactccttcccttcgctcgctattcacggactcatcgtacgctcggctggagtactttattagggctggctgtgttttcccaactaatctcttttttttccatcatcacgttttttataaacttctaaacggtattttctttcataaaatttatatatataaattatttagaaaattaatattgatctattttttaaataaaatatagctaatacctaattaattaaatgctaattgatagctttgttttacatgcactgtaaatttaatttcggaaccgcaatgaacaaacacagcctagttgaggctgccttcgcaaatctatcgatttattagatatataattacgttgacaatatttacataaattaattcgtttatattttttttatgaaatttaaaatttttaatgttaactcactgttatttaacatacatcctttcaaatatatcttacatctaatatctatagctctgtcaaacataatttttatttttattgaattccgatgagaccccttggtgccaaatttaaagccccatagttattgattgttttgtgcattcttatccttatataagtggaaattcaaacttttaaaacatgattttatgaattttttttctcatcatagtttattttataatattgtctttttatcactaacaacacgaatatataaaaggaggcaattttgcatctaaccctattttgcacaccacctaccaatttgaccccttctatgaacttcgttcgtttgatccttgttttaataataactaaagatatagtttggacttattatgttaaggtaatttgacactattttctcaaatcttttaaattagtttgacctaaagattattttttgtcaaaaatttcggtttgacagatgtttgacaaatttaatatagactagaaaaaatacccgtgcgttgcaacgggtaaagacgttatttctataatatattaagagctgagcaataaattgaaatattgtatcgctatacattataattgaaaaggttaatgaaaattctaatattgggatcgctatatattataattaaaaaggttaataaaaatctttcttgggttttgagccgaaagccttcattacttttcagcccaaggccagtccgctacctccctttatttggcctgcttgcttcaacccagccacgagtgaagccgttttcagccctaggccggtccgctacctccctccgtttggcttgcttccttcgacccatcaaatccggctgaatctttctcgatcacccaaaaatggttaagggtttttgatccacttacctcttttcgttttacccaaaatcaaagcgtaaaactcgagataaaaacaatgggggaagatcgtcgtcatcatcggcaacagttagattaaatccgcaaaataaagctaggaaaatcatggagaaaataatgaggaaggagtgggaatcgatttttttttcaatcaaattggagtgaaaacgcacaatcgatatggcgccggcacagcgcaagggttcaactcggtagacgtgccgcaaatagattggataaaaaacagacgagaaaaaccaaaagcgcacgggataaaaaaacaggtgacaaaaaaaccagaagtgctcgggagacacgcggtgaacaaatcggatttaaaaaaccggaaaaaaaaccgatagcacgtgcatagaaaaaactctttctcgtgaaaaaaaagcaaacggactttttttttgtttttcactggcgagacttttcttttccttttttactgtagtcggacgatttttttttctttttttactggtgacgacataagctttttttttctttgttgagtcggaattttttttaccttttgagtcggactttttttttcttttttacctactatatggaaatttcttattatttttaagtggagatagagatacagagattaaaccaaaacataaaattaaaaccgattgaaacacggatgacgtatcaaataccggcaaaaacatcttcaatttttataatagtagagatagagatttgacaaaagtgtgagtaaactataacaaattcttttgacagcatccaccaaaaaatgcatatatcgaatcaaaaagcatacgtacatatatattttagatcaaaaggctatcgcccagctttactgaaagcataagaagtctgtgtacagaaataaggctggggattccagcttacatatcaagttcttagccaacgacaccggcaacaaagctgctgactcagcacaaacataccatacaaaaagcaaaagaattaccataggatgacacataggataaaagagttttgaaggcactctcttcacagtgcaagcaccactagtgggacccacaaatatcttcaccaaatccccaactgcttctcctccctcctcactcatcacgccaccaaatccccaaatccggcgtcagctcaaccctcctccatcgcccattcccccgccgcctccgcccctgccgctggctatcccctcctcccttcgccggctcctcttctccctccgccggcgtcggccggctctcatcttctccgggccgagcggtggcgtcgtcctccgggccgagcggcggcggcgacgtcctccgggccgagcggcggcggcgctatcctccggaccgtgcagcggcgtcgtcctcaaggctgagctgcggcagcgtcctcgaagaagcggcggagcgacctggccaaggcggtggagctcggcatcaacgggctcgactcgcgtggcagcggagctcggcgtcgacctgtccaaggcgacggccgggagaaggaggaggtgggggagtagatctggccggcggctcgttctcggcgttctctccttggcgggcgcggagcccgctctctcctcggcgcgctcgtcctcggcgttcttggcggcggctcaagaacgggcggcgcggttgtcctcggcgttctaagcggcggctcaagaacgggcggcgcggtcgacggtgccgcctcgcctcgccgtcggccgagcgcgcaccggcgagcctttccccttcctttttgtacgcccgcccacccctctccctcccctattccatcctgccgccgctgccgcatccatccagccgccgccgccatttttgtttcatgggagccggcgccacagtgcaagggagagggcacggggcggcgaaggcacgctgcccacagtgcgcatgcctcgcgatttcagcgtcgcccttgacgaagtttcacgtcgctatgtttggtcacgagtttctctgtttggtcccgggtcttagcgccacgtcgacgaaaatcctacatagcacaacaaggttctgcttcacgtcctcgcactgtgaagggcctaagagctaccaaggcttttactagttactgccctctatccggcagatcagctgcttcttcctacttcttggatgctggcatgcagtgagaccctcaaagcctccagctctcccctcagcttcaatggaaccaggtttttccactgtaagaaaaatgacaatgctttataaggcacatacgtacatatatatagtacaagcttaccaagtaaattataatgttcgcatctattttttatgtatctttaacgatgatacaacagtgatattaaacatacgtaatggccacgctactactgtctaacagcataacgtcatgtcagccttcacacataagcacacgcatacatacgtccaacaagcaagtaccagcgagcattctcccaaaagtttttcttcttagaggtggggtaattgtcacgcccagaaattcccgaatagaattccaaacagaatgtgcattaaaatccccgtccaggaccggccggggtacacaagcgacaaagttgacatatagatccacgtcttacaaacattataaaagtcttacataaatgcagcggaaaacttaaaggataactggagctaagccttgacttggactgcagcgggaacaccactccacaggcatcctcgacagcacggacgaagcctactcctcggagaaaccatcatctgacgcatactcaaattctggggtttggggaaaatagagcaagactgcgtactacccactgtactcagtaagtcataccggaataggggtatgatgcaggaaattatcaagggatagctataatggttcatttgcataaagcggacgattataaacagaagttgaaagcagtaaaatagttgtaataattaatcaatattaatcatccactgtccaacgctataccacgttgtaacaggcccaaccatccacctatactagtcaattccattagactggtctagggtgagtataatcacggtgaatctagttgaccgcccataaccgcgggcacggctattcgaatagttttactctaatcagaggtgtacaactgtacccacaagacacagccccacgacacgtttccgtgcgccgacatgccaccacgacataccggaaagaggccgtgacaggacccttcgcataaccccctctaaccaagcacaccacacctcaggtttcacccccactcctcgcaaggcagcgggcaatcccctctcgtgcctaggtgaatccggaagccgcataggccgtcgcagggtccatccaaactccatcacgcccacccttacctggatgcgtcggctagaggaaagctatattacaagcccagccgttgcccacgctggcttgtggaaagtacgaggaattcttccagtgtttcccacgaaccgttccttaattgccatgggtgcgaccatcaaaaccatgcacccacggcccaccatttaatattaattaattaaccaacaccggagcggtgagcattaaccaacaacaatcctagaatttgatatctatgcattaatgtagttccccattgtgtgctagttgaactaagcaaagctaagcattccctagtccaatctctagtcatgttatatcccaagctaacaaaggaacatgttaccagatagcatggctatgacagtaggtaaacatcccatagtgatattgtaaaacaatgtagtatttgaaggaaaacaatggagcatttgcaatataggatcaacatgttcaagtgacaagcatgacttgccttgctctgcagctggaggaatttcggcgacaatttcaaggtacaccggagcgtcgggagagccggaatctaagcgacaaacaaagcaaacaatacaaacatgctataagactactgaaacagagaacaaaatcatttttaatggattctacacattttccttgatttactgagacttgaatgggcttaaacggagctcggatgaatcagttatgaattttagaagattcactgtgtttttactataaacggaaaaatccttaattgatttattgcgcaataaataaatcccggggagagagagagggcggcgccgacatgcgggccccacatggcagtgactcgagagggcggtccacggcggaccgggtccacggaccgggaaaaaccggcgtaccacgtggtgcacacgtggcaccgacgcggcgtacacgcggcggcaacgcggcggccgaaccgacggccccggtagatcggacggcgggggtggctcgcggccggcgcgcgcgggcacggctcaagccggcccggcggccatggcgcgcggtggcgcggcgcgcatgtgacggcggcgcgagatggcgaccggcggcggagagaggcggcgtcgcggcggctaagcggcaacgcggtggctagcggcgcgggagagagagagggagggggaaggggaggcctcaccgacggcgaccgacgacggggagcaatggagggcggcggcgacggcaggacgatctccggaaccacctagcgaacaccgtggaaggggttagtgagggagagggaattggaagagggtgaggacaccggccgaaggcggcggccatggcggtgctcaccggcgaacggcacggagtaggttccggcggcggacggggtggcccgtacgatggcgaatgcggcggcgtcgtcggcgcggatctgcgcggcggctagcggcgaccggagcggtggcggcggcggcgaagaggagggcgacggcgctagggcgttagagggcacgggagggctcggcgagatggggaaaaagagagaggggtggcggtgacgcttaaatagaggaggggaagctcggacgtggtcggtagaggcgggaatcgccggccgacgcgggggagtgggggaggagagagaggcgggattcgaatttcgaatcccggccatctcgggcgcgggcgcggcccaaagggagggggagtgggtccgggggatgcggcgcatgcgcgggcgtggccgacgtggcccggagaaggcgggaaacgtgggcgcgccggtggttccggggcacgcggcgccggctagagaaaggggacgggcccgacaggtgggccccacctgtcggcgaccccgggagagagaggagggaggcggctggctcggttaggcctcggcctgtcggccggcccagcgggaagggggggggaaaggagaatgggccggcggcccaattgaaggaaaaagagaaaagaaaaaggaaaaagaaggaaaatagattttcctgggattaaatattgcttgtgctcaattttaattggttaaaattatttctagagctctgaaaattccactaaaaatcttgttagaatatttcgacatgtagaactcaagaaaaattccacatgctaaatccgattattatttgcattaatttattagggttttctcttgcttttacaccgatattttctctggtggattataaattcaatttaggcttgggaaagaacttcagggtgtgacagtaatcctggttagaggcggggcttgcccgggtttaagtttgcttgagaccggctcaccattcttcatgtcgatgtaattaaaactttatttcccccaattttaatgaaattgaccggtcaatctttggccgtcccgacaaaaaaaaaagaaattattttgttaaatcctcattcccttttactcctgaagcagactatgccggcctgctgttaatctcatcactctctccatcagctgcattttctataatccttctcagacaatctatttccgactgttgtagcttgtgataatcttttataaaaagagaagaggaaaaagaagaagaagaaaattgacctgctcgggttgcatatcctcttcttttttcttgagatggttgggttaatgaaagtgtaactggtgcaggtatataacatgtttgcgtggtgctgctgaaattcgtttgcgtttgcatggtagaacacacctttacccttcaaatttcaagtaaagttgtgcgaaccttgattgacccttgtgtgctgtacagtcatgttgttagtactggtatggtatctttgttttcagttcatatatcttcgttgttttctacgaaatttcaataaagtttgtgtgaaaattctctatgctacatacaggttcttgcattcacatattccagattttgctctctaaggcctcgtctgagatagctgaaattgataggttgatggataatgtgatttttgtgatagccatttgacttttaaagtagtactagtagcttggaaaacatacaaacaagaaatcaaggttgtgttagttcacactaaaattgaaagtttggttgaaattggaacgatatgatgaaaaagttggaagtttatgtgtgtaggaaagttttgatgtgataaaaaagtggaagtttgaagaaaaagtttggaactaaacaatgccttagttcacaccaaaattggaagtttagttaaaatcggaatgatgtgatgaaaagttgaaagttaatgttgtagaaaaacttcgatgtgatggaaaagttgaaagtttgaataattattttggaccaaaacacggtccaaataagagaagataatccctccggagcgtcgaagagtctaatctcctgatggtgtacggcggctacggcctggaaaccagaacacaagcacgactggaaaactttcgacttcggggtaacgtggctcatctggaaattaagaatgcaatgctcaaatcttagacggaagagcagagcaatttatgacggtgtttacatgcaggtgtgtaaaattttgacgtgtcatatcgagtattatataggatgttgcatagggtatttggacactaataaaaaaataattacataatccgtcagtaaaccatgagacaaatttattaagcctaattaatctgtcattagcaaatatttaatgtagcaccaccagggtttcaaaaaccgccgggggcccggttaccgtcacccggcggtacggcggttaccggcggtaaccgcggtagccgcgcaaaaccgcgacaaatttacaaatcgaaatttgaattcaaaaattcgggcaaaccgcgcggtttggcgcggttaccgcgcggtttgacgcggtaaccacgcggtttggcgcggttaccgcgcgatgtgtaatgggttgcacagtaacgggccggcccattttttttttctttttccaattttcaaatttattctccgttttgctctcaaatttgaataaatattactcttttttgagaaatttcttcaccataaaacactataaatcaagcactaccttcactattttttttgatttttttcttttttttttaaatttttgaatttggacgaattttattaaaccgtaccgcgcggtacgggtaaccgtacccccgcggtacgggcggtaaccgcggtaaccgcgcggttaccggcggtttttcacacctgagcaccacattgtcaaatcatgaagcgattaagcttaaaagattcatctcgcaaattagttgcaatctgtaccataattattttttagcctatatttaatatttcatgcagatatttaaacgtttgatgtgacatggtaaaaaattgtaaggtgggatgtaaacaggcccagtgcaggagtggaaaacttggaaggctgcggggttagcaagcaaccctacgattagtagcggttttggtgtgtggcaaaccagtggcctggttcggtgtgagagccttggctctgcttgtactacaatacaattttttgaaccctctccttttcaatatatacttcggccggctacgccggtccggcgaaatatttatcaacattggccgtgtttatatccaaactttcaacttttttcatcacatcaatctgtcatatacacacaatttttcagtcacatcgtaccaatttcaacccaaacttttaactttggaagaaactaaacacagccaccgtgaaacttgcatagcacaatgctttcccatagaaaagattcggttctatctctcttactttttttccctgttatttaagtttcactgctaagcaatatgcatatttcactgatgtcttagttgatttcagctgtttgtaatttgcaattggatataaggttaattgctctactattttgtattacgaaaacttgaggaaggcttgcatatattttcagttccggttccatctcgaatagatactttatcgaatgcctagcattaacatttgtggcgttgagatgttataacttaacactaaaattccggtttgtatttacataaattttttgacattgtttattgttcaagtaagtttttcataagagtcaaattgtcaaaatttcggtcgtttgagacgctgcccatactccgcattctccttccctgaagaattgcagatacacaaggctcccattttaccttttctttttttttaaaaaaataacaagaaccacgcataaaaatttaggaaccgcaactggttaaaagatcagtgcactgcacatttataaacagcaaacaatgagaagattaacaaaatcagcggcgcatgaatagcccatagaacgagcgctctgaccagtacgaaaacgtggagggggaaaaaacgaagccattaaattaaacagaaccaagatcgcgcatgaccactactgataacataacaaaatgtagtagaagacgagcaccatacatcccctcagtgtcacatgcatatactgagaacacaattcaaatatatgttaatatgttacacaccacggttaggacaaaaggatattaagtgcaatggctgttatgtcagcaataacaagtcatcacaaacacacgatgagagctgataacaggagaacaagtgcttcctttcccgaatcgtttgcatgcatacttacgcactcccatctattttagcactcaaagtcccaactgcactggacgcaataaatatcgctgcaacattaccgccccacattagcttatctcgaaactccccattgggcaccccccaagaagttaacagcctgtgtatatgcatgcacatatatgaagctgaatccagggtgaaaaaaaaaagaataacaaacttgaacttgtaagctaccacatacctgttgagataatttctatcttcgctcttcagtttcctcacttcctccacatcttcaacaatctccctttgtgccatcgcctcaaattcatcaaatcgcctgatacttttgacctgattatcattcattaccttgaacatcaattgtgacaagattgatcaagaaacgagtcctattgttagagagagaagaattcatagacttcaatatcaatagttttcaggatgtcttcccaatgttaagagaataaaatgaacatttgcatactgcagggtaaggttagaagttagaaccagagcgggccagtgctgtgcagtggtttgcaatttagtgagttgagtaatcattactaatgcaagctatatttttctgttagtaactcttcaaaatgattgtattctctgcatatgctttctttttttacaaatataatctaacatgaatcacacacacccacatttctttaactatatgcaattatttttttaggcatacaaatttgagactggtgcatacatgggttatttgcattcttaacatgtactgcagaagattgacatttcctaacttcaatctatgttggcaacttggcatcaacaaggaagcaaaaatcacatcgttcctagaacatatcctctctaagctttgaatggaagcctatctagcactccaaacatatcctctcgaatttgcaatatctttgatataacatcctaaagtggattttgcaaggtggttttacccatgcaatatatgtggaacatacacaccaaactctctcctatgtatcaatctctctctctctttcaccaacaaaccaagcactggaacaatgccaacataccatcacagttggtcaaaataaagagtgaggattgatgaagtatcaaagtatcgttgtagtttgccaaaactgcctgtttaagcttcccataggcaaaaccaccatggaaaatcacattctatggggttatatgggttaaactgtaaactttttccgtgtgcacattttttttgggtgtgtacgtgttctggggggtggagtgggggatctgaagctggtgttgaagttccagttggtggattggacttctgttcaaagtttaggaggtggaccatttattctaaccaaacagcattatattcatgtggccatctttttctcccttttctgttgagaaagatactcccttttatttaataagtaataacacaaggttgaactacatagaaagattctcccttttatttaataagtaataacacaaggttgaactacataaatacaagaaaaaatcacatgggagtcagagcatcattttaagaactagtataacctaccagcgatagaaaatacaaagcacatttatcttgctgaagtggccaaaacatcatttactgatagcccacctaacaaagacacgatacccataggtagcggtgtacgatacctaggtaccatgctgagtcagcaacataaactgcacgattcaacactatggcgctttatagtctttatgtaacaaaataatgcctttgctagtacatttgacagtctttgataatgtacatccctgacttgttacccgagtaaaaactaatgtgtgattgtgatagaaccaggacaaaatatacgaaaacaaaattagaacgagaaagcttgtaagttgtaacatataccaacgtaacttgtatcatacatatgcggaacgataaaaagaaaagtaaattttgctgtatatatgttctagatcataattattatgtctggtaggataggatttagatggtaagtaaattacctgtattatattatatgactggattgttatcatttcacagaaacagcgctccaagtaggaaacataaataagtgattacaatagcgaggtcagtgaccttgagttcgctcaggctccctcacctaaggggattgtggtgcggaattgatccgctccaatcctgtcccttcctcatagggattagatgaacaagtaacagggagagagatggatggatttaaattggcgtgcgtctcttaaccgcacgaatgcgccatcctccctccctcaaagtatttgtatgcagatagatttttttaataacttttgatttgtaactgttgtataattgtgtaagaaacgaagggggcaaaaaaaaaaaagggggggggaacgggaggaggatggaaacggattaggtggtacctctcccggggaggaagatgaggaggataatctgctgctgcacaaagagcgggtgcggtgggggagaagcctctgcagggcgggccgaagcaacaaaggcgcggacatcgcgggcaccgtgttctgactctgagctagggtttcctctttctccctctcgattcgaattcgaatatttcgagttgtaaaggcttaagctgcttgaataaaataaaaagaaaatcccaagatgatgggcggggcctacccagacagagttaaagcccaaatccatcgccacctcttgtctctcaagagaaacggctccaagttcttttcctttttctacttactattattattatataatatatataaataatcctcacctacccgacaatctctctcccaccccacccctttctcgtttcgttggaagaagaagaagaagaagaagaaggtggtttcgctggaagaagaagaaggtgaaaccctagatctgatctcggatgacggcgcgatcgttgttggccggtaggatggtggcggcggctcgccgcgccttccgcagctggcccctccacacaatcacaaccaccaccaccaccgacgccgccactgccatcgccaccaaggaacagcacaaggtatgcaggagccttgattgaccacctgcctatctttgttcatgttgggttgattgatccgcatccatatccgctcgcgcgagcccttcttttgatttcgattctgtatctcgtaatttggtcgatgcgtaggtggtcagtcgtcttgatgtgatggaggatataagctttccctacatgacacgcgagatggccgccgtactgcggcggagccgtgttgcggctgtcgaacacaacaattttaacatcaggcagcttgctaatccttaccatgggtatgttggcttctttcctctctctctctctctctctctctcttatatatataactggagtatctcggacgcaacagcacaatcagtttatgcatattgatctaacctgtctcaatttgcattgttcgtaggccggctgatggagatatcctgtatgacagggcatggattaacaatcttgctctgctttttactctctccacgttatttggggcgtttagtactctagccaagctaaagcagacacggacagtggaccaatgtgtccagacccaaactagttaaagcaaccactgaggttgtatggattccagtcccaaacttgttaaatcaaccgctgacgttgtattggatatcatactctgtatgtcgtaatacttaatttcatatgctattgtcataacttgagaattacttcctatatgttagctttatatgtttctggatgttctgttgtgtctgcccccaaaatacaacttgctcagttaagatttctcatgctactttttgatgatttgttcaccatgtcgttaacatggcagcagtattaggtttaggcacatctttcttttgttattacttattgcactggaatatcatcaagctagaatgtggactacctactagcatagcaagttacagtagtgtattatagtaatgatattgagcttggatttggcatatgttgtgcctacacgactcttttacatgaatcagagtagagtgtgtggcttcgaaagctgcctcctttggtccatcatgcctgctcccgtaacttgctttaaaaatgcataggaagttataacctactactgggagtagctactcccaccctagtagatgttctcctcactttctaattgatattctgctatataactagttgattttctgctccatttctagttgaataattttctgcacattttcagttggtagattgctcgtttcatgtcatatatatactgctttttttctgccctatattctgctccttgtcaagatgatttaccgatcctcttcaagtgaatgtatattccgctcattttcatgttcatattctgtttctttccaactgattattttctgctcccaacgaacatgaaaccatgccgaggataatcatcatctgatctcttttaacaaatcccataatgggttttgggaatagcgtggctccaagcaaaggaattaagagacgcagaatcagctgtagcaagtccaactagcatatggaagtcctcgtggacagataggcagtaacgcagtacaaacattttgtgccttatctttgtgtttaactgatccatctggctaacgaacttctttgtacaggaatctgctatgtattcttagctgcgtgcagcaaaattatctagcaaaatgcaatcaatagcacaacaacagggcaatgaataaaactccctactcacctgagtacctcacaatgtctaagtgtccctttaaaaggcactagcaatcgtgcacatgcaatgcacattttcagccatatacatacatacatacatacatacatatatatatatatatatatatatatatatatatatatcataagatataaataatcacattaaaaaatataatttttatcgagcaactttatgatgctttaaaaaatgcataggaagttaaatcaatgtgcttcatcaacaggtgatctagtaacgatgcacagataccagttaaatagcatgtcctttattttaagatagctaaacatgtactttctctttctccgtttcacaatgtaagttattctagcatttttcatatttatattaatattaatgaatctaaatagaaatatatgtctagattcattaacatcaatatgaatgtgagaaatgctagaatgacttacattatgaaacggagggagtaccaaaattttgcaaatcaacataatctaaggaggctacactataaagaagcttgtaatcatgctaaagaaaagagagtcaatattgataatttgttttgttagaatgtattatcaaatttatattgaaccttacatatgaataaacatatctctgaacttctataaattacacatgtttatttacatggtgaatcattataatctaatacaaccacaacaaaattcctaaatgaatttcatggttatccactttcgataccatttgaagatctggctttacattcagactacctttacccgattacttgcatattttgaattcgagctctccattgatattttaccttgactaaatccgtggttggttttgatgaaaaaaatgattccaacttgcatatgcagctgtaacagttaatcttcaaagttcacaacgaaaatatgtgtaatattgaaagcaccttataggaaggaaacatgtatagaatgaatcaaattctaaagtaatttaaacaggtgcaatcttttaacagtgtaatgcccatattttttattgagagggatggaccagtgaaccatcatctctgctagtagaaagtaaattccatgcataattctcaaagaatcagattaaaaacatttagtagcattatctgaaagctaaagaataatttcttttagtgcaacaaatgattatctctacattacattttaatcaaatttggaaaaatataggtacctgaacaagtgtaagcctagaatttggaaaactatcatcagctttatgaaatttattccttcgtttttgttgcatagaggatggtggatggttgggtcagcacctgaaaggaggagcatagtactaccattcacctaaatcaagaccaaatttcaaaagtttgtccaacttatttggtagtgccacatgttttttttgtgggtactgttggtacaaaatccaactagcgtaatcaatgtgtattctgtattcgatcggctcgagatgagcgaagtttacatatttagagcaagttcaatagtatagccaactattagctccaattcatctatagtcaatctaatagctcattcatacaataattacatactatactattaatacgcggtcccacctgccatacacacattgcgtcttggagtccgtgctatagctggttacaaatctgtagcccgcttctcttctctctccttatttatcttattaaaatatgtttgtagctggcttatagcatgctattgtacctgctcttatacaaaggccattgaaaggggaagttacagtgctatcgagatgaactgagtgactgccatgcaggccagctcttgggtctcttcgtcatttccctggggaataagttcatctaaggttccttaactttacactgaatccgattttcgttcttgaaccccaaaaccagatacaacttgtcccttaactgtcaaaaccggtgcaaacaaggtccctcggtggtttggaaggcggttttggctaatgtggcgcttacgtggctggcttgactaggtcttcgtcccacgtggcattgacgtggcgcttacgtggcaattctatcccagaaaaataataaaaactgtgggcccacatgtcaattacacaaaaaataataattttaaaatggtggggcccacgtgggccccacatgtcagcctcactcctcccttcatccctctctcttctctctttgttcttcctcatcctcactcccctctctctcttcttcttcccggggagtgccggagcggacggggcgggtgggcggtggagcaggcgagcgaggcgggctgtccgagctccggcggtgggcaacggcgccagcgacgggagcctcgaccgggggagaggaggcgccgcggtagctggagccggggtggtcggcgcggcggcgggtgaggtggtggtaggcgcggcggcggaaagaagctgctgctgcatctccagcatgatgcagactctgctttccggattgcttgctattggaagaattgaggagtcgatcgactactattggaagagttgagctagataacttatcactgacagttaagctatagctattttttttctccatatctgaattttcttttgttgacaaaaccattgctatgcggccaattcatagatcatcaggcacacgttcaattcacaacaagtacttttctttgcgaatccacaatccccgctacgaccggctgcctcgccatgccagtatatgccttggcgaccccttcccgggctggtcgggagaccggcagcgtggtggtcggcgccgccgcggggtcttgcgccggccacatccccgccctcagtaccgctgccaccgctgtcgaactccatatccttctcgagtatgacggcgatggcgccggagtggtcatcctcgtcgtcggagcccgcggtcgagcgctccgactcctgcggctactggtccagctgtcgcgtgagcagccacggtcaccaccacgaggccgcggaagacgacgacccgtcggagagggaaggcggcagcgagggcgccgcctcgccgaggtcgccggctgcagtcagtgtccgaagaagagagaggataatggaaagaagaggatgacatatggggcccatataggtcccaccatttttttattttgtatgtgaaactgatatgtaggtctcatggtttttattattttttcggatcgaattgacacgtaagcgctacgtcggtgccacgtcagttgaagacagagtcaaattagccacgtaggcgctacatcagccaaaaccgccatgtaaaccactaagggatctcatatgtactggttttgatagttgagggacccgttgtatctggttttgcggttcaagcatgaaaatcgaattcattaaccagttaagggaccacggatgaacttgttcctttccctggtgacaaggttgggctatgcccaccaaggaaactgggccggcgctgaggaaatttaattttaacttttttaggggaaaagaaaaaaaaagtgaagcagatggttttctcaacagaaaaaatcccaatagaaaaacaagatggatggtttctagatagagacaaagaaaaaaaaagaaaaagggaaagatcgactgtgtatagatggaaacaaaagaaataaaaagagaggcacgagagaaattgaagagaggcatgagagaaactgggaaggaaaaaatagaggagatcaggaggcactggagagaatttgggaagaaaagaaaaggtaaagaaataaaaggggagaacgggaggtgctgatttttcacgggagaaggaggagattgggaggaactgattttttccaggggagtggagattgggagagcactaattttttttcttcaagaggaagggagttgcgcgcgtgaggaggggccgagggggaggagaggagttgcgccgtgcgttgggggaaggggcggacaggagcgcggggccagcatggaagggcgcacgcgcgggagaggataagggcacccacaatggttatctataagctctttacaagagatctatgtcagcatatttttctatttggaaggtattaaacgaatagagagagcaaagctatctactaacttagagatagtctatagagaaaaacgaggcaatgcatgagagagctatagataacaatgtagacatactattaaggtggtttactattaatcgagtcaggtgaatgggagggggagggtttgggcttgttagttgctaaaacacctatgataggtatggcctcaataaatgcatgtttaaaaaaataaaattgactgcattaaaagaccaaaagggcatgaaagacaccatgtatataactttctagtttattgttgtatacaacgtgcttaattatattcattctatgactaatttcatgttaatacactgtcaagaacatcggtttaaaaaaaactagtcctatttctaacaaaacaatttgaagaacaaacagaagctcctagcgtactgtgcttccaactggtgcttcttctgcttacgaccatcttctccacatgataccgcggcgacatatgtacggtcgttggatcactaagatgatgaaccagcaacttatcccttcctatctttagatcttgactaagaaaagaaaggaagctgtcacgctacttaatctgcaaaacgaattggtacccgtcagaatataagaatgaattgaaataaattacacacgaatcacgctggcaaccgccggtgacggcaccggtgaacctcgcgacgataagtggcggcgacgatgaacctcatggacgaccggcggtggcgatgacaaacctcatagcaaccaacagcgtgtaacgtcgtggcaacgaagctagcggatgaccggcgacggcgacgaaaccttgcagacaaccggtatagcagccgtggcgaccaacctcgcggacgaccggcggcgtcacggcatggcgaccaagctcgcagtagcagtagcacagcatcatccaccatccattttgctttagaattcgtgctatcaaaaaactgagtattaaacgaattagcgtcctattcctatccctattccctaatccgatctgcgtccggccatcgtcttcttcttcttactgtgggagtgcaggcctattcttgttgggccctcaacagaactcggcccagcaactaaaaattctcacagcctctttttttttcttcttttctggctcgaaaaatctttttatttttcttttcgtttctcgaagttaagaataggacgcagttcttctctcggctctcgctctcgtcgggagaaatttggaccggcaattctgttcccaaaaaaaaaaaatcgtacaattccgcagcctaaccctagtcgacgcgaacctccagccgccggaagatgctgcgaccagcggcggcggcggcgggcagggccatccggcgagccgcgtaccactccgacggcgcccctcctccccgcaagctccggggcccccgattcagccctctcaacaggcacaaccacgaggtacctcagatctatagccttgttcgtgcacccatctagagtttacccacccaaatttagtgtagaaagagagagtttttcatgtcttgttcaaagtacgaattagtcccaaatcctcctggctcagaaacccagtccctccttgtgtcatctgtttatcattgcacttgtttcctcctgctatcttcaaaaatatcactacctttttcctgtgcccccaaccttacacacacacaaaaacaacaactagggattcaagtatttagttactgcctcaatattcatgtgcaactttccaaagtattcggttcgccttcttctgggattactctatacggttgttatgttgcaatcaaaagcacactcctcttgggtaagagatggcactactgtcaaattccattatgccatagattgtccatgcttatttatgatgaatgaatttgtacaattgagttatataatttcataaggtttcaggcgttgtgatgtttttaaggtgtgtgttaagcatctgtcacttaatttgcactagaattctgactcttgctgttaccacagattaaaagcttgtcttttgttcaagcctccatctctaatttatttatctctataacttaaataccttatcttagaggttcaattaagaacgctctcacaagaaaaggaaaagctttcttgcgcacagtgcacttgtgccaaatgatgcatttaaagccttcatcttttgttcctccttcctatgttgttcaaagttagtttggtgaaaccctcgtggctcagaaaacaatccctgtgttgttcacagttacacctgtttttcctacaaacttgggaaatcttttttcaccttttcctttttttctttttacaaaaatatacttgtcctcccatattgtcagggtttaactactaccaattcccaaatattcggttcaagtgccaacatcaaacttcactcagttttaaattcggtatttctgatgctgctgcaatgttataactaataatatgccaattgaagctcaccccccttgatgaaaataaggcactgtcaagaaagaacggagcttgctttccttctattatggccctctgaatgcatgttccctagattatatatcattgtgtacacttacttatgataaatgagtttgtagggtcgtgtttccctaagattttggctgtgctcactgtgaagttgtaagaaatccagtagttcttgtgtgcttatgtagtagcatctgaacatcttactctaaatttttcaattttaagttgttcttctacagttatacaaatattgttagcttgtttattgcgcaagcattcatatacaatgtttttccttgtcatagtggttgaattaagaatctttaacatcttaaagaaaggctatgtcgggcgcagcacacttgtttaaaaatgatagattttaatccttcatctttagtcctcgtttggaagtgatgaaatgtggatggaatcaaaatggatggtctacttgattaacacggtgaattaatatcttgagaaattaacttaacaaatagctagaaacaagtgttctaaacaatacagtagaagaaagttattttcagaaatcgtattttcggaagtgtggagcaaataaatcgatccagggtagattacagttgatcatcacttcagaaaggggccttagttttatggatgacttaattatcactgtgcgggtacagtgatattgaacgtgctaaattttatggagaactgcagttaaatataattcttttgtataaatctgatagcagatgtagatgtctaatattacgcacgttgatgtgcaggttgatgcgttgctcgaggaaatcaagaatacgccggttagcatgatttccgatgacttaattatcagaactgtgcggcagtacgtaaacctctgaattgcagcttctgttattatttgttgtgtgtcttgttaaccatcctaaattgataattactattacctgtccttgtctgcttctctagttctattttggctcgtcagcagattcttgttcaaaatgttctccgatcatgggttattgctgcagcagttctctcaggctattgctgggggtacaacagagtggccaaacgtcctgtggctggctctgaaccaccaacagaagatgaggtgtagaggacttgacagtgttttcttttggagatgggagtctagaagtctgggagaatcaagaacgtagtgaactaagcatgtgtcataatctatcctgtgtatcagtgactctgtgttaactataactaattagtcctagagctaattggtgtggggattctgtaatgagagatctcgttcggtttgacctgtacatgtttctctggttgcggattctgttgccgaaactgatatgtgtaatgggagatctctttgggttgatctctgctttattttgttgagcaaatttgcaagaagataacggtttttgcccttttttgaatatcttttgcctcctcacgaaaactgacacgtgctaggctagtttgtaaaaaactcctcgttatatacataatcttacatcgaccctctcaacacctgatgtctaagctgttttttttttaatataattgtgaagtgaaaaatctgctttcagggtagcactgtagacataaagagtataggggtgtttctgaaaacaatcttcccttgttccacctatccccactccgctagccaatcaggaggcatattcatcagccctcggtcgatcgtgcaaggtgggccgtgggctgaaggcggagtcgtggacgcggagacagaaacggcgtcgcttcagctgcaatttttagttccccccttcttttttttggaaaaagtacaccgaaggtccctcaacttgtcatcgagtcacagaatcctcccccaaccgtaaaaccagatatccggggtcaaaactggtcacaataggtccttcgatggttttgaccaggttttgtcgtacgtggtggctgagtcagcgtgggatctacatggaccccacatgttagggtgccacgtcagcacacactctctctctttcccctcctctctctctctccccctccttctcactcttctctgcctttgactgtaggccggccagtggggtgaggcgggagaggaggtcggcgccgtggcggctgctggcgtcggcgggggctgcgatgggggagaatggagggcgtcggcgtcggcggcggcagcgacatgggagaaggggagggcgtcgccgcacgggtgaggtcgaggacatagacccggccggcggctcggtggagctcctcggcggccgaagatgggcctggggaggcagtagtgacgcgggaacaacgcgggcgtgcagcggtcatgcgcgtgcgtcgttggcgcgtgcgtccccgacggagcgagcgagccgccactatctcccctaccagccacccacccgaggacgagctcccgcaggttggggtaggctgcggcggggagctcccatgcgccagttgcttaggctatggacgtccaggaattggactgcgtcgtcgacgtccttgccatcgccgccaccgccgttgtagaggcaccgccctagaagggcgccgccttgggtggccgtcgctgcttggtatgcgtcattgaagtagttggaccacctgaactcgtccagcactccggcgttgtggtccatcgtcgcgacggggttggcatgtcctaggttggtggtggcgacgttggcgcgctgctgactgctcggcgtcagtcgcggcggggctgaggtcgtccatggaggtgagcgtgctggagctagaccaccggtggaggaggatctcccaaggaggcggtggtgcatgccgtccgctgcctccgacgacgccacacttggccgccacctggcgtgccgcctcgtgcaggtgggcattagcgacgtcttcgccgtgcccggggacttgaacctcacgcttctcgaccacctcatcgctgagcccggcctccgcgtcgtcgactgctgcaacgagctcaacaccggctatgccgctaacggctacgcgtgggcccgtggcatgggcacctgcaccgtcaccttcaccgtctgcggcctgctgctgcacggccgccgtcaccgcagccattggttctggaatcaggagacgggcgacgaagcaggcgccgccttcaggaatcaggagcgtgccagcgcatctccgtcgttgccgtcggcggtagctcgtcggagtggctccgtcgtcgtcggcggtggttgaagcgtgtggctccatcatcggagacgacagcctcctaggaccggcacagttgaagcgtgtgggcgtggctccgtccggcaccgtcctcgtcctctcccttgcgcaagtgaattgggcagtcgtcgagctcgaggccgcgtttgctgtgagccaccgccgcgctccttccccgccgggcttgtcgtgcccactgcaccggcgacgcactccgtttctcccgcgtcgttgccatcgagcgacggctcgctcgctccgtcggacaagaggagaaaagtgagagagagatgagggagggagagaatgggggagagagagagagggggagggtgatgacatggcatcctgacatgtgcggcccacgtgggacctactctgactcaaccgctacatcggacaaaaccggagtaaaaaccaccaaaggacatcaagtgaacggttttgtaagttgagggatgtcatatatctggttttgtggttggaggacgattttgtaattcgatgacaagttgagggaccatcggtgcatttttcctttttttttttgccaatatctattttaactgggctttgggccagaaattttttgggtggtcaggggaccaccctttggatccgctggtgatgctgaggaacatgtgaattgactgtcaggggttaactcatcatctgagtctcatcccagagttgtaaaacctgggacagtcgttaagtatcatctttgaccgttaattcctgcataaaggaatgcaaaatataatatcaaattaagtggtagggtttactaaccgtttcctctagttttggtaagtatttataccccagtgattttttggatgaatttacccccctcctgcaaagaaatatacctatatgggactaaaccacaatgcaccgtcttaggggcccacatgtcatcccctagaggaaggcagtggagagtggtgg

SEQ ID NO: 36873 - DNA, 17023 bp, Oryza sativa
  unsure (1)..(17023): unsure at all n locations
cacctccaccttccacaatgatagttgtgggtacaccgacctccacaaccgccattccaaccgtcatatggttatataaaaggatgagctccagccgttgcacaacacacaacaacaaaaacaaaactcactttcatattttaggcatcactttattagtgtggaaaaaatagatagagagtgaggggaaggtctggaggaatgccggagttgtcggtgctctctcctcacttgtacctcggtggatgcttcatttaataaagtaagtgtttgagatttcttatggtatttaattagcatacttaagtgagatatattctcaccattgcagattcgacacttagtatttatattaagagcttgtttggttctttaccctactaattcattggcagtgctaaagtctaggcaaactttggcactaccaaaatattggtaagataaaattatttagttaacatttgaattgctgccaataaaaagccaaattcttatagtatagtaaagaaacttctagaatataaccaaatagaataggggcgctaccaaatatttggtctcaattcaaactaacacacaaactattcaatttgccaataaactagcatcttaagtcgtgtgttcacacggttatgacctctccatctattaaaatattgtttgtgttaatggacataatgtttaataataattaataataaatatgtttttaacattttttttaagaagtgtagctataacattaatggatttatatatcttgatttgtcattaagaatatcatcgtaacaacaaataatttatcatatattagcgcaaccattacctcctacaatatctaaaagagtcaattgtagtaataatgtaaatagccacatttcttacgcgttgcaattctttcatcaccagttgaaaaactgcatatgcaccagccttcaagatcaattgacacaaaataggggatgcaaactcaaagctttttcatctaaacgaaatggcaggagacaccacaatcacattcaaatgttgcaaacctcaatcagtttagttttgtcccatgaagagaaagggcaagaagttcagagacctgttccctccataaaaaaaaaaaaccccacatctgggtttgaatctagacataggtcggctatgttaagaattaaatccagaagtgtttttttatggagagagtaattgctttatcatgcaccaagcttttccttttcaagatcctacaggagatatgtgtgtgtatttgtattaaattgaaagaaagaaacagagaaactaagtcccaatgtaaagttgagaagccaaagattacaaatatgtagtccttaaaattccaaccaaccaacgaactatcatttgtcccagaccatagtgggaaacctcctctaaacttttccaccaaaaagaaagttgaagtttatgtattcactttatacccagtttggccaatccaacagaatcatatgataaatagggattgttgacagctgagaggccaacagtctggagaaaatctttgggaaactatgcagaaagcttatatgctttataacccatcacctcaattatttttttttagacaacaggtaattgcattacccaccttggaaaccaagcccagagacaatccatcacctcaactgcattcctgtttctagacaacatacaaaacaggccaccatacatacaaagatgaatgaatattggtacaataaactgacggggcatttgcgtttttaccctattttaaggtctaactaccaaattgaccttgctttcttcagtttgctattttgaccctctttttttaaaacgaacgttaggtctggccctattccgttaaggcaacataatggtgttaattcagagagaaatgacttttatgccctcactcatttgactctattttttcaaagttttttgcttgcctaattttgtgtatttttatctgaaaatgtgacattatttttactaagataagtgacaaatctaacttaggtttgagggatttgacaagtttgaaacagatttaaattttttcagacaaaattcacttagatttgatatattttcgacaaacttaacatacatttgacagatttttgataaatttcacaaaaaatacataatccctctacaccagcagcatgcagtcctccagaccaggagagcaccggctccgtctccctccagccgggcaagaacaaggagaggcgagagaaagacggagagcagcaatagcaaaaacaaagcagcaaaattctagggagagagctacaaatcggacgtccgatgttgaaaaaaaatcggatggtcaaatgtttcagttgaccgttggtacaacattaagttatacatggtgaaacaaaaaaaatcagcctataaaacatatagaaattttgtgaaacacaataagaacacatggtgaaacatattgctatcacgtatgaaacattaagcttttattgtccgaaacatatatttttctttcacaacaatataatcatgtgatatcttgttgtaaagatttaattataacgaattcaacggtgtgattgaatcgttcatcggataagtagtttagaagaaaaaagatttttaatacgactaaatacttgcatcatgcatggtgtggggagaaagctaatagatggtaggagagagagagagagagagaagaggcctgagttatacattggtgaaacaaaaaatcagttgttgaaacattgagttatatatagtgaaacaaaaaatcagttgttgaaatattttaaaaatttttatgaaacataacaaaaacacacgttgaaacatattgctaccgtgtctgaaacattaaatttaacggattgaaacatatgtttttgtttcatcggaatgtaatgatgtgatatcttgttgtaaagatttaattataacaaatataatggtgcgatcatatcataaattggataagaagttgaggagaaaaaatattctgaagaccattatagcatgtatgtatttgtgaagtggacagggaggtagtagtttatccgtccgatttttgttggttgcgtcgaacgtctgatcctaagcatttttgaaattctagcagcagccaaacacctgctggcgagctcccgcgccatcctcgacctgcgctgcatgcctccttccgcggccagtggcggcgggctcctgtgtcgcgcgcctcccttcgcaccccgccgcggccgcgagctcccgtgccacgcgcctccttccgcgcccagcggcggcgggctcccacgccacgcgcctctcttcgcaccccgcggtggtggcgagcacctgcgcctccctccttccgcacggagtagctgctgccgccgtctgtgcaccggcgctgagagatatagggttgagagtgactggataggattgggagtgaatggatagggttgagtcatgaaaggtattttggtcagtttgattaataatgtgatttttttcttttcctaaatgaaaccctaacggtataatagaaatagggtcagacggtaacttcatttttgaaaagcaggatcaaataagcaaactaaaaaaaaaaggtcagattggtagttaggctctgaaatagggtgaaatgagcaattgtccctaaactgatagtatgaaagacctacatccaaggccaccataacgactcaacattggtagaattcaccttgtaattgtcctttcaactggtgccaagtatcaaaccctaggatagataaactgatactaactggattaaggatttgagttgtgatatttcctatgcttttctctatcccaactctgctctgagctctgaaggactgaaggtgctcaactgttgatccattattttcactacagaattgcgacaactactcccgccccgggacgatctaagaaacccttgtagcactccaggatgaggatggagtcaggatgggaaggggagagtaccttcactggattggcggtggtggtgggttcgccggggccggttgagggcgtggccgccatggaagaggcgcggcgcgggcacgacagggaggcggactgccgtctggatctccgccgccatgccttcccttgggtgggtgtgtgtctccggcaacaaggcggcgggggctcgccggcggcgacggcggcgtggcgagaaaatgaagaggtgaggatgatgagaatcttaaagcaatcccagccgttgtaaatcgcttggttttttccccttaataaaaccaaaacaaaaggaaaagctggagaaatccttgtaaatgtatgggcctgggctgaatttcagggggccacctacaaatcatgcctcggtgtcatcatcgtgtttggatctcctatgacatttcttccgcgtttagctaccaatgtcgattttggggttggttttataataggtaaaatgaagcaaacaaaagaaaatacacattgattgagataagagtactagaaaattgttggcatgcaaacaatactttaatccgttcaaatggggcgctgtttcaccaagtagatcagaattgtttcactaagtagatcgaaattgtttcaatattttaaaaatctgaaacacaaccaaatcacctcgtgaaacattttgctacaaggtttgaaacaatggtttccaaaaaaatcgggcattgtttcactttatataaaaacaatgtttcagcaaatagcgaaaggatgtttcaatttgctgcaacatttgatccatagatagtgaaacatcatgagtacacttgtaaaacattgttggtggaaaaaaatgaaacagattcacttaatagagcgtttctaatacgtgggtaatttgttgcaatggcgcgtgtggtgaggcgcgtggtaggaacagcgcggaggcgcgggaagcggtgggcgcccgatttttttttgccactgatcgggcgcctgatcgctggcatttctgggatttcagtccaatcatatctcagttccagatacatgtgcatcaaatgtactgctctattggataaactttcttttataaaacttatacggattaaggagtaacattaatttaaggtatgttaaaaattgtaagtttaataaaaataataagaacaaagtcttgtctatctctttattgatggctagcttactttatagtttatacaagagcttctcaatatagagatgtagtaagtcttatttatcaggtcgtcgataattacatcggtgatgctagctttagtgttcaggacaccgacttattccgagccattcgttgtgaactataatagcggaagaatacataaatttaccttgggagccctaacttctctgtaatctcattctcactaactaggaactcaccatgatctactgccaatgggaggcttgtctaactttgcatttgctgggctttgcaccattttagtagcaaagcaacaaaggtttggtccatctaacataacacttctacgagctttgctacgagatgatgcgtattttaatattatatatatactagataatgctccgcgctttgctacgagatatatgtaaaatcaaaggtgtttttgattattattctgtgatgaataattggccattggagattattggttttgttatttggaatttattcacgaagtggttttggagatgattggatttcacaggtgaatctacaggttatcattttatgtgaccggtcagactgggctgtgtatgccggtcagaccggcggtgatcgagcggtcggactggctagcccgcggtctgaccggccgacactgtgtcggtttcggtgatggaccgggagtcggcttggggataagacgacgtccgtggtggtcagagatcatgcgggatacttaggctagagctgatgaaagtggttgatggagattccatatggcatacgatggagttattgtgtgcgtatgggatgcggagtcgaatttggaaggagtccaaatttggtacgattggtcatgtaaagtttctttcttgtattagtgggtttcctaaggtgtttaggactcctaatatgagtttggttcatggctttaggctgcctatctcatgtataaatagagggggagcgtgagtgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagcggaaaaataagaaaaacggcgcagacgactccactccacaggcagcttgaccagggctacacctaatcctccacaccatcagcatcactgtagaactcttcctctgataaatgattgcaaggtgagtatatgacatactcagcaagccacgcagcaaatatgcaagtgcacaaggataccaaagaatggcataatatatggctcatttgcaaaagcagcatttagcaaacatttgagaattataaaacagtagagtaattaatcattaattttaatcaacactaaacagcacacccatgctgctcaggcccaaccatcctgaacaaccatacccggctgtacatatctatctccaaaccaggaatataccattccaaaccaggaggctaaacaaattattaccagttatagcatcttttattatgatgagaagtgtgaaactaatcacgaaagacattgttagacccgcccataaccgcgggcacggctattcgaatagttttactctggccagaggtgtaccactgtacccacaagacacagccccacaacatgtcaccatgtgcctcaataccaccacggtacctcggaaaggagctgtgacagtacccctcgcacaacacaatccaccacagcgcacctttcctggatcataatcacccttataaacaaggcatggactccccagcgacccccgtgggcttatctccgccacttctcagtctggtgccccgcaatgaaccatgttatacaaaaggtaaagccgttgcccacgctggcttgtggttggcacggttaatgtttcacaaccgaaactcgtgaaccggtccttaattgtcatgagcacgaccatcaaaaccatgtgctcacaacccaccattatcaagttttagttggcaaattaattaattaaccaatcacgattaaccatcatgagctatcattaagccatcattaaataatagtgagtcataagttatcccaatagtgtgctaatgtttctaagcatggctaagcaatcatatctactatctagctgaaccaatatataaagctcaactagtcaagttatgataacccaaggtatcaaggaataaagtaatcaagaacaaaagggctataacaaacattaggttaattccacccaatgacattcgaaaataaatgcaatagttgaatagaaacaatagctttaaacgggatcaacatgctcaaagggatgtttgggatctgtgtgacttgccttgctggccttggaactcttcaaaatcttctcctgcaaaaacggactctccggaaacgtcggaatctaaacagaaaggagcaaaatcaccaaaacagcacacaaacaagcatgaacagtacatgtggatatttttaacatgtagatctctattttagaaaaaattagaaacttgaaccaactaaattcgagctaagatgaattagttatgaattttcaaagattaaatcagattaaatcatttatttagattttaattgaattatgacgcaataatgaattatttttgaaaaggaaaagggaattattgcgtcagcggctagggttcacggtgaaccgggtgcacggcggcggctcacggaaacgaacggccgatattgacccatccaaaacggacggccaagatccatcggtccacggccagaccacgagagacgacgacgatgacgtcagcggtgacgtcaccaccggcggcggctcaggcgcgcaaactcgccggcgaacgacggcacgacgacgcgaacggaggacaccaacacgtagagggcgacgcggcgaactcaccggtgaccaaaacaacggcggaagatcaacggacggcgatggcgtcgaggaagaagcggctgcaaccttcggcttgacgacggcgacggtcctccggcaacctacggcgacgacggaggggcggacgaggtcggcgacggcttggcgatcacgacggcagccttcccgagcgacgacgacgacaggatcggcggcggcgcacggctggacgaacggctacgacggcggcgctaggctacacggtgctagggctctaccggcgacgagaggcgaaggcgagggtggcgacaagtagcggaggacttggggggtccttttataggggttggaaggcggcggcgaagacccacggcgaccggcgacacgaaggaaagtctagggttcggaggagagagatcgatccgaatcgaactcgaatccacggatttccaaacgatttagccgacgattccaaaagagaaaaggtagaggagatcccgaagatcttttcccctctattgatttcaccggagaaggaaaggcacgagcgaatttggaaggagacggcggcgcggctcggctagggttccggccgggcgacggcgcgaggaggacgacgagtccgacaggtgggacccacctgtcagcggccgagcgcgcgcgcgggcggctgcgggcggactgggccagcttgggccggggagagggagagagaaggttttgggccgactttcggcccaaagccaaaagaggattttaaaaacctttttcaatttaaattattcatgaaatgcaattccatttattaaaaatacttccttagctcaaataaatcccagaaaaatctaggaattatagagttaagcaaagtatttaatgaaattttatctggccccattttatattggaatttattatttaaaattagatcttcttttctaggcttttaaaataaattctaataattccaattaaacaacaatttatatgtttaggatttttagggtgtgacagtgaggcttcccggtatcgctttagagagcaattgagttgagttttgagttagggtttcgagtttagtcgaaatttttgtaaggtgtgatgttggtgcactttgtaaacacagagagaatcaataaagtcatcatctactttaagagttcttcgatttgtgtttcaccgggtttcggcggtctaaccagcggtgcaccggcggtcagaccggcgggcacacggcggtcagaccggcggcgacaggagtcggcggcaggcattctcgacagttcgaccgatcgatctacatcggtcagaccgacgttcatcaggcggtcagaccggcgcaactacttcggtcagaccgcgatccatcgatttcgagggtaacttttattttcgctaaaagtttttggtttttgggtataccaaccattcacccccctctggttggcttagttcttgtgattcgttcctacaatatatgttagatattgtagaaatgattaaatgatttgaattgaaatattttgaaaatgatttaagattgatgatttagcatgtgtatgtttagctttagaatgaaataaattatagatataattactatatgcttgcatgttgaactttgtgtgcttagtggttttataaagataatacccactaaacacatgcaaacatagtatttattagcacttctagaatcaatatgtagccacatattgattctagaagtgctaataaatactatatttgcatgtgtttagtgggtattatctttatagaaagaagagatatgaacatgtgtgtgggaggaaactaggataatgtggcctacatgtcaaagattgtaggatcaaatttaattttagagtcaaacatgcattagcatgaattattttattattaattttatcatcacacaaatctgcttaagtccgggggtcatatcaaaggcttacttctgctcttatattacttaccactatacacaccacgtttgtagaacatcgatcgacattcaaaaaccaggtcgttgtcatattaccaatgaaaaatacaacttatggctgtgctaatcccatcaaagcaactaattcaccaattaatagaaattacaattagaatgaacatcaaacagacaactatatataagtcaattattgtttattaatttcgaactatattatatatatatcacccatattcatatatagctaatatatatatctctatgtaccctattaattattatctttccagtgatctcaacacgaataagtaactacttaccgtgctaattaatccatcgaagcagctaattaagattaataattaggctacaaattaaccccaaattaaatcgatggtgtgcatgcttgtactacccatcatgcctcattgccctaggcaccatgtcatcaaggagccccttgtcgacgggaagaacactcgccggcggcgacgacgacgacgacgggtagccgccgcagctggcaacaacctgcagctcatggttgcagtgcagaggcagctgtagcagcgacgacgacgacgccggagtagtagcagcaagcggcatcgtcggcggcggcggctgcaggttgctgtacagttgttggtgcgcgaagaagggtgcggcggccagggcggccatggcgtggatgtgcgaaaagccgccggcggtggcggcggcgcggggaaaggtgacggtgtggtgggagtgttggccctcgtaggtggtgatgacgacggaggggtcgtcggaggagcgctccacccgcttcttcaccgtgcacttgctgttcgtgcacctgtagtagctcctgtttttttttttatatatacacacacatgttaattaattaatttaaccaagagattgattgattaatttatttgcaaaaaaagtttgggggctaattaattacatttgcagaagaaatatatacatgttggggggagatcagccagcttatattagcttgttacattttagggttcaagggtttaggaccaatgcatcatctagaatactactatagtaagtagtagtaactacacttaacaggtatactctctccactaaaaaaaatataagacttggtttgatttggtatggtctccaatgtcaaactttgaccgtcaatttctcccaaattacattattattggtactgaaactaaaaaatagatgaaagtgcaagcaaatacgaattcaacgattatctttttttttgtttctagacatatacatgattagactacttgttgatcaaaagttgtaaaatttaaatcttaaaatacgtgtgtgcgcgtcttatatttttaaacacagagagagagagtgtgtgtgtatacgttatgaataaaagccatcaaaacaactgcacatgctttatatccgactagaaaatttgtgcacaagagcatatagaagaaaattaatggtagttgcctaataaggttatggttgtattatttaataaaattacaaatagtctttactctagtgctgaaaggagtaatttgggggatatttctagcttaaaacatcattcaccgccattgtaacagccaaaaaccattggagtttgcatcataacttgagaaagatacgactacctaagtcaatttctatttaattagattatgtgatatcatgttatatatacatactagcattcctttaattatagcagtcgtcctagctatacttactgcaaccaatagttattaacatgattggacacatttttgttgcatgcgtatgtggctcaccgaaatgaaatcatagaaaatcaaagtatacaatgttaatcaaatccagaaaattaatcaacgcatttcattccctgagttgcttaatttgcttcgttggcatattcatgttcagaatcgaagtaccgtgattgtaattatgaaaaatattggagtagatacgcttttacaacacacgcatacaactaactaaaagtacgtcgtccttttcgttcagcccacaactttaatatgtgaacccactgtgctgatactcactcatagttgctgcactactgtatcaattaatcgagaatgaatgtatatatgtgctgaattaattatattaatcatgcatatcaggaactattacttaattaattagaagaagatcgaaattagagaaaccaaattaaagcaaagacatcttattactacagcatgcatgcatttgtaatactccatatatgaatttatatgtataaaatgtaggtaggcaccttggaaaaggactgttcttgacggctttctggccatactttctccagcgatagccatcctccaggtgatcgatctcgctcttcgtcatgaacgcgaaccgcggttgccgcgccctcttcttcccaggcgtcagcgacttgctcctgaacatacataaccacacgatgaaaattaatattgtagagaatttccgtcagaaaggtatatagttcagatcgagaatttaaaagttatgaaaagaaaactactactataagccatcaagtagaagtagctaggcaataagaaattatgttactgacgacttgcaatgaaaatgtcctaactcgatgcctaatactcctatatattcatgatcctgtcttaattaattaattaattacgtttgttctctcaccagatcgacctcttttgcaatttaattcgcaacctaattccaacacgtactcgtacgtacgtattcgtacttccttttgtagctagtgcgcattatctaggctacatgcatgcaccgatcgattaattggcaaatagtagtataaattaatgaaacataaacacttccaaggtactcatagatttttgctatataatatgagagattgagagtatatatatatacacgtatgtagagtacgtagtacgtgtctgaaaaatatacactactccagtacttaattatctctagcaaaaaaaatgaacataagctcacctaaaagctagcatatatatgtaaataaagacaagacaattcaatttaagaggaacacattaaattaattaggaaattataagcacatgtgcgatggaggtttagcacgcgaatcccggcgcaatgttcgaagaagattaaccacacaaacacactcccttggctagaagctagtagcgtctttttttaccgttttgcccctcggagaaatgcgtaaattaattaattaattatccacgtaaacgaattggccaccgttaaatcatctccatccaaacaaaatgcaaagcaaaaaaaaagaggaaaaactgaaaaggagatagaagagacttgaaaagttttaaattaattagttccttgtttcgaattcaattcaattttatagtatgctaagagaaccataatttggataatttggagggaaataacaagcgatttatcgagtaaattaaattaatctcttgcaacaaattaactgcgattaattattgtacttacgctgcctcggtggacgcggcggccggcttcccgccgtcggcgtcgtcggtggagcacgacgacgcggcgccgtccgcggaggacccggccggcgtctccggcagatccagcggcggcggcggcggcgtggccagctcgcccggtggatccagcggcggcagtagctcccccacggcgtcgacgacggcgagcccgttggcccagccgagctcggcgaatatggccgacgagtcggcgtacgcttcgtcggcggcgaacggccagtcgccggcgcccgccatggccatggcacactccggccggccggccagccggaggagcagcagctagctagtagtgcagcagagagagagagagagagagagagagagagagaggtcacttcacttgcttggcttaattaatttctctggattttaatcaacaccgcttggcttgctttgctccccatgagcctttttattttgtagtagtagcaactccagtgtcctcccttgtgtcgttagtgagctgctagctagctagctgtggtctctgcatttatttcactcctctctcatacgttctctccgtcgtaaaataaataaatctaatatatgatatggtatattttatatttttaatatggatagacacaccgtctagatttataatactagaatatagaatgtgttacgttccgtattaagtttgatcgtttcagaacggaagaaatacttattcatattattgtctctatttccttatgatgaaagttaatccagcctctttatatagtctggttcaattggttgagtaaccgtatattagtaaaatatacaaccaacgaaaaaaatataattagaacttttatatctatattattagcacggttcaattaaaagataaggcttgaaaataaactatgataaaataaatctctatctaatttaaattttttattgcggttaataaaatcaagcagacgacgtcatctctacaattatatataccctatattttcaattaaaataatttcaatgcatggaaatctaattaaacacttttagctaatcagatgtttaggagaggaattacaaaatttaaaatttaacaagtaagataatttagatggaatttccaatcttataattaatatttgctaaacaacttaaaaatatctaaatatttaagaagggacgaaggtgaattggttatagctggcgcgcggtactttttcttcactgcgaaacagcggtcatgatagtgaaataacgcaagtatatatgtgcaccgtcgatcttcattctgttcacacaactactcagctatagctgctactatcataaatttattcatttttacaattttcagatactgtttgaatagcatattggctatatatatagcacgtatacgtagctaacattattctagataatttatatagcagctaatgcatttatcaactagctagtagcctagtagtagtatattagctagctctctacagtattacacatataattaattaatcaatccggtaattgaagttggggacaaagatatagttcaactcaaatcgtttagtttcgcttaagtcaactcaaatcattgtcattgtcatatatacatcagctctcgctagcgtccaccgctcgtcacttaattttactccactgttaattttcatatactaatatcattctgaaattaaactgtcaaacccaaaaccttaattagaactaacttgtttgtattttgagataaattacttcagtctctcgtcatcttgcatcgatctttggacctctaactagctagctggctggatctctgtagtaattatattaattactacaaatacgtacaagcatgggaccaattaagagcaagtttaatattacatccaactactagcttcaaattatctatagtcaatttaatagccaattaatataatagttatctataaatatatatgcaatattaatatctggtctcatctgtcatacacacattacgtctgagagtccgtgctgatcgctacaaatctgtagcccgctgctatctccctcttcttttatcttctcgatatatgttatagctggcttacgctccactattgtgcctgcttaaaaaaaatgtttagatccagaggtgtaaagttttagcgtgtcacatcgggtattatatagggtatcgcatagggtgtccggacattaataaaaactattacanngattttgtcagtaacccgtgagacgaatttattaggcctaattaatccgttattagcaaatgtttactgtagcaccacattgtcaaatcatggagcaattaggcttaaaagattcgtcttgcaaattagtcgcacaatttttgtaattagttattatttttcatatattaatacttcatgcagatattcaaacgttcgatatgatagggtgtaaagttttaggacgtgatctaaacagaacctaaattaaatcatgcatgcagtactagaccagtggaccaaacagcatcgagtatttgcagttcattctaacgtaacgtacgtactagccgataattattagtacggtattttatgagcaattaacgccaccggctacaaagaatagtactactccctccgtcccccccaaaaaaaaaaaaccagtcctaaatacgtttcagtgccctaattgcgatcgatcgatctaagttatatatatatattgaccatttaattatagttgataggtccggctcttatccggaatctcagattaattttctggatgtcgatcgctttgtcctcacgtccaccgatcgagcggcgccacacgttaatattatcaaaatattataaaccgaatttttaaccatattaaacaattggtggaaccaattgccagaacccatatataagatcagattattactgtatatatgaacgtacggccactagctagttcatcaaaatggtcagaatatattgagacaagtatatattgatattctcgtatgtctttgtaagattgtaaagggtctatatctttgcaccatcattaagggtctttcccacacacgtgggactattcaataatatccccttttacacattggtgtctcttaaccgttcatcgccccttcaccgtttcctcagggttcctcaggtatactggccccgcaggcacccacggtccatcaagtcttcacacactttgtcccttgggtcagatacgttgaactagccagactctgatactaattgtagaatcgtaaagggtctttcctacccataagctagtcaattaggtgagaggctcttccacttatatatttggtctcttaccctttcataaccaatgtgagactattcaatagtcttgttatatataagtgctccctccatcccaaaaagagtccaattctagagatgaatctggacatgctagctactagctatatgtttaatttagacatataattagaatcaagtttgagattaagttatg

SEQ ID NO: 36874 - DNA, 16430 bp, Oryza sativa
tatacacgagtaaaatcaaacgcacatatacagtcacattataggcaatggaaggacaatcatcatcactacattatgcatgataattaggagtacaatgcaaaagtgcatcatatatactctcttcgtccttaaatatttgacgtcgttgactttttgaacatacttgaccgtttgtcttattaaaaaaattaagtaattattaattattttcctatcatttgattcattgttaaatatatttttatatatacatatagttttacatatttttttaaaaaattgaataagacaaacggtcaaatatatttaaaaaagtcaatggcgttaaatattttgggacggagggagtagtgtgtgtgtgtgtgtgtgtgtgtgtgtgtgtgtgtgtgtgtatatatatatatatatatatatatatatatatatatatatatatatatatatatatatatatatatatataatgcacgtatacgtaatatattctatctcaggtatattcaggtaggatattttgggacggagggagtagtatatatatataatgcacgtatacataatatactctatctcaggtatattcaggtaggttaattatgaacatatacgtactgccagcagtgttgtaccagctatgtacatgtgtttttgtacgtagagtacgtagcatgtctaggttggccgagttggcttcgtgtctgccacgtacgtactttaatttgtaattataccggccacagacagctcaaaaaattaatcactaatttctagctatgcatgggtgtgtttgagaggaggtttaatttgcaatttttttttttgcccattcaatgagttatttaaaaagataacattgtttcaattcccaactggattaactatattgagttctggagtgaaggttacacacatgatacatccattcttattatatttttctgggtttcctcaaagtaatcggtattatcaaatggctaaaatttctccgagttttggctatcattggccaaaaccacacctcatcctaatctcgctatatatgttttgctactaacaattggtcctcatcaatgatttatagagaggaagagcccaagtggacgcctgagtcctgaccagcctgagagctagctctgccgtgcttgcctataatttctcctcaccggacagatgctatggccctcttcttttctccaacaaaaatcagataaaattttggatacttatgacatattttttgaactgctaaacggtgtttcgtgtaaaaaatttctatatgaaagttgctctaaaatatcaaattaatctattttcaagttttgaataattaaaactcaatcaatcatacgttaataccccatcttttttgtaaaatacttaatcttaatctttatcttaatcttcatattagtgtatatgttacctaacctattcattgcttttaccttccgactatggcccgatttagatccatgggtaattttttagccctccctcaaatagcccaaaagtttcaaacatgtgagctatttcagggctatttggaaataacctaccaaaaaaactatcctcctcaaggggtgctaattggggctatttcggatggacccactgaaaaaaagtgccttctctcttcatggaaaagtgcattaaatgctaaatagctctcaaaataacccttggatccaaacaacttaattagggctattttattaaagggttatttccttgtgctaaaaaatagctctcaaaataactcttgactagttctccaaacatgccctgtatatcattgcgccgtcacagagagtggtaaagcctgggcttggccagcatgagcggcttcacatcccctgtctttgggcattacggcaaagtttgctgttcctccatcccaaacgtccattccatacctacagctagattttgctggtccatacatatatcacctcaaaaaccgtcttcttctcaaaggaagacctcttagacgtcatggttgtgtgacccactgtagttcaattttgttgaatgtgaccatcatgaatagctgaatcttcaagctagactttattatccacaatacaagatcattagggattatatgtgtgtgcgtttaacaaatgtatcaatttttttcccagtagacatggaacaaatgagtctgatatcaaaggcaactctagcaagcgtttaatcaacgatgtgtatttcgttacgttttgctggagaaggaaagcaatttcttaattgggagggccagcaaaatccatctgtaggtatggaatggacgcttgtgattgacgaacggtaaactttgttgttatgcccaaaggcaggagatgcgaacccagcacgggcaagtacgtgcctaggctccgcctcatgaagcagcaggatatatgataagttattttactgcttaattaacctgctatagtgatagttctaaattctaatggagtgctttatctattatttttatacttaaattgtttgcactctgttgcttgaaattaaagttaaagcggtaggattatattctctaccaccattgttagacttacctaggctcaagaaaatttttggatattcacatatactatattattggattatgacacatgcacatgagctaaatcgttaggagatccagatcgaggtaggatcgattaaatatttatatattaaaagaaaatttgaaaaagttaaccgcgaaaggattgacttacaagtttacaagcagcgctagtactcctcaagaattctgagacagatcaaatatataaacccgtccaattaatgcaggcattcgtccaaattaaacttccatttttgaacggttcgtgaattcaaatcttttcaaatatggcatataggagtaacatgcatgtcaaattgcactaacacaattacatgatgagtttatagtacgagcactttgtgtacaggagtatatatatatacgatatgatatctagagtacatatatttttgctagttagatatatagcctcttcaattcacagccgcaggtccagccgtgcgtacgtacatgcgcattaacattaatgaaataattactcgcttcgccgagccaaataaaaagggtttaaaagtgaacagtaatttcgatactactccatccgtccttaaatatacggggttttaggacacatcctatataatatgtgggagggagggagtatttgctatatattcgatatggcagcacccagcgcccgcaccatccgcggccctttcagttttccgatcgattatgggtatagtactaaaacaacgaacagaaaattaacgagatatacggtagtgattgctttcgatatagtattaattatctccgttccatattgattatagattagcgtgctttttgaaagaatgaagtgaaattagataagagataattatagttagttgagaataaaaaaacaggtggaaaagtatctatatactcacttcgtcccaaaatatatataagaaattttagatggatgcaacatatcgtacgacaatgaatctgctcctaaatagatatggaggtaacaaagttgatgatatatatatatatatatatatatatatatatatatatatatatagcaaacatctatctattatataataaaagtccattaaacttcctacaaacgcttctaagccgtcacgtggcatcctacaaatactcctaagtcgtcacgtggcactataatttagagaattctccagtggtccagccattaattttcattaaattagtggacccattatttaccaccattagatttatcaaaaaaaaatttcctaaccccaaaccgggcccaccatggacatgtacgtattactatatattccctccattccaaattaatctatatatagttttataaggttactcctaaatgatctacatatttgtattcatttattaagtctattcgttatttgtgcattagagtaaatggacattgatgcatgcatccatgcacacaagtatttataacccacatgtaatatattgatttgctattggctagaaaatagtggggatggtgcatgcatcgagtttgttgctagagtaaatatagtatgagagagttattagcttttcttggctttggtaaacctattaaatatataaatcgatttggaatggagggagtatatgtatacgtacaacttttttaaggatagtacgtacgtacgtactttcaccccttcttccctcaatttcttatatttttgcacatatttattctcctattatcatactttattagctagaaaaaaaaacttttgtgctgaacaattcaacaactataacatctaaatcataccacaaatttttaatccaccgttgacaataaagtttaactggcctacttaccgataaaattatggttcaggctcatcttgaggagcacgactatatcacgggaatttagagaattctctagccattgattttcattaaattaatggaccaattatttaccaccattagatttataaaaaaaattcctaaccccaaaccgggtccaccatggacatgtacgtattactatatgtatacgtacatttctttaaggatagtacgtacgtacgtacttgcaccccttcttccctcgatttcttatatttttgcacacatttattctcctattatcatactttattagctagaaaaaaaacttttgtgctgaacaattcaacaactataacatctaaatcataccacaaatttttaatccaccgttgacaataaagtttaactggcctacttgccgataaaattatggtccacgctcatcttgaggagcacgactatatcacgggacccatgaataaggcattagcgaaaactccttagcggcaatagtcggcttcacccgatcgtcagaggagtattcatatataagtttaattgttttatccaattaattggtagaagtggtatttttaaatatttatatataaatgtggacatctgtgagacatgggtatttgggtatgatgttgtcggtgacatggggccgggagtatcgtgactagaggcttgggtagccgcggtcacccacgtggcctgaccccctcgggggggtcgggcccgagggtgacgtggccacccctccctctgtctccccgaggggtcgggccgctcccgtttcggcccccgagggctggggcgccccgaccccctgtggttttggccccacgtgtgtgggttaggtgagcacagcggggctcacctaaccgcatttatagcgggttggacgagcgcgccacgccgcatttaatgcggcgcagcgcacgcttatccggtccgtgaacagtcgcggcgtgtgaccggtcacagaccggtcagatcgcgggttaggtggcacaggcggcctgtcacacgcctcgccccgtcccgtcggaatgatgagagcttcctggctctcgtccctagccggagccggcgtgctaactcctggagttggtatgtcagtcccggtcagatccattccaggcttcagcgcaagcatggcaaggaagtcgctggccattgaatgaaggttgaaacgggcgtccaccggagagctgacaagcggagcagaagacgtgcgctgtgcttgtcagaggtcacttccggttgtagactagccctcattgtaaaaagaatgtttcttttcttaggcagctagaggcccatgtggtgacccctaaccagataaaaaggaggcccaggcctaagaggaggagataactctggccactcggttctagagtctgaactctctctcgctgtcgagctctctgtattccttcacacacagatccaccagaacacaggagtagggtgttacgcttctcagcggcccaaacctgtctacgtcgcccgtgtcttgtgcgattcttctcgctgacattccttagatcgagggcgaagaacctcacttagcgcccccggccgaaccggcaaaggggggcctgcgcggtctcccggtgaggagccccaagctccgtcagatgtggatattaacttttttatggtattaataatgtatttggtttattttttatagagctgcaattccatctatgaaaaagaaaatgaaaataagttgtggtgaatgctgaatttatatataaccggaataaagtgatttttgattcgatatgatagccattttgatcatttagtacatatcaatggtctatttcttatagtgaatatgatgagataatgcttcttttagtattgtttttatagacaataaataaattgcccgcgcatcgcacgggcttccgtcctagttgtaataatagccagtgagatctacatatatattgagtactccctccttttcaagttataagacgttttaactttggttaaagtcaaactgctttaaatttgatcaagtttgtagaaaaagtagtaacgtttttaacctaagacaaatttattatgaaaatatattcaattattgatttgatgaaactaatttagtattataaatattattatatttgtctataaacttagttaaattacaaacttagtcaaatttgaaacagtcatcttataacctaaaaggatggagtatataatacatggagtagcttatctttatctttacctattataaaagtttaagatgtttttgccaaaaaattttcgtacgttgtccgattccctcctcgcgatcttttttttttgcgatttttccgtgttattttcctgtccaactccctccccgttcccactcgtgtcgcgccacagcgccagtaccacataaggcggatgttgcacaaattcaaatacgtgtggcgccggtaccacataaagcggatgttgcacaaattcaaataccgatacaaaatccaatcggacattgaatctagagaaaaagaaaacgaaacaagaagattaaaaaaaccgcacaaataaaaaaatcgcacaaaaaaagcccacgaccggctcaaatcgatccaattttcttcattgagtacttcaatacccattcccaaattgaagatgaatatatgaacaacaaacaataatccccataaccttatttcaagatatgaacaacacatacaaatccttaagattaaaaaaacatgaataaacatgaacaaatcacatgagtaatttattatcatcgccatcatcactgcttctgcttctggtgtgggaggaagaacaggagggggcggcgtcaccatcgcacctcccagatcgggccatctccgacctccaacactaatggatcagacaagccaccgccaccagaggaaagtagaggagaagaagggtatttgtcgcacctgcagcccgttgtcgccgtcagctcgctaccatggcggtcgtcgccggttgatgccgtagccggtggcgggaggagtccgcaagaccgagtcgccatcgccgccgcctcgagtcgcctcgcccttgccgggaagggtgagtgcaggaagaggaggagatggagtagaagaggatggatctaggacgccggaccgccgccgcctcccttcccactggatccggcagaggggagggcgccgcccctgcccaccgcctcccctcccaccggaagggagggcgccgccgcttgccaccacccgtcaacatcgagccctcccgcggccccatggcgagggagaggaggcgagggacagagaggcgtcgctgcgcggaaggagagccgccgacgccgaggagtagcttgccggcgctgctccccggctcgttgcgcaccgctgctcctgctctctaggcatcattgccgcgggacggcgggtcgtgtgtagagggagagaggaggcgtggagaatgagagaggagaggagaggatgtgtggctggcgacaggagagagacggggaaagagagagagagagtaaacgagagagggtggatagagataatgttctttgactagaaacagtcacgatattttctaagtaacgtactgtaccagcttctgtttttcttatactccgtttcgaaatgtttgacaccgttgactttttaagcacatgtttgaccgttcgtcttattcaaaaacttttgtaaaatatgtagaattataagcctacataaaaatatatttaacaataaatcaaatgattggaaaagaattaataattacttaaattttttaaataagacgaacggtcaaacatgtgctaaaaaatcaatagtgtcaaacatttcgaaacggagggagtactaaaatggaatctatgacctagatatgctattgattgaattgaattccgctgaaaaattacagtgggctgagatacacatatatacttagtgttgttctctttaattattattttctactagcgaaaagactcgtgagttataacgggtgaaaaaatatttaatcataatatacgtttttcatgcataaccatgtcaataacaatgtttgtatggatcgtttgcagctgagacaataaaaaaattagaacatcttcaatgtaatctcgcatgtttttatttaattttttttacctacgatggaaatattttttttctcgcatatttttttattatttatagaagacagaaaacattattttaacgctttttctgactttttttcttacgtattttttaaccgtttttattttctcatgctttttttaagttgtagaatgaaaacttctcttttgagtagttatattagattagagatagagaaagatatatactgtctacaaaaacgaatagaaatcggacttcttttccacacttttttttccaccttttttcacacgtgattttttagtttatacgagccattttttcgtcactttcttaggaaatcggacaaacttttttttacatgtttttgtggtttttttatttttcgccttttacaaaatcagacttttttccatttttatgggaatcggatctagcttttttttaaaactttttttcacctttataggaatcagatttctttttcggttcggatctacgtttttttttgccacttagtggaaccagaatttttttagttgtttttcgctattttttttctcagattttttcctttttagggggaatcggatctacggttttttttcaccacctttttaggggagtcggactttttttttgttgttttttttgctattttttttattttgacggacgaaggaaacgttttgaaattttttaagtagtagaaattgctgacaccaaaatcaccaaaacttttctactattataaaaattgaagataattttaccagtactctggtacgtcattcgtgtataagttgatttttaaccgtattgaaaaatacagttcgttcgcttttgaaaatatagatctatatttgagtcgggttttaatttcgttcgcttttgaaaatacataagaagtcgtataagaaatctcttgaaaaaaaactcgcgtgctaacttaacatgatttaatctcttgaaaagaaaaacttgcatgacatgattttctagaaaagtatatatccaagcaaattctcacagtaaacaataataagattataatagccttcacccgttgcaacgcactggcatttgttttaatatagctcatattcagactatatgtttgcacagtagatgtttattgattcttacgtacacagtacgtacatacgtatgtgcgtacgtgcatgtacgtacggtacgcatgctcttcaatggcaggcaacgcatgtaatatgtatatatatatccggcgcctgctcgatctctcgtactgaaattaatttaacctcgacgtaagtacgcgtactgtttattacttgggcgcatatatgatggctcgtaattagttagtggtggtaagtgtcaaagtacactcctgtcagtagtgtacgtagtagtaaatccaccgtgtgtatattaactccagtgttaattgtgctatcacttgtggagaaagagtttatagtcccggttggcaaccctctgtacgaatccgggattaaaaatgtccatatttagtcaaaaatacatcttttgtcccggttaatgtaaccaactgggactaaaggcttttttcttttttttcttttctcacgttcaatatctccaaatcattataaaaataacaaataacaaatcacaccacacaacacaaattacagatagcatgaatcacatatagttcacatatcacatatcgccccatatcatttacaaatcacagatcacatcacaaatcgcagatcgaacagatcacagatcgcataaattatagtcattcacatcacattaagaaggaaaaaaaagaaaaaaaagagtaaaatttcccatgctggccaccgccggggcagccctccgcggccctccgtgcctccgccgcttgctgccgccggggcggccctccgcgcattcaccgccgggcttccgtgcggggcagccgccgctgccggccgccgccgccaggaagacatgggagaggggaaggggaggaggagaaggacgaataggagaaggagtgaggaggagaactaatggaggagaagaaaagctaaggataagactgaggagggacagacagatcgacgcgccaagagataaacatcgcgccggcttggagtgatttttagtcctagttggtataaacaaccggaactaaaaatccaaccgggactaaaaataattggggcttgacacgacctgacaacttcttcaaccgggactaaaaatgatcttaccaaccgggactaaagattaaaaaataccccttagcttttaaaccgggactaaagaaactttttagtctcggtttttattgaaaccgggactattgtgaaatttggccgaccgaccaaaaatagtttttccacccgtgtaccatacatggacaccatccatgtatactccattattattattaagctttggccagcagtttgtagcctacctacctcttcgtaattaatttcatactctaaatttagttaattacttattagagggcgtgcttattccgttcgtttctgattaacatatagattttaccttaattttcattagtatattttttaaattgctaaatggcatatttcgtatgaaaatttaaaatatcatataaatctcgtttttaagtttgtagttaaaacttaattaaatatgtactaatgactttcttattttacatgcatgttagtacttaatcttcatattcagtattaccgaatggggtctcagaggtgcctatattgtcttttattatatatatacatggctcatgttgtattatacttcatgatgttcgttaacatatagcagtattttccaccgtcaactagcttactgaccgcgggggggggggggggggggagattaatgtcagtaagatatacacatataaatcgttcgtgatttttatatgacactctctaattaattttctatataaggattatatacttatctctactactctaaaagataggtttgtccatccacccctatcatctgttctattcaaggcattccctctctcaccatgcatataggtcacatggaaatcaatatgggtgcagctaaaaattgtcacacactatgatcatattcaatctatgatcgtagattcgtagtgtgttatatctataatcctgttacaaatcacgacagacaccttagtcttagtaatttatttaaataatataaaccattacaaaatgactacttttactcggtcattcggtgattgattagttaatcgactatagatacaaagcaatcagtttgattaacttttaaccgcagtcatcaaaacaccgacactataataggagggtttttacttgtaagttttattcaggagaaatgtgagtggccggaggagttcagcttggaagctagcttctgtgttccaagaaccatacagaagacgaaatattcgccgcgtacttaaacttttcttaaaattttcttttaccacccaactttttattaatactccctgtcgattgatatatatttattttatctttgatttgactgcacacggattattactagtactgccattagttcccctcctagagcaagcaacattgtccctcatttcggtcccacattttggagaccttgcatggtgatggaagatacacgtacatttgctcctcccttttttttaatagaaaacgttattgatttttcaataagacgaatgatcaaacgtgtgacaaagagtcatcgacattatctattaaaaaacaaatgtagtatttaattactactagaaaccaggaaattacatgcattttcgaatgaatttgttcatttctcatgaaaatccttcaaaattcctcctttctaattaagcttctatatgaaatatttaacatgatttttttagaaagtgtactgattaattgatctataacaaataaaagccattttgttttactccaaagctctttggtctatgtcttcaaaattcctcctttctaattaagcttctatatgaaatatttaacatgatttttttagaaagtgtactgattaattgatctataacaaataaaagccattttgttttactccaaagttctttggtctatgtctatatatctctactaatataaaaattgaagatgcttttgccggtattttggtacatcatctatattaatttgagtcagtttttaagttatttcacttttggaaatagagatccgtgtatgagttggattttaagttcgtttgcttttaaaaatacaaaagaagtcgtataagaaatttctttaaaaaacttgtatgctaacttgaaaggaaagtcagacttctaattgaagctcatgattttctaaaaaaaaatccaaatgaattctcatggtgaatttcatcctagctaaaccgtataacaataataagattaaaatagcattcacctgttgtaacgcacatacattttttctagttaatatataaatgacaaactaaaatatatatgcacgcatgtacaatactactaattggagtacctttgtagctgtgttgatcggtagcataagccagacacacacatatatgcatccctacatatacgaggcatacagaaattatagaggctatacgaactatagtactatcgacaatataaatatatgaatgtaaattgagaaggtgatagcctctactctctgcctcaaaataaataaataaaatatagaattaatgtgacgtattctaatactataaatttaaacagaaatactaagatatatcacatccccgtattaggttaatttatttattttgagagggaaggagtttcttagctggttaattaattactagtagatattactatatccctaatccatggccattaatttacatcatagtagtattgatcatgacaatcgtccttaaaaaaaaatattgactgttacccttacgtgcagtacattgacaagtacatgcatatcatgtattataattattgggtcatcaatcaattatatcgatcgatctcattactctctctctctctctctctctctctctctctctatagatttgtttttgtgaggtctctatctcagaatctgtttcatcccgtaaaattatatacgctagtaagtagcctgcatatatgatgcattattcccaaatcatatacagagatggtggactgatgcacatgggtacgtgtaaactaattaagccttctagctaggtccttaatcaattaccatgggggaactgatgacaaatgaaagagaaaatcttatcagatcaggtctttttagtcagggaggtgtgtgacctcatgactggacacggagagatcttagtcagaaaaattcaccaatgtgtaaactcagccagtcattctttagctaataaggctcgttatgaagctggcttaaaagtttggttagagaataactgtgacgagttactacatcttgtaagagttgatttaaatcctgaataaagatctccccttttacccgaaaaaaaaatatcaaggtgctagccatcttagatatattaattatatattttatttttttctgtttgcatcaattggtgtaggtatggaaggcgcaaaaattaattactctactgaataaatgtccagattttttttcttggtaatcatcagctgggttgaaagttgaaattaacaaacactctatagctagcaacgagacgatctctgaggctccctatttcaatatttggtggctagctagcttgctttcatatacataaatttgtctgccaatgaaatgaaactacagttcgatcaactacttgctgttgtacgtgcaaaagatcgatatatatgtatcacacatcacgtcggtcgatcgagagcgatgtgcatcttgaaaattgattgatcccccatagctagatggacggagcaataatgggtgacaatcataaaggagaaaattccatcgatctatagcacaaacatcttatcagtaccaatatatagaattgagatctagtgcagtcctaactgtgacagcaagttaggaactacacatcatctcagccatccattttttcaatgaacggtctagatctgatgctatagtattgctgctacagtagttatacagtttttttagacgtgaacagtattttgtagattttggaccctcagatttgcatcaaaaggtcctagtgtgactgcttaggttacagtcacactaggtactgcaccggatccaaatcccaatatataaataccataaaattcccccacctttcaaaaaatacgatatgtatcacacatcatgttgatgatctattgattgagagtgatatacatattgaattgaagtgcgatgtaatgtccatgtatcgctccttgtctttctagctgataataaaaattcaggtgggaaaactctttccttcgatgatatattgtaattgattgatcgacggtagctatggactcatggatggatcaatataatgggtcacgataaaacgtgtgcctcgcaacaacggaagtagcatcgaattgctccaacttccatagcttcctcacagactccatagatatgatagcacgtactccctctgtcccataaaaaacgaatctagaatcagatgtaacatattctagtacaataaatctgagcatatgtatatccagattcgtagtactaggatgtatcacatccgatactagattggtttttaagggacggagagagtacatctgtggagtagcaagctaggatgacgtgacggcactcacttgatattactttttcctccgtctgcgactttaggatcggatttatgtatttcaaaccctgttttaacattgtcaatatatattatatgtactaccttcatattttaatatatgacgtcgttgatttttttatttagaccattcatcttatttaaaatttttgtgcaaatataaaaatatttaaatcatgcttaaagaacatttgatgataaatcaagtcataataaaataaataatacttacataattttttcaataagatgaatggttaaacgtatcttattaaaaaagttaataatgtcatgcattagaaaatagagggagtaattaataaagtttacacaaactattggaaacatataaggttgattgttactggatttatcatgactgaagtaacatattttcagactctgtcgattgatgtcgcaattaaactctacttgtatttctttcggttcgagtctgagagagtatgcacctgataattaaactaatgaataagtgcatgaaattatggaattacttgccccaggtggggttttaagtagtatattatagtgacaacatggttgtttaaaacattatcccaatgacaacaaccatggaatgattgagatgagaaatatgattaattttaattagttagcactactgtactagcatagcaaatttgaagggaaaaagtccacttagactcccttaattgttcaccgaatctaattcgtgaatcttaactagaaaaccgggtaagacgactccccgaattagtgaaactagtccaatttgactcctccggcggtattggaggttggttttgctgacgtggcgctgatgtggcggtgctaacccggatttcatgccacgtgacgcttacgtggcattagagttaaaacaaatatctatgggacctatttgtcattcaaccaaaaattattgtgggacccaccggcccacaaagcatcatttctccatcctttcttcctcctccctctctctcccttctctcttttctctccccattctctctctcccttccaaatcggcggcggcggcggccgggggccatggcggcggcgaggttgggtcatcgacggggagaggcgaggactcagttgagcatgagcccggcgccctcgatgagggcgaggagcat

SEQ ID NO: 36875 - DNA, 7485 bp, Oryza sativa
ctggaagggagagagagaatggagagagaaaagagagaaaggagagcatagggaggatgaagaaaggatgaacgatgacatgtgggccccacctgtcagtgggtcccacaataattttgtgttgaatgacatatgagtcccatatatattttttttaactctaataccacgtaagcgccacgtggcatgaaaaccgggttagcaccgccacatcagcgccacgtcagcaaaaccaccctccaataccgccggaggagtcaaattgcactggtttcactaattcggagagtcgtcttacccggttttctagttaagggtcacgaattagattaggtgaataattaagggagtctaagtggactttttccaatttgaagcgctgatatcaaagttgctcaaagtgtacaagcatgttgccaatgaattatgggccgtgattttatatctaactgggctttaatttggtgttgggcttcaatttagcttcagaggttgggccacttccagatttttaataagtaaactgtactttaaaaaaaaaaacaagcaataccatgccagatggcagcatttttttttccagaaggtacactaatttaatctgctgctgcctaacctttgaattcaaattagaagcaattccactcaattccacccccattcattcaaaagtggcttaaagagttggtttgaattgtggcctaaataggccttaccaaattttgtcaatgctaaattttgacaagttttgacataactaattttggtaaggaaaatcgtgtttggattaaagttaaaatagcctaagtttatactattgaaatgacttattttcttaggcatgtcactaaacactattgaaattacgaaatattagtaaatctaatttaggcttcaaaccaaaccagcccaagccgcaaaagtggacaatttgccatcttcaattcggtatctcttcacttcatccatttgcccttccaacttccaacatccaaggcatattccacttggagctggacccactgacagtgggccccacctcgtcagtgacctactctccattaattacgctaactcctcacgtcgtctcgcccgcaaaatgcttctcttcctcctcttcctcctcgccgccggcgaggccgcggcggcggcggcggccaccacgctcaccgcgacgccggcgaagctcacccagtccgaccgcgagatcacgatccggtggtcgggcctcccggacccggacggcctcgactacgtcggcatctactcgccgccgacctcctccgaccgcgacttcctcggctacctcttcctcaacggctcggccacctggcgcacgggcaccggcgagctcaccctcccgcgcctccccaacctgcgcgcgccctaccagttccgcctcttccgctggcccgcgagggagtactcctaccaccacatcgaccacgacgggaacccgctcccccacggccgccaccgcgtcgccgcctccggtgaggtcgccttcgactccccctcccgccccgaccaggtgcacctctcgttcgccgacggggtcgacgagatgcgggtcatgttcgtctgcggcgacggcgggaggagggtggtgaggtacgggccggcgaaggaggagggggagggctggaaggaggtggccgcggaggtgaggacgtacgagcagaagcacatgtgcgactcgccggcgaactcctccgtcgggtggagggatccagggttcgtcttcgatggactcatgaagggattggagcccgggaggaggtacttctacaaggtcaatcacttgcctctgctttgaattgattgttaattactacactataaagatgaatttctttgtagcgacttcacttctgctaattatatgtgttcagcctgcaattgcaatttgggatttagggtagtattgtaggcacatgaaaatttaggattcgagtcttgagagtgatctaaagctccttttttatttcggatccagggattgaattttgttgatttagcgagtatgacttatagtacgttttgacctacgaattcagtttgaggtgaagatggctgaatcatcaaacttttagagatactaacttgagcatgagcacccgctttggaaattatgtttgattatcccctttttagaactgaagttggttatagtactacactaaagatgaatttttatgtagcgatttaacttctgctttatatgtgttcagcctacaattgcaatttgggatttagggtagtactgtaggcacatgaaaatttagtgctcgagcccaagagtgagctggagctgtgttttttgggctccagggattgaattttgttgatttagtgatcgtgacttgtagtaagttttggcctataaattcagtttgaggtgaagatggctgatgcatcaaacttttagaggtaattactggagcatgagcacccacctcggaaactatctttgattattccctttttagaactgaagttggttgaagtttttgtctcaacatttcatgggttattacatgactcgattggcaatactttctttaaggaggagtttagagatcagttatgtcatctgaaaatcatgattttcttttttctgactagctactaagcttctaccaatcaaacatgcttcagttctttcctgcagttagaatacaactgtatgtgaattgaggtttaggatttcagttacaagggatttcactcaaatttgttgttgctctatcttaagctttggttgttatgtgacttccttcttaactgtttgcttcatttgagtgacatatgcattgcttagttgctcttatggatcatgattggatttttacggatgctccatttaagcactgtagttcatactatttttgaatgttgggtgagttcttaaaagacctgatgagataccttttaggcagaatttcaaacgccagtttttgtttttgttggttggtactcattattttcaaaattctggttttctagtacttctctaaaatcagttttggttgtaagtacctttgttatctatttgcctttttgttctattattattatgtatggaaagcatgtatgctatacttttgatgaatgatgattaataagatagctgtggttatgcgacttacttcttcactgtttgcttcattgagtggcatgtgtattgtttaattgctctatgaattataattggatttttactggtgctccatttgagcactgtaggttataatatttcttaaagtttggtgattccttaaaagacctgatgagtataccttttggacagaaattcaaacgccatttttcttttgttggttggtacgcattattttcaaaattcaggttttctagtactttttaaaatcagtttttttaagtgcctatgttatctatttacctctttgttctattattattgtgtatatggaaagcatacatgctatactattgatgaatgatgattaataatatttgaatttttatttgcttctttttgctgacacaaatgaattgtcattttctttttctttttttttttgggggggggagggaattagataaaaaatttctcttatttcagagtttcagctttgacttcagaattttctccccaaattagcttaatttagacttaccaaattaaacaagaccgagccatgttgtgtttttaactgccatcagtttcatgtttaatcccctctaaaagatgtacaagcttttggacaatggcttctagagcaagtaggcccagtaaaatatgctagggtgctattgatgctaggcccagtaaaataatagtgagtaactgagtagtgacacttgagcatgttttgtatatgccttttgttgttcaatttgattgactgggcttttctgcataggttggtagcaactcttcaggatggagcgatacgtacagcttcatttcacgtgacaacgaagccaatgaaactattgcatttctctttggtgacatgggcacttatataccatataacacctatgtccgcacgcaagatgaaagcttgtcgactgtaaagtggatacttcgtgatattcaagcccttggagataagcctgcatttatttcacacattggggacatcagctatgctagaggttatgcttgggtatgggatcacttcttcaaccagattgagcctattgctgccaataccccataccatgtctgcataggaaatcatgaatatgattggccattgcaaccttggaaaccttggtgggcaactggtatatatggaacagatggtggaggtgaatgtggcataccttacagcgtaaagttcagaatgcctggcaattcttttgtgcctactggcaatggagctcccgacacccgaaatctttactactccttcgattcaggggttgtgcattttgtttacatgtcaactgagactaattttgttcagggcagtgaccaatacaacttcataaaagctgacctagagaaggtcaaccgaagtagaactcctttcattgtgtttcagggccaccggccaatgtatacatcaagcaatgaagctagggattttgctcatagacagcagatgctccagaacctggaaccactcttggtaacatacaaagtgacccttgcactctggggacatgtccacaggtacgagaggttctgccccatgaaaaacttccaatgtgtcaacatgtcatcaagcttcgtataccctggtgcccctgttcatcttgtgatcgggatgggtggtcaagattatcaaccattctggcagccaaggaaggatcaccctgatgtacctgtctatccgcagcctgagaggtctatgtaccgtggtggggagtttggatacacaaaacttgtagctacaaaggagaagttgacactaacgtacatcggcaaccatgatgggcaagtccatgatatggtggagatattctctgggcaagtatctaataacaatggtgttcctgaggtgatcgatgatacaaagctcagcacaggggtcagcaccaaactgaaaatccctctgttctccttggaaattgtaggcagcgtgatgtttgcactggttctgggtttctctcttggatttctgatcagaaggaagaaagaagctgcacagtggaccccagtgaagaacgaggagacctaaaatcacacactgtatctaatgcaaatgcaaatggtttttgatcaacaacctgtttataggatcgtgccccatttcttggggctctacagtgttgtactatagtgcatagagtattgtaacatgtgctgtgtcaatcgtgggcattgtagagtttgatcagcatatctgttgccgtgattctacgatacataaaggtttcaataagtgacattacgttcacatcaattggttggtatgagtggttaacctgttccataacgtaatgcacgattcattgtttcatctgtgtttttctgtttgggactgaatcgagtaacagagaaaatgtatcatgcagcaatttacaaaatcagtttaactgtataagcatttttacaccctgttatttaacgcccccattgtttggtttatttatggaataagcgaaacgacatatttgtaaacgagaaataatttgtgaatataacttttatatacatgttcttagcaacctactctctcggcttcacaatgtaagtcattctaatatttcccatattcatgaatatatatatatatatattcattaatattaatatgaacgtggaaaatgctaaaatgacttacattgtgaaacggaagaagtaaaagcaaaggctggaaaataaatttcgatgaaaaaaaatcttaaaatcagctacaaatttaatgttaaaaattcaaattttggctgataagcataaacggaaatatgtgtacgtcacgatgtaaaggtatcatctttattctgaatgatgatgattcatgatgtaaaggtatcatctttattctgaataaaaaatgatgaatagatttgacaccgattcaggtaggccaagaggtatccccggattggattgtgatcaaatgcagtagctactaggactgcacggtaactactgcacacaatctgagccctctatatcaaaatctaacggacaaaacggatttggcacagtaaaatcagaacagtacctttccacattaaatcactacagtgttttgctacagtgctcggatatatctgggacgtccattttagatcatgcgatgctagtttgactgcttattttgcagtcccactggctactgcacctgaatcggatccccccggattgggatcctctgactttactcagagagctatagtaccgtgactttgggagtatttctagccgtccgatccacagcgaacggacaagatcgatcgctagttcgctacagcgaatcggtgaatagtaattctgaacagtattttgcactgtttgctacagtaaaactacaaatcactattccgcactgtagcgacaggctcattttactgtgcatgtctgccgttcgcttcaaaagtcagaggagccgcttcccccatttgcacactgtgaggaccatgtctgcactatacgagcaggtacaacagaacaacagactataagccaactatgagtatattttaaagaggtaaaagaagagaaagaaaagcatcaggctacagatatatctgtagctagctacagtatggactccaaaacataatgtatgtatagcagatgagactaaatattaatagtatagtaagagctagtagtgggctatactattaaacttgctctactaccatccatttataaaaaaaaatatctatatgttcagatgagcacgccattgaatttggagttggagagactgtccatgttgaatccaatcatgtcgtcggatcggagctccaagaaggtgtgtgtcgtcggcgccgggatggcggggctggcggccgcgcgcgagctgcggcgggaaggcctcgacgtgacggtgctcgagcagctcgccggcgtcggcgggcagtggctgtacgacgcggcgaccgacgccggcgacccgctcggcatggccggcgtgcacagcagcgtgttcgcctcgctccgtatcaacggcccgagggagtccatcggcttctccgacttcccgttccgccccaccaacgacgccggcggcgacgcgcggcggtaccccgtccacggcgagctcctcaggtacatcagggacttctgcgacgcgttcggcctcatggacgccgtcaggctcaacaccacggtcacgcgagtcgccatggcaccggcgcggcgcgacgggtcgctgcggtgggcggtgaggagcaagcgccacgcgaggcggagacagaggaggtgttcgacgccgtcgtggtggccatcgggcactactcgcagccaaggctcccgaccatcgacgggatggataggtggaggaggaaacagctccattcccactcgtaccg

SEQ ID NO: 36876 - DNA, 2076 bp, Oryza sativa
aaagtgtcgcaggtacgaaaacctccactgcgcccacagttggaacacctgcgcaagaagggactgtggtgttcgacgacggctcgttcgtcgtcgccgacgctgtcatttactgcacggggtacaactactcgttcccgttcctgacacgaacgggaaggtcaccgtcgacgacaaccgcgtcgggccgctgtacgagcacgtgttcccgccggagctggcgccgtcgctgtcgttcgtgggcatcccgggcaaggtggtcctgccggtgttcatcgaggtgcagccgaggtgggtggcgcaggtgctgtccgggcggaggacgctgccgtcgccggaggagatgcagcgcgccgtcgaggagcacacccgcggcatggaggccgccgggttgccgaagcggtggacgcatgacatgttcttgaacctggaacgctgcgacgactacggcgagcgcatctgcggcttcccgcggatggaacagtggaagaaggagatctttgtgtcatccctctccgacatggtcgacgacatcgagaacttccgcgacggctaccacgacagcgacctcgtccgcgacgccctgcgccggcacggttggactcccgccgaggaggacgacgacgcccacaaataaaagcacttggattggactccaataaattcaggttaagatgaagcaaaccaaataaatacacgacaattcaacaaaaaaaatgctggcctgtctgtctcaagaggatttttcattgtactaaaaactgaacctttttattttcggaattgctataaatatgccgccatctttcttctcggattacattcgattttctcaccatacaattagtttagagatatgtgcgtgtccgaagactgataatgccatcgttaagtgctgatactgtacgtttatgtgcatcccagtctctagttatcgctggccattactgttgtagcagggggtgaacaccatcccctatactcggccaaaaactcgcatgatgaggaaagtgtttttgagctttgctcaaatcaaattctaatatgtagccgtttctgaccaagaatttgcattcgcccaatagggcctgttccaaggaaaatgtgttcgaacaagattacttgctcgaattggcatcactaaaggcattgtgtttgagcaggttctttggctaagacaagtgaagtgacgaggagctaaaagatgggagagtattcaagtccaggcacaagtgttcgactcgagcaatcgaagttgaggaaaagtaccatccagcaaagcatatattttagaaaagtgttatgggaaccacgtcaactgctctcaccagttagcatcaaatgttacttggggaccactaaaatgttttaatatgcccctaaggtcataaactttataagggtaatatgataacttcatgtaagcctgcaatagcaaactagtgaatcttgggtacatgataacttcctacggtcatattgactttgtaccatctgtaaagttcctttctgttagatgaaatgtgttgttgtataggactttaattacaaacgcgcgtgcgttgcaaacggtgattactatgtacaattaaaatgtgattactatgtacaattaaaattatataactccactggtggagaaaccatctttggtcggtccggcaaaatccataatagtcccggatccaaaaagaaccggaactaaagattgtttttagtcccggttataaaaattttgatctttagtcccagttcatcccctgtcaaatgtgtgtcaggaggccgaggatctttagtcccggttggtgtaaataaccgggactaaagatcaccactttagtcacggctggtactaccaaccgggactaaagatcaagatgatgtttagtctcggttgggagtaccaaccgggactaaaattaaacacgtagtatataattcctatcccttatcctctcctccacagttacaacgtagacagatcgaatctcaccccctctcctcagatctatcctctctaactctcttctccaactcctcccctcatcctctcctcccccttcctcctcccattcc

SEQ ID NO: 36877 - DNA, 13337 bp, Oryza sativa
  unsure (1)..(13337): unsure at all n locations
tttttaatttgtgatgattcactgagatgtatttgactgagaagttacaaatttgtgattcattgtttggatctgtgatgaatttgagtaatttcttaggatattgtgatgtatttgatttgtgagtataaataactttatgatttgtgatgtggatttggtgatgtgaatttgggatgttagttagatttggggattgatttggggatttgcctacttgattcgggagaaaatgaaaaggaaaaaagaaaaagaaaaagggaccatttgcactgccgctattgtctctttagtcccggttggtaacatcaaccgggactaaagatcccctctctttagtcccggttggtggtaccaacggggactaaaatacatctttagtcccggttatttcaaccggtccatctttagtcccggattcttactcccggttggagaaccgggattaaaggggttcccaaccgagagtaaagatggtttctccaccaatgctcattgcaacgcatggacatatcgaccctaaaaataggaaataaaaaaattctatttttcttccgtcctccgactccagtgcaagccatgagctttccgatgggaagtgcgcagccagtttcatcatccgccacgcctagctctaactcgatctgttttttctaagtacatagggaatataaatagaggctatataccctagatttttttctaaatcctgcactcctcccgcacctctcagctctctcccgcacttctcccctcccctcacctagctctcctcctctccccggtgctgacagcggcggagggcgtgcggcggctaccggtggaggaggcggcggcggctaccgggggccaccggcgctcccctttctcgctccttcccagatctggcctgaggggggcgggggtaggacggtggccacacgtgtggcggtggcggcggcggcggcgggaggttgccaacggagggccgcgactaccgacgggaggcggaggttggcggcgggtggtggcggaagaaggcggcagccgctcccggaccctccctccctcccagatctggcccgaggggggcgtggggagggcagtggccggcggggctcccctccctcgctcccttcccagatctggcctaaggggggtggggggagggcggtggccacgtgtgcggcagcggcaccggcgggaggttggcggtggcaggagaaagggggccgtgctcggcggcgtcagagaaggtggaaccaatggcctggtcggcatctcggcatgcgcaaggaggaggaagcggcggttctgggcaccaatcctctcccttccttcgccccagacgtcggtgccggcggcgcaaacagcaccggccgctcccttcccagatctggacggaagaggggagccggctagcagttacggcaaaggcggcgctcccctcgccctcggacagcagcgccggacggaggtggagagccgtcggccggagggggatgccgacgccggcgggtagcaccggatttttcttctgtttcctcgctttattttcgcagtcaggccgcggacccgtttggattttcgcaggcgttaggatagcggcggatgtctccctcacctacaaaaactgtttttggccgctgtaaaaactatttttctaagtagtgtacccatctcactggaagcacgagagtcgagtccgactccaacaaaaactagatcggatctccttgcgtcgggcacgcgagcaggagcacggatgccacgctagctccgacgccggccaggagtggtgctggggaggatttttttttattttttttaaatttttaatttttaaaaataaaccatttaaaaacttatttttcaagatctaaaccttttggccacgccagccggactgacatagcaaaacaacattatcacgtcggtctggttgacgtgacaatgctatttagcctcatgggtttggctggcgtggcaccgttatttgatctcatcattctcgttgcgtggcaggataaaattatcacgcccgttgtgtgaccaaaaggttcagattctaaaaataagttttagaatgatttatttttaagatgtaaaataaaaaaagttcaaaaatcgctggggaggcaggctaatgaggtgatgagggcggccaggttgatgaacccgatgagccggacgtactgggtgctatggcagtaacacgatggctcatcctccgggcagagagagagagagagagagagagatcagagagagtccaaggggattgatcggtcatcctctcctccgttctgcagctagcgtgagtagacgaccagacaaattaagttacgattgtgaattaatttgtgattaacgagaagcatcgatcgttcccaattgatccaacgcgttcaagatatattaattgccgccgtgacctaggccctttttgaaagattagcacagggctaatattgagagctaatgtttagtcataaattggtaggataaacattattctagggtggtatgtttggatccatgggctaattcaagactaaaaggtagagagagagagctgctttttgatagtccccacacaaaactagccccattagcaccctttggaggagctaatgttttgaggagggctaattcactttagcctcaaattagcccacctgtttgaatccttaagagctaattcagagctaaaaggtgaggactagtaattagcccatagaaccaaacaagatcctagcaacctatccacctcgccgccggctgccgtgaatacgatcgaggtgagagcagcagccaattgatcagcacaccacgttgtctacttgcctttggctaatttgcctgattggattcgtcaggttagcgtagagccttggaggctacgatgaatatcactgaatcgatcatgcaaccaccagcgcctagcgcgtattgccgaaagatttatattagtttcaattattattaatatgatactgttgtacttttataaccaattcataatttatatgaagttaaccattaacgtgttaatcttttcatttatcagttcatcccagataccatgtcatcaagtgatatgtacaagggtatacgatgaaacaacaaataatatatattaattattactttgatattaatgtctctgtcctaaaatatagttatttctaccacagtgccttgttctaaaataaagctattttttcacctacctcttctcaaccaatcacaaccattcttcttgacatgctttctcttttcactcaatcacacacttcctctaattttctcacatattttcttaatatccgtgtcaactttaaaaatagctatattttagaacggagggagtattaagtgtttccacttttagttttgtcctggccactcaaatctctggattgagactgaacggggctacacacgtgagaaaggaggacgagtagagaggtcgctgctactagacagggaggcgagctcgtcgtggtacggtgacagggtcatcgcggcccacgaagatggtgatggcaccagcaagttagcttgggctgatgaatttttattttattttttttgaacttttttaaatttttattttaaaaataaactcttctaaaacttatttttaaaatttaaaccttgtagccaagtcagcccatctggcgaggaaaaattactatcacgctacttgctgcgggtgtgataatttaatcctaccacggcaaccaggatggtgtggtagtattattttgtcacatcagttcaagtttcatatcttaagtattgaaaaggtttatttcaaaaataaaaaaaatatgggtgactagcagacggtcgagtgtggccatgaaaaaggaggtgaggacgacttgacgggttcctttttccttagatgcattttataagaacctttccgtgcaacatcgttcgaccatgtcagccatcatgactactacatcggcgcgaggcatacatcaaacactaataccaaaacgatttttgtttgcagttgaaagggattttcgcgtgcggatctcacgcccgtctacaacagggtgcctgtgaaaatatgaaacttttcgtgcgggtgacgcaccagcacacgaaaaatcagatttttcgtatgcgggtggcttatgtcgcccacacgcaacaaaaaaaaagacccccaaaaaaataaaataaaaaacataaccctagccgccgccctcctcgtggttgccgctgtcgtcgttgtcgtcgttgtcaccgttggtggcggtgccatcgccaccttccaccgctgcccaccgccggatctgggcgggagaggggcgccgcctctagacccggccgggcgggcgaggggcgccgctgccggtcacggccgcacgcaaggacgcgctagctgccgccgcccgccgccgctcccggccgtcgccagccgcctcgcgcctgttgccccgcgcctgtggagaaagagacgagagagagagataagaaataggataaggacaagtaggtggagaggataagatagaaatttttgaagtagttgagaggaaaaaatacctgaggagggaggggattttcgcgtgcggtactcttaagatgctcgggtcttcacgtaaaaattggcttattttttgcgtgcggacctcttaaggaatcttaaggatccgcacctaaaaataggaggacgatttttccaaactcggtcagttatggaccatccggaatctgacgaggagttcgtccaggaaaatcgtttttatatttgtgaaatgcagacttgtcttgtcggagcaacatctgcttattggactggagaatttaaggaagtaactttcgtcattgtcactatcaccttctcaaacgccgtaacttggttgagtttatgttttggatcaaagttgtcaaactgtagcacatcggagagaagaaaattcagcgaatgagttctgtggctaggcttctgcaattcaaatagataaggataacattgatgtaaactctagagtagaggtacaacatccgacatgaaggggtagcatcacataccttgcgcagagcaatttctaacctttttttttatttcccgttgcaacggacaactgtgtctcgcttacttggcctctgtttctaaataatatttgacgccgttgacttttttaaatatataattattaattttttttctatcatttgattcattgttaaatatacttatatgtatatatatagttttacatatattttacaaaagtttttaaataaggtgaacagttaaacatgtgttaaaaggtcaacggtgtcaaatactccgaccacgacatataaaaagttaaacggtgtcaaacacatgttaaaaagttaaacatgtgttaaacatgtgtcaaatacgtatttagaaacggagggagtagtacgtaggatcttatataactgtctctcttgctctcgtcgagaagggaaggatggtgtccgaccacgacgacggcaagctgccggcgcagtggaagaaggtgtgcgtcgtcggcggcgggatggcggggctggcggcggcgcgcgagctgcggcgagagggcctcgacgtgacggtgctcgagcagcgcggcggcgtcggcgggcagtggctgtacgacgcggcgaccgacgccggcgacccgctcggcatggccggcgtgcacagcagcgtgttcgcctcgctccgtctcaatagcccgagggagtccataggcttctccgacttcccgttccgccccaccaacgacgccggcggcgacgcgcggcggtaccccgtccacggcgagctcctcaggtacatcagggacttctgcgacgcgttcggcctcatggacgccgtcaggctcaacaccacggtcacgcgcgtcgccatggcaccgccgcggcgcgacgggtcgctgcggtgggcggtgaggagcaagcgccacggcgaggcggagacagaggaggtgttcgacgccgtcgtggtggccatcgggcactactcgcagccaaggctcccgaccgtcgacgggatggataggtggaggaggaaacagctccattcccactcgtaccgcgtcccggactccttcgccggcgaggtcgtcgtcatcgttgggtgcagcgtgagcggcgcagagctcgcgcttgagctccgccgcgtcgccaaggaggtccacctcagcaccaagtcgacggaggagaccatcacgtcggcgatgtccaaaagtgtcgccaggtacgaaaacctccacctgcgaccacaggtcgaacacctgcgcgaggacgggactgtggtgttcgacgacggctcgttcgtcgtcgccgacgctgtcatctactgcaccgggtacaactactcgttcccgttcctggacacgaacgggaaggtcaccgtcgacgacaaccgcgtcgggccgctgtacgagcacgtgttcccgccggagctggcgccgtcgctgtcgttcgtgggcatcccagccaaggtgcttctgccggtgttcatcgaggtgcaggcgaggtgggtggcgcaggtgctgtccgggcggaggacgctgccgtcgcaggaggagatgcagcgcgccgtcgaggagcacagccgcggcatggaggccgccggcttgccgaagcggtggacgcatgacatgttcttggacctggaacgctgcgacgactccggcgagcgcacctgcggcttcccgcggatggagcagtggaagaaggagatctttttctcgtccctctccgacatggtcgacgacatggagagcttccgcgacggctaccacgacagtgacctcgtccgcgacggcctgcgccggcacggctggactcccgtcgcgccgcggccgcaggaggaggacgacgacgcaaaagcaattggagtggcgaacatataacaaaaattaccgggtgcaatacgtactccctccttccctaaatatttaacgccattgactttttaaaacatgtttgactgttcgtcttattcaaaaacttttgtgaaatgtgtaaaactatatgtatacataaaagtatatttaacaataaatcaaatgataggaaaagaattaataattacttaaattttttaaataagacgaacggtcaaaacatgttttaaaaagtcaacggcgtcaaatattttggaatggagggagtagtaattactctctccgtttcgaaatgtttgacaccattgacattttagcacatgtttgaccgttcgttttatttaaaaattttgtgaaatatataaaattatttgcctacataaaaatgactttttagcacatgtttgaccgttcgtcttatttaaaaattttgtgaaatatataaaattatttgcctacataaaaatatatttaacaataaatcaaatgataggaaaagaattaataattacttaaattttttgaataagacgaatagtcaaacatgtactaaaaagtcaacggcgtcaaacatttcgaaacggagggattatctaattattagttagtatattaattaaaatggcacattttagttatgattggataaaatatctaggatcctgtgattgaacgtggaagcgccactgcttattagactccaataatttctgcttaagcctaaggaaacaaaataaatacacggtaattcgaaaagaagtgctggcctgtctgtatcaagaggattttttttttgacaccaggtaatacaccttcattaaccaggggctctaggcaaatcgccagaatccagctggtggaatacaagctcagggacttggttgacatgcactgtgagagttaacagaactcaccccatacttagctaggcagtcatccactttcttgcaagacctcggacaataccaaatgagacagctaacgaaatgagaggaaacaaagacttttatttggcgaaataagcatccatcttgatgacgatcaaagtccgccgatgtggcgatgtgagagcacgtacgctgcagttctgtggcatccgtctccagtatgattcttgtcatcccaagctgcacaactttctcgatactgtggagcgccgcggtagcctcagcctacaacggtgttcgtacgtactcacatcaaaagatgcatcagtgttgatcttatatgtataaatagcagtgggggtctgagcatactaggtagagttacagtccctcctcccatctgcatatggtaaaaaattttagtggggtcttcgtggggtctctcatagttttcacgtcagtagtgggggctcgaaactccgctgccccatgctggatccgccactgcggccggtggcgattcccatttttcattcatcatcatacgtggagctcgatccaactgcagtttttcaaggtccattgtatggtaaatgatggcatcacacacctctgaacccgtgagcttcttgtcatccgcattggccttattccctgcataccaccactcaagaggatttttcattgtactcaaaactgaacctttttagttttgttcagtttatccaattactgctagtagtttatttctccgagggggtgtaccataatgtaataatctgttcgatcattgaatgcaaactaattaagcatttacaaattagtataactaacttttttatgacataaacgatttacatctgttagtataactgaatatatatcatatttgtagtcgatcgtgtatatgaccatatatatatctaactaaaaaatacggaaggattcggtacttttttggtttgtctttttttcgttggtttctttttgcccgatcgcttccaggttttctgtccatctggtttttctcaaccgatccgttgcacgcacgcatagcgcgcctcccgtcatgggctcatggccacgtcaatatgtcttcacgtgtgttttctcctttaattgactacaaaaatcgattctcactttcccttatcattttcctcatgatttaccctaatagcgatcatagtgcttcactttatcgctaagctcctaccaactattgtatcactgaaaaaatatctttaactgttgcaacgcatgggtatttttttctagtgtatttaaaaggattgtatttgttctttctgaagtatttaaaatggatgatgtaatcttatcttcttcatgtagctggtgttgagtagtttctttgtcgagggataactatgtctagtcaattctaacatttatcttccccgcaaaaaaaaaattctaacatttatcttagcaatatgttattatgatttgtctgtgcagaactgcagatatgggttcatttgcactaaagaaaaattaaaccactcctgcatgacattaggtagcagcatcttcttgttggaagacgactgctaatacagtagtcaagatgcgagtattaagtttatgacctcagaaggtcaagatgcaaatgttactaaacaattaaagaaagcagttgagcaatgggatgttccaagattaaagaaaggtgattactactcctttgaagagcatcttatattaactttgtgttgtaaaaaaatgatgagcaggtaaggcatctctgactctacatgagagcacatactttggtcattaatggtgattataatgatatattctgtatttattgtttgctgcattcagtttgattggttgctttgttcagagctgtttctaccaaatccattcaagttgaaacatctccaaaaaaaaatcaattttaaacggactgggagctgtccatgctgacccatgttgctctgtacaagctttatttaaatgtgctgcaaatttgattgcaattccatcacgatggcatcctgcaagaaggtgtgcgtgatcggcgccggtgtgtctggcctcgccgccgcgcgcgagctgcggcgagagggcctcgacgtgacggtgctcgagcagcgcggcggcgtcggcgggcagtggctgtacgacacggcgaccgacgccggcgacccgctcggcgtggccggcgtgcacagcagcatgtacgcgtcgctccgcctcatcaccccgagggaggtgatgggcttctccgacttcccgttccgcccaggcaaggacggcgactccggcgccggcgaggtcgacgcgcggcggttccccggccacgccgagttcctcaggtacatcagggagttatgcgacgtgttcggcctcatggacgccgttcggctcaacacggcggtcacgcgcgtcgccatggcgccgccgcggcgcgacggctcgctgcggtgggcggtgaggagcaaacaccacggcgaggcggagacggaggaggtgttcgacgccgtcgtcgtggcgtccggccacttctgccagccaaggctcccgaccatcgacgggatggacaggtggaggaggaggcagctgcattcccattcctaccgcgtcccggacgccttccatggcgaggtggtggtgatcgtgggctgcggcatcagcagcaaggacatcgggctagagctccgccgcgtcgccaaggaggtgcacctgagcgcaaagtcgccggaggaggccatgacgccggcgatgtccaagattctcgccaggtacgacaaccttcacctccacccacagatcgaacacctgcgcgaggacgggacggtggtgttcgtcgacggcacatgcgtcgtcgccgacgccgtcgtctactgcaccggcaacacctactcgtacccgttcctggacacggacggcaaggtcaccgtcgacgacaaccgcgtcgggccgctgttcgaccacgtgttcccgccggcgctcgcgccgtcgctgtcgttcgtggggatcccggccatggtggtggtgccgctgttcaacgaggtgcaggcgaggtgggtggcgcaggtgctgtccgggcggagggcgctgccgtcgccggaggagatggcgcgcgccgcggaggagtacaaccgcggcagggaggccgccggcgtggcgaagcggcggacgcacgacatcctggacctggagtactgcgacgactacggcgagcgcaactgcggcttcccgcggctggaggcgtggaagaaggagctcatgtggtcttcctacctcaccatgtgcgacaacctcgagaccttccgcgacgactaccatgacagcgacctcgtcgccgacggcctgaggctgcacggctggatctcaccggcgacgacgctgacgcagcagggcgacgatgacaaacggccccatcttttatgagaaattccggcttattaccaacttaaaataatagtttgcgaataaaatttttatatatgtgtttttagctatttaaaaataaataatataaaataaactataatgaaaaaaaatcataaaatcaacttccacattaaatttgaaattcaaattttgacgtataagtataagcataaactaaatgatggggctcaaagatgttggctaaaagtgaacggaaatgagttgagctgggtgtacgtgagtgtgcgtgtgttatgagcgtctgcgttttttttttaaaaaaagcacaatatttagcaggaaaaggcactcgattctaatcagttcagcttagcattattgaaagaaaaaggagggaatgtataagtatattaaataatgcaacgcaacacataggaagtataagcataaactaaatgatggggctcaaagatgttggctaaaagtgaacggaaatgagttgagctgggtgtacgtgagtgtgcgtgtgttatgagcgtctgcgtttttttttttaaaaaaagcacaatatttagcaggaaaaggcactcgattctaatcagttcagcttagcattattgaaagaaaaaggagggaatgtataagtatattaaataatgcaacgcaacccataggatacagtctcaaaatgttgaaaggttatgtatgatcgatcttttcacaagatcaactttatctcgagatagaacaatacgaaaatttacgcatggttctactattactatatagtactaattcataaccggagtatatgtcagaaactgagacgatttaacaagattcaaatttcaaaatagatcaggttcagtgattcacacaccaacatcaacatacagtgcaaactctggctgcacatacgcacgatgtcgttgttttttatttgtttgttgttcttgtttgtgtactgtactgatgggctggccatctagagataggtctaatcacattggcaccataccaaacctgagctcacgtgctgacaaccagaggtgaaaaaggatcggattcgaatggatagtagtcatactatctcctgaaccattattttgtagtagatttggagcgggtgtggatggtatatggatgtggagagaatcatttcggatttctaaaacaatgcaaagccaatgtaggctcaactcataaatggattaaaatcatcggatatgacgtctatattcaatcaatgtaacattaagtcatcaattcaacaggcaacaatataataacaatatcctaagcatttaataataacatcacacaacatatcgatataggacagctggtatcacattttaggtgtcatggtggatgaacaagaaatcaaattctaacttactattgatatatttttctaaaatgaaatctcgatgtctaatcgctaaacttttaaatcctaaatccaagacttaaaaaaagatccaaatagagtggatgagctaaggaaattatcccaaaatttactgaatgggttgtctgatgtgaaatggaccaaatagagtggttacaagatatgggccaagaaaatcgcattgtttaccaaaccctccaccacataatctgcttagaatatcgaataatctgcatccatcgcatatcatcggtatcacatccggcttcgtatccgcatgctaccattcaaatccaactctatatgcaccaaatatctatgaactcttatcatatccttgcttcgggaggatttggagcgaataatatcgtctctgttttgacctttattgacaactaaaaatgggctctaacaaaatatcagggaaattgtagctacattagcatgatggcacacattcgtgtagaggcatagtttcaatgtccaatgatggcgcatgatatgattaaataatcatcatgtgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 36878 - DNA, 836 bp, Oryza sativa
caagaggagaaatacatatttataaacattttaaaatgcttgaatttttctcgagtattatatttacatcaggtactactcatcctatctgtttgttctgtaggatccagatccagatatgcataaaagggattcatggctttaagcttatctcctacgctttaggaatggatcaatcagaacatcaccaccggctcgccttcgtcgccgccgactggtgtcctcgcctgcacggctggcctattatgccgccgttgttgggtgtctacgtcttcaccaccggctcgccttcgtcgccgccgactggtgtcctcgcctgcacggctggcctattatgccgccattgttgggcgcctacgtcttcaccgaccggcctgcctccgtcgccgccgactggtgtcctcgcctgcacggctggcctattatgccgccgttgttgggcgtctacgtcttcaccgaccggcttgccttcgtcgccgccaactggtgtcctcgcctgcacggctggcctattatgccgccattgttgggcgcctacgtcttcaccgaccggcctgcctccgtcgccgccgactggtgtcctcgcctgcacggctggcctattatgccgccgttgttgggcgtctacgtcttcaccaaccggcttgccttcgtcgccgccaactggtgtcctcgcctgcacggctggcctattatgccgccattgttgggcgcctacatcttcaccgatcggccacctcatccgccaccgaccggtgtttccgcttacacggctggcctattatgccgccgttgttggacgtctacgttttcaccgaccggccgcctcgttcgct

SEQ ID NO: 36879 - DNA, 6314 bp, Oryza sativa
  unsure (1)..(6314): unsure at all n locations
nnnnnnnnnnnnnnnnnnnnnnnnnnnnnnnnnnnnnnnncaaaatttcttcaaaaaagaggggaggtcatgccaaaatttatagtaaatttactttggtgattatatacaaatcggaggtgcctaaaaggttagcaacttcatcctccaatgttttttttgtcatttgcagctatgttttgcatacttttttgtctccaaaattttgttgtaagttgatgagagagaaaatttgtgtgggaaaagaaagaatatatagaaattttgtttatttgctaaataaggttttataaaataattgagtaggaaaatatagtgaaagttaatcttaaataaaagaaaacaaactaaattgaaaactaaaagaatttaaaacttaaaaaaaataaataagaattatttggtggaatattttataatttttgtatgaataatgatatgtcattattgtatgactgttgaaagagtttgtgattattttgtcattattgtatgattgtcattattgtacgaatgattatttgtgtacgattttttttgcatttcatgtagatggatcggcaatggatgtacactgaccggcggtccaaagagtttattaacggcgtgcattattttttgagagtggccgaagctaacaagcagaagggttttatttgttgtccatgcaataagtgtaagaatcagaaggagtattctgcatccaggactattcatttccacttgtttgagtcggggttcatgccaagctataattgttggacatcccacggagagcaaggggttgaaatgaaagaagatgaagtggaagacgacaatattccagactttgctcagtacgctgaatttgaaggaaatcaaacgggcgaggaggacatagatgctgattataacgacgttgcggatgatcttagtcagatgttgcaggatgccaaggaggactgcgaaagtgaaaagggggcccataaattggacaagatgttagaggaccacagaacgtcgttgtacccaggttgcgagcagaggcacaaaaagttggataccactctggagttcttgcaatggaaggcaaaaaatggtgttagtgacaaggcatttggcgatttattgaaactcgtcaagaacattcttccggagggaaacaaattgcccgagacaacgtacgaggctaagaagatagtctgccctctaggactggaagttcagaagattcacgcatgtccgaatgattgtatcctatatcacggtgaggagtacgagaacctagaagcatgccctgtttgtaaagcactacgatacaagattagacgagatgatctaggtgaggttgatgggcagctaacgaagaagagaattcctgctaaagtgatgtggtatttccctataataccacggctaaggcgtttgctcaggaacaaggggaatgctagaatgatgtgttggcacgctgaagaaagtcaacaggacgggatgctgagacaccccgcagatggttcgcagtggcgaaacattgatagaaaatttaaagactttggaaaggacgcacgaaacatacggtttggtttaagtacggatggcatgaatccttttggagagatgagcagcggccatagcacttggcccgttacgatgtgtatctacaacctcctcccttggctatgcatgaagaggaagtacataatgatgccgattattattcaaggccccaagcaacctggtaacgacatcgatgtgttcctaagaccactggttgaagatcttaaactgttgtggaagaaggaaggtgtccccgtgtgggacgaggacaaacaggagaagtttaacctacaagcgctactgttcgtaaccatcaacgattggcctgcacttagcaacctatccggacagtccaacaaggggtacaaggcttgcactcactgtatggatgaaacagaaagtacgtatcttaaccactgtaggaaggttgtgtacatgggtcatcgtcgattccttgcagcaaaccacccggtacggaagaaaggcaagcactttgaacatacggcggaccaccgtacgcagcgggaaaacagtgtttgctatggttaaagatcttaaagtagtgtttggaaaggagcctggcagccagcctatagagagtgaagatggtcacgcggcgatgtggaaaaaaaactccatattttgggagttaccctagtgggaattcttggacgtccgccacgcaatcgacgtgatgcacctcactaagaaccttttcgtaaaccttcttggcttcctaggtgtatatggaaagttgaaagatacactggaagcacgtaatgatctgaagcatatgaaacaacgcggcgaccttcacccggaaccacaggagaaaggcagccattacttgagtccagccagctacactcttagcaaggcagagaaggaaagtatgtttcaatgcttggagagcatcaaggtaccgtctggatactccacgaatataaagcgaataataagcacgaaggagaagaagttcacaaacctaaagtctcatgactatcacgtgttgatgacacagctgctaccagttataataaggagtatcctcccagacaatgtccgggtaacaataacaaagctatgttctttcatgaacgcaatttcgcagaaggtcatcgatccggataggttagaagcccttcagaatgatgtggtgcaatgtcttgtcagctttgagttgatatttccaccttcatttttcaatataatgacgcatctgatttgtcacctagtgaaagagatcggtattctcgggcctgtgttcctacacaacatgtttcctttcgagaggtacatgggcgttctgaagaagtatattcgtaaccgtgctcttccagaggcaagcatcgccaaggggtatggaacatgggcgtagaatttattgaagaccttcgcccaatcggggtacctgaatcacgccacgaagggagactacggggaaaggggactctcggaaggaaagcaataatgacggtagacaacaatttatttcataaagcccatttcacggttttacaacaatcttcattggtggctccttacatcgaggagcacttggctctagttcgcgccagaaacatcggtaagtccgatgcatggattacacggcatcacattgatactttccccgcatggctgcaacaacatctcatgggtaacgagacgattaaccagtaactggccttcctggcaaggggttcatctgagtcgatcgcgatattccagggatatgagatcaatgggtacacattctacacaagagcccaagacatgaagagcacgaaccagaacagtgctattcgtatcaatgccatgggacacgatggtacaactggcacatattacggagccatcgaggagatataggaacttgactatggacctctcaaggtccctctgttccggtgccaatgggttaggttgactggtggaggcgtaacgattaatgacagtgggatgacaacggttgaccttaacaaggttggatactcggacgaaccttttgtccttgccaatgatgtaacgcaagttttttatgtgaaggacatgtctagcaaaggaaagaatggcaaagggcctgacgagccgaagcgccacgtggttctcccaggcaaaagaaaaatcgtcggagtagaggataagactgacgaggattacgatcagtttgatgggcaaccccctttcacggtgacggttgaccctagcatcctcctatcaaacgaagacaccccttactcatgtagcgatcacaaggaaggaacaatagtgaggagaaagtacgtgcggacaaccgtcaccgctgatctattgccgtaattgttgtaaactaatttggatgtattgaatatgctagttatatatgattaattacaatttttaacaatttaatatcatgcatatactaattatatatgattattagaatttttaaaagttttaaatcatgcatatgggatttacatatgttagttacaatttttaacaatttaatatcatgcatatgctaattatatacaattattagaatttttaaaagttttaaatcatgcatgtgggatttacatatgtttgttacaatttttaacaatttaatatcatgcatatgctaattatatataattattagaatttttaaaagttttaaatcaagcatgtgggatttacatatgttaattagaatttttaatgcattatttactattttagaaacacatatgcaacgaaattcaatattcagtgctattaactttagtcctgtttcttaaccctaaccaggtttaaaaaagaatttgaaaatagcgggaaaatatctttactcccggttcttctcaccaaccgggagtaaagatccgggggtatatatattcccggtgcgccctcgtcttctccaccaacacttagacgtttttccatcgagatcgagcatcggcttctccttcgtcgccactgcctagcgctaccccgcgccgacgccgccgttgtctctcaccgtcgcctggtggtcctcgccacctccgccgcagacgccgtcgccgcgtctcttgggtgagagccctcgccctctctctctctttctcgatgtagctctctgtctctctctctttcgccgacggacaccgacgacgccgacgccgacgtatgccgccgggccgctacgttacgctgccgccgcgcccccatgccgccgggcccccatgccgccgccgcggcccgccgccgccatgcccccacgccgccgggccccgcccccgccgccgcgagacgccgccaccgcgagatgacgccgccgccgccacgcccccacgccgccaggccggcccacggcgccagaccacgcccccaccgccgcgagacgccgccaccgcgagatgatgccgccgccgcgcccccacgccgccgggccggcccacggcgccggaccgtgcccccaccgccgcgagacgccgccgccgcgaacgaacgcttaacaaacgtgactgaacgcgaacgaacgcgaacgaacgtgaacgaacgcgaacgaacgcttaacgaatgcgaacgaacgtgaacgaacgcgaacgaaacgttaaagaaacgtgaacgaacgcgaacgaaacgtgaatgaacgtgaacgaacgcgaatgaacgtgactgaaatgtgaacgaacgtgagtgttagtgaacgaacacgaatgaacgtgaacgaacgcgaacgaacgcttaacgaacgcgaacgaacgtgaacgaacgcgaacgaaacgttaaagaaacgtgaacgaacgcgaacgaaacgtgaacgaacgtgaacaaacgtgactgaaacgtgaacgaacgtgagtgttagtgaacgaacgcgaacgaacgcgaatgaaacgcgaacgaacgtgattgaaacgttaacgaacattaatgcacttgaactaaaagtgtgagaacgaacgcgagcgaaacgtgtacgaacgagataattaaactattgttgaacttagcatatatatatgattatatatacttgaaaacatgaaatacatttttttgcatgttgcagagaagacgtcgtcgtcgtcgtccctcaagccgaagtggtagctagccctcgaaggaattcgcgcaggcaagtgatgtaaagatgtgattgttagagatataatataagattgttagatttctaatataagattattagattattagagttaccatatgtgagtgttagaaattattagattattagacttagcatatttgagtgttagagatagttagagatttaatataagattattagaggtttaatatacgaaacttaattagacttagcatatgtgagtgttagagatttaatataagattattagagatgtaatattcgaaacatatttgattgttagagatttaatataagattattagagatgtaatattcgaaacttaattagacttagcatatatgattatctaccgtacaaatacacgacacttagacttagcatatttgagtgttagagatagttagagatttaatataagattattagaggtttaatatacgaaacttaattagacttagcatatgtgagtgttagagatttaatataagattactagagatgtaatattcgaaatatatttgattgttagagatttaatataagattattagagatgtaaaattcgaaacttaattagacttaggatatatgattatctaccgtacaaatacacgacacttagacttaacatatttgagtgttagagatagttagagatttaatataagattattagaggtttaa

SEQ ID NO: 36880 - DNA, 1775 bp, Oryza sativa
ataagattattagagatgtaatattcgaaacttaattagacttagcatatatgattatctaccgtacaaatacacgacacttagacttagcatatttgagtgttagagatagttagagatttaatataagattattagaggtttaatatacgaaacttaattagacttagcatatgtgagtgttagagatttaatataagattactagagatgtaatattcgaaatatatttgattgttagagatttaatataagattattagagatgtaaaattcgaaacttaattagacttaggatatatgattatctaccgtacaaatacacgacacttagacttaacatatttgagtgttagagatagttagagatttaatataagattattagaggtttaatatacgaaacttaattagacttagcatatgtgagtgttagagatttaatataagattattagagatgtaatattcgaaacatatttgattgttagaaatttaatataagattattagagatgtaatattcgaaacttaaatagacttagcatatatgattatttgagttttaatacaagattagtagagtgttaatattacgcttagcaaatatttcttctatgaacagatggctgatcgtgatgaggaacagatactgtacgatacaatcgcatcgggaagcagctagtactggaacgaagaagaggggaacgaggatccaaaccagtacttgaacgaggaggggaacacggagagggatgcagaggggaacgaggaggggaacgtggagagggatgcggaggggaacgaggaggaggctagtggaagtcatccctccgctggacagaagagggcatgcggaaaacgaggtgccgcgaagaagatagagggtcggcacatcataactgaggtggacgcagatggccgacgtagtgccccggcacaagcagccaagaattttgtacgccacagcggttgggttgtgagggataacgtgcctgtcagcaaggtgtactggcgcagaacaagggcacgcaggggtgatgacagctttgtcccggaatcagagaaagagatgctgtggaccacaatgctcgagacgttcacgctccctgcaggtacagagaacatagtgaaatagtggactcttaagaaaatggcagaacagttccagaccttcaagggagatctgtaccagaaatacatcctgaaggggcagacaccgaacttcgacgtattcctgaagctatgggatcactgggacgagttcgttgcttacaagacaggtcaacaagggcaggcgatgatggaaagaaacaaagaaaatgccgctaagaagaagtaccatcaccacttggtgtcaggcggctatagcgtcgcgatgccgaagtgggaggagatggaggcaagcttgcttgagaagggtatcgaaccggccaccgctaaagggcctgatcgatcgaagttctggtactatgctcacggtggaatgctcaacccagttgatggctccttggtcttcagcgatcagatacgcgaggctgcgaatcgactaacggacgcagtggaagcctcttctcagggcatgttctgacccgacagagagaaggacgagctgtcactcgccctacagactcccgagcatctaggacgaacacgagggaaaggcgtgattccctggaagatgggattcaaggaggacatccacacgtacaagagtcggatgaggagcaagagagataccgaggcgaagattgcaaatcttgagtacagggtat

SEQ ID NO: 36881 - DNA, 9374 bp, Oryza sativa
cattccgcaagttgctacttaggttgattactaatagatgacctctcatcacgtgaaggtggcgtggggaatggccatcccaacggacatttcagggacttaccactgcaggccgattccagcaggatactcgagggttaaagttgagctggtggaagccgtgtacagacctcgagttggactacccaggaggagacggtgagacgcatctacgagacacaagccacaccattatactatggcgcaagcggtacatcatcctccctgggcgacaagcggcgtctcgtgcaccatctcttctggctccgccgtctcctcctgcaccatctcctccggctcctccgccacctcctcctgcaccatctcctccggctcctccgcctcctcctgcaacaggctcctccgcctcctcctgcaccatctcctccggctcctccgccacctcctcctgcaccatctcctccgcctcctccgcctcctccaccgtgtccgcctacacctcccaagacaaggtctcgccaagctccacctcctgccagcacaagggcaacgaagaaggccaaagttgacaccaccaaaaacaaggagccaccgtacggttgcagtcaagaggagcttgacgcttatgtggcaggagaagtgaagaggcaactcaagtctcggagtcttgaaaagaagatacatattgacccgagcatgaagaatttcttcaagggaatgtccaccacaaacaaggaggccttaaagctatcagactatgaccgaacacttaggaaagcctattacaagaagtccaaaccagttcctcagcttggagaacaaccacaccaagtggtagagccgttggtgaccggcgaagactttggcataacggatttcatttcggacaccggtctaaccatcgctcagtaggttggaggcgcaccaatcccgaaggcggaagtggcatacaagtttgaactcagtaaaccgcttgtcaggcctgagcagctgcagtccctaccgacacaaatgtacaaattccatgcacggtacatggaaatgagcgccaatggtagagagatgttcggagcgaggatcagaaaccccgacttcttgcaaggagaagatgttctatggatccatttcaaggatgtcttcgatctgtaccatcgggacgccctcgacgtctctcttcttagcgcatggattttgtaagtatctttgagttcgatttgtttcattcaataattagctcctggcatatatgtaagcaataataatttcctttcattgttgtagaatggagattcaaagggcccgacagcgggggttttatgatactgggttcatcgtccctcggaaaatcaacaccgaaatgctcgacaagtacgagaaagacacagaggacaatctcgtccatctcctaacgcagcagcatttcaagacgttcatactattgccgtacaacacagagtgagtttttgttgtcgtttgaacaaatttcattcccatacatataacatgtatattctgatatttatctcatctcacgcatattctagattccactggtcctgttctttttcgacttggacgcatgcagagtcactgtgtacgactcaatgaataaaaaggagaaggtttttgacaaggtcttccaactgatagacaggtaatataatgccatctattccaaagtcgcgggactctgttgctattatgttgatctcgggtaatatttaattaatcatagcttgcaactgcacatgtagggcttgggatcggttccgtcaattggtccgcgggacttggaaagaaaaacttggacgaaggtttcattttctagtgagtacatgcatgatccaaaattatattgaattgaatctctagttacagttaatataaagagtatattaaatctctcatcgtttctcatgtagtgtgcaaagcaggacaagggaactaacttatgcggctactacgtatgcgagtatgcccactgcctatcaaaccaaatatacaccacacgagagctcgatgtacgtatacataaaccattcaaaatttcattgcgtatcgatttgttaagttgtttattaatttcatatattgatatgtcattatttttcgaatgatagcgtattcacatgagggaaaaactcccacacaaggattttatcatggctgttcaagaacaactgatggggttcatcaacgaagaagtccttaatcccgatgatgaattctactatgacggatcgataattcgtaacgtctgtccttcctcttctaacgtaacgcaagcgtcgaagtcgtagctatagctagcgagcaaatgaattgtactatacatgcatgtatatatatatatttatatatgtacgtatatttactttagtgtcaatatatattttggtaacatatatgtacacaaaatgttaagtgctttaaattataaatatgtgtgtaatatatgtatttatacatatatacataggcatatatatatatatatatgtatatatatacatgcataatatatatattacaatgcatatatatgtattgtaatatatatatatatatatatatatatatatatatatatatatatatatatatatatatatatataatcaaccatgtagcaaacagggccatgcaaataaaaaaaatggtacatagatctttagtccaccaaccgggactaaagatggatcagccggccacgtggctgaccgatctttagtcccggttatttcacccgggactaaagatcgctatctttagtcccggattcgtagtcccggttggacaagcgggactaaaggggggttacgaaccaggagtacaaacgatttctccactagtggtatctgcatattgatcagtgatttgagagagagatgagaagagtaataccattataatgtgagatcagtagtagttgagttgcacacagctcttgcgctaagatcccggtcttgaaataccttgggtactctcgttaacctttagttagtgttgttcacttgctaagatcccggccggccggacatcgcttaaatatacaatgcagaacgatttccagtgtccaattaattaatacgtgttatgttctccattacaatataatgttctgcttttttggacggattcgtcctcagccctttccaacaataatatctagttttataaaatgcatgcactctaacatataatcgttataacagaaaggtaatatacgtatcatacatacatatatacaagttttacatactcatggtcggcgcacagatgtcaaaaaaaatataaaaaagttctactgctactctcagtcaagaattgattgtattttacccgtaataagaaagaaaaaatgacaattctatgagtacaaattcattagaattttctattccccgctgctctttatgtgatgaattactacatctgtctacacatataaaggattccggggttcagatttaatccacaaatatatataagaaattctataatactagttccccccaactaatcacccctcatttaatttccacccaatataccccaaccatatatccttccatcccacatccttaatcctaatctctcaaaaattcctaggtccatatatgtatgtatatatatgtatatgtatgtatgtatgtatatatgtgtatatatgtatatatatgtatatatgtatatatatatacgtatatacatatacatgtatatatgtatatgtatatacatatacatgtatatatgtatatgtatatgtatataggaaaattatatactactactgggagtagctactccctccctgtccgccaccaattcaattcgtttgcctagataacgataatgactattaacgggtttattgaatcgaatacttttacccgtattttttttccctcagggtcaacaagattgtttctgttctgtagcagattcgaaaattgaatcaagaatcctgagtttgttgtagatagaattttgttcggagacagctaaccagagatatttcagggtggttttttcgctctttagtttgcttatccaaagcgagaaatcaggatgattatcccatcgagcagaacattatcgatctaaaatcgttctctgcgttttgagagttcttaacccatctcaactcagattagtagcctcgccggcggctgcgttgcagataacgttgaaagctctagcatggagaactccagttccaaggtttgttgccatattcatctgttattttgcagtgaatgcggcgccggccatggcgacgatgaacagcaccaacccgacattggtacggtatagcagtgtcaagctgcaggctgccggagtggagcgccccaatcttaccggagaggagcgccccaatgtgccgcgtgcacgccgagcgccccaacgccggcgccgtcaaagctcgcggtagccatggatggattttttttcctaatctttgagtctttttttgatcgtatctcttaatagtttgttttgtttatgtttttgcatttgcagcacctttgcagtcctgcagcaggtgcgaatgtttcaggtggtggtggctctagttctgttttcactagagcccttcatgctgctcaagcaagaaagatgcatcagcggaagcagctacctggttctgcagtatcaaattccaaaaaaacaagtggcatcaagggtaaaaaggtagtacaagaaaaaatttacaccaggtgcactcctgctattctctcagatctgttctcaagttttggtgatcagcaaaaagagctagtgaaacagatggggtttgatgggttgctttccatgaggctgactaaactgaacaagcaattcggagcatggattctgtgcaagctagacccatcatcaggtaatctgtttacgggatctagacatgaaatttgtttgacatgtgaggatgtcagcctacttttgggaatcccttgtggacggaaggagattttgcctgcaataaaaaacgaggtaaaagatgttaaggcttatatgtatgaaatcttcgagaaagattcctttgatggacttaccattgtaacaattcagaggatattggagaaaaaatttaacaggacgatgactgttcacgaacaaattgtattcaagactgcttttataatcttcgttgtaaccaaattcttggctcctcaatctgttaacaatcacatatctataaggtatatgaaggctttggttgatgtagaaaatattcacaagtacaactgggcggaatttgttttgcatgacatcaaagatgcagcagcagcattgcaacacaaaatacgccatcggaaaagcattggttacatcaatggctgcattatactacctcaggtgaaattatcctattattcgttcgaattatttgccttttactttctaatatactcgcaacatctttcacatgctataatttatactgctcagcttttttatttggacaatctggatttcgggacggacactcccgagcaggaaaacattccacggattggcatgtacaatgactccatgatagcggaattcattgagaaggatgtaattctcaagaaccggaatcctttccccgcgtatggaaagatgaaggtaaaatcaactctcctgccggtagtatattcttgttgaaatttctcttctgcagaaacttcagactattgacatttttattgggtttcagctgcgaaacaaacatgatgaaaaatacaatattggccatcatacgggtgcaatagaggtgcaatctcatgtagtttgtcaatctattcaatatgaaaaaaatccatttttctataagaattgttgatatatctgtacacaggctatccatgtggatcatacctacgatgccaggtctgacatcgagcccccaagctttaatctaggaataacacaagatatcgaagaagtaaacatggtggcatgtaccccaggtcatgacatatccaatgtggctgaagactctgacaaagaacaagaactcaactttttagcacgtaccccagatcagccaatctcaaagtcagtagatgcctctgacaaatccggagaaggtaatgcagtgcacaaaactccctcttcgcatagaggtaatgatacccacaagcctgtatcagtttttcattttcattcataaccaaccacatgcacataatatgactcactcttactgttttgactcataataggttaccaacaaacaaaacttagtagtttctctccgtactctatgttgaaagagacgagtggggcgtgaggagtacgcatgtacaaagctcccacctaaatccaagaggagaattattggcggtccttctgatatcctattcgatcggccaaagaggtcgattaaaccaagccatttggtgaaatcaccatttctgagcaagcaacactctttcgtcaggcatgaccagaaggcacttgatgatttatgcacatatgcaatttcaatcgctgatgcagaagctcttaagtaagccacctatctgaaacacttgatgatttatacacatatacaacttcaatagcttatgcagaagctctaatgtaagccacctacctgaaatgttcctttctttcaccactaattgtaaagatatcacatttaacaggaaaatctgggttcacatctcccaacctgtccctatgtcattaagcctacatgacatacaataggctattcggctggacactcaaatgcaagaagaaacattcaatgttgcagttcaagtattagtagcggatgcgatacagagatttggaggaactgattttgtaggctggagacatttcttaaatcaagattttgcagtaagtgcttccaattactctagatcgactatttcaatttttaaatatggtgtgttttaacataatatggcgctgtagatgtttgcaacagctggtgatgaccagtggaacccagaggaccatctcccctcattcaaagatgactccctgataccatatgtcgtacctagttgccacctggtttgataattaacagcatcttgaaaaattcagtacatcaagtgcaaatgttcaggccactaacttttgcaatgtcaatattaatttgcagatatttattccactacttcaaccactgcactattctctatacgcatttgatatggagaaaaaaaatatgcattcttgacccactgagagacgcctcgaaaagataagaggatacagcagaaagacacttaaaaacaaaatttcacatttcatctgctctgaaggagtgcatgaagcttgcatttccagattggggcgaggatataccaaactgggtttctaagttcccttcggtcatcccagctttaaacaacaagttccagttcatgctcccaatttgatccaaattaatttttccattctactcatttatggtcattacaataataacaattttggtaggctggattgtgcctttcacgtgctctactacatgcgaaactgggatggaactcgccttgtgaaccccccaaaatccgtgagttttctgtacacactaggttcaacttaagtttcattgaagtagcttcctttataataaataattttctatattaacaacaggatcaacgagatcttcgaaaggaatttctgtccaacttattgtcattcagaaacaacgaagctattctgccggacttcgtcgttcactgcctgaagttatctaacaagatctgagcagttatgcaagcatgccaaaataaacattacattcagttacatcattattatctaaaatttgttagttcccaataatatttgtcttgttcttattcaacatttttcaaggcttcatgttctctgctattctcttcccaaatagatgaatttgtcatttaccttccaactatcataaatttagattttcccaacatcaaatccatgatgttcacctatggcaaattaaatactagaaactaattacatcttctgttgccgtacattacgtgatcagctctcctccgaacttagagagcagatcatgccatgatccaaatcagtgcatgcccagcgaaaaagagacatgttctgctgggcgaacatgtctataacagtcatgttttgctcggcgaaaaaaagacatgctcccagagcagaacagtatgccaattgatttatgctaccacgaggatacatcccaccaaacaatagcagaaactactagccatgtactgctgccgagaatacatcccaccaaaacaacagcagaaactactagccatgttctgctaccgtgctaaaccccaactaaaaatacaccacaagcactcttcatgttctgctcccgatgcagagcatgatgaaaaacgtttttggctcccacgaagattcatccgacactacctccagcagaaacaattagctatgttctgctccaatacgatgcttccaaagactacaactacaccacaaactctgaggcacaacagaaaatagaaaaaaaaatacaaaactagtgttcgcaaatttcctacaatgtttgccaaatgtaaatattcaaaatatactacatgttctgctgacaaaatttaataataataaaagttccattttatgctaaacgaaatgctgacaccaaccctgcagaacattgaacagaataattacactcacttcttcctctcataactagatttctgaccacatgtaatcttatagtggccatgaccaccacattgcttgcagtacctaatctgcttcgttgactctttttttcctttggcgtgattcttcgactcgtccttggaggtactctcactagccttcttctttgctttgctagatgtctctcccttcgacatcagtctggtactcctcggtcgtccacgacttcttctaacctcaggagggagtatgtcttcttcgttgacatcagtcatgtccacatcaactgaatcctcaccagcagaaacatcctgtccaatgccgtcctcatcggctacacaaaagtcatcaggcattccatgctccgagtcagaactgtctacactatcatccaattgcacaccagtaggtttcttcccaattgttctatctccgcaatgaatttccttgttgtttacaacttgcgaagtacacatgacctgaagttctccaatcagctttgtcaacacttccaatgtcttctcatatgtttctgaactagtaccaccaagtctaaccatatcaagtgcagacttgtgcaggagggtgttccgataagttctcgatgatgccgcctccttatccttcaagtatgactcctccaagtgctttgggattgaatctctagcatcttttgtccacctcttcaggatatacttcttcggtattgggctgcagga

SEQ ID NO: 36882 - DNA, 3650 bp, Oryza sativa
cagccctccttgtaaagggggttaaggacggcccgccgagcatacctgaaagtaatccatacatagctgtaggtgtcatcccattatctaccatttcctttatgttcctctttgtcccttcatcaatgaaattatgagacctgaagtgcttagtatgctgcaggtcccgtttcatttcatggttatgctcactaatgaatgcaaaaactctccacttttgactttcagaagaacgatttaacctgaccatagcctggcagcctatcctggtcggcggaccagtgacagaattatctctaccctgcataaattacaggaacaccttactacgtaaaacctatcgaatgatgatcctacgcatcacactgtagaaacttgccaatcctacgagaatacgaaaccatggttttcaaaaaaaaaaagaacacactaaagatttttacctcacgaatgcagcagaactcttgcatggacttcacgccttcatctttgtatctgttcttggatctccttataccaaaaccagtgaacctagcgtacagattgtagaacgcatagccattagagtcctcattgaaggtctgcccaatttccggcaacagaatggctgggtcagagagtgaaataggcagcagatcactatcttcctccccctcaaccacgatcctaggatcaaaaaacgagaaatcaggaaacaatgcagaaaggggaattgtacactacaatcacactgacataaaaaaatacctttccaacggaactacgtccatgggttgtccactatgatcctcgccacctttctccggccagccttcttcctccatacctatctccgtgaatattgtttctgtccagcacggactctggtagctaccccttttggcaaacagaatttgctctagggtgtccttttttttcagctggttggatatatactgacaaataattacggtttattttccaccagctgctcaacaacctccccgaaaatcaaggctcctacgtgcgaagcatgttattggactctggaaagtcagccactagcaacattaacgaattctgatgaaaccataccgccacaaaaatagcatctataacaaatattccgaatacgcaacgctacactcacagaaaccaattcgaaatctctgctccattcttgtacaatattctgctcgaagaacttcatcttggtgaaggattgcattcacgatgacaacagggagtttgcagtacacacaacttaaatagataaatgaaaggataacatctcaattttatttcacttcccaaatagcagaagatacagatttctcaactcagatactactcgcttttttctcatagaatataccatacaaaactagagacagttcgtacgactaatctacggccgtgcagaaagcaagcccttattacaattttcctgatcatcacactattggctacatattttccttggacacatgttcgcaactattactgttgccccgggttgtttcgttgcttctgaaattcacgtcgcaagccacgcgaatatcacggagtgagcaccaagcacatctcttcctaggattcctcatggaaagaggatgacatccatccaaatgaatgacatatttctggagggagtggttcatcacttcactccgggcagcagtatccatgcaacgcacaaaaccattcctgatgaccaaataacgcaataaccagtcagagccaaacaaacaaacaagagaaaaattttcaacagaacataacctaaaactaaacttctatgtgtacctatctgcggcaggcttctgctgcttgtcaccattagctgtaatggttccattttcttccttcgccagattgtgctgcttgctactactcactggcgacgacgcgcctacggccaccaccgacttctgctgctcgacatcacgcgccgacgagcctccgcctacttgcgccgcggaaggcgacgcaacagacctcgccgacgacattctgccctttccaccggaggggttctgctccaccaaaaacctgcagaacaaaatcttcttcctcacaaatccgaaatataattctgctcctcattttctgtcctacatcaccgtcaacttaaatagagtatcaacagcaacctccacactaactactctcctggtcgcacggccatgcatgcgtgcgggtcaacaatccatgcatgcagaacattcaaaatgactcgccatgcagaacaccacgcggtgatacgaattttcaaagaaaaaaagaatattcaagtttctgcatcggtggatcagtggatcttttctcaccaaccgttagtgagttaaagcccgaaaccctgatatgagttgggcaggtgtccgatggttacaataggagtacctactacagggagtagtatataggcttcctatgtatatatatatatatatatatatatatatatatatatatatatatatatatgtatgtatgtatatatatgtatgtatgtatgtatatgtatgtatgtatagatataaatatgtatgtatatatatatatatgtatatataaatatatatatgtatatatatatgtatatatatatatatgtatatatatatgtatatatatatatatatatatatatatatatatatatatgtatatataaatatatatatgtatatatatatatatctatgtatatatgtatatgtatatgtatatgtatatgtatatgtatatgtatatgtatatgtatatgtatatgtatatgtatatatgtatatatatatatgtatatatgtatatatatatatgtgtatatgtatgtcggagaatgaactcctccaccagggaaccgtgaggcccccctttgtgtgttcggccgggggcagcgggtgagattcgagggcttggtgagcggagctgtgtgatcttgagggggttagccccccccccccaagacgatgagacaaaagaggtttatacaggttcgggctgctgagaagcgtaataccctactcctgtgcatgattgattgaatgtagaacacaagtgcttggggttgcgagacccaagcgccagttcgccccgaagtcccccctccaccactaggcctggacctccttttatacctcaaggggttaccacatgggcccaacaacctaacctaactccggtggagaagtattataatctttgcattaaatgcatgtcttgtctcttgacttgggaagccaagcacacgtcgtcttgatgatggggcctgtcaaatcttgccgcctgacatggggggtgcccctgtcagtcaccatttaatgggtgaagacttctaggctcctattacaccgagaaacgggagccttgcttttaccagagcgggaggactgactctggctgggataagaggatgagaacctctcaccatcactatttgatgggacatgtcaggctgcacgccgcctgacacacgagcagcgcacaggcgcactagccagtcccattggtcattcgaccggtcacagaccggttgagtgcactgcacgccacattaaatgcagcgtggcgcgactactcgggatgccataaatgcgggtaggtgggcacttggaggcggacacctaacctaccgtacgtggtgacctagagaaggggtcggggga

SEQ ID NO: 36883 - DNA, 12186 bp, Oryza sativa
  unsure (1)..(12186): unsure at all n locations
gggcccgattccccctcgagggggagccacgtggcgcctggggcagccttctccctatagtatcggccagggagtggccgccgccctacctcgggcccgacccctctcgggggagggccacgtggcattggagggcagcctcctacatctagtctctgggaaggagtggccgccgtcctacctcgggcctgactcccctcggcggaggaccacgtggcatcggggggcagcctccaccgactagtctttggggaaggaggggccaccaccccacctcgggcctaactcccctcgggggaggggcacgtggcatcggggggcagcctcctccctctaaacatgatagccccgggcccatatcaccgacagtagcccccggcgttagccctgaccaaaaccttccccaggtggtcagggtgacgccactttcctagtctgatgataggtgggcccgatctcttattctttctttgctggtactaggacccatgcgcctttttcgccccaacctaagggcgactcgctagcccataccttaggctgtgaaattattttatgtatatattcagcaaacgttgttagattctctcgggcccgtgaccttacgccgcgtacctcacttgcccctgccatttgttaacctttgttcatgttctacttcatctattcaaacaattattttcgcgagtgtgaggactgaactttccatagccagcaatcttcacccgtgatcaagctaagctgggcgccatagccagccggcggggccaaagccagccgctgtggaagagctagcataggagggcccgggtgtcgacggtacccagagcttgacgcaaggctaggatagagctaggaatcgtagcccccgtactttaagcaaagaatcgtttgaatggatgaagcgaatacaaactttttgttaccaagggaggcaagccggtgcgcgacacataggtaccgcggagaccgcgaggaagagataggcgagagataaatataagcaataataattttatgcaaacgattatcttcgcgcgagtgtgaggactgaactttctatagccagcaattttcgcctgcgatcaagcgaagctgagcgttgtaaccagccgatggggccaaagccagccgctacggaagagctagcacagggggccccgggcgtcgacggtacccagagctcgacacagggctaggatagagctaggaatcgtagcatccacacttacagcaaagaattgcttgtatgaatgaagcaaacacaaacctttagctcgaagagggccccccaccatgggttccgaaccatcttgggaagcctgtgaccacttagcaaacgaggttaggttcccacgagcctgtgtccccacactacacattctgtttgctctttcctttcggtggcctccttccaatctcttttccttctacatgcacgattactttcgcatgagtgtgagagccgaaaactctagagccagcaatccccgtccacagttgagccaggccgggtaccgtagccagccggcgggaccaaagccagccgctacggaagagccaacacactgggtcccgggcgtcgacggcacccggggctcaacttaaggctaggataaggctagaaaacttagcccccacacttagtgaagaatcgttcatgtagatgggggagaggttgggctcttaccaccgagggagcaaacaaatgcgcaacacgcgggcgtcgcagggccatgagaatagaatggggggaaagaaatataagatttcaagctaatgaattgaaaaattgaaaatacttgaagcttgaaaggacgatcagttgagccgggccgggcatcgtagccagccgacgggaccaaagtcagccgctacagaagagctagcacagggggtcccgggcttcgacggcacccggagctcaaaactgcaagagtcctcccaggagtgaaccgaggcagcagcaggttcatgggccaaccccgcgcttggcccctaagggccatgggaatgacgttcgccatgacccggtcgccaccacccgccacctctatgatcgccgtgcagatctggagggactcggaggggtcggcgccatcgtcgtacttctcggtgaggcagggctggagctttgggggccctcggacattctgaagactcgccacaaagaccaggtagccaagattacctggtggggatgtggggggccttgccccctgcctggggtggcacgacactcctgaggatgttgcgccttccccagtagcggcggcgcgacactcaccacaccggcgctcgaaagaacctcaaaaatcacgaacgcgccccctacctggcgcgccagatatcggagaatgaattcctcaaccagggaaccgtgaggcccccctttgtgagttcggccgggggcagcgggtgagattcgagggcttggtgagcagagctgtgtgatcttgagggggttagccccccccccaagacgatgagacaaaaaaggtttatacaggttcgagccgctgagaagcgtaataccctactcctgtgcatgattgattgaatgtagaacacaagtgcttggggttgggagacccaagcgccagttcgccccgaagtctcccctccaccactaggcctggacctccttttataccttaaggggttaccatatgggcccaacaacctaacctagctctggtggagaagtattgtaatctttgcattaaatgcatgtcttgtctcttgacttgggaagccaagcaaacgtcgtcttgatgatggggcctgtcaaatcttgccgcctgacacggggggtgcccctgtcagtcaccatttaatgggtgaagacttctgggctcctattataccgggaaacgggagccttgcttttactagagcgggaggcctgactccggctgagataagaggatgagaacctctcaccatcactatttgatgggacatgtcaggctgcacgccgcctgacacacgagcagcgcacaggcgcactagccagtcccatcggtcattcgaccggtcacagaacggttgagtgcactgcacgccgcattaaatacggcgtggcgcgatcgctcgggatgccataaatgcggtaggtgggcacctggaggcggacgcctaacccaccgtacgtggtgacctagagagggggtcgggggagcctgacccctagtcacgggagggggcggccgccgcccgacctcgggcccgatccccctcggggaggagccacgtggcgcctggggcggcattctccctctagtctcggccagggagtggccgccgccctacctcgggcccgacccccctcggggaagggccacgtagcattggagggcagcatcctccatccagtctctgggaaggagtggccgcggtcctaccttgggcctgactcccctcaagggagggccacgtggtatcgggaggcagcctcctacctctaaacctgatacccccgggcccatatcaccgacaatatatatatatatatatatatatatatatatatatatatatatatatatatatatatatatatatatatagacacgggataggaatgaaagaacttcttactctctccgccaacccaaaaggaaagaaaagaacagaacagccggaggaattggtcaactcatcatgctcatgacctgaagactgcaggtttgaatcgggctgatggctagtctaaagacattgaccatctggagcgaaggacaattggcgaagttagttagagaaagcttgaaagataggattttctcgtgtggtaactcgtgaaatgccgagttggtacgaattctgggaaatccttccttttactctctcttttgaatgagtcgtggtgcgcgtgaacaaagcaaccctattaataggagggctagctcgggggcaaatctctagtattggtaccgggggccggtgtctagggataggagccgtcaaagggctagtcatcgctagaaaatccgaaacaaggctatcgctagctttattggggaatttctaatcttagtaggagctttccaaagaaatggaaaagtaaggaattttctcgagattgttttcgcttaaccaaagaaagaaagagaagaaggaaccatttttactaataaaatactataaaaaaatttatctctatcataaatctatctctaccataaaggaataggtctcgttttttatacaatgttctacgtcaagtttaaaattttttcatgaaaaaaagattttcaatttgactggacttgacactggattatgttttctgagacagaaaatgaacgccttcgttcaatatctatagtattctcggatatgatagattcatcgcttgttcgcacagtcttattgaagaatttggaatgaaaagaagagtaatgcttcctagggtcttggcttatacctttgcttctcttctctagggatctatacttggatatgcaactttaggtagtcagacagtcaccctcgtatcggctggatatatatagatcagtggtcgtaactggttatgcttaaggaactgtaacaacaaaaaaaggttcttcgtttttcaactggctctaatgcaaatttaaaaaataaagaagagttccgtcaggcgtactgaatctcaagacgttcctcaaaccaatcatatactttattgagataggtaactaacccgaaccccagaagtcatgggtgataattggtctgatgcttcgggcgannnnnnnnnnnnnnnnnnnnnnnnnnnnnnnngatcatacgtctataatgcattgtatgtcctagaatagggcccttttggcgttccttcgtagatctacggatttcacccctacacacgaaattccactctcctctgtctcactcaagtgaattggtttcgagagcattccgccactttttggtgactttcactttcaacccgattcacccccaagacgatgttggcgcagaagcaataaaagtatgatctcgttgtcgctttcatcaacccggaacgatagtgtaggcgagcccggatgtagagatggatgatgtgtaaccaaagaagcagtgcccaaaatgcctctagaaagatcagacagaagtaagacgagctgtaattgtacgtacatgtaaaggagcttagtatggagttgcctggattagatcctcgttggtccttgaagaagaaggcggaagacttaaacccttcatttcctaatttttggttcggctctcctaaagaattgacttcctagagccacatgtttcgtcgtggtgctgatcgcgtggtttgcctcttcgtccaattttagaatactttttgattttttagtcccttatcaacatttcatcaatatctccatcttccttgtcaagttccctaaccccctttatagcttcacgctgtttgaatagttccaattaatggaatcaaagtcattacacgagtgagtttagcaagtggaatatctgactttgaaggagctgctgcgaggtgtatggtttgagtacaattaattcatttttttatgtatatgtatatatatgtatatatgtatatatatatatgtgtgtgtgtgtatatatatatagacatatatatatatatatagaagaagatcagagtcaatactagaaaaatcatttttctagacgatgacatttttttctaggcaggtagggctctcagagctaaatgaccacttgcgaaaattacaaccgtggggtgaaatcgttatccgcctgcaaaaatctattttcgcaggcgaaccacttaagcgatccgcctgcaaaaattccatttatttttgcaagtggacctcttaagtggtccgcctgcgaaaattggcgtggcatataaatagatgcgacatcaataatattttttctaagtcctatcctctcttctcccccagctctcctctctccctcagccctcagctctcctctccctaagctccctcagcgaccgtgggcgttctggggggcggcgacggcaaggcgcggggccggtgggcaacggcgagcgcgaggtcagcgatggcgaggcatgggtgggcgacggcgatgcaccggggctacggcatccaccctcggcgcggctccccttccctcccttctagatgtggccaaagagggaggggagggcggtggtggctgcggttccactacctcccagatccggccggagggaagggggagggcggcggcggcggttcccctccctccccaggtctggccagaagaaggggggagggcggcggcggttccccttcctcccaggtccggctggagggagggggagggcggtggcgagcggctccacttcctctccctctccctcccaaaaccctaacctagatcggccggaggtgggtaggggcttgggtgggattaggcccataagtttgtatacccaagcactatatatatttcactaattatccttgccaactcttatctaacttgtggctaaggattacatagtcagataaattgtgacatgtgacaccttagttgtaaaagtttggtaaattaaaacaagctttcgaacagcccattcttcaacaaaaatatttcgtagaggcatttaattattagccctgcagaatatcgaaaactacaatttcaatacaatggaaagtacatttgtagtttgctttgttttatatttttacattaatcttgatgtattgttattattttaaaaagaaaatcataatctcataacagtttacaacaagtaaaccttgtttttccacttctaggttagaacattattcgcttcaccataagaaaagaaacatacaagtgtgagttgtttgtattgattcggtgttaaataaatgattgatagataagaaaaatattagccacttgacaagtagactcccccttagaatatttaattaactagatatgttaaatattattttatatttaactgtccaagctcgaataattcgtagtaccataaagctatccctcattatggtagcaacgcaagagtgctgaggtcaccttgatgacgtttaagaaaaacagagagatcacccagcttgatgacgcagcgaaattatcctgtttctatattgaaatctaacaagaatcagaaaataaaaaaatattggagcggttaccatatgatcagcaatttgtcgagttggaatagcatttacctaaaccactaataaagcatatacatatgggttgtagaaattcaaagatatgttttaactctctctttttttatgtgggcatatatgccaaagatgatatgttggcaagagacattattgaaacctaattattaatgacctgtttaggacttcagttagcttccccaatgtttttttttttttttgaaatgcacatggcattctcttcatctggaagctagactggaacattttgagctgtgccttttggtttcaacatatgggcaacattcccatgccacacatccataaagaacatcaatctggttaaagagatttgataaacaagacagggatttgggatatttggtagtactagcattgtacgcagtggcgttttgggccaattggaagactaaaaaatacagtgcatggttttaaagtcatgcgtatgtgatttataatcatgtaaaaatattgtttatatgtgttgtttactattggattattttggttttaatttgtctttctacagaaattggagaggcagggaagttaaagacatgctgttggaagacaagtggcaggctgacagcagaagtttcaaagaatcggagaatattaaggacggcgggatgggcgctcgctcgctgcgtccacgtcggattttgctacagtagctacagtgcgcgcggggtggaaattatgcgaaaaagccctccgatttttcgtaataatgtataggtccctagcgtcctgtgtttgaagaggaataatcgcggacaggggcttttttgtgatatgtgaaagaagaggggcttttccgcaaaacagcatccactaacgcataccccccacagccctagctgccgcctctccctctcccaccacccctcccgcgccgccgccgcctgcgcctaccctcgcgccgccgccgccgcctcccactccccctcaccccgtccacgtcgccgagcgccaccgccgcctccactcccgccgctgcgcctaccctcgcgccgccgcctccgccccccctccccctcgtcccatccacgtccccgagcgccgcctccgccccctcgcgccgccacctccactcccgccgccgccactgccgccgcagagtgccgccgccgctctccttgtcccgcgccgccaccgagtgcctgccatctcaccctctccctcttcttctcccaccgccgccaccgccgccgccgtcaccgagtgcagccgtctccacctccaccaccgccatcgccgtcgccgagcgccatcgctgccgctccctgctatccctttctcaccccgcctgcctccggtccccctgcttaccccgcctacctccccaatgatgtggcggcggcggtggcgacgacgacgacggtcgatggggtcatttcctccccacagaggtgggggtccaagctggctgcggcaaatttagtttgttcacgctgttcagaaacggtggttgcgtttcatgtgtacgggctgcgttgattggtgcatgtgaaggcacgtgtctttgagtgtgtccgtggcagcttgggcggtgcatccgtggtaaagaaggaaggggacggcatggcattttctggatgcactcgcatttcctcttcgtcgttggccgcgccattccgtgcgatttttgctccgatatcagcggctccattgttttgcccccctgatttggtattgaatcgatgctctttctatctcagtgccaaatctgtatgcctggtgtgatttcttcctccttatacattttctccctggtaatggatggccagttaattggtgttggatgtttgcttgctgttcttcctcgcttgtctctgcatatcatagcatggtacaaatcgttcagggtgcctgctcacaccactcaagatgctctgattgggccattgtggtgtatgccagtcgagtctcgtcgctgcgggagggtcccaccagtgcggccagtgtcaggtgcactcaccaccactcgtcgttcgagggcgggacagagaactcgagcatgcctagtcaatggcagccggtcatcggggctgcgaggtgattggtggcgtctgtgcgtgttctggcgagtagtcggtcccacggctttagccaatcatgctccactgttgttcgggccccacgtagtcgtggtccatgccaattgcagttggccgttgtagcaggctccgccgatgtgccctttttccggcgcagtgttactgctcggtgtgttacgtcggagagctcgaggatggcctccgtcagagcactgatgtgttacgtcgtatgctgtggctgaccgatggccctgtcatctgtggggtcctattgacagcctctgagtatgttgttttttatgttacatatttttttgttttgtttaccagtataagtagctcattgcctgccaatcttctctttcccttctgctttttcgccatttcctttgcattgccttttggtgcccgttcgctgttcttcttgtcgtctgttctagcccattctccgctgttgtgctttcttcgttcgatcatgaaccctggggggtgaacgcgtgtgctggtgggttttctgtatctagcctagctgccttcctttgtgtctgtgccgtgtgtttcctttttatcctgtgattaggcttggtgcatctcaggtagccatgtactggcctgtttgttgcacgagacttactgtcacagagtttttaggttttaggcgattttccccgtgttcatatttcccttttcacagtggatcattgcttatctctgttgttcttcttttagtaaatacttctttcagtaaatagatggtggctattacatagatgaagcacacggtcgttagttaatgacaaatatcattgctttttttttcctggttctgattcattattggatcatgtttcgccactcagagtgtgtcccgtggtgttttcttttcgtgcagaaccatgtggttcatttgcatttttgagtctttccttaagtgcatctctgtacgtttacatgtttttttttgtcccttcacatcgattttttttggcgcaggtgcttattgtcgcggtcaggtccgtgcgatacgttcgttgctgttgtgctgctgttccctttaccatcagctcctgttcaggtgagctttgtttctttgctatttctttggggcagacatcctttttgttttgtagtttatttgtgccttgtggtttggtgtatgttctttcttttatctgatatccagcttaaattacattcttattccctgcaggttgcggaccgcatctcctgtgcccgtacatgtcggctaaggtataacaattggcctttgttgcttcagctatctatacattattcgagctgcgctgttccttgtgggttatatgttctatatgtgtgcacgacatttctgtttttctatgcgtttagttcctatatggaagggggtcgtgtggttaggcctgctcgttgacgggatcgccgattgctagagcgtagcagcgcttctcttagatgtatggtttgttgcggtttgttttttttagatgctttagattttatatcttttcctgggtggaaagattaaatcgtctgttgcttgtttagcatcttcctctaattcagctgccagcgaatatgtttgggagactgttgctccaccccatcagggtatgtgatttactgatctgtgtgcgactgttgttgtggcttgtttatatttatgtagtcgttgctcatatatttttctcgctttagtagacgatggatttttccctatctaccctgcatggtattcttcaaaaagacggcaaatgtgttcaaaaaaattggccatgaaacgattggaggctacaggtttttccattggatctttggttttctgcatatgttcttgctgacatggcttacatggatgttatatctccttccctataggcaaaaaaccttgccgtattgctcctgtctcttgcaacaagtttgacagtgattatgccaagtttttaagaggttgctttcatctctgattcgtttccattcccttgtttgcaatgccagcacgcttggtttaaacataaatttctttttttgaatgcttgcatagagacttcaaaggataggtgcgattatggccctcctgagtatcgctgccgtatgtgcgctgctcagttctggtaccaggaacagtgcaagaaagattctgctattaccaagcgccgtgtctgttacaacctttgttgcaaaggcgggaaaatttttgtccctccatttgcgcagccaccagaacctttgaattcacttcttaaatttgatggagatgctcgaagtaaacattttttgcaacacatacgtcagtacaattcgctgttttctttcacttcgatgggtgcagatattgacgatagtttaaaccagggtggtggtccttatgtctttaaaataaatggccaggtctatcaccgtataggttcgctcttgcctaatgaagataatccaccaaaatttgctcagctgtatatttatgatactcaaaatgaggtccaaaacagaatgcttgctgttcttggtgaagagaatggtagctgtgatctagatcctgagatagctgctgaattgctagacatgctagacaattgtaatcctttggttaagcagtttaggcttatgagagattggttggatgaatttggtgatgaataattagcaattaagattgtaggtgatgatgaggaagggcttgttcagttgatgaactaggtgggttaattgtaagtgatttttcattggaaaatgcaaaatgtgatataattgtgcagagcattcttggtccactccatcatgtatatagcttgcatcctgcttacatggccttacaatacccactgttattcccatatggtgaacgtggttttcagcttggtataaatttgaggggggttgatttaaatcgcactgatatacgtactaaggcttccatgcaagaacattattgttactgttgccactatcgtcgacaccagttc

SEQ ID NO: 36884 - DNA, 1713 bp, Oryza sativa
tttatgtgataagcaatctatgtggagattatatgcatatgatattcattttagaaacccttctgttgaacgtttagcatgccatttaccgaacatgaacgtggtctcttttagattagacacaaatttagcatctatggtttcaaatacatttttacaaaaaacaacattgactgagtggtttgtcgctaatgatctgttcccgcaaggccgtcacctaacatactgcaaatatcctacgatgtttacttgggaagatgatttaaaaagttggaaaataaggcagcacggctataagattggtaggatgtattacatccatccttctgcaggcgaagcatattttatgaggatgttgatcatgtacgtaaaaggcactagaagttatgaggatattagaacatatgacggcgttgtttatgatacgtttaaggaggcttgtgctgctagagggttgcttgttgatgatagagaatggtcgtatgcatttgatgaggctgatagttgggcatccagcggccagcttagatcgctttttgtgttgatgattgttcattgtggtattgctgatgagagtgcattttttgagaagcattggcatgcgatggctgatgatattctgtttaatctgcagcaagccttaaataactcttcgtactctgttcctgatgctcagcttaaaaatatggttttacaagaattgcatacattgtttgttcgcaacggggtttctatgtcttcttttaatttgccaagcatcaattgtgatagctcctttcaatcagcaaatagattgattgacgatgaaatgtcttatgatatagataatttatgtgtgaatgctccattgctatatgaccagcttaacgttgatcaacgaaatgcatatgatcgtattgtgcaaagcgtcatgacgaaatcacctgctttttactttgtttctggctatggcggcactgggaaaacgtttctgtggaattgtattgttacctaccttagatctcaaaaaaaaattgttcttgctgttgcatcatcgggagttgctccattacttttgcccggcggtagaactgctcattcccggtttaaaattccaatagaggttgatgaatcaactatttgccatataaagcgaggtacaatgctagctgatcttattaagtccacttcacttattatatgggatgaagctctgatgactcaccgtcgatgttttgaggccttagataggacattgcgtgatatccttgctgaggatgatccttctgctgcatgattaccctttggtggtatagttgttgtgcttggtggggactttcgtcagattttacctgttgtggaagggggtattagatcaaaaacaattgatgctgcaatatcaaggtcccctctctggtcacatgtgtctattttagagctatcgataaatatgcgtttgcgttcaagctctctaagccctgaggtacaacatgaaatcgctgactttagtgattggattctttgtatcggcgatggtacaacagctgcaagtgctcgtgatactgacactgaaccaacatgggttgatatcccacacgatctgttagtcatggataatgatgataagattggagctattatatctgcagtctatactgattttgctgaacattatagtgatcctatatatctacaagatcgtgctattgtttcacctacaaatgatatatgtgg

SEQ ID NO: 36885 - DNA, 5418 bp, Oryza sativa
catgtatattacctggttatgctgcgcttttgtttgctgtcttactatactctttgccataggtgatgcaccgcatatttatctgcttattttatgctttttttgcccttttgcatgaccttgttttttgctttcctatagatggctttcgatttgctgtgtgacatatccctagcaagcagaggctggaagatccgtgcaaggatagcaagaatgtgggactacactggtacagctaacgatgtgcctcctatgcatgttgatctggtgcttgttgatgagaaggtatatctcattagtccgaatgcagggcacctttatattccctgtccaatttgatttgcttacgatttaaatgcttatgtagggaaatgcaatgtatgctgaaattccaggcgttgaggctgataagttcagaccacttcttcaggaatcgaaagtctacacttttagcaagttccttgttttgcctagcaaacctgcatacaagcccttccctaacaagtatatgatcaagcttactccatggacaaacgtggaacaggtcaatgaagttcctgctgatttcccatcccatgtgtttaatttggttcaattctcagatctaagccagcgcgttgggatgcaagagtacttcactggtttgttctttcctttaccattactttccattatttatgctatctatagcatttatcaatttacaaaccactgttcttaattctttttagatgtgatcggtatgatcattggggtatcaaagctagcctatgtccgaatggcgtctaaaacgtcagacacacctaagagggtcattgctctaagggatcttgcgtacgtagcctccatgatttatttgttgttccagtctttaccagcttgttgtttatgaccctgacctctaatgcatggccaactattttgataaccgttcattcttccgaataggaactgtgaggttaaacttgtcctatggggagagcatgctctcgactttgatgctgatgctgttcatagtgttggccaagataatgttgtcgttggtatctttgttggtactcttatgaaagcatataatagtaagcttttctccttctctgcatgtttagttctctctttattttctggtgccggtgttgtatcttcaatgtacatttgtttttttttgttgtctccacaatcatttcacctatgtattatgtacatgaagaaactcttagtggaggatcagcctgcaaatggtatttaaatgaggacataccagagataaaccagttctttgataggttagttaaagcccctcacaacagagttaataattttttagagttctaccccctttctctaacatgtcgttttccatgccttgattagcctgggtgatagtgctccaaagatccagtggatatcagccggagcaaagtcctttggttcgtcacaacgcccagcacagttggagcataaatctgttgctgaccttaaaaagattgatccatgggaagctgcggtaatcactgtaaaaagcatattatatgctttcgcatatgtatttttcatttagttcatctacaaggttattgctaaacacttcctatgcagggtgctggcttctcatctactgtgaccatagctaagttgagcccatctcagtcatggtggttttcatcctgttcccgttgtcatagagccgcaactgcatatggatctagctataaatgctacagcggttgctcatcagttactgccattccaaagtaatgttctacagcatacatgttcagctccttttttatatgtctgcttggcctctatgacagaaatttcatttttatatgttaggtaccgtctttgcctgataggaaccgatggaactgattcagcagagtttgtgctgtttggacgtgttgcgcagcaagttgttggccgtcctgttatgaatcttatcaaatttcagggcagatcagacaatattcctaaagaaattgctgctgttgtttcatagaaatttacctttgctgtctctgtcactgagcggagccttatgcataggaatatatcttttcaagttaatggaattgagactttctttggaagacagggttctattccgcagcctagggaacagggtccatctgcaggcccttctactcctttggctcttgttgcttctggtatgaataaggatgacgcctctcaatctcatgagttaaccccggtcaattcatctacttcgactgctgatccagtcgatgaacttcctggtgacagcaagaagcggaaatccattgtccgtcatgtacgcccttccattcatatcccatacattacctgttgctttttttatggcccttctttttatatgtctgattgctattccagcctctagcagcacagaaaaaattgacctttgaaacagctccatccagcaaagaaaacaccagcccggttgaccctcctgctaggtacaagtgtttttccacacttcttgttcttcttatatgttgaaactttctctatgttacatctgctttctaatttttatggccaacagtaaatgtggtttgcctctgctacatagcagagcacggtcagtccctccacttcaatcagatataagcatccaacccattctatttagtgaggaaccatgcattatgaacatattaatgtaggttccttgttgatctatattcctaatcatcctacctaggcctaatagacctaaataagtcattgctatttctcttgcttccatatgccattccgtacctctggtctactctgtactttgttccaccgtataaattgcctgtatgctaaatagaaccactttacattactatgacatggcctgctagctaatcgaaagaaacatgctcatagacaactacagaacattatttactacaggcagattagttgcttacttgttatcttttatatgggatgtaatgcgctccaaaatgatctgcatatggcctaccatcttttgctaccactgaccattgcacgcagcctaccagttatatcttttgctatgcataggcatatcatgtaatattactgatcatgatggctatctgctatatttctcagttcttctcgcactgatgaccaagctgctgataagcaacatgctgtgcctcatgaggttgatgtttctcagattgcagctgcctctgctgaaccaaatactcaggttaagcataaatacaccactttccagctaattcagtggtcgaatttttttagtgacactggcaacctaattattcccgttctataggtcaaagatatcctgccaactgaagccaaaaagaaaaggtataaaactacatattccagctgagaacgaataagaaaatccctatttttgtactagcggtggaagcatgtcacattcattgttaaatagactgcaccatttcgctttcgctgctctctcatttttggttcttctagattaaccaggtgttcctctctgctttagtgttgatccaggctctacaggcacacgcaagactaagcctcctgtaccgaaagggaactaaattgctcaccttagcttttgtgctgatgtgagtatcttgttctgttatatatctatgggcacggcattagtttcacctagattgctgatcactttaaattattttttaggggaataataccctacatcagcgatcccaccctatgtctacatatttccttaatcttactgttggcgatgctgcttgacatggcacatcgtatcagacaatcttttgtttacatgattgctggcaccactgtgtccatgcatgtgcatgtttggtcctctacctgctgctctttcgccctttagtgtcggtgtgctttccatataaccgtagcagagacttcctatgaaacgctgccatacgactgcacatcaccccatcttttgcttgtatgttataaccatgactgtcaatgtccatatggtgctctgtcagtcctatgaactcgttcagcaaacccccttctgttatggatcatattaatgcactagcgttctatctgctgttgttctgttcatattacatgccttgcagctgctttggatatatctagcacttgtgatacactatcgtcattaaaaacttatgtttcatgtgctacgtgcctgtgcaggaatttgaaatttgtagcatttccatcctacccagctaatgtgataagtaggattttgtgccatcctttctgtcctaaagaaagggtgggcaaaatttgcagctaaaaatagcatacgcgttggatcgaactgcattttccacttctacagggcaagccagatgcaaatgacatgcaaatgaccatcgatgttctgtagaccacacgtgaatagtcaatgtattcaggaccacttaccagctctaccgccactgctatgttaattagtgttgcaccttaagattattatcataggtactgcagcaccttacaaatatcagacatatgtgtgttagcgctgcaatctatttatctattgccgtctgctttcattacttttcccccaccaacactttttaaccgttcttccctggctatcagcttattgggcggcacacgtgcgtacaggcggtgcgccaagggcgcgccccaacctctagttaaaggtaacagagggctccagagaatcagattcatgtaagattgtcactagctagcatccatggagaaaattctctacgtgctcttgagaatttgcccgatccttatatgtccatgaatttttatctaatgtattatatgcacctgagttctccttttgattatgttagttgaccgttaattttttcaaaggactatattgcccccgtcatacttaatcagttaattgtctgctagcctagtgataaaaaagacaactctcaacaggagtaagattcaattgtaaaaatgaagggatagaattaattgaccacaaatttaataatgaaattaaaattttaaataaatttcaaatgaactttgatgaaatccgtacagcattttgaccaaaatttaaacccaagtaataaataatttttgttctgaatttctagcttaaattctcgtatggatttagtaaaaataataatttattcaaattaagttttgtattttaaatgttgcatatttctgttcgatttgatttgattataaattataatttttcacatagatattaatgagtcatgtagcatgtgagtatgagaaggggtgatatagttatttcaaaaaaatctaatggtcaactcaaggtttaactaatggatcgggaaaaactcaaaggagataaggcaaattttagggtgtcgaaacatgaattcggcaataataaaagggggtagcgcacgagacctaaaagtggatggatgcggagacaaaagattagacaggtcaggccctctcaat

SEQ ID NO: 36886 - DNA, 23540 bp, Oryza sativa
  unsure (1)..(23540): unsure at all n locations
gccctccttatataggttggggggcagggttacaagatagaaaccttaaccaatacggtatcggttttctaaatctactttacaatcttatcaaactaggactttaggctgttccataatatacagggaaacgtaatacccaagtcatgatctgttacatattttatatatataagttatcccctataactagtcggataaccatgccgtgtgggtatggggtacccataatctccacagtagcccctgagaccttcacagtcggaaagataatcttctctcgaactagattactccaaagccgagtgcttcaatcatcttcgccatgatctcccgagtactttttccaaatcagaagactgtggagggctgaaaaaataaagtcaggtgcatcgactagatgcaccgagtggtttcgataattgtagtcaaccaagcgacttaatatgtagcatatgtggtatgaatccctgaataatatgatccaagtgatataccgactgctttgtaaaatatgatgagtgtaacctaaagttggctacatcattgaaaattcacatagcaaaatagctataaagaagcttgtatgttgtgaataaagaaatttccatagtattgggcatacgccatgcgcacactgctttaacagatgtgcttaagtccctagaagacacatggttccaccacacctggaaatatatggcatatgaggtataaaatctgagtaaataaactcataaaggatttaccaaccgcctggaaaatgaccacaatatataatcagcctaagccataatattggtcaataaaaatgcacacttacgtggcaaaaagcaatgatattgtatccaatcaattgcttaaaaacccaaacaacaccatgactatataaaaaagtcagcggggcagctatataaagctttactgtttgacaccttttaagatgcattataccaactcctaaaaagttgagtaactgcgatataaaaggattttaaggtattgggcaattgatcacgcgcactttggcctaagcaaaaagtgcctaagtccctaaaagaacgtgacaggccacacctgaaaatatgggctgcagatatattaggcctaggccaaaaaatatgccttcgacaccctttaaaggatgacgcatgtaacatgctcccgagtaataaatcttttcgggtgatatagaccaagtgtagctcatatgaatagcttctgatctgagtgattatcctttatgggatactccaaaatagatataacaattgaattccgactggcacaagtattcagttgataacccttacggggaataataaatagtccagtctttgagcatagaaaatagacccatgatcatgaattcatgttgcatgtatccggagcaagtccaaattgaagatataatacttgtatttgagctagtaagcccctgagcacgtagtcacaattgttcattgatggtagctgacgcagttggcatagagacaagacgaccaatatagagataatattgcccaacagaggtggcaaaaatattggtggtagtgaagatagtgataccaatcaaaagtgatgaagttgcacagccgtggaggcgaagaaaccagtcagctgttgtagatgcttcacttggaggagagttgatgttgttgcccaactcgtctaaccgaaatatttgaagttgttgaagtagaatgtctgctccgaagcaaagatgaagataatgactcctggagttgactcgttggctgattaattgatttcttcagcttgacataaaatttgtcaaattttgagccttgtatttgtgtagcccccgactctttgatcagttgggaaacaactgaacatagagtcgagaactgtagcttcttgtcatcgaatagtcataacttgagtgaagatatgtgttgaggatgtccgagtagaaatattgaagattggaacaccacttgttgtaataaaataatacggcatcatatttagtgacatatgccgaggtgtcgaaactcttgtagtcgtcgtggttggtgaagtagcaaagcttgcgaagtagaagcaataaagtttgccggtgccgaagataataaagatgaagtcgctccaccatggtgacaaagttgcatagctgtaatgaagtgaacacgagtcggcggtaacagaagcaaaccggtggtgaagacgcgcagttgtgaagataaaagcaccagtcggcggcggcataaccagtcggcgacggaagacgatgatgtccatcagtagtggtagctattagcggtgacggtgatgtagccagccgtgaagaagatagcatcagttggcgtcataacaggccagccgtgcaggcggtgacaccagtcggcggcggacgaggcggccggtcggtgaagacgtagacgcccaacaacggcggcataataggccagccgtgcaggcggaaacaccagtcggcggcggacgaggcggccggtcggtgaagacgtagacgcccaacaacggcggcataataggccaacgtgcaggcggaaacaccagtcggcagcgaacgaggcggccggtcggtgaaaacgtagacgtccaacaacggcggcataataggccagccgtgtaagcggaaacaccggtcggtggcggatgaggtggccgatcggtgaagatgtaggcgcccaacaatggcggcataataggccagccgtgcaggcgaggacaccagttggcggcgacgaaggcaagccggttggtgaagacgtagacgcccaacaacggcggcataataggccagccgtgcaggcgaggacaccagtcggcggcgacggaggcaggccggtcggtgaagacgtaggcgcccaacaatggcggcataataggccagccgtgcaggcgaggacaccagtcggcggcgacgaaggcgagccggtggtgaagacgtagacacccaacaacggcggcataataggccagccgtgcaggcgaggacaccagtcggcggcgacgaaggcgagccggtggtgatgttctgattgatccattcctaaagcgtaggagataagcttaaagccatgaatcccttttatgcatatctggatctggatcctacagaacaaacagataggatgagtagtacctgatgtaaatataatactcgagaaaaattcaagcattttaaaatgtttataaatatgtatttctcctcttgtcaattgtgatttccccgagcagatgactccttacgtttaaacactctgcccgactagtcatagtccccaagcatcgggagtcggcctaggcacttcccaaacatgcatatgagtgacatgagttcgtcattaatggaacaaagtttcacggatcagaatttactactcgggtacttttgccattattaagagcagaaaataaatttatctcatctctatgcttttgatttattccgaataatacttagcaccttgcgttactcggtccatccaacgagcccccgggtgctaggaatcagcccaaaggcaaccatccattggcaaaccaaacggaaagcataggaagatagaactccataactcgataggtacttttgtactcagattatgtcgcaagtaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagtgaagatgcccactaatggcggcacaataggccaaccgtgtaagcggaaacaccagtcgacggcaatgaaggtgagccaacggtgaagatgtagacatccaacaacggcggcataataggccagccgtgcaggcggaaacaccagtcggcgaaggccagccggtcggtgaagacgtggacgcccatgaacggtggtgtgaccaaccgaccgtataggcggggacgccagtcggcggcgacggaggcaggccggcggtgtagatgacgatgcccatcaacggtggtgtgaccaaccgaccgtataggcgaggacatcagtcggcggcgacggaggcaggccggcggtgtagatgacgatgcccatcaacggtggtgtgaccaaccgaccgtataggcgaggacaccagtcggcggcgacggaggcaggccggtggtgaagtcgtagacgcccaacaacggcggcataataggccagccgtgcaggcggaaacaccagtcggcgaaggccagccggtcggtgaagacatggacgcctatgaacggtggtgtgaccaaccgtatataggcgaggacaccggtcggcggcgacggaggcaggctgccggtgaagtcgtagtcgcccaacagcggcggcataataggccaaccgtgcaggcaaggacaccagtcagcagcggacgaggcggccggtcggtgaagacgtagacgcctaacaacggcggcataataggccagccgtgcaggcgaggacaccagtcggcggcgacaaaggcgagccggtggtgaagacgtagacacccaacaacggcggcataataggccagccgtgcaggcgaggacaccagtcggcggcgacggaggcaggccggtcggtgaagacgtaggcgcccaacaatagcggcataataggccagccgtgcaggcgaggacaccagttggcggcgacgaaggcaagccggtcggtgaagacgtagacgcccaacaacggtggcttgatatgccagccgtgtagacggagacaccagtcggcggcggcgaaggcaaaccgggcggtgacggtggctccagcagtacatgtaaagagaaaagcaatctctaattagcatcaagaaaattaatcttgtgtacgtaagtctgcatatatgaagcatgcatatattttttgattggccgattgatctcctgtagcatgaacagtacacacatccacacatgcacgtcaccagacagattgcaggctgccatccgtgcgtacagatcacggtccgagtccggatcaaatccaacttggaggctttacgtgatgggaatcagactcaggtgaccatggcgcatgcaaaataaggaatcacagatcaaactgagattagaaaattaatctaatctaatctagttagtacacactagaagattaattagaagtatatgcatgcatgattaggtagatcgtgcatgtatgttaatctgctaaatcaactcatgcatgcgtgaaatttctccgagcaagctataggcggctgctcccatgtgcccgtggtggcgtggtggccgcaacgcatccgtcggcgctgctcctggcgatcgccgtcaacagctccgttttaacctcagccgaccagcccatagaaagcaaggaaaacaccagaagagcaaatcacaattagaaattaatctaataacagttagatcaaaacaccgaacccgactgaagatttgagccatcgagattaatctcgccgtttcttctgtagttgattccatcacacttttcgatgggtaattcgacgcagcccctacctggcgcgccaactgtcgaaacatgaattcggcaataataaaagggggtagcgcacgagacctaaaagtggatggatgcggagacaaaggatttagacaggttcaggccctctcaatgagaggtaataccctactcctgtttggggatttgaatccgccgagtgtgtattgatctgacgatcaggttgtctcatgcccctagagggggctccctgccctccttatataggttggggggcagggttacaagatagaaaccttaaccaatacggtatcggtttcctaaatctactttacaatcttatcaaaccaggactttaggctgttccataatatacagggaaacgtaatacccaagtcatgatctgttacatattttatatatataagttatcccctataactagtcggataaccatgccgtgtgggtatggggtacccataatctccacatagggcatgaatgagattgagaaaaattgtcaaggggtacacactagtttggataggaagatagggaaaaaaaggagatgaagatcgaggacgtttttcccaagatggaccgtgtgactgatatatcgaaatacaagcagtacacggtcgcaaggtctccaccacggagatcaaggatgccttggccgttccacaccaaatagtgatgatatgctcatgcatgtaacatcgtggagtcccaatctaaatcaggtttaacaatttgggggtgtgtgtctggggaggggggagcggtaaaattagaaattgtagattttttttccaaaatttggatcaaattttttgatgaaatttgagccaatttaaatacatttccacaaaaatgaaactttctacaacgatatctatatagtcccttccccggcgcccgcctccgcccctggagagcacggagacattggtgtaacttcgtgtgatgctatgcctgttttttttttattctcgatgcgaaactatgtcttctctctcttttcgccgatccgaaaatattaaaataataaagacggtgtccagtgacaaattatgacatttacagagtgtcttcttctaaagtttaacttggtgtcttacatgtaaaactgtaaagtgacaatatcatatagcaaatttaccaattaactgcgcatataaaattaattattttatatccactgattatactgaccagccaattacatattgatctctattacacgcatggagacgaaggagagctagcatgacccttattgcatatatatctcgcatgcattcaggttacatacgtttagacgtactactacgatatagcttgatcagtatacagctttattctcggcacacacatatatagtatactcccatgcactaatagtacgtaggtacatgcaagggtatatacaatttaatccattttatcaacgacagttgctgtgctttgctttgagcttcttatatatggtttccagttctgcatactctttgtgcttagcctgcctgtaattctccagtgcttgtatcttcatctggagggctgcattttgattcttcaaggcagcgatttcagcctcgtacgatttgttcttgcttattgctagctgaccacatgcttcatcctgcatacatgcataataatgcattggtatttatatatatagattcaatcaaaattaaagtacatatattaattctacatttgtgtagtatatgtatggtagctagttctacatatatatgttacgactgttatatactgagagagagagagagagagagagagtgcatagagaggaggggaagaagaagggtatagtatgtaccattatattgagctagatatatcgtagctagttctgtttgcagaactacaacacttgttcagtggctaacttagcatgtttctcgcttcctacgtacgcttaaatagacaaagcagcatggaggcttgcagttagttttcgtttcactactataaatccccaggttccctagggttaaaattcgttaccttgtagtgaatttgtccatgttgtcaacttcttcttcctcatttttcatacgtacgttttccgaatgttatgttttattgtaaatttctataggaaagtagctttaaagaatcatatcatattaaacaattcattttcaagttattttagctaatacttaattaatcatgtgttaattcaccgctacgttttccatgcatagagaataagttcccaacttcccaaaagaacagtcttatgctctcatggtagtgtgttgcttttttgggtggattctcctctacttctcgaacaatatataacgttataaaatagatacgcactaaaatatttagagaaaagttatcatatatatatatatatatatatatatatatatatatatatatatatatatatatatatatagagagagagagagagagagagagactgactgagactttgtagggtgattgaatgtaggagagccattgtgatcacttgtaatctaacgatgtaagataagatacaaatgaaaaggtattaaaaatatggttaacgtactaacaacagatgctagctagcgaatacgtgcgacaacggtaagttgcgcaccccgattagagtttagagctttggtgcaagagcgttgcaggtgaacgagagcccattgcagtgcgcatgtctccacctaagcgagagcttcccattccccagtatcacatgaccacaagaatcctaaaacttttgtctcgaattcaaaagaagacttttaattcaaaatctagaaattccttcacaaatttagaaaatttcaactcaaatatgaaaacttttgtctgaaaaattcaaaatttttaattcaaaaaccaacaatttcatataaaaaatttaattgaaaatccaaaacttatatctcaaaaacataaaactttcaatttatgatgccttatcccaaaataaagctatttctccacctaccacctcctctcaaccatttacaatcattatccatttaatttattcatatatattctcttctcaatcaatcacaacatttctctaacaatttttacctactttcttaatacccgagtccacctctaacattttgagcaaaggaagtattttctaatttatggttaaaataaatcaacggtggatacttggttgggtggcttaggagctagtatacctccaagcacgataaaattagttctcatatataggcatgtcattcacacatgatcgtcaggaaactataggatcgtcagtccagtgacttcaatgtatgcatcatctaattaagcacaagacgagcagaatatttaatttactggatatatatgcgttaaaagctattctctaagcaagttgtgatcaaactatatatacccacgcaagagtgctgagatcaccttgatgacacattgaaattattcgtttattagctagctagtagcttggatatatatattggggcaaacgctccctgttttcatcattatacttacaccaaaacaattaattactagtacattttttttcacattataagcagggccggccctgggattcttggccatcctcaacgtctgattgtatggaagcttacagaaaggaacaaattttagtttttaccatgtcaaatcaacctgacggtaatatatagaactctgggagcatgcacgtaatcaactagagctaaatcctatttcatcacattataagacattttaggttttgaatatatatgtgtgggtgtatgtatatatatgtatatatatgtatgtatatatatccatatatgtgtgtttcatatatgtacctacatttatatagatgtaagtggaactaactcttgtgcctgttcgttcgaaacaattagtaaatcaacttggaatggcagaattaattctactatcaaaaaattaggtcaagttggagcaataattcatttttataccgctaacattctatacttctatatctatatacgttgggaaaaaaagttgttccaaaatacttttacttgcgcacatgcatatataccaaagaagatatgtatgttctctacacagtcaaatctaataatttaagacccgtgtttagagcatcaacaatggtgtccctactccattcctaatctttattttttggaattttagtaagaaaaaaccgctccaacagtacccatactattcattccaaaaatcaccattcccttcttcattctcgctcttcacaaatcgggaatcgttctcaatctcaaattttgtctcctgagcgagactgccatccaagaagaggggcgagtgggagggcagcgctagatgggtgattgtggagtcagatggcacgatgataaagcgcgggttgaggtaatacttttaatattctcaaatcctcattagataatctcaaaaggagatttaggaaagagatttttagtcatctattggccatgaggtttcttagcttcgtccgggaatagtcgtctcttgaagagaaagtaaaaatttatgtcaaaatgagatatatatgttcaatgttcaatgtcaaagtgagcacaaaaagctcaaataattgctgaaagttttcttggttattgtttttctcaaaaggagttaatttgagaatcaatgataatgcaataagtctacatgtagagtttttctttcaacctatgtactattgaatatattgtattataaattgtttgaaatcatgaatcttgattgttgacttaagcttaattgtaacatttttggttcatgtttatactcacaatgcatgcttgttaactcgttgatgaatttatatcttttgttttgcaacacacgtccttgaattgctcttgttatatctcaaagctctttgaactataagtggtgacttgcaaaacttgataatatcattgtcaaagggggagaagagatacaaaacatgcatgttttcagctgggggaattttctttcttttcaaaagggggagaagttctatgttgattttttagcactccaatgattttttaccacttatttgtttttattttttcaaataacaaaacaacaaaattttgatcggtttatcaatgtgttcatcaagggggagattatgaaatcaaagtgtgcttgattgttattttgtgatgaacaattgatatgagagacaattggttttaatatttggtggatgattagcgaggtggtgctgactgtgttagcttggtcatacccatcagtggtggccggacaaacccacgtggtatgtgcggtcaaatcggctagcccaatggtttgatcgaccgattttgtattggtgtcgatttcgggctgtttatttggatactcgtgattatctcatgtttaggacttctagaagatttctatatgtatataataaaattgtgtgctaatgttgagtcaagttgagaagaacttatgctcggatatggttgcctatttgattcatgtgtaggaatatcttgatgccatgggagagtattgtcgatgatggatcaggatttaacttgggagaagatgatgtccagatgatcgggatatcatggggatgcttaggctaaagaacaatggacgaggttgatggagattccatgcggcatacgatgggagattgtgtgcgtatggaaagtggagtcaaactccgaaggagtccaaatttgagaagattagagtttaagttggaaagagataagtttgtttcttatacgggaatgtttcctagtggattaggacttcttgcacaagttggattcgtggctttaggctatctacctcgagtgtaagtagagaggggggctaagccctcctggtatcgatttgtacgagttgagctgagagaaaaagttagggtttcgagtttagttgaaatttttgaaagaagtgttgtagttcgcactttgtaaacgctaatataatcagtaaaggttgaaatttttgaaagaagtgttgtagttcgcactttgtaaacgctaatataatcagtaaaggttaatctatttccacgagttatttaatttgtgtttgctcggtttcgagaatcacaccggcaagtatacggcaaccagaccgatggcttaccaatggtcagaccgatgggtatagggcagttagacctgcggcagcgacaggcgcaggcggttcgataggcggtcagactggccgatcaatactgctcagaccggctgcaagggcatggtcagaccagggctagccagttagaccgatctccaacgattggaaggtaacttttaattccgcaaaaacttttggtttttggtgttgctgccattcacctcttctctgatgtgtttagtttttattgtttgatccatgaaataattgtataccatatttatattttgagtgaagtttagtttggacctctctttcttgccaccgcgccttagaccgatcggccaaactgtagtggcagccttaagcaatgatgtagtcagcaacaacagccattttctctatgcacattaagcctgatggccttaatttttcactgatcagttttccctaccggcaaaagaatgacgttcagcgggttatatggctgagaatttgcttgtcgctcaacccgtcatgaaacactcccccatcatacattttccatttccgcatcatcctactcctgtcaggtctctttcaaggcttgttcggttaatcccaaatgagagatagaaaaattgagcagattaattaattccaagtacagaattattttccttcaaatcccattcaatccttttatgttggggattaagcgaataagacctcaacactattatttttcatgttggtttttgcaaattccctgccagtatttttgttgtcacgaaagataggaatcctagtagatgtcagaagcattagcactcggtaacttgaagcgctgactcctgaccaatctgtatatgttttttctgcattggctacatataaaggatatatgtcatatttatgacttgaggaaaatccaatggcccacaatgattatcaattatcatggcttctatttcgcacgattgatcatccatcctagcaatgattcataaatcaaattttgcatttcttcttttctattacaccgggggccgccgacctactatgtacagggatatgatcaggtacagttgtacccaaaaattttgcaaaaaaaaaccccaccatatattatagtatatgttatgtatatgtactaatagttgggtcaaatgggtaatatttgagtttaaaatggcattctagatggtatggaaatttctcgactgagccgttattgtttctgcaaaaataataatataataatatattgtgttgttaacttttatggtaatgcttgaaaatatcgcaactggttctatgcaaactaaattaaaaaatattgcagacaacaaaatacttaaatgattttcttggttacatgctttgaaatcgacattttctacatattcagaataaagatgtaatatcccgtttataaaaaaaaatcacatcaagtatacttttaattttatttttttagtatatattttgtagttctagaaatttattgcacactatactcactttactaaactatgtccatgttagtttttcttatcaaggcatttatcattaatttatatcaagtctatatatagtaccgtctttttttaagaaaaaatacaaagatttttttcttaacttcatacccacattttaaaaatctttcatccaccaccgtattacactagtgatctaaactagttgacatctctttatcacgttacacataagagtatcatctaggtattatgtaagaaatatatatagcttagaatcaataaacaaccaagacatcaacatgcacacaggatcaaaggccaaacataaataaaacatttgatttcatacaacaacaatgctgaccacttacatcaatattgatgcatgcatggagatgaaggtgagctaccatgcatgacatagacgtatggcacacatttttgctgctagctagcggccggggtcatatccagcttattacaaatatgtatagttatactcacatacatcactcatatctgtaggtataaaacaggggagtaggtatcataagcatgcatatataagtaacgtactccctctatcttaaaataaagggattttatccatgtaactgtatatttacatggataaaatacctgatatttgaattatttatatatatagtatatatatatggatgcatgcgatgacatacatgcacatagattatataagtatatataataaaaactcttccatatcttaattatccgcagcatccgggcctactcatttgccacctgagagcattgtgcctggcctccaggttgtggtagctggtttgcaggttgtggtggcaggcttgcaggtttctgtagctgctgtgcagcttgttgtattcgctttccaggttgtagtactccctgcgcttctgctcctcgtagctctcgtggttctgaagcttcatcctaagcgtccggatttgctcttctaatcctgcgatttcacggtcctgcagcctgatgttgcctttctctagcacctctgttgcttgtcctctctgccacattaattgaacatggatggatcggatggatgcaaattaaattaattgtgtgcaatcagaaaaattcatcaattaattctacctattatttttctgggtatagtatatgactgtaaacgtactgtaagtaaatatgagctagagatgaggaggacaagatcaggaagaagaaaggaagtaattataataaccatgttgttgtgagatcgatcggtagcaagttgatcagttgcactcacttggttccttcagaatactctccttctaccttagctttctagttcatttgttatggcctatcagagaccctgaacatcgcttaaatagacatcgcatgaagagtggcaggactaactaattaagtaatatatgcattatgttctccattgtaattaatttactgatgtgtggatggattcgtctcaacatgtagttttctaagatgctcatgttcaaaattaaacaacaaattttgtatgatcgatgcatgcatccacctcaaataccgttagtgaggagttgcgttgcgtgtacatgagcatatgcatgcgtctgtattgagtatcgaaaattggttttgccaaatcccatgcaattatgctgcatttgatttatacattaatttaaggaattatataaacagttttttaaaaaaaaaacacacaaagcacagacgcaggcactcacaacccatacacactttcccctataaacgttccctatgaacacctaaaaaaattaggtcggcatatcttaagatcgacaaatttctttttttctactcactacctaagctcaggttatgcataccttttaagggcataatgtttaccaagtttgtgcccgtttgaactagatgaagaagctgatgacagttgatgaatgcatgatgtattgctttacaaggatgaattaaacactatataatatagggatagtctagatctcatgcatgcatacgactaaaatttaggcacttctagctcgtatcccccatataaactacttaagcctttctttattagataaagattgaacaaagaattattctaacttaaacacaaaataaatttacaattggtaaaaaatacaaaatacaataacaagactacacttaaaataaactaaaattgcatatacatagcagaatgattttagactaattagcagtatgtaattttaggtaattaaaaaatttcaaatttacttcttacgtttcaaaatataaggcttgttttgttttgttaagaaaggctttgaccaataattagcttattagatatactttttatgacataaaattatttttattcatattgaaaagtactacttatatatgatgattatgtttttgtattgcacagtaatgtcataatagataaattgttggttaaagttttatctatatcgatactaaaatacaccttatattttaaaatggatgtggagtgtaacctctaaatgaacagagttttggataaatcatagttttggaagtatattcactaataatcatatactaagatagccatgcatgcaggagtgctgatatcaccttgatgacggcccgaaattattccattaccccattagatctagatacaagagaatatatgcgccctggtttcattattaataaaccaaaacaattattaatcctacatggttgaatagcaaatgtagaattgtaattgggactccctagctactatacgacaacttagtattatcaattatagattttagaattaaataattaaatagatttaaaaaaaagaaagaattaaaaagtacggttgtggattctatatataattttgacattaattattttttattttgataaaaaagtatgtaatataaatgtgccatgcgaagacagggattactgtgattatagtatcatagtatggttaattactcaagttgaaagaacatttacctaaaccattatgaagcagtacctatgggtcctaaaaaaggttttttcaactattgcttttacttgtgggcatataggcatatatgcaaagcgctatgttggctttacatgtaaacctgattattaagacctaatttaggagcttcaaaaggtttgttaagttaaactaagtatagattcagacaacagatttaggtcacattgatttagacaactttggaaactaactatataaatgatactttcattggttttcttatatagtaacttttaacttcataagggcacattgatcttttaagggcaaatatgatagtcaattaattgacgttgaccaataatagtgacaaaagagagctgagaactaactgaatagtggcaaaagaaagagttccaaattcttgatggtctttttgttggatatttgcttgcaaattctatatgttttttttctgagaaatataaaatttcaagttaagaattatacatttagagatctattgaaacgtatgggtattttgctagtaaataccttttggtttcaatgggctacactcgcatgccacacacatccataaagaacatcgatctggttaaagagatttgctaaacacgacagggatttgtgatatctgatgttgactgccattacatgcaggtgtgcgttgggccatttaatttggaagactcagaaaacagcatggtttttaaattatgtgatttatagtcctgtaaaaatcttgtttatatgtacgttacgtgttgcttaatattggatttctttggtattaatttgtcattcatctacagaaattggagaggcggcgaagttaaaggcggctgctagaattagacgagtgttagtagtggagggatcaagtgaatcagattcatgccacgtactgtgcatccatccagagaaaattgctacaagattaatctgctatgcccctaaattttgtgtcatccgttacatgcaccagagacttttttcttattggtagttgattgttatttttctttaaataactacatattgcccccatcccatacttatatgctagtgataaaaacacaactgtcaactgaaaaaagattcattaatttgtagaaaaaaggacatatgaaatcagctttgatgaaattcatacaacattttcataaaaagtgccacacaatttagtgcctgtagaaagtgcatctactttcttataggcatgcataaggaaatatctctacgaaaataccgcaaggcatatagacatttcataaaatgtctatttgtttctagagacaattcaccaaaagacatttagggcctctttgaatcgcaagattaagaaaacgtaagaataggaaaaaggtaggattttagggcccctttgaattggaggaaaaacataggctttttggaggattttaatcctatagaaaaatttcctatgatgccctttgaaacacaggattgaatcatatccaatcctttgaaattcctatggaatggacaaccctatagagattttggaggaatattagcaagagctttaccctcttggtaacttttatttgagtctatcttctctcatccaattcctgggtttttcctgtggttcaatcagacggtgtaaggattcaccaaaagacatttagggcccctttgaatcgtagggttgaaaaaatagagggatagaaaaaacacaggattctgacaggtattgaagtgtaaaacagaggattgcaaaacacaggaatgatcgtttgattggaccgtaggaaaaacataggaattggatgagagagagatagactcaaagaaaattttccaagaggttggacctcttgntgagtttcctccaaaatccacatgcaatgtgtcattccataggaatttcataggatttagaaagtttcaatcctttaaatcaaagggccaaatagaaaattttcctataggatttgaatcctatgaaattcctacataaatattttgattcaaaggggccctaaaaatacaggagtccaaaggatgagaaatgtcacttaagttttcaaatatttaagatgatagcacttttctattgaattttctaacatccggtgtgcagaccatacaaaggctaacctgtttaagagagaaccgcacaagttgctgagatcacctagatggcgcatcgaaattattccgttatagcttggacctggaaaatgccccttgatttccttactagaagtcaattaaaacagtgcaaaaacccacttgtgttaccgtaaagtttatttagtcaagttgaaaagtcttctctagaccactaaaaatctctatatgtgcatgggttctaattacaaacgattgttctaaattcttttttacatgcgagcatatataccaaaggtggtatatatattttggcaagacatctaaaccaaattataaattaagacgaggtgatgtgcaggaatgcacagcacagcgcatagtagtctgcgcatgatcctaaatgtaacattcctattttacttaatttacttataatttaaaatcggagattgattagaattgatgaatcttatacatagttttcagaaagaaaatgaatttatgttacacaatatttactcttttatacaatagatttttttcgtatatacttatcattcttatatagaaatttatttggagcgatgccaattaattatatcatgtttttcttcaactttctcatgtcttcaaaatctacatgccaaaaatatcccaaatttccatttggctcctcgccacaaaattttctacccatatctcttttagtaaaaagttctgctccaaaaagctcctaggatacaccatgtcattgaatgaatattggctgtccgattgagaagacaacaaaaatagagagattcaatattcatcggctgtttccaggttattggtcttcctttctctcacacagtctctgtgcaggtttccttgatctgtcttcctatctcacacactctctgtgtgtcgatcgccttctatttttttctctccctgtcaagagcaaatgaacagagaaaggagaaaagacaaaccaagagagtgggaaaatgtggcaaaaataccatctcgctgctctcaatgcacatgtgaaccatacaaagctaacccagattaagagataagctaccgaaggtcgctgacatcacctggatgatgcaacaaaaattactttgttactactgatctgagaaagtgccccttgattttcttcctgagtgacaattaacacaattacctagttgaatggaaaatgcaaagacccacttgtgttaccatatgattataatagtcaagttggaaaatatccttttctaaaccactaaaaatacatgggtgaagggttgttctaaatatttctttttagatatgggcatatatgccataaaggcgatatatacaaaattatattaagaccctgcttaccaggttacatagcttctccgggaattaccttctccatgaagagagtgaaaattacaggtccaacaaaaagcatctgataaaggagaaatgtgatgggcagacgtgcgtctgcgcttatcatcctaaataaatgtaacattcctattttactcaagttataatttcaaattttggatttattagaattgatgaatcttaatacataattttcagaagcaaactaaaggggattaatttgaataaaaacttttataggggattgaaaagttaaactgatttttttttcatgaaactagagtataatatgtagtttttctgatatacccctaatccaggccatctcgctatttaaatttctggaagaaactatataaaattcacaagtatccataaaacataactaaaagatatatgcataaatatatatttgtccatagaatgtcgtcgtacctgcagctcaagaggtcgtgaggatggcagactaactacagccatacccttattgacctcttttatatacagggtgtgtgtttagttcacgataaaattgaaagtttggttaaaattggaacgatgtgacggaaaagttggaagtttacgtgtgtaggaaaatttcgatgtgatgaaaaaattaaaagtttgaagaaatagtttggaactaaactcggccacaatcaagccctgaagtaatttctcatttggctcctcaccacagaatttccaggtaatatacaagtgaaggacaaaattaatattcctatacatggattagcagagctgagatgctgggcatctgtataggcaatttggaatgcaagataattttggaccctttttatcttgcatataaattaagctttttgattcttcaaggcagagtagttctccataatccctcaaattatatatcaattactaaaataatgacttggcttggatgatagagggggtagatgaagccatgaagatcatgctggacagctactacagcagtgcaggctgcccgtatctatgtatgtatgtatgcagtgacagataacatatatatgtttttttttaataatggaatataacattccggcacagaagctacagcccatcattacaatctagcaatcaaaacaagtgtagtccaaaaataatagcaaccagcgtataaagataaaagtaaccagcgtataacaacaagtatatatatatgtactgaccacactttgcatttcaatattacatccagctgcaggaacaggagaggttgcatgacatcgatcgatcacatatcaatgttgcatgctctagatatatagctgccagtatacatgcagctttattcttcacacacatatacatacagtacactcgcaactctcataggcatgcatatacatcacacacaaccctgcatatactgtatagatacttatacatatattcaggtacgtacgtagggcattcgatggttgtgcagatcgatcatatcgatcgatcaattgtggcggtgatagtagggttgtccgacggtgaaaacagggaatctgacagtggggccgcaattcctgtgggctgcatccaggtctctgtatttcctctccagctctgcgaattctttctgaagattcgcgtgctgcttctgcttctcttccttgtacctggtcaggttctgaacctgcctctccagcgcctcgatcgtgtcgtttaactcttttattgtgtcgtttaatttactgattctgccgtttaagcccttgacttgatccttgtgcgcatcggcgttctctctctctagtacctttgttggcggatcgcccgtatatccccttcttgttgcccggtgctgcatgcatatatagatcatcataataatcatatgcatgtttgataagaatattaactccattacaaaatatgggaatctaaaatcgggtgagaccatatccagatatacgatgaatctaatgctatatttgagatggaaggagtatataagcactccatccgtcccaataaagcactttgcatatcttgtataaggattaagcgagaaagaactcgtagcctagtggttgaaatgctcgagtagtactgggtatgactatctatgtaagcgaatttcaggttaaaaaagatcacttgtagactcctcgtaaaaacgtgtattaagaatgggcccatcatctgaaagacagaggtcttaaaacatgggttaatgacagatcataaggactaatccgcatgtatgggccaaagttcgtggccatttttagccagtttggttgaagctttttcttattctttccttcatcggtcgagttatttcattacaaggattgggaatagacgtaacattaaaaagaaaattaattagtaatgattggtactttggtagggacaagcagctggtggagaaactaaacaaatgatgagatatataagaaaatagctaggtagacaagtaatataagaaaaaaaaataaatttaaacgtttaaagtaactatattttgggacgaagatcatagtagtatatgcgtatagcaagagaagatcagtaccattgtgaaaccagctagctagcaaattcgatcagttgcaaacttgatccttgagttattctaaccttggtcgcttgctaccgtctggagaccccggggcaatgcttaaatagacagtgccaacttgcagggctaattaattaatatacttcctctgaatatttaatgtttaggatcagatttagtgaaacttgtaaaactttaaccatcaatagcttcttactcacattactacaaaacatcaaattggtctcgacactataggtgccagaagtgctaaatctgacacatataggccttttcgcacatgtgggttgaaattgcaaaaaaaacgacatctttaaacaattataggtgccggttctaaataaaaaccaacacttattctataggtgctggtttttattaaaaaaccgaaacctttaatatgtcaaaaaacggcacctttaatccactagaatggataccctcatctcaatcgggcggtaagccccatctcaatcgggcatggcgtccatcacaggctagaagtcactgatgtgatgagctatctcaatcgggcaaacggtcgtcacagatgattctatctcaatcgggccctaagtaaagcccgtcaccgatagctttgacccagacgaccaatcaaactatagcccctcacagatgacctatctcaatcgggccacaactataacccgtcacagatgagtcatctgtgacgggcattaacttatgctagagttaatgcctgtcacatatgagtatattccaaaaataaataaattttattttttggctagccctcactcgtgtgcacccacgcggaagttcaaacttcccggtcggtcacccatcccaaaattactccagaccaagcacacttaatgtcaaagttctttagagattggcttccggaagatacgagtattctattaatcctattatgccctaggccaggatgttaaattggggttattaaatgatttcaaatggaaaagtcaccaaaaccaaagttgtagaactcatcgaggtgcaaaatttttattttggtcatttctccatctgactctatttaaacaatttgaaatttgaaattcaaagtttgaaaagttcaaaaagaattttagatcagtgaacgacttcaactgaaaaagtcatcaacaacaaagttgtataactcatcaaaatctataacttttatttgggtcatttttctatataacattttttgaaccgtttgaatttgaatttgaaaatatgacaacttcaaacaacattttcaaatactgaatgatatcaactgaaaaagtcatcaacaccaaa

SEQ ID NO: 36887 - DNA, 3140 bp, Oryza sativa
cacaacttgaggcccgtttgagatatggaatgttatctcaaacgggcctaaagttgtggcccgtcactgataggtgtcatccgtgacgggcttaagttttatacccatctaacatgtctgtgcgaccatatctcaatcgggcacttttcggcccgattgagatgacttccttatgacggcccgctatttctaagcatattagagcccgttacagatagaaggatctgtactagtgatcattggtgggccccacaaaaaccgagccgagccgagtccgcacaagaccgcaagtcgtcgttcttatccatccactcggctacatctctctctccttgtctctttcttctcctcttctcctccactcggctccatcttctcctcttctctttcttctctctctccttatcccgggcggcgccatggtgggaggggacgtgcggcgacactcggtggcgtgaggtggcgctacggtgggagggaggtggcccgctcccctcggcggcaggaggcggcgtgcagcggcgggaggaaggcaacctgcgcagccgagtccctcggcagcgggaggcagtcggacagaggtggcccgcgccaaatctgaaggtgcggctcggcgaagacagccggtgtggaggtggggccgtcggcaggaggtgcgacggcgtcggtggcctaaccagagtgctttcatcaagggccgctcccttcatgacaacttccgctatgtccagcttgcggcaagggcgctccacgccaaatgcgttccccgacttcttctcaaggtggatatcgcgaaggcctttgacatggtcagctggcctttcttgcttgaggtgctagcccagcttggcttcagtcaacgttggcgtgattgggtctccctcattctcagtgcctcctcttcccgggtgctggtcaatggggtgccaggtatcggagaggtcttcgccaaggagatcctctttcccccatgcttttcattctagtcatggatgtgctcaatgcgatgctccgcaaagcctctgactcgagtagttttcttcccctcaatgattgtgctattcgacatcgtgcatccctctacgccgatgatctagttctcttcctttcccccgttcggtaggaccttgagttcatccaaggcatcctctctatcttcagtgccgcttccgggcttcagaccaacttcaccaaatgcttgattactccgatccactgctcggttcttgacctagagctggttcagtcctcttttccttgctcgatctctgagtttccctgcacctacctcggcattccactatcagttcgcaagctgccaaaagcggccctgcaaccacttgtggataaagcctcccatcggctccccccccctcgaagggtcgtctcaccactctggcgggtcgctcggttctggtccaatcggttgtctcttctattctggtacatctttctatggcgatcggcttgccaggctgggttatcaaagccattgacaagaagcgtcaccccttcttgtggacaggtacggactcggccaatgggggacaatgccgagtgtcctggacgaaggtttgccatcctaggtatctcagtggtatgggcattccggacctcaggatagctggctttgccttgagagttcgctggctctggcttcagcgctcaggacaccccaactggtctgatctgaaggcctctgttgagcggagcgtctccgacatgttcgcagcatctaccttcactaccttgggagatggtcagtccacgctcttctggactgacgatggattgatggtcggtcgctagcttctatagctcctgacctcctccatgtcgtgcctccacgtttccggggatcgcgcacggttgctactgggttagcgaacaactcctgggttggtgatatacgcggtgccctcactgtcccggtcatctctcagttcctgttagtttgggacgcggtgcttcctacccagctctcgccgggtgttgaggatcgcctcgtctggtgttggacgggtgaccagtgctactcagtgcgattggcgtaccaggcgttcttccttggctagcactcttttgcctgtgccgacctgctctagcacgcgaagggccctgctaaatgcaagttcttcctatggtttgcatttcagcagcgctgctggactaccgatcttctccagaagcgtggtatcgatagccactctgcttaccccttttgcgcttaggagcttgagagggtgaaccacatcctcattaattgcatgttcgctcggtaggtctggctccgtgtgatgtcccctcctggctgggttgccctctctccccctcgtggcagctggctccaggattggtggtcatcctccagggcccatttacctgagcacctccgtatcggctttgactacttggtactcctaatctcttggcagctgtggaaggaatgaaactccagggtttttgactctgcgctcgcttcggtcccagtgattttggagtccatccgctcggagggccagctgtggtctttagctggcattgctgtttttggggatttcttgggagtgtagtgtggctctgccccctcctgttgtttggagtttcgttttaaccatcgtagtagttcctagcttcaggttttttattaagccaatctggctgattccgttgtgtaacaaaaactcttttcctgctaatattgacgtgcaatccttttacgcgttcgcgaaaaaaatcgatacatattaaaattgaaagtcacttaatatttaataatttataattacataattattgattcagtaaaaaatttaattgagattcaaaagaagattaaaactttgcatttatatcaatattggattgagaaaaattttatgaggaaaaataaaattaatagtacgcaccaagtgcgaagatgcatttcctaattaaaggtccatgttagtcatacgatgttaattattaagtttaattgcaagaattaataaattatgaaatcatcgagactccaagattacttgctagtttcaaattttatactctagcttcgattttttctaggcaaacgtttttttaggtttaaccaagtttattgcaacatttagcaatttctacgacactaagggctgcaggaa

SEQ ID NO: 36888 - DNA, 17360 bp, Oryza sativa
aatattgctatatttttctataaacttgaccaaacttaaaaaagtttaactagaaaatagtcaatgcgacttataatataaaatggagggagtacttagtaaatccagaaaaactataagtgcgatttcaaaccatgttgctttttttttatttattctaaattttagtattatataataagaaaacatataaagttcaactccacaatatgtacaactttgtaaatacaaattttgaattagtaaatttactaaatagaagcaacaacaaaattatttgaatggttttgtgtatgttgtttcattaataatttaaatttagagctgtttcagatatatgcaaatcacgtaatatgagattacccgtggttatccataggttaactagtccccgtataaaaacagttactcaagttagaagaatatttacctaaaccactaacagcatgtacctattggatgctttgaaaaggtcgttttaaattttatttacttgtgggcatatattcaaaggcgctaatggtgattacacgtataaatcaaattattaggaccctgtgtaatcttcctcggggagctggcttctccgaaaaaagagtgaacatttagaggtccaacaaatagaacctaattcagcaactaaacaagagaaaaactggaatgttacatttgagattgttctgaattattaaattgggttttaagttttcaattgttgaatagtttcatattagttatgaaagggtaaaagacctagtatagcttgtcacctcattggtgaactttaggggttgagaaaggtcatttaggatcatacatcgaatttgtgggatttttcatgaattatcctacagttgactgggattttcttgattttgtattggctcagaaaatttcatgaagttagacgaagtacaagttccaggaactgattcaggggacttttaaaattttcaggcttatgttatagtagtatattgctgcacgtattgacacaatgatacattagaaaaggatttcttctgcagctacctccttggttgagccgttgaggcacttatcatgaccttcaagtccatggtctatttccaaggttgtcagtatcccgatacgtataccagtatactagacactacgatccaccaaatcaaaatgatattatctcatctattatcctaattttcatagtatctcaatcttactaattgttttcgcacgttcctacgaaatcttaggtagtatcctaattctactatccctacgatcctacaaaatattatttaaaaataggtggattgaaaataatatgaataaatatgctcaagtttacattaaaaaccaattaaatttatcaaaatcaatattatatgctttaatttatacaacatattatatattttatataaaaatatgtattttctaaaatctaatagtatctcgatactgattatcttgtatatttttggccattgcccatatgtcttttggtattaaaaaaatgtctaagaaaaccgtaatctaatttttttgaattgaaagggtagttacttacttgacattgttttcctcttttcttccacctatatattgtcgattgctctctattgaattgaattatcaaattgaaaacgagtagcacttagtataacgtaagagggttaattaactagtgaaaataaacagcagcaggtcatgataaatttatttttcattagtcgtgagctcgattggggttgggtgggggggggtgaccgtccacacgatttttcattaagaataagtcatgacatcttttttgcccagaatcaagactggtgctaacttgaaactctgagtccaagtttatgtttcaggtaacctcaaactcataatccaagtttcatgggtaaggttaacttggaaattagtttatggctgtgtttatatccaaagtttggatccaaacttcagtcattttccatcgcatcaacctgtcatacacacccaacttttcagtcacatcatctccaatataaaccaaaatccaaactttgcgctgactaaacccagcctatgaccattgcccaatatgagggtaactgacgaaaatgaacagcagcaggccagtcatggtaacttttttcactagggtatacagtatggttcaactgagttttcataattgtcagagtctcaaaaataattgctctgttgaatcctggagtaggtcttaatatttactggtacatgttacaccaaccagtggtcaatagggatggaggcttgagtctggggcaaaagagttgtcatgaaaggccctcataatcagttatgacttttcgaatttgctgtcaaaatttagttatgtgttgaaaatttcagctgttaattctttcaattattgtccgcccgcactccgcgcaggatcatgctttggacttgggatgtacagtatgtatgtttcaggtaacctgaaactctgaatccaagtttcaaaattgaaatgtctagccattttttgaatcattcaattgagctatctgtagacttggaccactgaagtaacaggatttcacttcagaggttccgaactgactgctgaagaacaaaaccctggaactgcatttcctacagatgtgaaactaattctacatgtattggataaccattcttgattaatctgaagtggaacaataatcctgagcatctgcatagccagattaggaatgtaaggtaatcttggatctttattcaacaggcatacactgaacactaacaaaacaaagccatcaagctttttgcttctgcaggttctagttcttcctaattcctcagctccatctacttctactctccaaaaacaaaacaaaaagaaacgaattcaaacagcctatccttctcctcctcttccccccattcatttacacagctcaccacctaccatcacaaattcacaacaaactcgcatcaaattctccaccacaaacacatgtaagatcatcaaacaagcccaagaaggcacaaacatttttcttatgttttctgttcagagttatatggtggtttcaatcgaatggcgacttggccttggatgatgagttgtagatcatggcggatgagccggagaagctgctgctgctcggcggcgtgctcgacgacgtcgacgtggcggcggcggcggcgcgaggcggcgaggcggcggcggcgccggacttgaggaggaggtcgacgttggcgtagtcgtcgcggtcgaggcggatctcgttgagcatggcggcgacgtccttcatggcggggcggtcgtcgggggaaggggcgacgcagaggagggcgacgcccatgacctgcagcatctcgtcgacctcggcgtcggagcggccgcgcagcgccgggtcgagcacgtcggcggcgcccttccggcggcggacccagtcgacgacgtgctggccgtcggggatggtggggtcgatgggctgcttcccggtgagcacctccagcaccaccaccccgtagctgtacacgtcgcttttctccgttatcttcatcatgtacccgtactctgcaatgtttgttaatcagaaggtgaaagattgaagtaacttttgtgacatagtattgaaagccactgaactatatgattctgttcaacatttgtgcttaagatgggtggtttgtcctttttggttgcgtgaattttaagcggagtgggctcaattggttgtaccatcttgatgtaattgaataagtttcgataaagcttccattatcttaaagaaaaaacttacctggggcgatgtagccatatgatccggcgacggtgttggacgagcggccaaagtcgccgtcgtcgacgagcttggcgaggccgaagtcggcgatgtaggcctcgaagtcgagcccgatgaggatgttgttggccttgatgtcgcggtgcacgatcggcggcacgcagtcgtggtgcaggtacgcgagcccctgcgccgcaccgagcacgatcctgtacctcacatcccactccagctgcgcgccgccgccgccatggccgccatggcggcgctcgtggagcacagcacccaggctaccgttcgccatgtagtcgtacatgagcagccgtgtcgtcttgttccagcagcagccgaggaacctcacgatgttcttgtgccggatgcaccccagcgtcctcacctccgccgagaacgagtcgcggacgcgcccgccgccggcgacgtcgtccttgtcggcgccgttgcgggtgcttggccagagcttcttgacggcgatgacctcgccggtgtcgaggccgacgcggtacaccacgccggagcagcccttgccgatgatgttggcgtcgacgaggttgcgcaccacctgctcgacgctgaagctcagcttctggaacggcgtgaactgccacggccacgccaggtcgccgccggactccgagtcgctgctcccgccgccgtgcccgcccttcccgccgacgatgcccatcccgcgcgcccgtaggatcccgaccatgcccagcaccatcgccaccgtcgccgtcaccagcagcgcgatggcgagcttgagccggtgcatccgctgcacctcctcctcgtcggcgctcatcaccggcctcccgctggcgtcgatgctgacgaagcacacgtcgccgcccttggtgcagagcccggagttgccggcgaggcacgacgtcgacagctgccggaacagcttcgtgtccgggaggtagccggtgaagttgttgttggacacgttgagcgtgacgaggttgtcgaggccggcgagcggcgcgaggccgccgtcgagcgcgttgtacgacaggtcgagcaccgagagcttgctcagcgccgagatcctcgccgggatcggcccggtgagcccgttccggctgaggttgagcgcgatgtcgaggccatcaatggcgcagagttcgtcggggatgcggccggagagggcgttgtcgctgaggtcgaggagctcgaggttgcggcactttcccagcgccgccgggatggcgccggagagcgagttgccgctgaggacgaggcggctgagcgcctccagcctcccgaacgcgtcggggacgccgccggtgagctggttgtgtgacacgtcgatctcctgcaggccgcggacgccggcgagcgactccggcagcgcgccggtgagcgtgttgttgctgaggtcgagcatctggagctgcgagcagttgccgagctcggcggggacgccgccggcgaggcggttgctgccgaggtcgaggaagttgatgctcctcatcccggccaccgccgccgggatcgtcccggcgagccggtttcctcctagccgcagccgcacgaggctcgccgccttgccgatctccggcgggatgacgccggagaggtcgttggagaggaggagcagcttggtgaggttgcggagcaagaagatcccggggggaatggcgccggtgaggtggttgtgcgagaggtcgagcgcctggaggttggcgaggccggcgagcgacgccgggatggagccctcgagctggttctgccacgcgaacaccacctgcagcgcggcgaggcggccgagctccggcgggatgaggccggagatggcgttggtgtcgagctggagctggacgagcgacgtcgcgttcgccagcgccggcgggatggtccccgtgaggttgttgtcgctgagcatgaggtcctgcagcgccgggaggcggccgagcgacgccgggatggcgccggagatggcgttgatggagaggtcgagggagacgagggaggtgaggttgccgaaggtgtccgggatgggccccgtcagcgagttctgccatagcagcagcttctgcagccgcggcagcgcgcccagcgacggcgggagcgggccggagagcgagttctcgtagaggtagacgttggtgaggttgccgcagccggcgagctccgccgggatggagccggacagcatcgtcgtgtagatggacagcgtctgcaagctctggagccgccccagcgacgccgggagcgcgccggagatcttggtgtcggcgaggccgagcacgacgaggttggagagcctcgagaacgactccgggatctcgccgccgaggtcacggttgccgccggcgcgcagcgactcgagcagccgcagctcgccgagcgacgccgggagctcgccggagaggcggttgtcgaagagcaggaggtccctgagcgacgcggcgaggttgccgagcgacgccgggattgggcccgagagctggttggagttgagcgccagcgacgccatggccgtcgcgttcccgagcgaggccgggatggggccggagagcgagttgccgctgaggtcgagcacggcgaggcggcggcacaggtggaggtcgtcggggacgccgccggtgaggttggcgtcggagacgacgagcgacgcgagcgacgggagcgcggcgcagatgccgggggggagcggcgcggcgaggtgcaccgactggaacgtgacggaggtgacgctccccgtggcggcatcgcagccgacgtgcgaccacttgcacggcgacgacgccgacggcgaccagtccggcggccgcgccgccgtggtgttgagccattgcgtcaggaaggcgacctccgatgaagccgaggcggcggtggaggaggagaaggagaggaggtggagtaagaggagaaggaagtgcatggggcttggcaacaatggtggcaatggcagctgcatcaaaaatcgtgctgtgcttgcttggggcagtgcacaatacactatgctaaccaagcttgcttggttcaagagaggtgatgatctctatgaacttcactctcactcttcactcactcaccatggttcaagagtgaaaacaaacaccttgtttctctctctctctctctctctctctctctctagctactctctctctcttttcctcctcaaaacactcaacaggttgagctgtttgcttgtgtcttggtgcttggttgcttgctccagatggatagtggtggtggtggtgtcatggtgaaatgtgggtgcttgcttcaatgcattgggcttctccccaacacaatttaacaaagttttgcttcttctctctctattcaattggtgatgtgtgtgtagagagagagagagacaagggggtgcattggggggagggaagaagggagaagaaaattgggtgtggcactgacaatgggagcttagctactctagtctctagtgtgcagctgccctttggctatgatcaagtatttctattgtcaaattgcaaacaatttgcaatgctacactcatgtggagcatgtacaccatgcttttggtctcaatcgcaccaatcttgatgtgtatcttggctttgtaaatctatggttgagattaaaatcttgacttagttgtcaactacttaacttaatttgtgcggctgcgtcttctcccataatcagaagctctcacaaacagtacatcttttggtccagattttgagaagctgtagttctagaatccagaaaatgaactaaagccagaaactggaaaacccagcttttccagatcctcagaagctggctatcaaccaactacttctcagaattttaagttccaccaaacaggccgtaagacatgtttgattggcaactacaggttgctacctttttatcaatagaaattatcaaacttacctaaggttatgtgcttaaaatcttggtcatatcgtagatagaattttgcctctctttttagttattattaccacgtgcgatctaatttgttgaaaaggaattttaccacaattacgaatgcaaccaaacagttagtatctgtatttatcaaacttgtctaactctagatatggtaaattgtgctaagctgtggctggcaactaaacatgtcctaattgtgtgctctaataaatgttatttgtggctttctgtggtactggtgttggttgatgggggtgatcttcatggctttagaaagcaagcggcttgtggggaagccagtcggtgttgtgtcccctgcacaagtcgattgaatgttgacaatttaattttgcttgcttcatcagtgagggcaaaagcagcattaaatcccatgaaatgcgcggcaaaaaggtagggtttgtttccgaaaattaacacccaaaataattataggcaatgttcgaccgtacaaaggctaatgtatactatttttttggccaaatagtcttgaagtcaagtcaagggagtatgtacataggttggtcaggattgtatgtattcagagggggacaaaacgttaaaatgcagtttgaaaagtaagactgcaggtttgaagtttgtatattcagactgctatgatcaaatgtctaattgaaaatgtgtaaagagatcacataattgacctaattaatctcctatcatctttagtttggtcgaaaaaaacatgaaaagacttactattttgttaaaaaaaacattaaggaatcctctcaaatggaggattggcacgagatttcaattcccaatggattctttttcatgtaggctcctttgattcaagggaaggatttgaaaatcttcataggattgcatttattatcaatttcataggaaaataagccacattaagacttttcttcagttcaatctttcttggaacaaaatgtttcaacaagcttcgcaagcaaaccaatggcttctttgacttgcacctgccgggattgcaggctagacaatagacctgattgatcaacttgtcggggtctggagtgccattcaggctctacacctggtagagcacgaggaggacaatataacatggaagcttactaaccacggcgaatacacgacatcaacggcatataacgcacaactccttggaaccaccgctaccaacttcaacaggctaaactggaaagcctgggcgctgcgtaagtgcaagacctttgcctggctaatcatccaaaatagagtctggacttctgacaggctagcgacaagagattgactaaacggttccatctgccccttacgtcgccggacccatggaacagccctgcacctcctcgcggaatgtagatacacaagaagagtctgggcggaactagcggagtgggcagcgtgcgagcgactacaatctagccaatggcggcaaacttcgatggtgctagattggtgggaggctaccgtaaatatacaagagacacctaagaaggcactccgcactttggtgttgttggtcgcctgggagatatggaacaaaaggaattgcataaccttccaacagaaggagatttcagctacctccctgttagccaagatcaagaaagaggctaaaacttgggccttagcaggagcgaaaagtcttaataattggctttcttttagttagctcggatggaaggtcctcagcttcttttttttcctttcgttttgtaaagttttccttctctgttcaatgaaagtggcactagtcaatttgttaaaaaaaaaggtttctctttccgtttcgtgtgttttcgattctatacgattgaaaaaacatgctactttatttttttcccaactgtttttcctattgagcatttcaaaaggggcctaagagcctggctattctgaataacgcatgcttgcttgattgtcgcaagtaaacatagtagaatcccattttgtagtactccaattaacagagtgttaactaggccggagcctctagctagttaattaattagctaaatggtaaatttccagcatagagatgtcaagatgctgtatgggttattccaacattggatcacgtgtatatcacgcgcacagcaggcagctgcagattaaaattacagtaagccaacaaaaattagtacaccattgtttaagattgatgcagggaaattagagtactaatagctttttacagtgccaattaaccgtgtgccaaccttgaggtttacattccggttaactactagagcactcactgaatggtgggcctcatcatttacattaatctctcataggacccacatgtcagcgagtaattaccagtggctttgcttgtttaattagtaaagaaaatcatatagattcgcgctagtgttgagttggatgatgaggagcgacccgcacacgacatggggcatctctccacagtgacagccttcattgcgtgcagccactagttattagttaattaattaattaacgtgataagtaaacagagttagtggtagaaattaagaagcatcactctaattaagctggtcagggctagctggttaaaatgaggcaagcatttttctattactttccacattcacaattcagtccctctaatttatctgcatctatatgtacttcacctgcactacataattggagctgctataattctagagaagaacaagaagatcaaatctatcttgtttcaatcgattccaattgttaaattgtcaattcaaatcatggtttcaattaatcctatgtgcattgtatgaacaaatcctcatatatacatctattagtagattacaagtagtatcatgtttggacttgcaaagaaatcttgagtaatccaggatgttctgctaaacacatacatgcatatttaacaatgtgatcaaactgtcataaagtaaaagaaaaattaatgtttaaaatcagaatgaaggtggtgtaagtgtgacttctgagaggtgtttaatactttaacaactttaccacgttggctgatgatatcttattcctaaccgagtactactactctctagcctctactcttaattaaccgagtacttgaattaacagtgttcatacaagctagagtctaaccccagctctcgttgtctaatctacacaaattaaatattaattagcagctagctagtctcggcttagggcaagtactataatagatgtaattgttacctccaaatttatttatggcattcaccaataaattaagatgcaagatatacaataggtcacccctaatacacaaatatcaatgcctttagtactctcacatctttcttggagcttgtgtggaggctacctcttgatttaggggtggttcatcatctctctccttacttctctcctccacctcatcacccaatcctatgtgtcatttttaggggcagcacatgaaccattatagcacttgcccttagatggctcaatggtaagcttggtcttgggctttgagcttgtggctacctatttaaattggcaccatgttagggtgcagctaccagtcaattgtaacctagaaaggcatctcaaagtgtttttgattcatttgaatgttgggtttcttttgaggtatggtgtcaagcagaaggcattggtatgcatcaaaggattaggatgacttgtggtggggttaattctcctcctcactgtccccaaaatatagggcccatcactgttaagaataatagagatgaagtaaggaataacctagtttgatgttccatttctttttgtaaggataaatgtatctaatatgtttgatcgatgttccattaattgtagagtatgttgatcgaggtactagaatataaaggacatcatgtaaggttttacaaattaaatgagcatcctcaatcacgatggcaaggttgtcattcatcaaacaatttatatatctcaatataaacttttgtatgagagtgcatcaaagaagaaaagaaccatctttaagaatgtgtacgaaaagaaactactaatatggagtgaggacaaagagacttatctatctattaaattaatttaatttggtcagcagaactttgtgaaaggaaatattgcaatggtaagaaaatttgaaaataattagtggatagggaagtaagtaaataaaggatatgccggattcacaaaacataaatcatatagaatatcataaaagcatataaatttggatcgttgattctttagtactcttttggatgatgattcttattgcatccgttgtgcatcttacaacgaattatcaagtccatacgtgcatgtgaactctctatcttgttggcgcatgaattgtctatccccaatggtttttgcgaaccctggtcgtcacagttttaaattagttacacactcttaacggtttgtgtttccacaaacatatgtatagtaatgaaaacagcaaacaagacccagagttgtatggcgaaaatccagaaatggccaaaattggtggcaacaatgaccccaaaaaactaatttttcctctaaagtccaatcaatgactcctggtacaagtaataggaaacaagccagctggccaacttcatgtcaaactgtcaatataggtttaggccaaagttgagcgtggttgtttcaaaaaaaaaaaggaaaaatagtttagtgtggttggttgtattgtcacttgattggctatgggtcaaagctagttcctggttttggggagttaaagagcaagtccacattggaaagtttgggatggggacccatttgacggccagatgatctcctggatagcgacaagacaatgcatggtgtggtgtctcttcatatggttctgcactcgtgtgcatttaagacattatgattgggttgaaatagctgtgtaccttagagaaaacctttctgttttcttaactttttcagataactattaaatgtaaaaattgtctaaacttattttggaaataaatcttttgaccacatccctttgaatatgcaggcacctaaacctctctatattccatacagttctactccatccgtcctaaaataacttcactctttatcaactagtttgacccaaataacctcatcctttaagcaattatcgcattagaaatttgtgaaagtgagcaataaatgcattacgatttataaaagtgacagacaattgcatattgaagtttgttagagtaaagggcattctaggttttattttttttacctttgtattggtatgtgtaggatgtgtgttaaaattaaagttattttgggacaagtacactgttacaacactatgatgtgctgaaaggttcaaatctagacctaatatctatgtgaggatttatatttttcatatatatttttttaaaaaaaatgaaaattcaataaatatgtttatgttgacgaaaacatgcccaatcttataaaaattcaattatggtcatagtttcgtccaaaacttgtggctatggttcatgtttgcaaagctttgcatcgatgctgtggaagtgtggagagatgagcatgttcatggtttcaagtttcaacaggccataaggtcaaaatgtcaaatatagtacaacgatgtacatttaaaataatcactaacatgttttttaattatggttaaggtatcaaagctatatgcaaatataatcactcggtatatatgacgagcacaaaacttatcacccaactacttctataaaagtgcattttagtactaatgctaacactgtatatatgaaccatagccacaaacatgcaaatataagacactaaatgcaaaatattataaataatggttacaaagaccatcaaatgttgcaaatatacgaagttttctgcaacggacgcaatgtttcatcatttcctacgtcctcagcatttttattctaattaatgaagcacataagaagttccaaacttcaagaactgatctaaacttgcagcagaaagaatcatgatcggttgtgggtaacacaaggagggatgtgaagacatgctccatgtagaaattaaactgttaaaaccccaagaactggatcatgcagtgcatgtggatgcaggaaaaagtacaaaccgatcgagctgtaaaaattctcttaccggatgtcactaaattactagcttgctctgcagccctgcaggcacaaagctagcaggtttagtggtaaaaacaagaattctagatcccaatgcaatggctgtttgtttaggctcaagtcgtttctcagatttaatttacttaattaccacaagataggtgtaatagacatctgtattttttttactgcctgaattatttagtactacacactagtagtatttagtttacacagaacatggtgggtagagactaatatatgaagtatgatatgattcactcttagctgtagtttacttgggtaattacatgcatctatagaacaaaggcactactcctatgttttagaggtaaatggagatggaagaaagtaactagagatgcccatgaacttgtgctggtaaaaaaaagagtagtagaaaacttaaagaacgccctaaaaagcatctcagcatgcagtgaccatgctgtataatcaccagccacactgcacaccatccatcccggtcagctgctgctgcttttgaagcgagtttaaaggttaaaacactggcctctctccagacggattaactatacacgcatcccaaggttaattaggacgtcacatgctgttagattccatctcacaccgcttaacccacttaagtttatcttaccattccatctccatctctttttcaacgtgtattatgtactatacaaagctacaagcaagtagctaggctcgtagccacgtggaaccgccgccaaaagatccaaatttctttgtgcctattagcaaaacattagtatgcatgattatattaatttctgaattgggcataggtcttaattttgttttgtaggctgggtgatactgatgttcatgatagatgtaaaatctgtttagttttatccttttcaattaaaagttctaattcctgggatgtacaccaactagagctgtacacggacattacacgtaaaactaaaacctgtatttctagcatggcggtcaataattacagttaagggcaaagagtgcctaaaccagtggatgtatatattacatatatgctcctttgataaaggtaccatcaatctcattggtagaatggagtagaaatcacctagtattgtttagatggctgtctacactgtgatttcaattatctgagaatttaaatgatgtggtgactggatttcatataaacagtggtttccactgtaaagttacccctactatcttaccctggaagcgctggtattttacggatatttctagctgttatctaaagaactcgtgtaacaggataagaactttactggaagtactagaacaaaccatagagaaaactgccgttcgctgcagaagataaaaggctcggtaaatagcgtactagtacaagatagaccgcttagtgcaaagagaaattattcttcgtatatttacaaacaggaatttaggaaaccaggatacatactgccaagaaagccctacttgtaatcttgtatgcatctccatcactgatcaagtagccagctgttaagcaagtccagtgttagtcggatcagatgtcctagaaatacatatagtaaacatttcagtgcattttttttatgctagtactacgagcagaagtctagctacaatgagattccagtaaacctaggaaaccaagaaatttgatatagggatgactgaacagaagggtgaaactgcaaattgtcaacaaacctgaatatggcttcaaaagtccacctgagtctatgacccatccatttccacgaccacaggagcaaactgcattcagatgaaaagaatgttttcactctgagtgcagcaaagaaatgctatcactcgatcatgaatcgtgatccaaatttacctcatcatcttcatcaattagattcaccgtattgttgtcaagatcccatccaaatgtggtctccagaagtgattttagttttcgagtctgaatatatggaggtaaacattagaaacatcttttgatattattccaacattacacaataataaagctgaaataaattttctacagaaataatgaggctggctgctcaatggattgaatttgcagcatactttgtctgcaacgtactctagttatgaataaaataaaaaaacatttttctctgatattactctcctctgttcatataaacggcaaccacagaccaatcattcaagtgcacgaaaatataactccctcaaaataactggtcaaaggtccataatttgtggttttgtggatattaaaccaggaatttgaagtaaccaaaatactagtccagctagggtattttcagagaaagtatgaagttctaaactcagtctaaatgtggtaattcaagcatgggctacagaattgcttatgtggtatgtgtaaatgtgagagagaaggtataggaatgcccacccatgacagaaggtcaccatcaacaactgtagcttcaagtatcaccgcaaagaaatcctgacaatagcagaacaagctattcagcttctagctgtgcttctaagcaaactgtttcttactccataattcaaatatgcgataagaaatcatgcttggtcatgattaaatataatgattccaaaataaatcatgaagtcaaatgaactgaacaatatattcacacattttccagatatgcaaattcacctctaccttgatgagtttactattattataggtgtttaatagtcctcgagtttaaaaatgtacgaatgttagggtcctctgcattacgagtcccaaatggacgatcaaacttaagttagcaatgaataggcacactgcgctgctgcttactgtcttcacaacaataaaaaacagtaaacatgtaactaattgaatccaggatatgtctgctaactatacacagtgaagctaaaatcgttttacttcaggtccaagcagtgcattcattgcaattgctaaggacccatttaaatgcaattatggagtaatcaatataagggtgaaatacagtttcaaatgaaaagagcagtgatagaggagagatgaggttttactaactgttgggacatatctggtaggagctaactaaaatacgaaaaatgactcgatcagtagccagtgttggacagtggtgacttgttgtggttgtttcaagatgtacaatctgatctagagatcaatattaccattacttgatttttcgtatttgacacaattaaaaattatataatgttttttcttagtcatacaactagttttaggaaatatttaccttaaacagtaagcatatatcttgtaaccaagaagattttgtagggttatcaacaaaagatggtaataagtaccttagaaagacgatagagaaatatgtctcttgaaaaccatgcttcatctaagaacagagaattccccatttcctcaccacttctattatcctgtgtgtgctgaaagccatgcttgagttgatagtaaattgccctaataaactgaagcagcacaaaatgacaaggaaatggttgattagtcattatcatttcagaccatctttgccctgataaattcagtaaaacgtgcccatatatg

SEQ ID NO: 36889 - DNA, 1100 bp, Oryza sativa
  unsure (1)..(1100): unsure at all n locations
tttcttatgacttatgaggtatgatttaactcggacagtggtatgtgcattatanatttgtagtagtactatatagtgcaataaatcctcaagaaggtaattataaactgtcatgtcagtgcatccgttcgcttcattgttccacactcccagcctcaagacaccaagtaaattcagtttgttaacattgacggaaagcattcatgtcttgaagcatgtgctcagcttcatcaagatgtaccctaagatgacagttttaaccaacagaatctggttactacagataatgatgagttgttgaaacttttagacagcatattcatggaatttggttgaaccaatgcttacagaagcacggtagcttcttcatcaaaatgtgtcctgagcagtttaatcaacctattacatgtctcacttcaaaaaagaaatggaacctctagccatctgggtacaagcgaagctctatttttgcagaatgcagatgcaagcagccaccaaaaaaatgctcaatgacactattttgtgcactctgatttttctgttttgatagaaattagttagcatgtttaaataaagagtagcactattgagtaggcagtacaccatcgatgaagcaaaacatgtacattctatccatcaatttgtgaagatgcagtaaaagtgctgcttaatattaacagaaagttgagataaattagtacttacagcttcactacagctcaaaagaagactaactaatgctttccattgcataaaagcctccagtgactgccccatctaaataactcaaaaatgttaagagaattatgatttattgaatgtctttaaagaagttggtttttttcagtagtaccataaatgctatgaaagcaaactgcagctctcccaagagtaaatcctcttggccttggtaattcttggccaaaacactctccagcaagcatgtctgagaagtataatagcttcatcagcaaataataatacaatttttcgatttggtgcaatttacatgaggcatgtgtgaaaggaatcaatccaagcaatccaccattagtagaaattactatgcctaatgtagaaactagagcatgagagcatat

SEQ ID NO: 36890 - DNA, 13204 bp, Oryza sativa
aaatgaatccaaattatatggtccaagctgactgtcaaactcgaaatgtcttactgcttcagaatatctgatttcctaccaaaaagtaaacttcagtttcctaaacgaaaaaccaactgggcatatctgttatgtgtatttttgtcaagtcatagtgaattttgcagaagcacaagtctgtggaatatgtacaagttaggggtattagacaaatttaattttacctgattcatgtaatgtacactgtttctcactaacaacagtggcaatccatagaaaaacaagttcaaacttcaaacataggttgagtgcattttgtctagtcctttttttagggaattgtctagtctaatttccactgtcatttatggtgcaagtatgagagagctgcaattccaattttaagcaatgtatcttatacctcattataaactgatttagttattcacaagttgccatgtctgtcttcataatgtacaatcacaatacaattgatacttggcatactttacagtttaacagcgcatgaaggaaatatgaaaattacaggatttaaaagaacttgaagctactataccaacattcagcaaaatgcactcttttatcttctgaaatagtggcttttcaagacacttccatctcagttcagtgcaatgtagcctttataagaactagaaagggacaggtgcttctatgctccacatactttaatttgcaccggtttcaaagcaatattaacattgcacgcatcggaggatcacttggatcctagtactggaagtggatcaattggttgaaatataatgctttttgtttcaaatggtccattagcaacatataaaagcagatttcctggttttcagttagcagccaaacagaatgcctagcaattgaaggatcaagacattcatcaaaggaaacaaagcaatggaggaccaatcaatagtccgtatgtctacactgataaccattacaaaagttactagaaaaatataaagtgatataatagattaaagacaattctatcaatcagatatgtcacctcctcttctggtagttttattaatctctcctcctgtgcatgccacttccgaacaatcacctggaaatagcatacagaaaatggtactgtaaacatgcaagttactgccatcatcagaatccccccccccccaaaaaaaaaaaatcaaactttgacttccttcaaaattttaagtacagttgagaatattaatcgtcattcactgtgacaacaatcacaacattcattttcatctcttgcttcagtacatcttacaagtgagttcttctttgttggcttttcttctgttcattctatagaccaaattagattttttttcttttagccaggcatacatatctatatatatacaatacatgcaagtttatccattatttgaaaatgagtggttagatccacgcattcatgtaactacacttcagcaaatcatatcaacagtatcttatttgctaagatgaaaataaaaaagagaataacatacggtagtaatgcaactgtagtaaaaataaatacaatactactttatttagcaggacagggttctacattttgaattcaccgccctatctgattttccgtggctagcactgataaaagaaatattagctattcacagaataataaatgtagtggatatgttgatggttcatccttccaacccccattttcagtaaaactgacatgttcacatacaacagagtagcacaaaacaaaacccaggatgcagaattcagcattaaccctagaatggataatatctggtgccatattatctctgcgggcaatttaaacttgatttggggcatcatgaaagagtacctcagatgggtgagtagtaagaaagaatccgacagtaggtgcgaactcatttgcgtgcctgaaaggatcacagattgtggaagaataatcaatatgtggcttctcatgtaagttgttttggccataactgaaagacacagaccatgcaggcgaaatggaacagaatgcgtaaaacaggcacaagtggtttcatcatcttaacatggttttctgaatgccataactccagatcaagtaatcaaacgtgctgctactgatatatatcaagaccggtttacaaatgttaatcaagatcggtaccagtgatttcaagtcgtctagtcgggactagtcgtaagggcaccgactagtcgactaatcgcgattagtcgcaactagtcatagattagtcggtgactataggctagggatatgcaggataatgtacagatgtttataagtattaattaccatagtatactagtatagtatagtacaaactaaggataatcagattttcacagttgacagttcacacttgacataaggtcttaaagttaaatcatttacctgtcctagttgcaataagtccttcatcttttctcccctctctctcgtgactagatctagatggctggttagggttagatgaggggtacaggccttcttgggctgggcaaaaggcctgccactgaagtgtaaagtccaacacatatttttagccctaacagactagtcatccacgactaatttgatcgactctcatgactagtcgtgattagtcggacgataagttttctggtcaaactaatcgcttcaaagttcatgatcgaggtcagggtagcgataaggataactaatcatgattagtcgcgactaatcggacgacttgaaaacactgatcagtacacaaactgttgtgacccaaagaagcactaggtagttaattacgcttcgctaagattgtcttgtcaaaatggaaggtagaatcgagctatccgatccaattgatgatgctacactagtacactagcaaggttcttttaataatttttttaaaaaaaaatcaaccttacatgcatatcactcagcacttgctggctaaacaactctgcacaagttgactgacggtgtgataaatctaagaaatagagaaatgggatgacgcaatgcaacctgttgggggagcagtagtagaggaaatgcggccccggaggcaccatcttgatccccttgaacttgggcccgacggagaacacctgaaccgaatcgaatcaaaagcagcagcacgcaagaattagcctagcgaggagaaaaggtggggtttagggtttagggaaaccaacctgggtgtcgacgccgaggagggtgcgctggggcacgtcgaggaggaggagcgtggcgcccttccgcaccagctccgtcgccgcctccgggtccaccgccgccgccgcgccgccgccgctcgacatggtgccgcccagaagagaatgaaggacccagaaaagaaaaatcgaaacgaaacctggtcgggcgggtggatcttctgcggctggactcaactcgtgtactcaagcgccgattagttgccgtgtattggtccgttaacttgtgagagagcatctaatgcactcacctcccccttaaataagcaggcaggtttaaaaaagtcacacaatattgatcaatttgcttcttcaaataaaagagtacttcaaaatcatggtgttgttggaggagatggaggaggaagatggccttcagattcttcctcatcagtaggagggcatcggttggaacaaatgggagagagcaatccagaagagatgtgaaggattcataaatggcgatgcagagagaggagacacagcaacgagctcacgtagaagtgagggaggaagaggcaatggagacgaatcaagagctagaagcagagcttctcgccgggataggggaggtgaggttcaagctagagctcaagcggctgattcagggagatgctatctctctaagtatggctcttcctttgcaaattctcatctggcaactaatagaaatgtactccctggtggcgttagggtactagcagtgctatggaagaaaatgacaagctcttttatcaagaagtggatgatcgagctcaatcagaaggaagcaagtctcagtttctccacagagtcaagtcgcacctgactttaggtatggcttatttggctggggctcaagctgctaggaattatggttctcctgctacgatcgggggatgttgttctgtttctgggcatgatgtggctagcgttcctcgaggaaaacttttgcaaactcagcctcaagatcagcttcttgcacatggggattacttgggattggagaaaggtcggctcacttctcaagggcagttggcgccagcccacaaggtgccacaggcaccatgactttcttgagctggaactgccgaggtatgggaggacacctcggcaggaggaagatgcagtacctccgtagtttgatcagctccactctcgctcaggtaatatttatttctgaaacaaaaaatgattctttcacttcctctgatctcactgatgcttttcatgtagataatagctatatagttcctgttgtccatgcttctggtggtttgtggcttttgtggaataatgaagtggacctcactgcgatgagtagttgtgccaattatatagtagctgtaggtgtttcatatccctagtggcacgatgtttaatcttttgtatatatatggtgatcctactcatcttagttctagcagaatttggcaggaggttagtacttttgttaatcaaagtagccatcgtgccaccatctgtatgggacacttgaatgatattatgaaccttgggagaaatatggtaatgctccccctaattttaatcgcatctctatgttttataatcatttgagacatgttggtttgatggatatgggttaaatatattattaacaccagaataacggattgatgattttatcaatgagggtaataacgtcataatcatggaacggggttgtgatacttagcctgagacggtcaatatcggtgtgagaggaggaatgcttcacgcaagtagagacttcggtgacgtgattctcatatgagggtatcactgcgactaacaaataagagtaatatgagggtatcatttttacttggtgttaatttgtacattaatccttaaaacagctaactttctggcattgagggagtagttaagttggtattttgacttttgtggtttataagccaatagcttaaaacccacaaggtcaagagtagtttcctaactccacttcacataataagccaagaaaagcaactcaaatctagctttcagtccattaatgtagtagtaacctatagctttagaagggaaaaaaagcctttagagcaagttttatgtagaggtggatactacatctaattttagccgtgttatctactcttcactacacatacccttataataagggttaattggatccatgccactgcaaatatgtcaattcggaaaaatgccactactattcgcgatatcggctacgtgccactggaatttggcgaaattggaaccatgccattccatcgcattttccgttaaaaatccatgttagaatccaactgcgcatgggacccacctccctcccctctctttccccttcctctctctcacccgcatcaccagctgccgacatccatggcggagaagcacgccggccgctgatttcctcgacgacggcggcgagagaagcgcatctaccggtggggactatgaaggggagggcttgccggcatccaagttgcagcagtggtggtggcgtcgtcgtcgtcagcctgctactgctgctgctgccgccgttcagatccacagcagccacctgcggcgcgtcagatctaggcgtcaccgccgccgcaagccgctcgagctcacttgagatatccgagttgaagctcgagtagtcactgaaatcccgcaagagctcgagcatctccgtggtcgcggcattggcggatgacgacttggccaccgccgccgggcagccgacggccacggtgcaccggtaatacgcacgcgggcaagggtttcccttcgccatcttctacccatacttcctccattggcacccatcgctgatctgctcatcaccatatcgacatctcaacacaaacatccatgcgaagaagaagaagaacactagctgcatatggaacatgatcgagcacacacaccatgggtgcatcggagcgagctcgaacggagacacgggccttccgcatggagtgccccgtgcggcattgcggcacaggtgggtgcagaacgtggggtgcacggaggacgcgacggcgttcgtgaccctcgctgccgccatcggccggctactgctgctgctgctactgctgttgccggccacctgctgctggtattcgtcggccatgctcgccgaagagagatggggaaggaaggagagaggggatggaggaagaggatggagctgacatgtgggtcccaatcccacactgaagtgtgacggcgatggatgaaaaatgtgacggcggtggcatggatctaattttacaaagttgtaatggcacctagcagatttcgtgaatagtagtggaattatcctaatatgacaaaattacagtggcatggatccaattaacccataattttatattgttggttcactttcacactattacactttctctttacacttttcttggagattgcatagatattgcccgttgtatgagaggtggctcgtcctctctcccttctcacttctctactccaccatcacctaatcccatgtaacacttctagaggaagcacttaaagccttatagtaattgctcttaggtcttgagtcatctttgtttgggcttattggtgtagtatttgcagtccctggtgtattgcttggccatcgtaaataagtatcatttagtgggaatagtgagtactacaaaacctatcatttaatgaaaatagcaagtgctatctctacatgtaaataagtaacattttaaatagcgatacagtcaccaaaacgctatatatttgtaatcagagggagtgtatctctataaaacaatctcctgtatacaacatgaagtcataaaaatatgtgatgttttatataacaacaatatcaccaaaatattagttcttatcattttgtagtacacaaccaatgagaaatgtaggatatatattattggtgttatgaataaggcatatataatacttttgtgttagactcggcgaggcatcatatactaaatcttatacggaattaagcctcatatatagaaggtgttccgggtaaggactactcggataatatccgtacttgactccctaattctacttagataaggggacacccgaggcgaagagagacggagacaagtcaagacagatctagataatctaagacaagcctagacgaactagatacagagctacagaggtcgacaagagggatctaggatgacctccaatctcgccaagttcatattcgagcaagcataaagtagattagatcatcctaaatattgtactttctcgccccttctatatataagcaacaccgacttcagctaataaggagtaagggtattacttgtcagtttaggggctggacctctataaaaatccatatctcccttctcttttacatcaatctcacgtatatcttagcaccaatgatcggggggaccctaatgggcatgtgatcgctgtgggcgatcaccccccatccctcttacacgctcctctcccccttcctcctccacttcttctcttactactacaccataaattttaaaaaataaaaaaacaaagttagaaaaaaaattaaaatagaaaaaaaatctaatactcttattttatgtgcatagactctgtacttatgtacagactttataccgtaaacttcgcatgtacaaactttatgtatagaaaatactatatataaaaaatatttgaattcaaattcaaatttgaatcgggtatataaacttttgattataaattttgtgtctatgaactttaggtgcataaactttatatatgtatagaaataatatatataaaaaaacatatttgaattcaaattcaaatttgaatcaggcatataaacttttaacttataaactttgggtctctaaactttaggtgtataaactttagatgcgtacaaactttaggtgtataaatttactaaaatagaaaagtaatacggtgaaaaaaaagaaaaccaagtgcatgtttggtacaactccaactcctaaatttagttccaggagttgggtctgaagtggagttgtagagctgcctaaacccagctccacaactctagttcattttgtgagagctccacccagctacactcccatttttggtggagctgaaactgtttggctgagctccagctccaggaagggtggagttggagctggagctgtgccaagcaggcccctcgtgaggagaggcgatcgatcgatcgcccgcccattaagaatttcgccaatgatccccacactctatcaatgccataggcgcttatatcttaccatactaattcccctttttttcagtccaaatgccgccacctcacagttggggattggaattcggaatttggaaaggagaggggaaagtgaaaagaaaaatttaaaaaaagagtaaatttcactttgggtcaccttttattaccagtatttcactttgggttacccttcaactaacgttttcacattagactgggtaatcttacatttgtttcactttggaccaccccgattctcttctcaagcatatgaacgacctcgagtacgccagctcctatttgtcaataaacctccttagctgtatttagaccgtttctttaacatatgacaaattagatgtagatgaataagagagttgagggtagtccaaagtgacacaatggtaaacatacccgatccaaattgaaaacatttgttgaagggtggtccaaagcgaaacaccggtgtcggagatatgggcccgggggtatgcaaagtgaggggaagttaccttcccatccagccacgtgactctacagtctagccctccccccacgcctcgggagacgcaggggcagccagggggcctcggggtgccatgttacgccccttaggcccccgcgttgacttgccccgaggccctcgcccgaccgccatgtggcggggggagcgagcggggaggagacccaagccaagccgctaccaatgcgcgcggtgccccaactgcccctcatcgcatttaatgcggtaagggcagacaaacggtgccgcccgactgatgcacgtcagtcgggtctgaccagtctgtgaccggcctatcgtcggtcacgtctgactggacaggcggccgtacccccacgtcgcctctgtatccggcggagtggaggtaggtatgtcctgtcacatcggagcgtcatccggagttctctccacgtaaggagagcagccacaagtctccgcccatttaagagcgagtgacagggctgtcccccatgtcaggtggggggtggcgccgggtgacactgaagggcggaccgctttttagcttccgggcgaaggcacgaatcacggtccggtcaaggtagagtgggtccccctcccgtagaaagagcaggtagaagcggtgcatgtggtatccccttgaactataaaagtaggaccttgtccaccgggaaggggaacgccactcagtaggcctgaactctagggaaagaagagcgagagtgctctccggagtttaggaacccttgtaacactcgaccataatctcacacacaagagtagggtattacgctcgatagcggcccgaacctgtataatcttgttgcccatacgcgattagcagcattcagggtggatacgcaatctcgaaaagcgagccttttcccccggccgaactcacaaaagggggatctcacgatctcccgctagagaggatcactcctcgatagctggcgtgccaggtagggggatttcgcgcgctttgaagacaagtcgttttcttctgccccaagttttcctccgccttcgacgatcatggtcgaggtattggaggaggaggtggcggtgcacacccccactagcgggagccgcggcccccgtcaccgtcgccgcaactctcagactccgccccgccgcgacccctcgcggagggaggattccacccggtcgggtggctcggcccactccccgcctccgggcggggggaagccacgtcgcgtcggggtgcgacaccgcctcacttatggcgacggcggctcgccccgaggcgcgcttcaggcggcgggtgcccttctacggcatccccccgtgaactcagggccagagacccccgtccagcgatggttagacgacgtggccaacctagtcaccactgcccagcggcagttggccgcggccggccggcccaccgctgctggtacatcgcgtacccccaccaccctctcctcgtcagcaaggaggagggcccatcggtcggccacggcctcgaggcgatccacggccccaacgtcgtcgggggcctcgggaagtcgaagacatcacgacggcctctacggggaacaggacgctcgaatcaacatcgagcgacgccgggatgagcgccgcgctgcccgcatgggagaaggcgcctcctcgtctagagtgccacgttcctcctcgcgaggcggcccgccccccacgttcaccttggagggactggttgtagggccttcgttgcgagtctccggaatgtccggtggcccccgaagtttcgccccaacctcacggagaagtatgatggcaacatcaatcactccgagttcctccagatctataccatgatcatcgtggcggcggggggatggggggggcacgaccaggtcatggcgaattatttccccatggctctcaagggtcaggcgcgcggctggctcatgacccagccccccgactgtcgcgaccgggaaaattgccttttcccgaacgctagtgtattaatccccgtcccaggaaaagccggggtacaccatacaaacatgatataaaagacacatctttattacatcgataatatttacattattacaaaggcacataaggcctgacaatcaaaaataaacagcagcggactagcgggcctacggctccatcttcacaggcgctcaactggggtataagccaggactccacctaagacatcttctccaaagcttctcttactgaagggggaaaagattgagcaagaatgagtacaaccacagtactcagcaagccacaccggcggatgcataattaatgcaagggaggtacaagggaataataatataggggttaagttttgcagtaaacggcatttaaaagtcacttagttgccccaaagccattttataaagacgatcctagagctacacagtattattaatcaaggccgtgaaccctcacgaacctgccttaacccaaggcctacgatgattcagaccgaactggcaacccgaccctgggtcccagctcgtcccaagccaacccaggccaaccattccatattttagttgttgagcaaattttaagaattagaacactgacttgggtacattgctcggcttgcccataaccgagggcgcggctattcgaatagattatactctgatcagaggtgtacatctttacccacaagacacatcttcctcacgtgcaaccacgtgccacataccaccacggtatacggacggaagacgtgacatagttcccaacccatcctagccataatcaagagtaccgacccaatcctcctacggccgggacacccgggacaggcaggcaggactgagccccctagcagcagggcaccaaccctctgccatatgacatctcgactaccgggccgcagctcgtgtagccttcatttgccctggagaatgtccatcgacccccgacttcatccatctccaatccgtgtacttttgtttatgactagattgagccacaaactaagccttacccactagacatgtggaagtacggtagtgctttgcaacagaggcccgagcttaatccttatagtggccggggtgctacttcccacaactggcatgcacccaaaccccaccgaaaataggttttaggggttttgaaagaggaagagaggtgtatgtccaattccaccataaaccaacaattcatagtgtccaggtgatatgaatattcccaaagtctaaaattataaaaccacctaatgttgtcctattaatcggcgaagcatctacctaaattcatactagtggaaccataaatagagtgtccactagttggggttttgtttattctagggtgaacaaggtaataataacaataacaataatagtatggtcctaacaaaggtaaataggcatggctaaataaaacagtgataacgcgggaatttaaataaagcgataatgcattaatttaaatcaaattaattttataaactgggattcaatatgctcaaggatgatgtgacttgccttgctcgctttcccaaacgacggcttcgacttccacgaagagcggatcttccgaagctgcagcgtctacacgaccaacggaaaagaaaaaggcttttactctaataaactccacataacagcagaaacaaagcacaaaaatgggttcttgacttcttaaggaaaaattagagacttgaacggtccaattccgagttcaaatggccaagatatggccatttgaagtttatatgctctttaaatggatatttgcgaatttcttcatttaatttttaattaaaaatcccatttattgcgtcagccgagggagcggcgcgcggaccgggtccacgggaagtggggcccacgcgtcagccccacggtccacggtggaccgggcgcacgcggctggcggcggtcggcgccgtgggtcccgcgcgtcagccgcacccgcgggcgcgggcggctgacggccgggcccacttggcagccgcgagggcgcgcccgagggcggcctcgctggcgcggccgacgggagcggcgcgcacccgcgctccgatggtcgccgccggcgaccaacggcgcggcggagtggcacccgagagagaggagggaagggggaaaacgaacggcggtcttcggctcaccccgggacaacgacgacgacgagagcggcggccggagcggaggaagacggcggcgcggttcgggatgacgatgacgacggtgctccggcggtcggcgggcgaagcggagcggcggacggggtcggcaaccactcggcgaagcggacggaggggctgcagg

SEQ ID NO: 36891 - DNA, 17222 bp, Oryza sativa
gagcggagcacggcgcgagcacgattccgacggcgagagcgagcggcgagcggcggaaacggaaaagcggagctcggggaacgtttttatagcgtcgggagggagagagggcggccgggcgaagggggaaacggccgcgaaagatgcggccgccattgatgccggcgaggtttaggggaaagattccgagcgaatccgagggagagagagcgggaaaagtggggggaaatggcgagggaatcacggggagtaattccccccacttcaatgcgcgcggggacggcgggatgcggcggatttggcggcggcggcggcgctagggcacgggcgggcggcggctgcggcgcgaggagggagatgacaggtgggtcccacccgtcagcgagagtggcgggcgggcccgcctgtcagcggcgcgcgcgcgcgagggaggccgatgggccgcgggggaagagagagagagagggagggactgggccgagccggcccaagaaggaaaaaggggggggggggaaagaacttcttttaggatttttctttttataaaccttttcaactttgtttatttcttttcaattattatttgtgctctgaaaattccactaaaatttgagggctccttttaggccaaggagaatttaacaaaaattctccgggccacatttgaatttttcttgtacgtattttagggtttgccaatttcttttcgaattttaattaattctattattccttttagagaatgatttttatttcgggatgaatttatcaggacgtgacaccgactccatccactcctggaaggacctgtgccagcagttcattatgaagttccaaggcacgtacccctgcctaggagaggaggcggacctgcatgctgtgcagcggaaggctgatgagtccctccgctcgtatatacatcgtttttgccaggtccgcaacactatttcgtgcattccggcccacgcagtcgtttatgcgtttcggaacggcgtgcggcacaaccgcatgctagagaagatcgcctccaaggagcccaagaccaccgccgagctcttcgagctggcggacaaggtggttcggaaggaggaggcgtgggtctggaactcccccagcaccggcgcggcggctgcggctgcccccgaatctgttccccactctaagcggcgagataggaggggcaaaaggaagccggcccgctccgacgacgagggccacgtccttgcggccgatgggccctcacgggccccgcgcaaggagaaagccaccggcgacaagccaagctccaccgctccctctggcgagggtcggtcggcagacaagtggtgctcggtgcacaacacttatcggcacagcctcgccgactgccgctcggtcaagaacttggctgagcggttccggaaaaccgatgaggagaagcggcagagtcgacgggagggcaaagcccccgcgacccctgccaatgaccggcgaggggaggccaagaagaaggccccccagatgacagcgacaacagtgaggatctggaattccaaataccttagggaaccgtcaccactcttgataggggggcttgcgctcacacctcccgccgcggtttcaaggccatgaggtgtgagcttctggctgccgtcccaactcacgaggcggcacggaaggcgcgctggtcagagatgaaactcaccttcgaccagagcgaccatctgacagtgctcgctcagggagggaagttggccctcgtggtctcccccaccatccacaacgtcaagatgaagcgtgtcctggtcgacggagggggggggcagcctgagcatcatctcctcggctgcctttgatgcgctcaagtccccggggatgaagctccagccgtcattgccgatcatcggcatgaccccgggtcacacgtggcccctgggtcatgttgagctcacggtgacctttggcgactccaccaacttccgcaccgagcggatcgacttcgatgtggcggacctcaacctgccctacaacgcggtccagggcaggcccgcgttggtgaagttcatggccaccacccactacacctaccaccagatgaagatgccaggtcccaacggccccatcaccgtctgtggcgatgtcaaggtcgccctcgcctgcgcggagcagcgcactgataacctggcggcggccacgaagccgcaggccccggaggcctctgcgtcccgcgcttccaagaagcgcctcgcctcggccgatgaggtgcccgtcaaggagattctccttggcgatgatccgtccaagaccgccaagattggtggcaccttggacgccaaataggaaagcacgttcatctccttcctgcgggcgaactccgacgtcttcgcgtggaagccgtcggatatgcccgggatccccagggaggtgatcgagcaccgcctcaccgtgcggccgggtgcgtgacccatccggcagaaggtacggcgccaagccccggagcggcaagccttcatccgcgaggaggtgacgcggctcctggaggccggcttcatccgagaagtcatccacccggagtggctggcgaacccggtggtcgtcccgaaggccaacagcaagctccagatgtgcattgactacagagacctcaacaaggcatgccctaaggatcccttccctttaccgcgcatagatcagatagtcgactccactgcggggtgcgaccttttgtctttcttagatgcctactccgggtatcaccagatccgcatggctagggaagataaggaaaaaactactttcattactcctgtaggcaccttctgttatacaactatgccttttggcctcaagaacataggtcctacttttcagcgcatgactcgcattactttgagtaatcaaatagggcgcaatatagaggcgtatgtcgatgacttggtggtaaagacacgccaccaggacacattgttgcaggatttggccaagactttcgacagtcttaggtccacgtgcatgaaactgaaccccgaaaagtgcgtgttcggtgtgccggcgggcaaactcctcggttttcttgtctcctcccgaggcatagaagctaatcccgagaaaatacgcgtgatagagaggatgcgccccccagcaaacttagggatgtgcagtgcgtcacgagatgcatggccgccctaagtcgattcatatcgaggctgggagagagggcgttgcccctattcaagctcctcaaatgccccgagccgtttgtgtggacggtgcaagctctcaatcagttgaaagcttacctcacttctccccccatcttggtggccccggggccagagaaaccgttgctgctctacttggtcgcgacctcccacacggtgagtgccgcccttgtagttgagcgcgacgagggcgacccgcgttgtgagcccatctatgagaagggaccaggggcccccttgactggcgatggcccctcgtcgcccgacagcctggtgcccgaagcccccaacccccgggagggccccgaggcccccgtggaaggaagagagactctggcgggtggccccgaggcctatactcccgacatggcccgagatcccccgaggcccctgagcacgggcgccccgggccagctgcccctaacaacaaggaccggccccactagaaggtgcagcggcccatctacattgtcagcgaggcactccgagacgcgaaaacccgatacccacaggctcagaagatgctttacgcagtcttaatggcctcaaggaaattgcgccactacttccaagcgcatcggatttccgtcgtgacatcttaccctctcggccaaatctttcacaaccgggaggggaccggtcgggtcgtaaagtgggccattgagctcgctgagttcgacctgcactccaaaccgcggcacgcgatcaaaaaccaggttctagctgacttcatcgcggagtggaccccggtggacgaccctgttccgtctaatgttcccttcctccccggagacggaggagacccaaacgccgacattcgcgccgggtactgggttatgcacttcgacggctccctccaccttcagggcgcgggggtcggagtcacgctgacttcgccaagcggggatgtcctaaagtacgtcgttcaactcgatttccgagccatgaacaatatggcggaatacgaaggactcctagcaggattgagggcggtggccggaatgggcatccgacaataatactcttcctgagggtcgcgcaaaacctgagaagctcacgcgtatctctaagcaatacgtgctcgtagaagggaccctctaccggcgtgccgccaacgggatactcttgaagtgtatttctcgggagcaaggtgttgagctcatcgccgacgctcatcagggtgagtgtggggcctattcggcctcacgcacattggtcggtaaagccttccgacaaggtttttactggccgaccgcgttgcaagatgccccagaatgggtctggcggtgcaaggcgtgccagttccacgccaagcaaacccatcagctggcccaagccttgcaggtcatcccgctctcttggcctttcgcggtcttggggctagacatcctaggacccttcaaagcggcccaaggcgggtattagcacctgtacgtcgccatcgacaagttcaccaaatggcccgaggcttacccggtcgtcaagatcgacaagcattccgccctgaagttcatcaggggcatttcatcccggttcggggtgcccaaccgtatcattacggataacggcacctagttcaccaatgagcttttcggtgaccccaagagcaacggccaagtcgagcgagccaacaccaaaatcctcaaaggcctcaagaccaagacgtacaacgtcctaaagaagcacagggattcatggctggaggaactgcctgccgtgctgtgggcgaatcggaccactccaagtcgccccaccggggaaacgccctttttcctggtctatggtgccgaagcagtcctaccttccgagctctccctaggttcgcctcgcgtcgtgctgtacgatgaggccaaccaggatgatcttcgccgtgacgatctcgactatttagaagaatgcagaaggcgtgcaaccctgcgagcggcgctaccaccagcgccacgtcctggcccgatcactacaagtcggcgacctcgtcctatgtcgcgtgcagtcgcgcttgggactgagcaagctctcaccaatgtgggaagggccataaaaagtgttggcgttccccggccgggctccgttcgactaaccacgaggacggcacggggttgcctaacccctagaatatcgaaaacctccgccgtttctatccatagggtcgcgcgtctttcgctttcatggtgctcgggccaacccccgcacatccttcggcttgtgcgggcttggcctggggctaccactgttaaatatgttgtatcttgttccttccccagcaataaatttttctgctcaagtggaagccgttgtgtaccctttcttactccttcctatggcttgtccgggtttaaaggacgattcgcgcttactccggaccctaagtggcattgggcggcctgaaaaccgccgaaagggagcctaaacgcgggccgcgccccgggctgcggcgaaccctgggggctcggaagggccttcacacggccatccccgacccccggtcgccgtagccccggtttggccagacccgctgggcagctttctcggggcgacggcattgcccctcgccacctaggtaccacggaccgagcgtgagtttcccttttcaccagaacgagcccgaggggggtataaagggggtaagaacgacaacttaatcataagaaagttaattgaatacgttcgctttggtttttccttctctccttgccgcagacattgaaaggcggaagcaagaacgtaaaggtgcgaagggtaagctttatttgcaaacaggatggcacgatggcctaaagtttgaagcgttcaccgcgagtacataaccaaataaaagaagaaaagcggggatagtcacggagtgcccgggcccctgagtccggcgccgctgaccacctcgtcccagtcctcgccgccatcatcgccaccaccgtcctcgctcccgctctcctcgtctgaagcaagcgcgaggttgaaccgaggggccgacccgtcgaagctggagacgattacgtcggccgcctcccagacttgctcccgagccctcgcctaggtccccggggggaagtcctcgagcgcgcgccacgggaggaagtcgttgtcacgagcttgatgacttgcgaggaccagctccaccatagcctgcgccaaagctgacgacgacttcacggtttcgccgacctcctcctctagcctctccaaatccgccgccatcccatccagccggagcacgactgccggctgtgtgggcgggagtttcctgtcctggcgcacggagatgcctattcggcgccccgcgcgccccagccggtcgacggcgtcggagagttggccaggtccaatctcgttggtgaggcgaagggctgtgatctccccgacttggtcctgcaccaggcgccccaggtcggcgagagtgctttgagccgcggtgagctggctcaccaactccgcgccagcgagttgcccgcctacctctagctccttctcctgggcctccagctcggaagacctcgttgccattgcctcgcgctcagcgcgggcactttctagatgccgggcctcgtgcccggtaacggcctcctcgcgcttcgcgagttgctcacccagccagcgcgccgccaccccacggcggttctcctcggcctcgcgtacggcaagcgtggcgtcccgttcctggcatgcctcctctcgaagccgcagctcctccgcgcgatgggccaccgaagcctctacggcaagggtggtccggttgcgctcggctgcggcctcctcacggaggcgaagggaggactctgcctcggccgccgttctctcgtgggcggccaaagtggtctcgcactggtctagcatgcgcgcccgctcttctagtgcccgggtatgctcctccagtgcccgagcgtgctcctcaagctcccgggcttgctgcgcctgtttccagctgcgctcgtcctgctcgcgctggttacggtcaaggacctcaattcgtcgatggatcgtggcctcgaactcttgcgcggagcgggcacgctcgtctaagaccttgcgctcggcctcgagcgccgccgactgagcccgcagcgaggcgtcgacctccgacgcccgccgctcttgggcggcagcagcgtcgaggactccgcgggtgtcttcgactctcttcgccagatcctcggcgtgggtctcgtactgcaaacggatgtcgcccagcgcctcatccaagacgctcgaggcgatgagcgccgcctgccgctcctcctccgtctcccgcatgaccgagtccagcgtctcttcacgcgcctggatctccgccggttgggcttggcgcattttgtgccccacctccaccatgtcgtccacggcgcggcgcccctcgtcaacccgtgcgcggtccgccgcgagctgcgcccactccgcctctagggccgcccgctcgtccgccagggcttgaacttgggcattgagcccctcccagacgatggagtcggcggcggcgagcacctacaggagtggctctatgctcgcgggagtcagggaagaaaaagtcacggtccgcccccgagatgacagagtgctgctggaccccccgcgggactgggggctgctctcagccccccttccgcgcggccagccccgagggcgccccagatgcagaggggaacagttgcccccgtcacccccgcctcgggccctcgggcagactcggcctcgacctcgacctcgggttcgggcccgcccccggcctcggcctccgggtcacgccctgcctcggcccccggagcgcgttccacctcggcctccgggccgcgatcgcttcggcctccgcccccgagtggcgctcctcgtaggtcgcaccctcgggatcggccctgggggggacgccgccaccactgccatcgcccgcgaatgggtgcacctcggctgtggcagactcagagccaaacccggcatgtgtcctgtgggccccgccagggtactgcgaaggccccgtggcactgggtcggccgggcccctctcgatctggtcgctcagattttgacccctgcgagggatcggtcgccgagaccccctaggaaggaatcccactacaggaggaccccgatcacgttaagaaaaaaaacagaaagaggaaggaacaggagcccgagatggatagagagcaccgagtcggatgttggcgatcgtacctgcgagggggggcgtttgaaggtccacttcgggggctcgatgaaactcccccggcacggctccgtttgccctatcttccggagccgcttcttcttccttccagcctcggacgcggcggggcgcttgtggcccgccggcggtctgtccgccactcgctcagcgccccctccgcgcgggggagagggtggccgagattcgaacatcttccgtttccctttcggatcaccggccgaatctcccccgggcccacggctcggaccaggtgccctgaagtcgccgtccccgccggagttgccggttcggctgccgcctgcggacgcgctgctgctacccgcgccgacggcgccgccaccggcgccgccccgacgggaccgacccctgccggcgccgacggccgacatcacagccaggatactctcccggtcgcggaagctgcataaggggaggatcccgtccggagtcagcgtttgctcgacagtgtccaggcccagcacccgccggatcaccgtcttcgcgtcctcctcgcccagtcccagtgctcacccacatgggtgcgcatgggatcgttgtacctagtgtactcccacgcgccgcgagaccgctcctggagaggcgcgatgcgacgacggaagtagtcaccgaacaccatcgcccccgttaggccctggcttcgcaggcccctgaggcgatcccgcactgcgtcgtactcctcgcctagttccgaaactaccaaccacgtggcggatcgttcgggagggccggcggggagccgaagtcgtggatggtccggcagcgcggtgtagaaccaatccttcttccaatcctcccacttcttgcataggtgactctcaatgtattgccccgccgtgcccggccggggctggaagcagcatccccccaccaccgcgccttgcagcagccatgggacgaagaaggacaggaactgccgcatcgtcggccgcaccccgatgaacatctcgcacaagtgcgctaagatggccagagtcatcacgacgttgggcgcgaggtggaaggcgtgaatttcgtagaaatccaaaacctcatggaagaacctggaaaatggtgggatcaaccccaccatggcgaaggacaggaggtgcacggatcgtcggggtaccgcggccgcagccgcgactcccccaccctcacggcggcatcctccggcatgatcttgcggatgaggctaaggtgcctctccgccgtgatgcgcaatgccggaaggacggcgtcaccagcgtcttgggccatgatggccggcgggaaaacggcgaggagcttggtgtatggagcagggtggagcgagaggagcgctagggctttaggagcgagtatgcgagtatgcagttggcgagagaaaggggacgaactctccgcctccccttccttttatccacccctcgcccgcactcgcctcctcgtttcacacccctacggttgccccctcgattcctgcgcctgcggttgcctcctcaaatctcgcgcccactcatcacgttgccccgcggagcccgcgtcccgcgtttagtgcgcttgtcagcggcacactcggcgtggggcgtgcgatgctcacaggcacggttaggcgggcccgccattggtcccatcgcatgcttgacaggcgggggagtcgaggcggcgtaaatagcgattctgggcatggtctgaccaaacccccgattttcgcgccctaagtgcccccatcatcagcgtggtcagtggcggtcaaatcgccattttggctaatgtgccatcctggttgccgccggcaaccgtctggagtcctcgtcgggcccacaacctcggcacggtaagtcgtgaggcgccacgtcagactgccctcaggggaccaatgtccgacgtggtgccgggggctactgtcggagatatgggcccgggggtatgcaaagtgaggggaagttaccttcccatccagccacgtgactctacagtttggccctccccccgcgcctcgggagacgcaggggcagccagggggcctcggggtgccacatcacgcccctcgggcccccgcgctgactcgccctgaggccctcgcccaactgccatgtggcggggggagcgagcggggaggagacccaagccaagccgctatcaatgcgcgcggcgccccaactgcccctcaccgcatttaatgcggtaagggcagacatgcggtgccgcccgactgatgcacgtcagtcgggtctgaccagtctgtgaccggcctgtcgtcggtcacatctgactggacaggcggccgtgcccccacgtcgcctctgtatccggcggagtggaggtaggtatgtcctgtcacatcggagcatcatccggagttctctccccgtaaggagggcagccacaagtctccgcccatttaagagtgagtgacagggctgtcccccgtgtcaggtggggggcggcaccgggtgacactgaagggcggaccgctttttagcttccgggcgaaggcacgaatcgcggtccggtcaaggtagagtgggtccccctcccgtagaaagagtaggtagaagcggtgcatgtggtatccccttgaactataaaaggaggaccttgtccaccgggaaggggaacgccactcagtaggcctgaactctagggaaagaagagcgagagtgctctccggagttttggaacccttgtaacactcgaccataatctcacacacaggagtagggtattacgctcgatagcggcccgaacctgtataatcttatcgcccatacgcgattagcagcattcagggcggatacgcaatctcgaaaagcgagccttttccctcggccgaactcacaaaaggggatctcatgatctcccgctggagaggatcactcctcgacaaccggtaataaaaggtgacccaaagaaaaaattactctaaaaaaatgaaaaagaaaagaaaagaaaaaagaaggagaagagatcacagcagagcacgcacgtagcaacacagcaaagcaaaggcattcgatttcagagacgcatcttcgctttttgcctcggcgtcggtgctccacggcggcggcggcgggggcggcgccggagttccaccgcgcccgcctacatccgcgtgtgtgagagagagcggctacaaatggcctccgccgccgaggaggccaagggcgtggaggaaggaggaggaggagccagcgccaacggcggcgacaaccccgccaccgccaccgcctccgcctccgccgcggccgcggcctcgtcgtcttcccccgctggtgatccatccatccgtaccccccacaccccgcctgcctctctcctttcgtcttcgttcgtgtagctttgctgcgagaggcaacctagggtgttgggattggtggcggttgctttgccttccctagttcagcttcgcccccccaaatctgcggcggcttctgccatctccgctcatgtggatggctgctagttgcgagcgcaccttcgccttgttggtggacactctgatggctgcttcactgtctgtgtcacgctggttgctgggaatgctgcgtgtgagggtttggtgtgggggtttggtgctgtgttgagtgctaattttaggcgttgactccacgactagtgggtgatggcctgccttctcctagattttacctttctgaataatggttttctcaaatctcttcacaaaacgaagccgttttggagggttagattacatcgaaaccccaatgaactaaacttattgtaattttgtttacactgtcaagcaggttgtgctcttcagctctggttattacacaatattgtaggtccattgcacagtgtgaaagtatgctctactcactactcagggtaacactgctaggcttagttgtaccatgtggcttgtgagttgtgttcaataggattatgcagtggtgtttatagttgtatcattttttaaaggataattaactgcagcaaacctcaaatcatagtgcaaatatatcttttgttgatacattttaatctcactttgttcagtaagttatgatagtgtaaaataaaaggaatgttgtcatccatatttttcaaaccatcattatgtttttgtagatgacaggggcctccccagatcaagcactatgccaggtgggattaataatgttgaaataaccaatgaaactgctggtccatctaatctggaaagatcaagaacagagaggcgtcgacaaaacaatccagctgatgatcctactaaacagttatttgatgataaaatttccctaaaaaagaaggtgcggataacatagtcctgttgcctatgtcttgcctttccttcatttgcaatgcaccctgtttcatctatttacccttgtagcttccttttcttcatgcatttgacctttgaaatttggagcatgtatatgttcatataagagaagccattttgaacagtcacgtgaactgttagccttatcttctgagcgcggacaagatagctatatctgaatttgatacattttagtataatgcagcattgtgaaaaagggctaggagcctgttgcagaggtgagggctaagatagctatatctgttaaacgattatgtgtgatactgctgattaatcagaattttgatagttatgctctactaatttatttatttataactaaagtcaattaaaacatgaaaattatgacatgttataaccacttaaaaacagcacttgctaagcttgacatgttgtattttgtgcttcactgcttcatctccaaagcaaacactactacatgagatcagagattagttcactgtaattagggagtaaagtctattttacgattaaacttgagaaacattccaactgattgaaaaatagttgattattcagattattatgcagccaattcagcctttttttcacaacaattgtgtattgtgatacactgcatggtagcttcgaatagtcaggaactcagtgccagatgtactcttttgtatctggatgcttgatgttgttcaacagttttttgtgatattttacattttattgtagctcgaaatgctaaatcggatagctacagtgaaagatgatggaactgtggtggttgatgtgccaagttctctggaaacaagtacaactgatggtgtagcatatgatggctatagtgatgttactgttgaggaaccattggatggagcagacatatctgtgaggcctcctatggatattgttattcttattgtgggcacaagaggtgatgttcaccattcattgctataggcaaacgcttacaggttagatcaaaagctaccattgtttgttaatttcacattattttatctctcatcaggtgaactattttgcttctcaagcttaatgtttctaaatacatggtttctgtatgactaggattatccattacctgttttttttaggattatggacaccgtgtgagattggcaacccatgcaaactttaaggagttcgttctaacggctggtctggagtttttccctcttggcggtgatccaaaaatacttgctgaatgtatgaaaataaatccttgtattcacatagttgattttttttcagtttctacgtcacgatgattaatatatttggtatattcatatttgagcagacatggtgaagaataaaggattcttgccttctggtccttcagaaattcctattcagaggaaacagatgaaagaaattatattctctttgctacctgcgtgcaaggagcctgatcctgacactggtattcctttcaaagtggatgctatcattgctaaccctccagcatatggtcagtatatcttaccagctttggattgatttcttgcgctttgctttactttctctctaccttacaagtgtaactccaagtttgtttattatatgctcaactaagtacctactactctaaaaaacaccaatttctgacatactcatatacaaggttgtgaggatcaggatccaaggcaggattttttttttgtcctgacatgcttggagtcttagtattgcactgtgaaaattgttactgtgaaggttatatgttataagttactaatttgcatggtcgtcagaattgaaaagatcctatgcacgttaggatccaacgggatcagcgtcatcatattttatggtccagtcaagatcatatattttttaaaacgaaaagatcttaaatttttataagtttgctcatgtacaattctttcttactgcttcaatttggtttatttttctgatttgaggcatccatttcagaacaatcatttcttgattcatgccttatgatggtggtgcttttctttggtgtgcaattaataggcagactgacctagtaatatacttgggaagttgacatctttaaaagctctttctgtttcgccaatctttctggaggcatctcttttcaggatttttctgtgtttatcactttggaaccaatcatagtcatttccagctcaaatgattaggcaatgatgtgtttacaaggtgctctagtgtgaatttttttgcatgttttgtattttatggtccagtagccaattgcaattcacttctatgaaaatttataaatgtttctttgctgctgaccttaacgattattcaggacatactcatgtggcagaggcactaaaagtacctattcatatattctttaccatgccatggacgtgagtcactattgttctgcttcctctttgaagagcacatttgctgaggaatattctcatttggagatctaacttgtgctgcttgttcaggccaactagtgaattcccccatcctctttctcgtgtgaaacaagcggctggatatcgagtgagtttgcatcttacatatttattcaggaaatattttaaacttcttctcttagacacatttgttatagttgctcaatgattaaattaaccctaccggcataacccagctgtgttagctaaacctgattttgtttttggcagcaaacttagacagtttaaatgcaattgccattaggctagatatgtggttttgcttcattaacagtagaaaaaacagaatcattagtgcttatattgtggtggttagcttactctatgccttttttggtgggtagcttaattataggtttgagcccataaccatctcttaatttgaaccaaacccacagcattggcacatactacaaactaatactgtggtgtaggccattctggatcattgtaaatttcacagaaaggataaacaacacatacttgaatgatttgtctgggaatgccctttctaagcctcatgaaagaacaaaaagagatatgagtatctatggaaatatattctaagaacataagaaagaaaacactctgctgtttgctgttatacattttcgcatttatagtttaagttcaatattttcaaggtcagtagatctttaatccttgaaccttatagttgatttagaggggtatttctgatttgggacatggaagaatagaagcagcattctaagggctttagacatttcccatttttcatcaaccgcgtctaattgattaactatcatattttgtgacacttaggcttattgaaaactgcagttggttttatggcataggcctcaggaatacttctttttggagtaagcaactaagcatagcgttaatcatatgttagaaaatggcaggcaaggattgatcttcgatttcccatttcttagtcagtatgctaattgatgaactgaaagaaatactacaaaaaaggttgccgggagcttacattctcttttaatcaatacataatgatccttatactattaaatgcggcagacactgcagggaggatagctggcagtgtcagctgcttgtgatgagagaacattatatatgacgaacacttagatgagattagattttatttgttctttcttgcgttcgattactatatctggctgccttcttaagtaggtgactaacccataattaagcaaagaccttatccaactgaacaatgtgccaacagatagattaagatgcagaacacctggctgtaatttgtttggtgtccagatggctagtctgctggccatagccatgtgcacgcttgtgcatatgtgtaataataggttgtccttaacatgttcttgcccacggatgtttctgaactattcattattacatttgttaatgccagagtaaatttcagaaagtgcaactattctgtcaaaactatcttcaactttagctgggcatttcaaggaactgcaaaaagtgtaggttttattagagaaccgacattctgttagcaacatgcaatagggcctttacagattgggccaacctattggacacaaatggggatggagttgcagttttctgataaaattgtgcactaatgttgcagttttctaaaatattgagctaaagtttatcagaaaacagagattggaaggagagggagaaatcaggatgatcaggagagaagaaaaggcaaagaagaaaaaaaaaagagaaaaaaaggcttgggaccttgggttgggctgggccgggggggggggggtctacaatagttattttaaactcatgtcgaattggatacgtaccaaaattccggtggaaacatcttcaatttttataatagtagagatatttgaaatggcttgaactgttattttgtaaatggcaatcagacaataggttttgttgtgcttactttgtttgcattgttgtgcatctctgggataggatcccaactctgacaattttggcctgcctgcttgtgctcgtttgttgttagactgatttgggtggtaaactcaagtgagttactgtatgcaaaaagttagtttctggcttcattcaatgtggctggtgttcttgggagtg

SEQ ID NO: 36892 - DNA, 969 bp, Oryza sativa
  unsure (1)..(969): unsure at all n locations
caccgtctcctcctgggtagtccaactcgaggtcctcgtacacggcttccaccagctcaactttaaccctcgagtatcctgctggaatcggcctgcagtggtaagtccctgaaatgtccgttgggatggccattcccaacgccaccttcacgtgatgagaggttatctattagtaatcaacctaagtagcaacttgcggaatgtacgagtcaaaaatcatatattacatcgagtataccttgattgataagttcttgaagggaatatgcagctcacatggtgtccgttgcgtgatctcatcaacggggcaggtggtttcgtcctgggtttgcatggcgtccatgctatgtgatactacctgccccattgaggcgcagctgctatgattgcctgatgggctgaccattggaggaggtatgtacggctggggatcgtgtgaccgatgtgctgccatgcgttcatccaccttccgggccacctcctcttgcatgctgagctcgtagctcgataccctgtactcaagatctgcaatcttcgcctcggtatctctcttgctcctcatccgactcttgtacgtgtggatgtcctccttgaatcccatcttccagggaatcacgcctttccctcgtgttcgtcctagatgctcgggagtctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 36893 - DNA, 1174 bp, Oryza sativa
taactaataaaaatggggttacacttctggattgaatgaatttataaactctaacagcagttccaattccacctaactttcagaaattcctgttaacacagttgcaaaaaatagggtctggcaggtggtgtgctactttttgggctaattcttgaaaatgattcagttctcctaacctagcctttgtgtgatttgtagtgccctacaactattgtacctttctttggtgaccaaccattctggggagaccgagtgcatgctagaggggtagggcctctacctataccagttgatcaattcagcttgcaaaaattggttgatgctataaacttcatgatggagccaaaggtaacatctactttgcaacacaattcaaatatgttcttaatgttgctgttatttttgttggtaagatgtataaagacaacaagaatatggatcggatgtatatatgttgtcaataggattgcgaatatatagatttcacccctcgtagatatgctgactagctggtgcattttaacttggttctaatgcttcctctttcatacataacatgatatcttccattcaaacatgtttaaccgtccaacaaatgtaaatagttaacagggaatctactacctccgttctcaagtagattacgtcttgagatcttaaattttaatatgctaaaaaatatttggatttgatatgtgaaaatggtattaataaatttataatgaaaaatactttcatatatttatgtttcaattttttgtaaatatatagttgaaaaaggtagcaatggaacatgcgcatcagggactgttgatgtgcaaaatgtctagtaaaaaacgaacatttgcttcaccgaaacaaccaacattgcatatatactgctcctactttgtgacaacagagttgctcctgcactgtctgtcttgaactcgctagggtttggaaaaccagtgttctctggagccttatcctgtttggtctctatttgcttggctggttttctctttatttggatctgcttgtatttgcagtttgaccagaataggcattatatcacctgttttctaagattatatattatatcactttttgccttccaaattaatggaccagcttttgtgctggaaatcacctgtttcaggatgaaaaccagaactggcaatatccgtttttt

SEQ ID NO: 36894 - DNA, 7872 bp, Oryza sativa
ttcctttttaaaataataaaataatctgtagatatgataataccatttggaattgaacattaccttgtgctggaatggttggcaataggcagtagtagggtatttttttccattgcacaatgtcgtcaatttccactgttgtcccagatagccgctgccactactgtttcaatacaatctgtaccaagttatcatagccattatctgctgtgtaaaccagccgatatagatatatatatatattttacttttatgtactttttatgtaagtgtcaattaacataaatcgaaatatttgatacgatgttgaaaagtactaattttcccatagcgtggataaggataaggggatactatggtctatggcatggtggtgtacattgtatgacgggtctgcttcgtacctgatcaatgactttgtcgggtgtcatatgtaattttaggtgaaagacaatgccgtggagcttgccaaggccatggaatctgaagatggtgtgtcaggtgcagtcagggcattcctcagacatctaccttcaagagcagaggaaacagcacctcagcagacatccagcttcctggaattcttaggtcctgtaagtaaatgtcttggttgctcataggtgacagtgaggcaattacacaaagaatgccatttctccctgttgaaagaagagaattttgaacatccctgcaaggatcaggagaacggatttcctggagagtgtgctttattatcttttatttttttcctttttgtgtattttttctcttttattgtgtaaaaggtgcttgtctatacatcattttgatgtgcatcgttgccctgctggtcctgcaacaagtaaagaatctcacatgtacgaccagtcctttctgtgtatatggagagaagtggagaggcacacgaatagttgagttgtcgattgctgcaatgattctaaccaaagcttcaggtttattgtattggtcatattgtaccttttataccattttctttagttctcgttttatgatatctttcatgtcatggcattgcaaactatagtagcattgtacatgtgccaataccacctaggggcatctctgtctgtctctagcagagtattaattcttgtggatccaacagtactagcgaacagcagaaacttgggtggtctaggcatatgttcgatgatgttttgcggtttgtcgtttggaggacgaacacaacaagatgggtcactcatgttttgacaacaaatgctgggatgtaggccgtggcaacttggcaaggccgcttgctccactcgattgtacattttctactgactgtaccctccctggttgtgttggatggcaacatttgcagctaaaatctccacaacttttgggcgttattgtcttggaaggtcataagatcgtgccaagtgggctgtgaaagtgtaccatgataggaccatggcacgtcagcctccacgtgtactgtgagattattctatgtggtcgcaattatgtaaagtcttggacatcgacactgtcttctatgggctccttcggaacaaaggggaaatggaggaattatcaaagattgaattcttaggggaaataattcttatgtgattgttttgaataaaagaatgactctgaaaagcatcttcagaattcctacggaatgggccatttgatggaattttttttttgaggaaaactaacatgaagtcttacctcgtggtttctcttacaaaaacgccacacttaggtttttagcctttggattagaatacaagagctgatagtggtcgagtgcatgagtacaccaagataggtgtgtgcataggataagttgcctagatctcaccccaaaattttaaactctgtcatatcgaacgtttaaacacatgcgtggagtattaaatataggctaaagaaatagctaatagcacatattgcgactaatttgcgagacggatcttttaagcctaattgctccatgatttgacaatatggtgttacaataaacatgtgctaatgacagattaattatgcttataataaattcgtctcgtggtttactaacggatactgtaattagttcttttattagtgcctgaacaccccatgcgacaccctatataatacctgatgtgacacgccaaaactttacacccctgtatctaaacacctcctagtatgcaaacttcatcacataataagtggcaacctattcacattttttctgtttcaaccacttttgatttaaattaattccttcccattttatcattcatcatttaaattacatgccatcccactctcaatcccatccgggcatttaggtaattcgtttgtcctactaatttggtttttaattaaattctacaactgcacttaatataagatggagagtactcttgtacttttttttcctgtctagatttacatagtagtgtaagttacatttagttatagactgctatattctaggatgagagagtatataaaaaataagcaaaataaactaaatttatacaaagtcacatcgaagtttgcctctcagccgctaccaaaattaaaaattgtgaagcagaattttagtttctttattggctaagaataaaacgaccaccgcgccgcgcggatggccggccagccgacctcaccacctggtgtcgccgccggcgacaagcatcgccttcccgctgctcgctgcggccaacaggtggccggtcttgcctatgatttatcgacaggcagcattgctagctaactagctggctacctagaaaacgtagctgcttataagctattttatctgtttgttattagggaattggtttttagctggagcagtccggaggcaggcaccatcctcagcgttccactaagttgacatcagataatcatgttatgtattttccacggtcaagattttcttttcactacaagtgaaacataatccaccacacggacgcttgctaagagcatgcctagcagctcatctatcatgttctccattgaaaaaatggcatatggagggaaaaaagcgactctagcatatatgctatccaggcctccaaaaatggtgcatacgctatcccacagagagaaacaccaaatttatatttggcgtttctctctcctcacgccatattgcaaccgactcctccagatcaagctcccgcccccattcggatcaactacccctgcccctacgcctgcagcacctccaattgcgacaacttcggcggccctgtgcgacccgcgctatcacctgcgccgctcacgccctcccctaggaggctctagcggcccacagtctgtgaccagtgcacctctcgtgctgagccgctgacccaactccgatggccctgcaccacccgtgcccatctgcgtcgctagctcccactgtcgcccctctactcggttgtcctagtccacccttcccctcttcctcttctctggatcgagcacccgggatgaacctgtcatagagaaaagatgaagagaaatatacttttaccagttaggagttgaaagatattaataaaatataaaaaggtgtggtttattgaagatgtaatatgaatgatttgttggagtgaaaagagatatagagatggatttttttatgaccattcaaatggtaatatggtagatcaggtttggatgagctaggacatgctctaacatgttagaggtagcgggagttctaaaggttgccaaagacgaactgcgcgctaattacaagtcaggaacttttccaaaatgtaactacaagttccccgtcaaatgccaaaaaaaaagctgatttctatactcttacctactattggttcacaaatggaagagttttatcccttcaataccccttacctaccaaccaacccaccaatactactttcatattaatgagatatgccaattttccctatatcaaatccctattacttatgtacggttttattcgagaataagtagaggcaacgcgacgagcaagggacaagacgagcaggtcgccaacggcatacggtgcagatcggcaaatggcgtagcttgggtagttgggcgagtagtttgtcaatttacttgtcaaatgaaaaagaaatactgcatgctctcaaaatatagcaagtgttaagctataaatctgaacacatatttgtccatattcataaccaaaagttggttatatgcatggtagaaaacaggaccaaatctaacaaagggcaatcagttaagaatctattacctccatccttcataaaatatagctacagctagaaatagccatattttgataactataaagtgaggtataatagaaggggataaatctcataagcaggcctcttgatcactaacaatagaaagataatgacatggcggatagctcggccgagacaatttaatgattgactacacagaagccatcatttgttgaacttaaaatcccacatccctaatcaaactgctacgtactatatgtatgtattgccaaatgccaatcagcaggcttgtgcaaccagcaagaatctacgagatctcatggagtatcaaaacttcagttaaaatatatgatgccccgctagcaagtcctaaagcaaatctagtttagtgactgatggacctacctttcaaagtattgctgcgtgggaaacaatcaggtaacctattctatgttgtatcgttgcgaacaccaaagcaaaaaatctgctgttctcccgttccaactgcagcacttatttcttttcagggttgatgagcaatagggtaaagaaaaaactaatccatggtagctgtttccggaccaaaagtattctccagatggattcacttctgtggaggtgacggagatggaggcggaggtggcgtcggcgttggttgggacttgcatgccttgcaatcaatttgtggtgatggtgtcgtgttgtctggaattgttaccctaattgtttggtgtttcccatcgtcagtaggaacatcaaggatagcatccattaatagtatttcccagtcactgcgttgcaggaatgaaaaccaagactcatctgcaagaataagaatgacatgggattagaaataggctcctacaacatggatcaagacttgtagagactcaaaaaatatcaaaatcagttgtctaacaaaaatttcttcagttaaccggtacttcagttctgtatcaacatgatttttcaaagatagcatgccaaagggaaaaatggaaacaagatttcattggaggaaaaatctggaagtgatgaatttaagaactaacaggtcccagatgaacgcaatatcagtagcaacacgatagaatgtgctctgggcctcaatatgaagaaaaccatcaactgagcaatcaaaaacaccaatgggaccaaaagttacaaactactccctccatcccataatacaagggattttgagtttttgtttgccctgtttgaccactcgtcttattcaaaaaaattttagaattattttttttgacttactttattacccaaagtactttaagcacaacattttattttttatatttgtacaaattttttgaataatagttacaatagttattttaggctcacatcgaattggatacgggcgacgtaccaaaattccggcggaaacatcttcaatttttataatagtagagatatttgaaatggcttgaactgttattttgtaaatggcaatcagacaataggttttgttgtgcttactttgtttgcattgttgtgcatctctgggatagggtcccaactctgacaattttggcctgcctgcttgtgctcgtttgttgttagactgatttgggtggtaaactcaagtgagttactgtatgcagagagttagtttctggcttcattcagtgtggctggtgttcttgggagtgctctttaggttgcaagggaccttgatccaatttatagtaattcttgtaattaaataggttgcaattttgctgcattccctaaaaacaaccatgcaccacatgtcaaagttagagatcatctccctaactcacatcaagcacttgttgaaagattcatactcaaatcactcattttcttctgatctgatttgttatctaatcttcaaatggtttacacttgcagctttcttatcaaattgttgactctatgatttggcttggtatccgagatatgataaatgaatttaggaagaagaagctgaagttgcgtccggtaacatacctaagtggtgcacagggttctgggaatgacattcctcatggttacatctggagtcctcaccttgttccaaaaccgaaaggttcctgatgagtattagctttatctgaaatttatatgttatcccttttcacgtcatgcttaaccttgtcatccttcgattgtatagtttttaaaacttgtggaccttaatctggtcctatggtttcttttcatttgactttcttatagcattcagttgttgtattgaaaagagcttgcttgagtatttgctgtgataacactgtgaaccaagtcaatattagtaatgccaactgaaattggtagcctttcagtttgataccacatttttctaattggtaatgagcatgaaagtttgctactccctccgtcccaaaatataagaatttttgaactttgacacggtttccgagatgctactctgaccagcaatatctataaaagtaagatgttttaaataaaaagagttacatattatgatagtttgtttaataataaatctagtaacatcaattttacatgattatgaaaaaatatgggagagagtagagaggagaagtgaagaaaggtgtggagagcattctttttttgggtcatgtacctatccccggggttcttttgatggttagaggctgctggcctaaaggagtcagttgttttctaatgctgtaggagtagcaaatatatcaaaaccaccgaaaaaccaatggcactgtagcaataagctcatttccgatggcagaccgatgactgatgcaaactctggtggcaaatatccaattctttctaaaatatatcattaggaaaatgcttgttaagctattttatgctttttcagtaatcactgatgtgtataaggaactatcatatcctttcaataatatgagttgtaagatatggatatattagtgcgttaactgttaaggaaaaaaccttgaagtttcctgctcaattttggtgttaactgagcaatttttgttgttaattgtctgtaattctactgtgaattacatagtctattctgttgcagattggggccctaagattgatgttgttggattttgctttcttgatcttgcttccaattatgtgcctcctgaaccacttgtaaaatggcttgaagctggtgacaagcccatatacgttgggtttggtagtcttgtaagatcactttgatctcgatttgtattattagaggttttcagtttttgttcccctgttctgatctaggcatcgtttgacgtattatgtttctactcttctatgtatgatggcacaattagttgacctttacttgtactatatagttaaactttgaactgcttgtctaatttgataggactgtgtgcatgtgttatcatttctgtagttgtccaaatgacatcggtggttaatgcagcttgtggattagtggaactcatatttattttactgcatgaaacaacactttacagtgttttcactttttaccattgcatatttacatctagtagtacactgttatgtcacttatgaagcttagcatagcatctcatggcaaacaatagttatgttattcacattagtttatgtcttactctagaaaatggtatatggacgtcaggagatcaaattgttatggaaaccataactttgatgcaccagagaagcttgg

SEQ ID NO: 36895 - DNA, 618 bp, Oryza sativa
gatccccgaggcggccggcaactgatgctgctccccggagcactcgtcgttgtcggggctgctcccgaggaggtcgaaccggaataatcctccgccaccgccaccgccaccgccgcctccggcgtccccggagtttagcaccgaggagctcgacgtgccggaccgttccggcgactccacattgagatccaacaacatctccaatcctcaccacaccggcaacccaaccaaacacttccaccctctctcgctcttccgacttcgatcgagttcaactcaccaccaactctcctcgccttctgcttcaccctggctatagctcagctcgatcgttggcgcctcgactgacgacgactcactcaccggcttcgagcggtggcgaggcaggagcagcagcaaccacagcaccaggtggtggtcgccatggggggttggatgaagaagaagaggaggaggagagagagaggtggggagcagcgggagaaaaggaaatagagagagatggatgggacgtcgaagtggcggaggagggtatctcagggaggagatgagaaactatcgcacaggggattagaatttcgctacggccacacgcgcagcggacgccgggctgcagga

SEQ ID NO: 36896 - DNA, 608 bp, Oryza sativa
  unsure (1)..(608): unsure at all n locations
nnnnnnnnnnnnnnnnnnnnnnnnnnnnnnnnnnnnnnnnnnnnnnnnnnnnnnnnnnnnnnnnnnnnnatcacatttgccagctccatgaattgtcgatcacggtctgagatgccatacccagagagatagccgaggctggtacggagactcaccagcacgatggcccagaccgggaacagctcattctcaaacctcgcggattgcatggctccaatgaggtacactactatctgatcagataattcgtcgatgctttcaagaatggtggtcaagattgagctacgagttcggcagcggtagaagtctatgatgaacattgcaaggaatatcaatgtcaccagtgccaccaaggactcaatgcggatcaagacatagatgttctctttcagcatgacaaaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 36897 - DNA, 5035 bp, Oryza sativa
  unsure (1)..(5035): unsure at all n locations
caaagctagagcttacacgttctacttcagacaatgcagcagcttttccatctcaaggaaatcatccatcaggtcaatctcaacatgattgtttacaacatctcttgagctggcactactgttcttgaactgatcaagttcggctatcagagccgaggcccatgaatcagaatttctcatttcactgtcaacagtcagcatacgctccccactgtcagactggctatcagtgagagattccatgcaagcattgttaggcgcaggcctagaatcattggccaaggaagttcttcgtgtcagatggcgcagcttacggcattctgcctcaacccttgcaatctttttcacactttccaaatgttgtttacttgctgtctctgctgcttcattgctcagatctctttccagtgacagtctcttcaagtccttggctagcgtgagcagctcgatcttcaggcccttgttttccttctctgcagcctgaagtttatcctgcagatcatgctggacagccacagtggcagcttctaatttagcggcttccagctgctgctttagctcataaatatggttctggagctcagacttgtgagaatccaattcttgagtcttcttagcaactgcatcacgaattttctcctcttgttcttccctagcttggcgaagctgcctgacacattctttgagagcatcatctaggtggttcacttgatcatccaaagaggcattcttctgagttgaagcttcgagtaacctcttcagggtactaacttcagcttcagcttgttcccaacctacaagtaagtcaaaaataaagttcaatatgaatttggttccatattggaataaataaaactatgattttcttgagaaggtacaactgaggagacagacgacacactcactccacacacactaacacgcatgtgcagacaaacagaattattggttgatactactattttaactttgccaaagaactatttgaatgagtttcctctttcttagttctattgatgtcctcacatataaaattaattttgaataatgaagggaagccacagactcaataaatgcatgggatcacaataatgcaaaatgtctaaaatcatagtgaaaagaaagattacctgcaacagcctcttctgcaacctttgtatgctgcttcaccaagtcatctttagcattgatagtcaaaagggctgaagcaagcttctcactcaaactcttcacagaatcttgcatatcttcatctttgacatttgtgaagacatctggctgtggtgactgacaatgctgtgtggaagaatcatctgacacagtttccaacactagcttttcatttaaagattttgctgttgcagttccttgagtctcattatctgtaattcttgagcaaattttaggtgattggctatgatttggggaagcaccattcggaataggcttttcgccctggttttgccagacacagaaaaaatgagagtattttccgcaagcacttacaaataatttcaaattttaaatagtctacagaaaaagtaagagatttaatgattgtaccggagaagcaattcctccctcctctctcatctccggtctctctttcagagaacttgattcagacaactagagtatgctctcaagccaccaaagtggaaatcaaacatgtgacctgttacataagaattaacttccttaacaatgagataccacaggattctgaaaaaaaatctatatgttacattctatcctctggaaaactgcaagtcaaaaacattcaacagagctatagagatcagcactatcaaaacattcaagttaaccatgcaaaactgagggggtaacagatgttaatggtggttctttctatatgcagtgtgctattctggaatataactatctaggaacaaaattgaggcataagcctttgaagcaaaactccagaaccatgtcagatagctattaatttattaatttgagaatcacttataacttcagcgagcaaatcgctcctcgacacagcaataaaagaacaagatattacatgacagttaagtgctacattcatttacaatttaaatattatgtccaaatgccactacttgcgtaacattatccttagtttgttaatccacaaattacaattgcacttcatccaggcacctaactacataaagaatgcatcaataccacatgaagcataataaaaccatttgtgacaaggttatgttgcttacgaagtagaacattaacccatgcttaactcaaagcccatttgtccctatcagggaaaaggggcccaataaagaacccgctagaagtcttgggaacctttatatcttgtttgatgcatttaaagattgtgtaaccatatgtttggaagtacttagtagtctcttacaaaatcatataatcaggacgaatcaagtacaaacctaactactcaagtctatttccaaatattaaaactggcatgctatattgctattggttactggatgtctgatttctacaaatttattcattgacaagcgtgtgacaaacgagtgaccctgtaatggctggcccaacagcaacagatcaaattgcaaatttgcatgtcataaatctgtccaaagcagaaaaaatgacatctcagctagagatgccaacaggcaacagcatccgttatgtttattaaaatcagaaatcccaactttggttcttaagaaaagtttgttccccaagtctaattcgcaaacacctaaactatcaccaaatcatgatgtttctagtacagaagtgcagatgaatagccaaacagaattcagaatttcttttctcaaaactgaattcaaaatttcttagatatggatcccattcagacagaatttaactattgaggtgaacctgatcaccggagtgcaatgacatcgaaccagggcattcaaacttgtgcctccagagtcaactcttggagatccatcttgcaaccaccggtcatcagacaatcaaagcatcaatagtgatcacttggtctaccagccaccatcaaaaagcatggtttggatcactgaagtctgaaacacaaaccaatggagagaaatctcatcaataaacatcacattgcatattactaatgggattccttaataatgtaatgttgtaaactgagcaacaggcagtaactacaatcgtcctagggaagtaaaagtaaaactttaaaacgttgcaattaccaaaatgtgagcaatgcacaggatccgattttccactgtaatatacaatgtctataacttaatgaacacttcaaaacaaagataccaaggaacacaaaatccaacaaggcattgagtacgattccagaaaccaagagaaaaataatatatgcttgctgcaaagcacggtaatatcaaagtttttttttttagcaaacgtaaaaagtacaaaccctatcctacccttttctaagacaaatctttgcatcaaacgaacacatcaaagatcaaaatgtggctagtaaatactcctaaaacttcaaaaccaaatctggcagcacctaaaaccctacaaaaatgcatgccaaagcagaagattttacccaactccgaggcctcaaaacgagccaagaaatcaaaatcacttcgcataacgcaaaaacaaaagagagagagaacaattaagaaaccaccaaaaacgaagagagcaccgcgcgtaaactggattgcagcgcaaatcaaaatctcccccctttcaatctttggaaaaactgcacccgcaatcaaatctcatcaaaatcaagtctacgacgggtggagtgcgcaagatacagagcaaaaaacctacaggaaagggaacaaagaagagagattcagaaaatcggcgcaggtgaaggggaaacagggagcaattaatacctctgagaacccccgaattaaacccgtcgcctggagaacagcaaaaccaccacaagaaccatgtgaacaccagaccaaagttcagtttttttttgtctttactgctactactattctatctctttccctttctcctagtagtttatttgggataaagatcagagggaagaacagccgcagattcacattgctcacctcgcccacaaaatcaatcacagatcgaagcgaacacacgcggagaaggatgagagagaagcaagcacaggaggtaaaaaagcaggaggttactgtaccagagcagcagcatcaccatgaatgacaccatgcccaagaaaggaggaggagggaaaaaggccactgcttttgacgagatgagagcctcgagtgcgtagaaatcgcagcaagaatccaaaaaccgcctccttttttgcttccttttttctctcttctcttcttcttcttcttcgcggttcgcctcctctctttcccgcccaggcagctcaaaccaggactcactttcagctgctggtgttcttgcctcccctcctctcctctcctcttctactgctcttcaatgtgtcattattgtagtactagtactacctgtgctgctaccactttcatctcaagaagaaaagggagaagggagaagaaaaaaaaatgttgttaccgcagctgttacttgtatactgataaatacttcctgtctttgaccgggcagagagtactgccacggtctgctgctactgtgtaagggtattcctaactcaataactagatggtgtccatagtattaaataagttgttatctatgataaaaaataatgtggcaagtgaataaataagaaaaaaagaagaaaatcatgtgttgcatctacacaacatccaagacattatgtgagataagtaacattaaattaaagtaggaatagtggtgtttgcattggaagagtaatgtctagtactagtttttttgatgatgtggagttcatagaaaccatgtctagtgttatgggttgggactgccctaacgtactactacttaattccactaaacaaccaccattatnnnnnnnnnnnnnnnnnnnnnnnnnnnnnnnnnnnnnnnnnnnnnnnnnnnnnnnnnnnnnnnnnnn

SEQ ID NO: 36898 - DNA, 1183 bp, Oryza sativa
  unsure (1)..(1183): unsure at all n locations
nnnnnnnnnnnnnnnnnnnnnnnnnnnnnnnnnnnnnnnnnnnnnnnnnnnnnnnnnnnnnnnnnnnnnnnnccactaatgaactacctcaccgtatagatgctggtcaacgcaactacaagtcatcagtttcacctatggctgaactacctcaccgtgcagatgatggtcaacgcaactacaagttatcagtttcacctgctgctgaactacctcaccgtgtagatgatggtcaacgcaattacaagttatcagttttacctgccactgaactagttcactatacagatggtcaacgcaattacaagtcatcagttttggagacgccagaacttctcaaagaccccgacatggcgctcttcttccttgagaagaatcttcaacaaggtaaaaaaattaataacgccctccacttcgccaacttgttggccactacgaactccaagttcctgccacgaggcaaggcggactccatcccgttctcctctaaagaactacccgagatcctggaccggttcggggtgcggccgggctccgacgacgcggctgagatgagtgctacgctgcaggactgcgagctgccggcgaataagggagagaagaaggcctgcgccacgtcgctggagtctatagtcgacttcgtcacatccagctttggggccagtgacgtcgacgccgcctccaccgttgtgctcagtaaggcggtggagtcttcttcgctggcgcaggactacacggtgagcggcgtgaggcgaatggccggaaccggccagctcatcgcttgccatccggagtcgtacccgtacgctgtgttcatgtgccacctcacagaggcgacgacgagggcgtacaaggcctcattggtcggcaaagatggtactgcggtggaggcggtcgccgtgtgccacaccgacacgtcggactggaacccagagcacgctgccttccatgtgctcggcgtcaagcctgggactgtgcctgtctgccacttcatgcagcctgacgctgtcgtctggacccgcaggggctgatgtatgtatgtatgccatatagtacctacttcatcgtactgtactgcgtacgcatgctgccagctgctttgcataccttgctgctggagatatatnnnnnnnnnnnnnnnnnnnnnnnnnnnnnnnnnnnnnnnnnnnnnnnnnnnnnnnnn

SEQ ID NO: 36899 - DNA, 883 bp, Oryza sativa
tagggcgaattcgagctcggtaccctcaagaatttcctgatcttcttcttatctgtgtccacttcctcaggggcgtaccgagccaacttgttgaacatacttaggtactcattgacactgctgttgccttgcttaagtctgttgaattcctctttcttcatgtcaatggtgctttcaggcacatgagctgcacggaaagccgtagcaaactcatcccaagcaatgttagtgggttcagggtatgcattacagtaattctcccaccaatctgcagtaggtcctcttagctggtgagaggcgtagagcgtcttctcaaccggagtacactgcaccaagttgagttttctatcaacatctttcagccaatcgtcagcctcgacgggctcgacggtctgagagaactctggcggacgagacctcagaaaatctgtcagcttggatctattattgcccatgtgagggtggccatttccatgcgcattgtgctgataaccggctacggctgcggctaatccttgcaagatttgtatctgaactgccattaagtgctgcatgttgttttccacatgaggtggggaagggaggcgttcttctccagaattgtgactggcagtgtggtgagagcggtgagactgttccatctctgcattacgggaagctgtgcgatgcgagcggttgctgcggcggggttgctcaacttctgcgttgcgggaagcagtgcggtgcgaacggttgctgtggtgagactgctcattagctgactcatgatttgcttctgtcacaactctaccttcttcaaaaccgaagcgggctggcgcacgggctgcacggggggggggggggggggggctacccatctaaactcccagaagagggcgaggta

SEQ ID NO: 36900 - DNA, 2286 bp, Oryza sativa
  unsure (1)..(2286): unsure at all n locations
nnnnnnnnnnnnnnnnnnnnnnnnnnnnnnnnnnnnnnnnnnnnnnnnnnnnnncattttgtgtgattaaaaaatagctaaaaaaaagcctacttgacagtacttcttccagttttgaaaacattattttgaacatccatatggccttcaaaatgcaaccttgactgctaattttacagtatgtttatatactagcatgttgaaattataataatcaaaatacgtctgtacttataattttcatactttcagtataagatgtactagatgtttagagtttttttaagtttaacctgaaacatgctcaaaacgatgtattttcaaaaccgaagttagtagcaccatcctatgattcctttgaagtctgctttcgaatttgttttagaattttgaagcagtgctatcagacagacatgtcatggttgaatggccgaccaactggtccaagtgtgttttcttctagcactggcccctctaaataactgttagttcgtactattgtactaatcaagaccgattaagaccctgtttagatgggactaaaactttccctatcacatcggatgtttagacaatccatccataatcttagactaattcgcgagacgaatctattaagcctaattaatccatgattagtctacgtgatgctacaataaacattctctaattatagattaattaggcttaaaaaatttgtctcacaaattagctttcatttatgtaattagttttgtaagtagtctatatttaatactctaaattagtgtctaaatacagagactaaagttaagtccctgatccaaacaccacctagacacgaatttgttgggtcggtaggtgggagctccgatcagaattcaggaccacctaacactatcccaaattccaaatccatgtgcaatgataagttctattcctccacaaatgaattatttcaatcctatgttttcactaacttcgtcatgattttgatgtgaaaaaaagaaatatatctgaaatactagtacataggcatttgctgacattaaccactgaagcaaattaatcacacaattgtgtactcgtgctaactttcacccacgatttggcgttcaaaatggcaagcttgacaactttccatgtcacaaaaattcctaaataatagcttgacatgaatttgtccaaggctcagtccatctttcagggggtgtttgggagacataantncntnncctaaagacttattgtctccataggtggacacacccactcagtactctcttgatgaaatcgcacacgttagacatggtagtttgcaacaaaggcactcatgaagacctcatgggcaacataataggggcttccaacaacatgagacaacgtatgacgtcactgaaattaaaatagaatttgatccacttttcatgactgacacactttgtcatcctctacccaacctgcaaggaaaaactaaggatccagatcctgccaatgcgaggttatcgaaaaagcttgccgtgacgcgtctcatgtgttgggacgaggctcatgtgttgggcagtgtggagtgcgggtaaagtgtacatccacttcagtgtgagtaaaacaaatctattccaatagccgtgctcgcggttattgagcaccgggacatgtattacacttggctagactctaaattcttaacttgtgtgggatgggatattgcatgatggattttatgctgatggagccacttcctgagaggagggaaggtggacgttctcagaaaaccatgacgactcaatggcgggaagctatccttgggattacaatggatggtggacagaaccgtcgttgtttaatgtgaacactggtattaaaacttgatcagtccatgctaggtcttaggcttgtgaaaagaattgcaaaactagctttatgcaaaaaaacctgaagccattccttgaaatacctcatatcatacgcattgttgttgtggtggcttgctgagtacggttggtactcacccttgctatttatatatcttttaggagagtgttgaagagaagcccttgtcggtacgcttgcgtatccaacaagatgatcagagtgcggtcttgttctaggtctcattccccagtcgactgcctgtggcatgttaaccgggcctttatattattttgtcttccgctgttgatctctgatagttgttggcctacctggccctaatgtaagtatttaactctgttagcctgaattcattcgtgatatgttgtgatccaactatgtatatgtgtaccaactactgatccagggattggt

SEQ ID NO: 36901 - DNA, 5337 bp, Oryza sativa
  unsure (1)..(5337): unsure at all n locations
nnnnnnnnnnnnnnnnnnnnnnnnnnnnnnnnnnnnnnnnnnnnnnnnnnnnnnnnnnnnnnnnnnnnaaaaagaaaagaaaaagaaaagaaggaaaaagaaaacagaaaagagaagagagaaaaaaaaagaaagaaaagaaaagagaaaagagaggagagattagagtgggccccacgtgattagagagtagtaatccccttcttaatcttcattagttgagtattacatgtgggtccgggtggttagaaatctaattaagggaggttctgtagtctcgggtctatgacaagcgggccctaccgggtttaatggccggtttgaccctagtcaaaggagtcgggcccacctgtcatttgcccatatggaattcctttagaaagaaaagtaaaataaaagaaaagaaaataggaagaccccacctgtcagtcactatagcttgtggataaggttgtattataaataaatgaattaggaacagtaccatttcgcaattattagaattaattcaaattggaatctttacactagcataacttattcattttagctccgatttgagtgaaacttgaacctaaattaatctaaattcataagctttccaatggtatataattcactatttgataaaatatatttataattattaaataattaatatcaagatgatgcataatagttaacttaaaaatgtgctaataaataaaattgatattgtactgtaaagtagatgtgagaatatttgtctctagcatgtcttgacattgtagcaaacatgtaaattaattataattaatgtttcaaattaataggagcataggaaatattagtgccattaactaatagatgtccatatataattatacccataacgtccaaactatatataaataatgtttagcctcatattttgtgactaaaacatgaacacacgttgatgagtctttaacttgtttatgagaaataatagcagagcttgtatgattaaatcaccaatatgaaattaattaacgacatctcctatacagtagtatatgttttgggatggaaatcgacccttaagttgtataggcagtaactcactcataaatccacttaaaatcacatgtactatatagcttaaagtaaatagcagctgtttaaataaatgattcaatattaagatattgtgcactcacatatactgtacagtccattatagctatacgttgtagtattaaatcgcttgattgcatatattaaaattaaagaggatatatgacaaacatgtatggtggataaatactaattataaaccttgacctaatataacccaagttcaattgtagattaggattattcattgtaaaattatgtgatgggataatctgtaaccataatatgattaacctaaacaactctaacatacaaagcatggataaatattaaccttttataatttattgtgacaagtaaaataggttcataattaaagtaaagcctccatcaagtaaataataatacaaatgattcactgtaattatttgattgatcctaaatccattcgacaacagaacctctagtatatgaccattttgtttagataaatgcatgtgtagccataatccttccatagccatttgatagactaaaccaccgattagccaaatatatatgtatcccataaatgctatgttggttaactcctaaatagaccacgatgacaatagaaagattaagaaatcttagcccttagcatgattggaatccattagcaaacacgaatagtacattttgttgtgcatatttgattgttgtttgaatattggtttttctcgcgtattatagaccttgtgtatcggttagtcgtgaggcaacgtctgcaacttctaggaggtgaaggttgatcaagattatatcaataataagaattatcctgagcaggcaagtcatcactattctttgaacatgttgatcccaattgcgaaattattttgtttacaaataaaattgcatgcaatgatgaacatcctacttgtgattatgccatgccttgattattgtttaccccttatgccttcgtaaccatgtttacgtatgagtccctagtcaattatgacaattgcttagaaatgttattctagaatcatgcatactcatatttatcaaatgctatatgcttgggcaattacctttgggaaggtaattgagatgcggcatgtggagacatgagcgccacattgccatgatattgatgacatgatttgtgaaaggaaaataaagtaaaacaactgttttcgactggggcggctttgaggatttgggtggtgtccggaaaaggctagtgccgtccctggtcaattaaggaccgagccatgaagttaagcatgaaacgacccccgtacaaccgcacttctcgtatgggtatagacctagcggagtagatagctgagcggaggcagtatccatgcatagtggttttctttaggtgtgtgatgcggcaagcagtctgctggcggatgcccggttcgggtggccaggtagatggcggacgccgttccggatggtcagaggctggcttggcaatactacatgaggacacccataagagaacaatcatgatggactgggttcaacgacaagaagcaatgtaggaatgtgtgtgtttttcccttcccgggtgcgccagaactcctctcactgctagaaactgtgtacgcctagagtgcatgaggatgaaaagttcatggagcgggtactgccaatgcgaggttatcgaaaagctttgccgtgacgcgtctcatgtgttgggacgaggctcatgtgttgggcagtgtggagtgcgggtaaagtgtacatccactgcagtgtgagtaaaacaaatctattcgaatagccgtgctcgcggttattgagcaccgggacatgtattacacttggctagactctaaattcttaacttgtgtgggatgggatattgcatgatggattttatgctgatggagccacttcctgagaggagggaaggtggacgttctcagaaaaccatgacgactcaatggcgggaagctatccttgggattacaatggatggtggacagaaccgtcgttgtttaatgtgaacactggtattaaaacttgatcagtccatgctaggtcttaggcttgtgaaaagaattgcaaaactagctttatgcaaaaaaacctgaagccattccttgaaatacctcatatcatacgcattgttgttgtggtggcttgctgagtacggttggtactcacccttgctatttatatatcttttaggagagtgttgaagagaagcccttgtcggtacgcttgcgtatccaacaagatgatcagagtgcggtcttgttctaggtctcattccccagtcgactgcctgtggcatgttaaccgggcctttatattattttgtcttccgctgttgatctctgatagttgttggcctacctggccctaatgtaagtatttaactcttttagcctgaattcattcgtgatatgttgtgatccaactatgtatatgtgtaccaactactgatccagggattggtacggataaacacagaagatttccgatttccaaaattgggggtctacacctatcctacgacttatggaatatacagatacggtataccttcgcgcatacggttcgtttttgtacgcgttaaggaaatttatctctaattatggaaaatatctccacgagtcaagtgatttccaaagtcctactcggaggggataagatttctgttatatcgtaccagatccgatgtctccaggtttgacttggagatcaagatgatccacgctataaaagggatccctaggcgggggtggaggagatcgaccaaaaccgccaacacacccaccatagtttacgaagccggagtactcggagccaagtcgccgtgagatctcgtcgatcctcatcgattacgatctcgtcggaatcgtcagtttcgtctacttctttgtaatctgtggtattctcatataatcccatactaattggactagggctattacccatcgaggtgcctgaaccaatataatctttgtttcttttgcttgttcgatgtcgtacaacgcagatccctgttccaacgtaacccaatacccaaatcatccggtccgcgagtatcactcgtcgacaattatttttaatgttgtgtttcttttttcacacgcgataagaatttgttttttacttttttggtcgccgggccgaacccaccatgtatctgtctcccgatgcgttccctcctccaattgattgtaaaaattgattcctcactactccctcattatttttttcatgatttttccttttaattctgcttaatttatgtctggtcccaaaactaatgattcggtaaccgacatattaaaactgtatcaagccctggatcagtagattgatacaggttcaacaatctggatcttcattgcatatatttgatcaatgctccaaagaagatttctttacataaagtaatagggtatttacaagattgtggctaactattacagtagaagctataggatgagccaactctaatgttttgctatagacttaaaccatctatctaatctatacttgaaaactaggtttaaagggaactaacttatgtgattgaactcccggcttcgataagaactccaaaatgactctgaaaaaggtggggtaaagcaagggtgagtacaacgtactcagcaagctattatattaatcaacaatgaatgcatggaatggtaatatctgtgtagagctaggtttacttgcagaaagcaaagaatatagaggaagaaagcctgtaatgttttaaatgcaacaatatttaataaagtttggacttatgtttctaaccaaataccatatgagtgccaatgctcaaatccgtgagcacggctattcgaatagattcatttatactttactgtagtaaatgtacgctttacccacggcccacgacttgtcgataatcatcagctttagtcatagcccagcattaggttactaacaatagtggcacctgttccatgaactctagtccccatatgctctgaacgtaacgttatcagcagcgataggagttctggcgttcccggggtatttagagaggactgattgtatgacaccatgtcatcgcaattagggtttacaaacaagtcatatgacatcataatttatctcaaacaaatatttacttgcgcctcggtaaatatcacaattgccctgctcggcataagttttcctcctgcgcgnnnnnnnnnnnnnnnnnnnnnnnnnnnnnnnnnnnnnnnnnnnnnnnnnnnnnnnnnnnnnnnn

SEQ ID NO: 36902 - DNA, 1729 bp, Oryza sativa
  unsure (1)..(1729): unsure at all n locations
nnnnnnnnnnnnnnnnnnnnnnnnnnnnnnnnnnnnnnnnnnnnnnnnnnnnnnnnnnnnnnnnnnctgatatggagcttggaagacgagtggaatttgactagcaaggtattgactaggatttggttgtgtactagtcgatgctagagttgagtagcataacgactaggtttggtatcttctctagccgatgtcgacgaatatcaacacggctagaggaataggaagtttgtgtaggtttagcgggatggaagtattactccgacaaccgtgagtggcggcggagcggctaggatcacacggagcccgaatttgggttttgccgggctttacaactaattgttcgacgtcggggccagtagaccatacggacgtccacatagaaggtgcaaagttctaaccgacggattttattggctaaagggtattttgaaaataaaaggaaatatttgaaaggcaaatataagtttaactcaaatatttattaaaatggtatttgaataaattaaggaaattcaaataaaatcttaaaatagaaaatttggcatcaaaatgtagattttgaatttagatgaatttaggtccaaatttcatcggaatcggatctacggtttaggagatatgggcttctaaagaataggatttgaattaaataggaaaaagtgaaatagtactgtacagggcccacctgtcagtctttcttttcctttttcttttctccttcttccttcttctcgtcttcctcctctgtcacagggagacgagagagggattttggacaatttgccattcatttcgatgtagcattcccaaatgccatcttctcaaataacttggacaatttaccccaggtccccacaaaccagctctcctatgccattttacactcaatttcgggtcccatggctgccacatcaccaaccaaggtggcaatggaacacgaaatgtccatcttgcccctgcccctcctcaactgtcatgtttgtaacataaaaattacacaaaattgccactgacactaaaattgaacagctggtctcgtaggagcaccgttaacacatcctagccaaaatcccttgttcatgacatcccaagttcccaacccaaattgcacaacctgatcaaatatatcagccatattgcaccaaaattttataaattgagaaaaccacaacccaaaataccagccacaccaaaataacaagtattgggtttcaaatagcataggtttcaaatattgttttctgcattcccacatagcacgtctagtagcaagcatggctggccttaacattgttctttgctgccattaaatacataaataaccccatctttcttgagtccagttttttgtaacaaagagaaaaagacaacatcaattcttctgttctttcttcgaagtcaatttcttcttggttggtggtagtggttgtgatggagctgcttcagtcatagccaaacgcctccttgtcaccggtccaggtgaatcttgtgagcatccttctccagcaacagttggtgttctagctactcttgttgtttgactgaagaagagaaggggaaaacagatttatctcatacctcgttggccgttgcagtgctgccgccggtgaatcgacagcgccaccgccgccgcaggagtgagaccagaatgggacgagtgaaaatgagagtggagagggatctgtggttgaggctgtgttatgaatgagaggggcaggggcaaggg

SEQ ID NO: 36903 - DNA, 1762 bp, Oryza sativa
tgaatgagagggtcaggggcaagatgaacatttcgcattccattgccaccttggttggtgatggggtagccgtgggccctgaatttgggtgtaaaatggtagaggagagctgatttgtggggacctggggcaaattatctaagttatttgggaagatggcatttgagaatgctacatcaaagtgaatggcaaattgtccaaaatcccgacgagggaatagacaggagaaggcgagcgagacggcggcgcttcagtggccaggaggcgacgacgtcggtggtggattgtgttcccgagcgacgtgcacccggggagggtggtggtcggcagagggagtgggagaggaggccagaacggtggatggaagagctctactccggccggtgtagcagtgatggtggtggcttgattcaaaggggaaaagaagggggaaaggggtaaaatgggttctctgtcaggaatcacccaaccaatcggcgagccaaacacacgcgacactttggacgaacacctttgtggaacactgtacaccgtctgaaaacgcgaagaacagagcaaacataggagtttggcgctacgaactgcttgcagcttttcaggttttttcttctccttatttatagcaaatacaaggatgcaaagaagggaaacgtgtgcttcagaaacattcccacgtcgcggatttgatcgtgtccatccccacggatccgcagaacgcgtgcacgcccccgtcgccagcgccacgccgagctattctcgtgccatgacatctattcgcacggcttccacaaaccggggctcgcgcgcatgcaaaacagaaagagaaacatgcaaacacgcaaggtttatctactaacaaatctccccctaaaccttgcgtggagttttgatttcgatgaggccaatccgagaacgaagttcgatgaatctgtcgcgcccgagtgccttcgtcaggatgtccgccaactgcccgtcagtgccgatgaactcggccttcaccctgccctcctcgatgcattccctgatgtagtggtatcttgtgtctatatgtttgctgcgatcatggaagatagggttcttactgagcatgattgcggattggttgtcaatcttcaacgtgacggcgtcggcctcctctccccggagctcagcaaggagacgcgccagccacacgccttggcaggccaccgttgtcgctgcgatgtactcagcttcgcatgacgacaatgccacaaccttctgtttctgcgactgccaggtgattgggttgtcgccgaggaagaagaaaacgccggaggtgctcttgcgagtgtcgaggtcgccggcgagatcactgtcactgaagccgacgagacttgcagcctccttcttcctcatgtagtggcagccgtagccgatagtgctagcgatgtatcgcagcacacgcttcacggccgccaggtgttcgacggtgggtttctccatgaatctgctgacatagcccacatagtacgccaagtctggtctcaaattcaccagatagcgcaaagagcccacaattcgccgataatcagtggcatcaacagcaggagcagtacttgacttactcaatttcaggcgcgtctccatgggagtcaggcttggattgctcccggccatgccagccacctcaagaatcttctgagcgtaggcactctggcacaccgtgatcccgtcctcagactggttcacctccaagccgagatagtatttcaacagcccgagatcgctcatctgaaaagtg

SEQ ID NO: 36904 - DNA, 638 bp, Oryza sativa
gtaccctcacatgtgccacacaccggaacgcgcaggtggtgcacggccagtgggactccattccaaagctcgtatggggtcttgccaccaatgctcttggacgagctcctgttcaacagatacacagccgtgttcatcgcctccccccaaaacatacctaggagtcctttggccttaagcatgcttcgcgccgtgcccacaacggactggttccggcgttcgacgacgccgttttgttgcggcgagtagggagccgtcagctcgcgttgcaccccgagctccgcacaatactcggtgaagtggccgacggtgaactcgcccccgcgatcggtgcggagtgcccaaagcttgcggccgctcttgcgttcggccgccgcctgaacgcgcttgatggcagccggtgcaccgtctttggtggcgaggagcgtcagccacatgtagcggctgtagtcgtcgacgagcaggaggaagtagcggttgccgctgggtgtcgccggtgtgatcggaccacaaagatcgccatggatcagcgcgagcagctcagtggcgttgtggagtgcctcttgcgcgaagggggcacgccggtgcttgccggcgaggcacgcctcgcatacccgttcgacctgcgacaagacagg

SEQ ID NO: 36905 - DNA, 208 bp, Oryza sativa
cacctatttcccatggcatgctgagtactcctgtactcacccttgctctatataaataattccccccccagttgctgaagaagatgaagcggatcccgctgacgaggagttcttccaggagcaagccggctacgatgagttttagggtttcggcctagttcccaagtcgcgcctgtgttgtttggtccaagtcctggcttccgtttcc

SEQ ID NO: 36906 - DNA, 848 bp, Oryza sativa
aaattcggcccatcgaccctgggggagacaaaatagacttttgcgaaggaatttgatttgaaagcatttggattcggaattgaactcgacgatagatcggggatttgagatcttgagatggcacggacactagacaacaagcaaagaaccaaatttcgcaactagggtttttaagagataattttcccgctaggcgccacgacggaacgggcgctacacaacacgtcatcattaatatatgtcccatttctctctcacacataatccctctataaaaaaaatggggaagcaccggaagtatggtggagtccttggtgcctaactccacccaccagggttcaaatcgcacatgtagatgagcgtgtatcctctaagattgggtttttaggatagacgagtaatttattggacccgtgctcttatattttgaaatggaataatatattttataaaaactgcatatacttcatgtgtcccaaagaaaggcccctttggcatagctctagttcctaactctaatttacccggagccggagctgtgccaaacagttcagatcctccgtttttggaagtggagttagctaagctactcataaaaaataaaatacgggggtggagctaaatttttgctgcggcacagttccactccaatctaaaagacccactaccatttaatttttggggatatttagagtcgaactgcaggcatgcaaccccacctctcacctctctttccctgccataatcctcaccttttccacccggccaggcgcacaggcggcatagtcgacggcttggggtgcgcggtaggccacgggcggcgcacggttggtggggggacggcatgc

SEQ ID NO: 36907 - DNA, 693 bp, Oryza sativa
  unsure (1)..(693): unsure at all n locations
nnnnnnnnnnnnnnnnnnnnnnnnnnnnnnnnnnnnnnnnnnnnnnnnnnnnnnnnnnnnnnatatggaatgctaactgatgtaagaaagtacttaaccaccatccacttcaagaataagaatttatctttatcttatgtcaccccatatctgtatctcagtatcctgattttcttatagacattatattgaaccatagagactatatatagtgttgcctgtattatagaaatttataagttgactggcataaaacggtcttattttgagtagcgctggtaactaattatcccatgaaattgtgaatgcacccttaactgttacaagcacttcacttacagctcaattatcacacctcagccacaattacaagctaaattttgataatgttccgtacagtatgatgatgatgaaggtgatagggtgttgctcactacggatactgatcttaccggggctgtgctccatgctaaatcttctggattgaaggtttgtcttttctgtaatcctcaaatagattggtccctctgttttcacattgcgatctttttttgttcattggattatgactattgcttcaccggagtgaaattttcaatttcagtcattgaggttggacactgatgagtcaaaatccagttctgaggtgacaaaacacagttctgaagtaacaaagcacgcttcttgagtgac

SEQ ID NO: 36908 - DNA, 3250 bp, Oryza sativa
  unsure (1)..(3250): unsure at all n locations
nnnnnnnnnnnnnnnnnnnnnnnnnnnnnnnnnnnnnnnnnnnnnnnnnnnnnnnnnnnnnnaggatttcgaggatcaagctccagatctcgagcaaggcaagccacctttgaacatcttgagcctatatttgaaatttaattatgttgcttgaaaaatattatgcattgataggatcgcacttaatctgttgtcccgtctgcaaggcagatcggcggacctacctaatttgttgcatttgatccttcctttgctaattgatataccatgtccccttgtaaccatctagttgcgtcccgatattcgtgcaccctgtgcgagtatcgacggacgccttcaaacttaaaattctgagtaacttcttgggtaaaacttgggttttacaaaagacttggaaaacccgacacctgggtcggtgcttgcgaactaaatgaatttccaaaaccgcggaccggggaacgtaccgggtgtacggttttccgctcttgcacttaaggaccgtttccttggaatttcatccaaacataagacaagtacgaccacatgggtggaataggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggttgggtgatccgggttagtaatgtcgtgtgggtaaagtgtaccccctctgcagaggttaacaaactgttcgaacagccgtgcccacggtcatgggcggatgtgaggtgattcctagcgtagttttgcttgactactgcttgtgaaattgctgttgtggaaaggggttcgatgattgaaaaatctgtagctgatggaatcagctaggcccgggtggccgtttgaaagttgttggcccgggtggccgtttgaaaagctgttggccgggtgccaaccttgattcaaatctaaagactgatacattgcacatactccgaccggacgagacgcactgtctcatccgtgtcatttgagaagcgctcacttagttgatttcagaaaagagttcaaatgaaatcaattgcaaaaacaacagcctttccttgaagcctgcaataaacacctatttcccatggcatgctgagtactcctgtactcacccttgctctatataaataattccccccccagttgctgaagaagatgaagcggatcccgctgacgaggagttcttccaggagcaagccggctacgatgagttttagggtttcggcctagttcccaagtcgcgcctgtgttgtttggtccaagtcctggcttccgtttcccttttgtaatgcagttgtgagctcgggatctgtccgcagcccaacatgactgtacctctactctataataaagagacctctgttgctgtgataatctgtcttcctatgataccagcactgtttcctgggtctggtatcaatttacaggttaatttggagcgtcacgggctagttccggtcggtactagttcggggcgtgacaagagatggtattagagcacaggcttggccctagggcgaaacccgacgtttaggacgaccctaaggatactaagttcaaaactacttgcgaaaagctaaggtttcttttgttttctttatttccaatagtttgtttctaaaatggttactaatattttctccctctttcaaaattgtagatggcagtgaacgcaagcgtcagctcccacggttttggtgagggtcaccacgtcgctcagcttcgtgacctcgcccgtttccttggcttctcgtgtcccgagtacacggggtactccgtggaccgtgttccccctcgctgtgagctctctgtgtacctttacccccgtggaggtatacacggagctggccttcgcccacaccacttcactgtggccaggcccactctccagatcgcgtaccaggacctctcctggactgcgcttcgtcgcctggcccacgactacagccaccgtctcgggggctccgccttccggcagcttccacgccttccttctggccacgcagacgccaggtacccttgtccgtacagcgagtctcagccagtgctgactcgcatggttgagctttcggaggctcaggccactcagcacgacctactccttgaggcttaccgctcccttgcccgccgctacgccgctctggaggcccatatggccgaggagggtgtcacctcagttgacactgtctcttgggactcaggccgcctctgtcacgccagccacctgtcctcccacagctcccgcggctctgcccgcactcccagtggcccgcgctcccctagctcgcgtgcgccgtactcaccagtgtactccccctacccacacccagttagcccctcctacacccccggacacaccccagttgcttcctcccgccgtggcccacgctttatccgcaccgcgcggaagcgtgttgttggttcttccaccgtgttccgtttccactacccagctcccccaccgccagcggcctgtgctgctgccggccctcgacaggttccgccggtcccttcgcgtcagccgatcgacgtttcttcgactgaggagccgactacaggaggcagccaggctgacgaggagtagaggaggcagtcttcaacagccgtccgtgtgttaggcccttttgttccgccgccaactcttttggagtcgtggcgaggtagtgcgtgcgtgtgtttgttgtgggtgttgtttggtagtctggttctcctaggtggtgtgcgcacagtcaagctcggcgtagctctgtgacttgtccacacccgttgtatcaggtgtttttatgatttgaaaaatccagtttatgcctagtgtgtgctgtctgaggtgctatttactttgctccttgccctcctaagtgcttacctgattcttacctcgccctcttctgggagtttagatggctagccccccccccccccccccccgtgcagcccgtgcgccagcccgcttcggttttgaagaaggtagagttgtgacagaagcaaatcatgagtcagctaatgagcagtctcaccacagcaannnnnnnnnnnnnnnnnnnnnnnnnnnnnnnnnnnnnnnnnnnnnnnnnnnnnnnnnnnnnnnnnnnnn

SEQ ID NO: 36909 - DNA, 7384 bp, Oryza sativa
  unsure (1)..(7384): unsure at all n locations
nnnnnnnnnnnnnnnnnnnnnnnnnnnnnnnnnnnnnnnnnnnnnnnnnnnnnnntccccacccatgtggaaaacaacatgcagcacttaatggcagttcagatacaaatcttgcaaggattagccgcagccgtagccggttatcagcacaatgcgcatggaaatggccaccctcacatgggcaataatagatccaagctgacagattttctgaggtctcgtccgccagagttctctcagaccgtcgagcccgtcgaggctgacgattggctgaaagatgttgatagaaaactcaacttggtgcagtgtactccggttgagaagacgctctacgcctctcaccagctaagaggacctactgcagattggtgggagaattactgtaatgcataccctgaacccactaacattgcttgggatgagtttgctacggctttccgtgcagctcatgtgcctgaaagcaccattgacatgaagaaagaggaattcaacagacttaagcaaggcaacagcagtgtcaatgagtacctaagtatgttcaacaagttggctcggtacgcccctgaggaagtggacacagataagaagaagatcaggaaattcttgaaaggaatcgcggttggaatgagactccagttgcttgctcacgacttccccacttttcaacatatgatcaacaaggcacttctacttgaggatgccagaaaagaggctaccgaagaatacaagaaacgcaagtctaaccatcagggaaattcctcccgaggcgcacctcgccctcgctacggtcaacccatgcaataccaccagtcggtcactcaggctaaccgccagccaggctacgccccttgtcctcaaatgaaccgtccggcacctcagccacagcagcgtgcccctagtggcaatactgcgccaaacagtgttacctctttcaagtcaccgcaaggaccgtcagctgttcagtgtttccggtgcaaccagatgggccactatgccagacagtgccctcagaatcctaccaacaccagctcacggcatgctaatggcagcactgccagaactcctactccagcggcagctcagtctcgtcctagctctcaggcaagtggacaaggtacttgtgcttccaacaactttggtcgaggccgggtgaaccacattcaagctgagaccgctcaggatgctccagacgttgtgatgggtatgttctctgtcaactccgtacccgcaatagttctgtttgattcaggagcttcccattctttcatatcacaagcttttgtgaaaagaaatggttggaaaacccaaaatttacgtgtaccaatgatagtacattcccctgggaggaatataagggcaactcaaatatgcccggaagttaaccttagaattgaggaagttgacttcctagccaaaccgatagtcctagactcgcaaagcttggacatcatcctagggatggattggttggctaagcacaaaggacagatagattgtgccgaaaagtccatcaccttgcaaggacctggaggaaagcaagtccgttttacctctaacacccctaccgcaagtcggtctatcttaacctgtttacaagtcacctccttggagtcggtgcccgtagtctgtgaatatcccgacgtatttccagaagaattaacgagtatgccaccagaccgagagattgagttcgccatagaactggcaccaggcaccgcaccaattgcaaaaagaccctaccgaatggtagccaatgagctagcagaagttaaaagacaaatcgaagaattgaagagtaaaggttatgtgcgacctagctcatccccttggggagccccagtgcttctggttaagaagaaggatggctctgagagaatgataatcgactatagagccctgaatgaagtgactataaagaacaagtacccgttgccacggattgacgatttgttcgatcaacttaaaggagcaagagttttctcaaagattgacttaagatcaggttaccaccaattgaaaatcagatctgaagatatcccgaagactgctttctcaacgcgttatggtctatatgagttcacagtgatgtccttcggactcaccaatgccccagcattcttcatgaacttaatgaacaaaatctttatggaatagctggaccagtttgtcgtggtgttcatcgatgacatcctgatatactccaagaatgaggaagaacatgctgaacacctgaggctaataatggaaaagctcagggatcatcaactattcgctaaattctcgaaatgcgaattctggttagaccgagaagcattccttggacacgtgatctcctccaacggtgtcgatgtagatcccagcaaggttgaagctgtacttgcttggaacccgcccaagaacgtgttagagattcgcagcctccttggcttagctggatattatcgaagattcattgaaggattctctaagctagtcagacctatgaccgagctgttaaagaaggaaaagaagtttcactggtctgcagcctgtgaagacagctttcaagaaatgaagaaaaggttgaccactgccccagttctcaccttgccagatatccgaaaagatttcgagatcttctgtgatgcatcaagacaaggcttaggatgtgtcctaatgcaagaacgaaaggttgtggcctatgcattcaggcagctcaggcctcatgaagtcaactatcccacccatgatctcgagttggcagccgtgtttcatgctcttaagatctggaggcactatttaatcgggaacagatgtgaagtatacactgatcacaaaagtcttaagtatatcttcactcagaccaaattaaatatgaggcagagaagatggttggaactaatcaaggattacgatcttggaattcattaccaccccggtaaagctaatgtggtcgctgatgcgctaagtcgcaaggcctattgcaatgtagctcaaatacggcctgaccaagatcgcctgtgcagagaattggagaagttgaggctgaccgtggtacagtcaggtgtccctgccagcttgacagtacagcctaccctagagtcgcaaatccgggaagctcagaaagacgacgaagggataaaagagttaataaaaagaatacaggagaagaaagacaccaatttctccatagacgatcaaggcacagtttggtgcggtccacgcatctgtgtaccggccaagaaggaattaagagatctcatcctaaaggaagctcatgagtccgcctactccattcatccaggaagtacgaagatgtaccaagatatcaaggcatacttctggtggactggaatgaagcgagatgtcgcagaatacgtagccttgtgtgacatttgccaaagagtcaaggcagagcaccagaggccagctggtctgctacagcccctaccaattcccgagtggaaatgggaagaaatcggaatgtatttcatcaccggtttgccaagaacccctagcgggtacgactccatctgggtaatcgtggatcgactcacgaaatcggctcatttcgtgccagtgaaaaccatctttgatggaaagaaactagcagaactctacatgacccatgtcgtatgtagatttggctgtcccaagaagatcgtgtcagaccgaggcactcagttcacctcaaggttctggaaacagttgcatgaagctctcggaaccgatctaaattttagtacagcctaccatccgcagaccgatggtcagaccgaaagggtaaaccaaatcctagaagacatgctacgtgcgtgtgccctggatttcgaaggcacttgggatcgttgtttgccgtatgctgagttctcatacaacaacagttaccaggccagtattcagatgtcgccgaatgaggcaatgttcggaagaaagtgccgcacccccttgtgctggaatgaggtgggcgaagcgctggtattcggtcctgacatactcaaggcagcagaagaacaagttaagctgatccgagaacgtttaaagacagcgcagaaccgccaaaagaattacgctgacaatcggaggcgtgaccttgagttcgaaaaaggagatcatgtgtacctgcgggtatcacctctccgtggtatgaggaggtttgggatgtccggcaagttagcaccccgctacatcggcccctaccttataaccgccagacgtggcgaagtggcttaccagcttgagttacctgaaggtctcgcagatgtgcacaacgtgttccacgtatcccagttaaagaaatgtcttcgagttccagaagaacaagtccccctgggtaacatcgagctggaaaagaatctgacctacaaggaaagaccgatcaaggttcttgaagaggcagtacgtcagactcgaaggaagaccattaagttctacaaagtccaatggagcaaccactctgaagatgaggcaacctgggagcgagaagatcttctccgcgccgagttcccggagctgctcccttaggtgctgaatctcggggtcgagattcttgttaggggggttggtctgtaacgcccgttccgtcgtggcgcctagcgggaaaattatctcttaaaaaccctagttgcgaaatttgtttctttgcttgttgtctagtgtccgtgccatctcaagatctcaaatccccgatctatcgtcgagttcaattccgaatccaaatccttccaaatcaaattcctccgcaaaagtctattttgtctcccccagggtcgatgggccgaatttctctcggcccatctccccccttcctcccggctatctctctcgctctctctctctctctctctccccctccccctccgctccgcccgcgcgccgcgcgcgcgtgcgcgtgagccgccgagccgagccctcctctttgctccctcgctgccgctccccgcgcgtcgttcgcgcgcgcgcccgcgtggtcgtcgcccgcgtcgcgcctacgccgtctgcgccgcccggccccgctgctctgccgcgcctgcagccgctcggccccacagccagcgcgcgtgcccgagccgcgccgctcaatccgccgcgcctcccattgcatcccgcgcgcgcgtgccgtggtggccgaccgcctggtcaccgtcgccatcaccctctgccgcgccagcccgcacctgtcgcccgtgtcgccgctccgctccaaaccgtcccgccgtcatcgccgtcgtcatcgcctcggccccgccactccgcgcgcaagccgccaagggacggaggcagagcccctcctccctctgccgcgacgccccgctcccctcctccttttcccaaagcggcaaggaggcaaacccctttctctccctccttttcccctttttctcccgccggcgttatcctccctccgtcctgtcgccgatttggccgcgagcgccgagcgccagctcgcgccttgaccgcccaaagtcggtttccaaaccgacattgccgcccttaaagccccaggcgccctcccttcctctttccccccccaatcctccccgtttctcgtccgcgccattgccgccgcctcccgtgctctgtctcgcctccgccgttcatcgccgagcgccgggagagccggtgcgttcgaggacgcgaaaggggactccgggcgctcgtcttcttcctcttccccggcccgaggccggagagattactcccgcgccgtcggcctctcgtcactgcgccccgcccgcacggtagtgcctccctccgttcttcctcctcggtccatctcccccccttagttttcggtggtagcatgagtagcctccccgtagctagccggcgccgccccgaccgttgccgtcgctcgccgtgtgctccccgccgtcgctgcccgagctccgtagcacccgctcgtcgccggcctcgctcggcgtagctccgcccaatccgacgctagcatcggattcccgtagccgcgtagatgctctcgccgccgggaattggcccctcgtgacctcgtcgccgtttcccccttttccctccgccgggcgccgccgccgcaatccgccgccgacggactccctccggcgaatccaagccgttggctcgctcgctcttattctccctcgtcatcccggtgtacgccccgtcgcccctcatcgtcgcaaggcgtcccggagaaaccgccgccgcccgcggtccattcgcggccggcgccttcgtcttcctcccgccagcccgcgtggcagcgcacgtaggcgccagctcggccgggtcgagccgaccccggtcagcccctccccgtgcgcgcgttccaccgcgagccgtgaggctgcgcgtgggcccgccgcatccgcatccaccgcgaatcgtgcgcgtgcaccgcgtccctcccccgcccgcgcgcgtgcgccgcgtgctcgctccgcacggtgaaccgtgtcaccgacaagcgggtcccacccgggaccacacgtggtgagcccggttcaccggctctctctctcctccctcccgcgcgcgcgcgccttgggccgccttgggccggccggcccatttagctcggccggaccgctccatttctctcgggccgcgccctagccgcccgagaaaagtctattgtccctccctcttttcttttcttttcttttcttttctaaaaaggatttaattaaatccttttcctttagaccaaaaatccaataatcttagaaattcaatatccttccaaccgtaagtccgtttgactccgttcaacttccaaaattcctcaaatctcgagatctatctaatggcacgcttagaggtcattaatagggctttattttcgccgtttgttgagttgtcccgtttcgcgtgtagtttcggagcccgaagacccgcagtgcgaggatttcgaggatcaagctccagatctcgagcaaggcaagccacctttgaacatcttgagcctatatttgaaatttaattatgttgcttgaaaaatattatgcattgataggatcgcacttaatctgttgtcccgtctgcaaggcagatcggcggacctacctaatttgttgcatttgatccttcctttgctaattgatataccatgttcccttgtaaccatctagttgcgtcccgatattcgtgcaccctgtgcgagtatcgacggacgccttcaaacttaaaattctgagtaacttcttgggtaaaacttgggttttacaaaagacttggaaaacccgacacctgggtcggtgcttgcgaactaaataaatttccaaaaccgcggaccggggaacgtaccgggtgtacggttttccgctcttgcacttaaggaccgtttccttggaatttcatccaaacataagacaagtacgaccacatgggtggaatgggacacccctggctgagtaactagcttatcagg

SEQ ID NO: 36910 - DNA, 13959 bp, Oryza sativa
  unsure (1)..(13959): unsure at all n locations
nnnnnnnnnnnnnnnnnnnnnnnnnnnnnnnnnnnnnnnnnnnnnnnnnnnnnnnnnnnnnnnnnntgattcctagcgtagttttgcttgactactgcttgtgaaattgctgttgtggaaaggggttcgatgattgaaaaatctgtagctgatggaatcagctaggcccgggtggccgtttgaaagttgttggcccgggtggccgtttgaaaagctgttggccgggtgccaaccttgattcaaatctaaagactgatacattgcacatactccgaccggacgagacgcactgtctcatccgtgtcgtttgagaagcactcacttagttgatttcagaaaagagttcaaatgaaatcaattgcaaaaacaacagcctttccttgaagcctgcaataaacacctatttcccatggcatgctgagtactcctgtactcacccttgctctatataaataattcccccccagttgctgaagaagatgaagcagatcccgctgacgaggagttcttccaggagtaagccggctacgatgagttttagggtttcggcctagttcccaagtcgcgcctgtgttgtttggtccaagtcctggcttccgtttcccttttgtaatgcagttgtgagctcgggatctgtccgcagcccaacatgactgtacctctactctataataaagagacctctgttgctgtgataatctgtcttcctgtgataccagcactatttcctgggactgatatcgatttacaggttaatttggagcgtcacgggctagttccggtcggtactatgttgtttatatatctataactaactattttatggatgggttattatattgcctatggatgatatgtatgaacttttgaagttagccgttggctatattattaaacttactctaagtatttctaggtttttcttagcaaaattaagttagtgggaaaatattcccttttactagttaccttagtggtcaaattttgaattgtttgtatttttttctcaagcatttgattggctaaaaatgtactatagattttcatgcattaaaatcaatgctatagaaaatactactatatatctgaatatacaaattttgaattctattccataaatggttagagcaggttcaatagcagactataagccagctataaacgtattttaaagtgataaaagaggagaaataagagcagtatgctacagatttatagccagctgtaacacgtactccaagatatgtgtgtatgacaggtgagactaaacattaattatgtagtatatgtttataggtaattattatatcaattggttattaaattgactatagataatttgaagtcagtagttggctatacgttagtataaagagagtactactagtacaaagttttaaaaggttcagagtaggaatacactcctcctagtatcaatcaataatgttgaggcctggtttaggccgagtttagttctaaaatttttttttcaaacttttaacttttctatcatatcaaaacttttctacacacacaaacttccaacttttccatcacatcgttccaattttaaccaaactttcaattttgacgtgaactaaacacacccttagttcccaactttttattcaaacttccaacttttctatcacatcaaaactttcctacacataaaatttcacctttttcatcatatcgttccaatttcaaccaaacttctaattattttagcgtgaactaaacacaccctcctaagtagagaaccgtatttatgtaccctcctcaagtagtatgcatcagctcaagctgcacgaacactgaccagtccgtttttttttactgtcagtacacaggacatcccgatcccggggtacaaaaacagttgtccactgtcacccttgccccagccatcaatctgtgtctggacctgatcctagtacaaattttggtaccctaaacattattactgcattcaaccttgcaaaatactagtatgcccatactgtactggattgccattgtacacaaacaatgcaacaccctcggcctaaacctttgcaatctccaggcgatttgctgctattgcaatactagtactgcattgctgggccttgctgccgctgcatgtgtgaccctggttcactgcaccgggggacatgtatatgattatctagtacttgattgtagaaaagtgataaaaaattaaagaaatgatacaagcagtataatagaataaagttttttttgaaaaatattttttaaaagtgaaacaaataatctattttaataatctagtaaaataagctgaaaagaacatgaccttagggctctattggagccgaacaattttacgagaactttgtaggaaacaaactgttttctatgaaaattctgtaaaatttccgtgttccaaataagcccaaattttgtcacttacttatactgaaacttcactatactgcttatcacagttcaaaagtccctcctgattaacagcgatcaaactaactgctccatataatgtagtagtaaccttgaagcaggttactagacaagcaaaagcaactccaatttaatttgtccacaggaacacctttttactgaacaatgaggactgctgctatgtagtactcctacttgtctgacagagagacagaaaggaacagttggtaattaacctgtgttgacaacacaacgcaaaattgacgacggcaccacctttttgcactcctcaaacagtcgccgcattcaattaattaagataacattactacaattaattttggtaattaagctactattataataccaggttagctgtaagatgaagcttacaagatactaaaagaataactgattctcaaccaagacttcatgccaaactaaatacgcacttctctgaagacaaatactaccagatgatggcatcatcacaccaatctgaaaaactacctttgaagctacgtacaacaacaatggcttccaaagacaaaagagaaaggattaatcatgagattccaagctacagccacgagtacattcctatcaggtgtccctgacacacgatctaaatggattaattatgcaaagatgacaagacatcacatacataaaagctaacagaaaaaagataaaggtttcacttccattgcatgcaagccatgaaaagtaaatagacacctcaactcttttaatcctttttatttgtactatgaaaacgattgtgcaatagataaatttatatataattcattatcattatcaatccatcacacgctaaaaggactggaggcccctctaacggggacacaaaaacttttggaaaaagaaaggagaatggataaataaaggtggcatgcacctttggatggtgagcaccttaaaattgagggattaccggtttactcacgactatttgtcttgtccttctaacaatatcgaatatgttttgtcttttgttaatgaatgtatcggccaatctagttttgttttcatgcgatttatatttcaatttacctcttgctgagacaaagtgtgaaaaccagagagagatatactatatccggtcatattctattatattccctccgtctcattttaaccgcagttatgaatttctatgtccaacatttaaccgtctgttttattttaaaaaattaaaacctatatatcaagagaagctcaaaattgttaatgtgacttagtggttcccattgaatttggactctatatctacctgggtgaaaactcaacttatatataaatttgtttgcggtaataatttgtttgaaatttattatttttatatctcacaaataaagttgaggttagataatattttttataatattgtgtaacatcaacttatctatatgtgcgattctttttataatttaggtgaccttttagttaggatttccaacggatatttaccctattttacctttacatttacatgttatctcccctctctatctctctctctacttagaaatgcagaactacaaatctcgaaacatggccggttactaccggtatttgtgcttatttcgtttcatggaagcgagcatctgtcttgtgtcctatgcctcctgtctagcacatatatatgttgccctttgcaaaggaaagtttgtttaaattcttttctgctctcgagaaaggattcaaagtaaaatccaaagtaggttcccttctaggggtccatacgggacggaaacaaaatgatatgtatttttcattctcgaaaagagaaaactaaagaatttgagtttctactctagcattggatacccgtaggaacatgacaagttttgggtttgatgcatgttggagcattttgtagtattgtactcctagctactccctccgtcccataaaaaactaacttctggctacgaacctagacgtagtgtgtgtccagattcataaccagaagttgattttttctgggacggagggagtagctaagagcgctactatgtatcatttggctagtacaaatgtcaaagggttggctccacatttcatggcgaaattaaaacactatccctattatccgaaggtcatagtatttgtcgatgacatgggaccgggagtatcatgactagaggcttgggcaggagcaatcacccacgtggcctgaccccctcggggggtcgggcccgagggtgatgtgaccgcccctctctttgtctccccgagggatcggaccgctcccgtttcggccccgagggccgaggcgcgccccgaccccttgtgggttttgcgtcgcgtatgggttaggtgagcacagcggggctcacctaaccgcatttattgtggtttgaacgagcgcgtcacgccgcatgtaacgcagtgcagcgcgctcgtttatccggtctgtgaccggtcacagaccgatcagatcgcgggttaggtggcaacaggcggtctgacacacgcctcgccccatcccgtcaggatgagagcctccaggcactcgtccctagccggagccagcgtgctagctcctgaagatggcacgttggtcccggtcagatatatgccaggcttcatcccaaccattacaagcaagacattgtatgaagaaggacgaacatgcagattgataaactgacgcgtggtggacaagaatgaccgatttgtgaccggtctgaccctggtcatgtcgtcggcagacagccatgatcccacgttgcacctgcttccggcggagtagaggtaggtatgggccatcccatcagaaggtcattcggacggcaaccattgcaaatctccgcccattgatgaaggaagggcgggccaagttttagtaaaaagaggatgggtccccatcgaaaggagaaataggtagaagtggtgcatgtggtatccccttgagatataaaaggaggacctagcccacttaggagggggatcagaggttggagactcccggagaatccaggagaagatcccacgagaggcaaaaagaaggaagagggtttctagagtttgatccctcttgctctccagctctttgtagcttcttcatacacagatccaccataacacaggagtagggtattacgcttctcagcagcccgaacctgtatacatcgcccgtgtcttgtgcgtttccactttcgcgaacattccacagaccaggagcttagaacctcacccagggcccccggccgaaccggcaaagggggacctgcgcggtctcccggtgaggagccccacgctccgtcagtattattcgagataatctgatctatttatctatttatttttggtcttataaggcgttcatgtacatattatttcacccctcaaactttagtttgatttgtaagttacatcctattattactcccaaattgttatatgaaattaaagtaccttttgttcaacataattcgataactgtggacaatatccaaactcctctagaaaaagaagtacggtgcgatggtggtgaatttggcatgtcaccacataatccttccatatatattgttctttttaatcacagtttagaacaaaaatacaacttttattggaaaattgattctagtcacaagtcacaagggcatcaagcaactacatagacagatgccatcaatcacaacacccaattagtccatccatgtatcttctcaaatatgcaattgccccttatgtttttgtaccagcataacgtacaacagttcatatctcacttctgtagttctgttggagaaaaggtagcaaaaggtagatctattattggttaatcaatgcatcaattatagagtactaagatgttgcagtaaacttttttgggcaatcaagatgttgtaataatgaatcactacgtactgtactattctttttgtgtggtgagcaaggttaataaaagtagaggtgattgatatatctaattttatccacataatctctcattagtaattaggagacagcatacatagtatattacctctatcacactaatattattttattcatttgctcccaatctactagtaggtctcttgtgagaggtagcagctcatcctcacttctgtgagttctctcttcacctcataattcaaacttacataaacattcttatggctagcaattcaacgcgtattttacttgctctttaacccatataacactggcaaccctcctggaattaccactaatcccaactttaggctggcttatggaaatgtagcctcattatgagaaaaccaactacttgcgccgttaaattttgataaaaactacattgaatttatttttcttccaggagacgaatgattatgtcggcattagccatttattccgatttatgatagattcagctatcctgatgaaacatgatgtggctgataaagaaagaaagaagggaaaaaaaagaaaaaaaaagaaaaggagatcaacgaattattgttagttaaatctaagaaggaagatctaatgttgttttcagggattaaaaaagaggaaaaaatggtcaacacaccattaaagtgaccaaagaagaaatgctggcgagttgctacatagctttcagaacagatagaaataagtggcaacgcatcatttagtctagaggtgcaacaaggtaaagaaaaatgttgcacaaacacattttcctgagctaaattttgcagcagcaaactgagactgatgaatggagcaaaatcctatcataacttcttatcagccacatcatgcataaagtatttccaggctcgaagagatgaagataacaaaaaaaaggacattaattctttctcacattaataaagaatgattatactgcatatattaattctttctcacattagtaaagaatgatcatacattgttgtattcttcatatcatttcttgccttcttgggttctgtcagggaagaatccactagattcgtggtgaccagtaattcataatttcatatagcaattatgcataacatgcatttcactacatctgtgaaaaatctgcatgcaaaaacaaaaatggagcaataccatattttgttagttccacttccagcccagttcctcagttcctgagaaaacctgagactgtcagttgattgcttttaggtccttgactccatgtacgccgtactttatcgtcgatgtccatctgtctcttcactcttaatctgttgataagctaagaagttcaatcgtgctgtttatattttaaattagagccatgtgtggaaaatttatctcagacaatcacactttagagcgtctcaagtaaatcatcaccacaacccctgttagaacaactgcacctgccatcaggccataatgagcaggggtcaactgacttgtgtgtgaagatgtcaactctggaggttgctttgtcacttcagaagtgtgctttgtcacttcagaagcgtgctttgttacttcagaactgtgttttgtcacctcagaactggaatttgactcatcagtgtacaacctcaatgactgaaattgaaaatttcactccggtgaagcaatagtcataatccaatgaacaaaaaaagaacgcaatgtgaaaacagagggaccaatctatttgaggattacagaaaagacaaaccttcaatccagaagatttagcatggagcacagccccggtaagatcagtatccgtagtgagcaacaccctatcaccttcatcatcatcatactgtacggaacattatcaaaatttagcttgtaattgtggctgaggtgtgataattgagctgtaagtgaagtgcttgtaacagttaagggtgcattcacaatttcatgggataattagttaccagcgctactcaaaataagaccgctttatgccagtcaacttataaatttctataatacaggcaacactatatatagtctctatggtcaatataatgtctataagaaatcaggatactgagatacagatatggggtgacataagataaagataaattcttattcttgaagtggatggtggttaagtactttcttacatcagttagcattccatataaaacaacagaacttcttgaacgatgatcagactgacaacctttttttttttttttgcttccaaacactaacgaaatacataaaataagggacaacaaattaccaaaagttgaactgtgcccttttcgccatcaatgcctaatctttgcaccacagaagacaccagctcatgtaaactctctgaacctgcagagacggaacaaaccaaactgttagttagagcagtacaaccatagtttaacattcaaccaacttgtaacacctaccacatgcaaatctatgcatacgtcccttctggtcctcaatcttaaagacaaatgaattgccaacaacaggaggattaatgctactcctgccatctccagcctctgatggcatgagcaaagatatttcactgaacaatgcaaaaatgcaggtaagaattgcaaatttgaaaaagaggacaaaggacaaaaaaggaagcgttaattaacctgcgactatcaaattcctcatctgggggctccaaagcaagagctgagtcccaaaacttttgcattattgtgtttgccacaccattcgtggtctcaggacctccttcaaccttcacacagaatgatgttagatgaacggaaaccataaggaaaaagcaaggaatgagaagcgaaaaaatacgcatgtgcagagagaccattgaaatggctgcatgggtaatctgcagaacatccaagcaagcaacaactctcccttctgttcatttttaaaattaaaaagttcagtcagatataaaatactagtaccataaagagaaaccttaggctgaagaagagtcaagtgttacctccatcaacaacaggaatatgcaagaatttgccatcgcgcataatatgcagagcatcgagaattgatgtgtctaatgtagcacattcagggtgtgcagtcattaccttgagcaaaacagtgagtaatgctgttagtctagaatgaattgtataacccatcggtagtttaaatcatttaaaataatattcaatctggagaaacaaccttttctacatgagttaactcaggagagagattttgtgtcacaacgcgcataagcacatcctttgagctgaatttcacaatgacatagccattagtgccttaagaaatataaaataatataaactctagaataaagaattattccataaaagtattgaaatgcttacgtaaaaatcccttgcaatgaatttcctgcagtgataaccactgagttaacccgtaattcatgcatttttcgtgctgctacacaaacaggatcccatggtgaaacaattgctactctgcaagttaaaaaagaggtaactcccatgattcaaaccacattatgttggatgatccattttataccaccaagtttcattcagtgtctacaatatactactgatgtctcactgcccacatggccacatgtcatcctcacagtgagtggtctactatggatatgaataaaactcagtggcatggtgtggatttatcccaaaaatggaatactaataaaaatttcatgtactttgtgttctccgagataatggttgacaatgaaggtttaagcatcctttctcttagagtttctattacactggaatgatctgcaaatggtaaacacagtaatttggtcagctaaacaagaccagaaaacagtggttaagtgaaatctatttagaaaataatgtacaaatgtatacagtaaagcatcaaacatcaaacatagttccaatcctgagaatcatctcattattctttgggataaactgggtattacaaattgctcataacctagttcacatggctactgactgcagtatacattttctgttcttgtgtagcaatgaacatttagagtgaaacaaaggaaaataactagtcagcacaatatgcaacagaaaacctggcaagttgtctcccacttgacgctcaaccccttctacagcagctgctaatgcacttccctgttctgctgccttttccagtcttgatattgcatcatagaggcattttgcaatgtctagcatggcaataacctcaccattttccaccactgggaggtgcctaaattttcctaaaacgtgagtgtttcatattagctctaaggagaggaaaatgaacatacttggaatacggagagacagtatataaaacaattggaatgatgagcccatgttattaaaataagaaacaaactttctaacaatgaccattgatttcatagcatagctgttactgctttattaacaagtgaataatgctttcttaatatgcatacaggtcattgggattgtagaatgctgatgttcagaggttaaagatatgcagttgtcctatagtaaattaaatttagccaatgagactctcaatactggaagaatgtctagaaattagaaagttcctctgaaattaatttagattattgctaaaaggaaatgcaacaaacttgaaaagacaaactgatgaatgcataaaagactgcaagaaaagagaaaaaaaaatggaagtactcaaatagtttaatagtcttgaccgaatagattttcaaagagattatactgtaaacagggaaagagaatgctgattgaagcttctcagaaatacaaaaatagtgataattttaaacaatatggctagtccaacattgtcaacaaggatttactgatcacaacattattatccaaaacattctcacaataagtagctacaacaaagataactaatgcatatgaaatatactccacagcagcttgtaggagttaaaggaagtgagttcaattgacccaagtccgaagtatctgaaccaaacaggcagatcactgggtctatgctttaagattacaagataccttggaccattttctgcagtgcttcaatagcaagtgtgtcagacatgacataaacaggagttcgtgtcatgatcttggaggtgattgtttgctcaacccgcaacccctctgcaatcacccttttagctatgtcctgtatccaaattaagcaaataagaaacgaaacgataaagaatctccttatctcctttaagctagaagtaccagccatgtcctatatcccaattatgcaaataagggcgaaaagataaagcatctactttaagctttaagtaccataagcataagatactttggcatgtacttatagtattaaatcattgctgtgatttgtacaaacttacagtcgaacacataacataggcacccgcaaagaaaaaagaaaaaaagaaaacacaacatggttgggccgcagtcgaatacataagaagcaaaatacataaataacaattgattcatggagcattagtcaaagtatttaaactctcaacgattcattattgaacaagtcagatgtggcaaagaggagttgtgcagtcctaagaaaaagttgcaataacataaagcgtccatctttaagaaatctaggcacttgatgtagacacaagcaaaactctatatggagtttcgtagagtacaattataccaaaacccacttattagccaatcgcaaccacctccagcttagaaaacacatcacagattgatttgaaaaataaaataagaagaggaaaattactttatcggtgacgatgccggagagtaatccgttggcgtccgtgagcagcacggcgtccaccctcctcgccgccatccgctggcaagcctccgccaccgtcgtcccctccgggatcgtcaccgccttcgtcagccgcagcttcttcaccgtcctctcccctctgaagaaaaagaagaaaaaaaaatccaatctctgtaaggatcaaaggcggcgaggagagagagagagagaggcaatcttggtacgcggcgtggctgggggagggcgtggcttcggcggtggagatagcggcgaccgcggcggcgggatcatcggacttctgggaggaggccaccgacggcgggcggctgcgggtgcggcggttcagcgccacgccggcggcactcatggcttcgtccgccgccgcctccgctgctccggaatcagcgatgtagttggcagtgggcggagagagggatcgtcggcggcggtggcggccgccggaaaaattggagggggggagaggtggccggttcgactgggctcccacacgccacgattgatgaataccccacgtgggagttttttcacatcgatctcttgatgacgtgtcaatgtcaggtgggtcccacacatgcacttgatgggaactaataaccagatggaaaaagtccactttgaccgaatctaatagccgaatctaattcgtacccctcaactaaaaaaggggataggacgactcctcgaactattgaaaaatcagtgtaatttaactcctccaagacagttaagtacaaattgcggagattcgcacccgatcggaaacaggccatacgagaagaactcgacaaacttctcaaagctggtttcatcagagaagtcatcaatccagagtggctcaccactccagtaatggtacgcaaagccaacagaaagtggaagttgtgtgtcaacttcaccgacctcaacaagacgtgtcccaaggactacttcattctttccttgaatagaccaatcggtagattcaaaagccagttgtgagctcttaagttttcctaatgcttactccggctaccaccagatcagcatggcaaaggaggacgaggagaaaacagcgttcatcacaccctttagtgtgttctgttatatgaagatgccgtttggattaataagtgcaggcaacacataccagcgcgggatccaaggagcacttggcgatcagcttggacgaaacgtcgaagcatatgtggacgacatcatcgtcaagatcaagacaggcgaataactgatcgatgacctaagggaaacgttcgacaacctctgaaaaaaaaagatattcgaagtcatactttagtatgatttatcactcacctgtagtcattgttaagaaccttcggttttcttagaaagcggaagaaactaatattctgatgtgctcagattcatatgtgacgggtgattagagaaggttctagttttagcaggattgagatcaaatgcagtagctactaggactgcacggtaactactgcacacaatctgagccctctatgtcaaaatctaacggccaaaacggatttggcacagtaaaatcagaacagtacctttccatcactacagtgttttgctacagtgctcggatatatctgggacgtccattttaaatcatgcgatgctagtttgactgcttattttgcagtcccactggctactgcacctgaatcggatccgttttagcatgcaatatgtaaaagtgaaaagaaaatgaaatagtgctttgttttataagctctttattggttggtagatatgctgcttaaataaaattgttacggtggtaatatactacctccgtcccaaaataagtgcagg

SEQ ID NO: 36911 - DNA, 6988 bp, Oryza sativa
aaaaaatttaataagcgttagattaactgcaggccccgccgacccactcattgatttttgcagaaatcccctcattatttcggtatttccagtcgagtccactgaatcagagccgttcaaccccacgcgtggacacaatctgaccattcgtctcctatctagatggctccgtccttacctacccgtggaatcggtcgtcgctcatctccccacgttgcatcccgtcatccccatcgagcgatccccttcctcctgatttctgtctagaggcggcatcgatgctcctcgcctcctccaagatcttccatcgtaggtcgtcacccacgacggcttgccatctgctatcccgtgcccagatgttggatgcatgatctcctccgtcggcacaatccgtgtagccgcatccatcggcgttcgtctccccgtacggtggcgaccggattggccactgaccagtgcctcatctccgtacacgggagtggggttttcttctgttcaagctccctcctcggctgctccgttcatcttctctggatttctctggtgagtctgctacattctttgccttcttttatccccttccttcacccttctctggtcaactacatcagtggctgcaagcctgcaagatggagctgagttgggaggctgagcaagcagcaacaggaggaatcaaggaacaagggggaaaatgtgagggaggaggaaactgggatacctaagtaatttgctaatgcgtttttaggctacctattccaatccctcatcgtatggtgtacattcagattcagatatgattggcttgatatttaggaggtaggttcgtgctttgtcctaatttcagttatttgtttttattttcacaaaattgttcaatttggatatacctaactttttcagtctttagaggccaaatcaaggaatgcaaataactatagagttgtacagggttccttaagccctctattaaggtaaagaacatggaaatctaccaagtagaatagaagttatcacaatctgaactctgttgtattgcagttcaaccataactcgagctgtcaacttgcaagggttttcatcctgtctatatggtcaaatattgccactctgtaactaaatgttgtaaggtatgtgatcctcaatccaatgtttgcgtattaatttacttattgtatcaagcttttctattaacagagttgtggtttcttgtttttcttgttctgtatatattgcaattcaatatttttatatcagctactggatgacaatgattttcgaaaactgacatggcacctcacttggtcgcattaacgaatctagagtcatgttctacttaatttcagcgatatgtgcagttcattatgattttctctaatatatgatgtgtctcagcctgtgagatagttgccagacacttataatcggtaggtcatccaagatacaagtacaaagcaagagatattcatcaaagggtacacaacaattttgtaggtaagtggctttcagttttgttgtaaaaaaaacttatgggaaattttagatgtgctactttattcgctgaagtgttatctgtatagattagtttcacctcattatacacgagttcatgcaggaccaacacaaattattgccatgcattctctatattcttcactgtgtatgatacataacgatataagtgatatgatggcattaaactattgagaactgcggtttggtattatgtgccagattacccatttcaaaattatacaaatgaaacatcctattgcaatagctattgttcggctttaaatatctgaagaggattttaccaaattgttctttcgtccaggacagccatggtatctgattattctcaattgttcttgatcttcagacaagtgaaaaatcgttggtcagtttgaaggaacaaatttcctcttgcaaaatacctattcctgtctagagggccaatgcactatcctcagctcaggaaaacataatggatgaagctgtcaattgttccactgagaaacaaacacaagataagataatagtgaacattcatactgcattgatctctgctctgagttctgagcaagaggtaaaccttatgaactttcttatttgatttatttctgagatgtgcttattaaatttttgcatggtggcattagtaatgttatatggactatcaggtcaatcttgacgcttcttgaattgaatcaatgcaaaaaaaacacgataattatttttgccctttgtatcatggagaattagtagacattttatgttcagatattatagtcatatgtgtttacttaaaagccgtgggattggttgaaggttagggccgccacgtcagcaaattttacaaaaaagaccctgtgtttttgttaattacatactggttcccaccaacatcgtccgttcgatctcgcggtagagccgatctaaccgtccacgtgtccactgtggcggccctttctcagccgtgggatcgtcgaattggcaatcaacggcatagatttcgtccggccggaccaaaccctagccccatcgcccgtctcggacgcagcctggcgcacgcctctcccttctacgcgactacgccggcacgccgtagcctctcgccgccgcctagcccttcttcctttgcgcgcgccgtcgccgctgcatcctcgccctcctccggccatcctcgccctagccgcactaccaagccccgcgtgtgtgacctcgcctgtcgccgccgccgctcgactgccgcctccgccgccgatcgcctgccgccgccgccgccgccgcggttgctcgcctgccgccgtgccgctcccctcgctccgcacaccaggccaccttctcccctcttctcccctctcatctccaggccacccaccgcctccctcttcctctccctatcctcggtgagctacagatccggttcgggggtcatcggaatcgatggtctcggccattggtctcctcgttggtgaatcattttgatacccctttcagccacaattgttttgtgcatacatttagcacaaaatccacaaggtaaggcaatggttttgactcgccattgagcatttccattgcgtttgctggtgtttttacatgatcccacatcttgccttaggttctgtggagaaattgatgggctaggatgaggtgttggtcgcagattacagagaggacgacttttatgctgcgcatctacagtcatactgagcaaatcctctcttaagcagggctgcgatatttagattatggtgagtttttcttgggttcagattatttcatatgaatttagctgtcagaagttccatggttattggttttgttgctgcattgtatggcaccccttgatagaatgacgtcaggaaggaaaaagaaaaccatgctaggtactacaaggctataagtataaggttatatgagagtattctgcaaacaggatatgcaatggaaggatattctttttattaactttgctaaatacctgccaatagcccaatactgacatcaaaaccccctagctctaatactgggagcataacacgccgatagacagtgtgcaaagcttttactgatgtctaatttgttgcaacaaaattattactacaccggatttatgtggtttgttgtgtttgtccagttcaacaaagaaagttggtaggatcatggaggaaatgaatcttatggttattttttcattgcttggtggtgtttcagacaactcagtctgctgccatatatccataaaacaaaacgttccgacaggtagttatttagtactatcctacaaacttacattctgccaaaaaaaaataactttcagcgtgcctgttatttttataatttaatgtgtaaatgatgaagagtgcaagcatctttctcctctgccttgacacaagagtttaggcctctagaatgtcctagcagcactgaaagtactctatgcatataagcatataaattttccatgttgcaagtcacagttatgccagtttgcttctggttatgtccacaacatattcaatgttgcaaaataaatataatgtagccatgcttcaggttacagcttccaatccactcttttaatattatgtagtgtggcatatgcttatgaaagtaatccataatactactatcttctgtaggctttcacatttaactattttattttgttgacatcgtttaacctggtttttttcccccttttcctaagtggttggttgatactattccaatagtataggtgcataccgcttattggtttattttgggtaatcacatacgcgatgtgcctacttctacatttgactattagaccatggtttaaaatgctatttacttgcttacttctacatttaaattatcaggaattgtgttcatcttttagaaataacattctgtcaggtcagagatttcggatggtagtttgcagtttgctcatgaatttgctttgtacttcctccgtcccataaaaaccaaccctagggaaccaaacctagggacgtcctagggatgaatccgtccagattcatccctaggtttggtttttatgggacgaagggagtataaattaagactgtcattttactgcagttggcctgcattcatattgaaagatttaacaccatcttacccttaggatctgtcgagtgactgatgaattacgatgaggtgttgttcatagataagagagatgtcttgtgtggtaccactctgttgtgccatcctgccgagggacccatctagctttgtcctcactcttaagcatggtatgtactatgcaatattcaatcgataatctccttgtgaaatttgtcaacaatattagatgcactactagaccccaacaatttccttctttttttttgtttttaactacaacccagtgattccttttattgcttccatgtagtatggggaagaatattctttcatgcagtaaggcaagaaatcattctgtcataagttaatacaattctcttatgattatgtagtatgcactaggttagttcattctctctcgactagattgttcgctgtctaggattaactaggattaaaagggatatcatattccttaaattaatgtttgcttcttttggtttgtggcaagatcagattcatgttcatgctcagttttgtggattcaagtttgaagaacacaaacaatatgcaggtgcatcgttttttatttatttccatattgttcatgtacaacattgtttaattttaggaaacactaactgcttcatgttgttcctacctctattctgaaagaggtacagtttcagcagggagattcatcttgcaggacacaattcatcttctttaccacagtacggttaacaaaagcttaattatattataatgatcatatacaattatgcttcacttctattaagggaatttttctttacttcagattatttcatatgaattcagttgtcagaaattccatgtttattgcttctactgctacattatatatggtatgatatggtggtgccaccttacctagcttgatagaatgacatcgatggcaaaaaaaaaaaaaaaaaaaaaaaaaaaagcatactaggcatcactacaaggctatcaatagaaagcttatatgaaagcattctgccaacaggatatgcattgaaaggatatactttttattaagattgctaaggtttctgccagaaatgacatgatgcgtacaatgcagatattatagatgatgtacatgctattgttgatgcgcgattagattagtttatggggtttgttgtgtcggtccagttcaataaggaaggttgataagatcatggaggaaatgaagcctatgattgttttatcattgcttggtggtgttttagatgactttgctgctccatgtttgacaaataggacataagcaggtagttatgtaatgctgtcctacaaacttatattctgcccaacaaaaaaaattttagaagatagctcttatttttataatgtaatgtgcaaatgatgaagactacatgcaacttatttgtctttgcaccactgtctttgccttgatccaagggtttggccgggcctctagaatatgctagctgcaccaggaatgttctatgcatataaattctccatgttgccggtcaccagcaattgcaattataagattctatcttaagttcatgacggaatacttctcttatgcttactgtttgtgccacttcttaatccatggccatcatgtgttgatagatgccatatttctcttttcttctctcttcgtataaagtagcctctaacgctggaagtacacatcccagtaacctattgttgtgtgtatattattcccacaattttcattaatttttgcaataacattgcatcatcttttgcaaatcagttttgactattcttttttttcaggagattcctttctgatgtatataatggtgaatagagaaactcatgcaagagcaataccacctcagttactgccaaaagatcagagaatcgcctttcaaaagctgagccagcattgctgctcttgaaaaacacatctatttctactatttttgtttggtgatatttgtatcccaaaacctatatttagactatatcatggtgtgtatttttgtgccgttttggtaattgagacattttttctctattggtcatgatttatgctacataaaagagactgtacatgggaggcctctctatatacgatattacttctcttattttgtcattaaaatcattagtacagttgtaagttactccttggcaaactccaatggtttatcggctttacaaacactgtacaacaaacattgcataatctttatgatcttctgcttaggtagtgtatcagatactgaaatatgcttacgcatattctttgttctgctaatgcattataataatactttttatataaaacaatatgttttctcaataaagttatattcatgtgtatgtggccaggtgctattttatacgc

SEQ ID NO: 36912 - DNA, 2118 bp, Oryza sativa
  unsure (1)..(2118): unsure at all n locations
acaaacactgtacaacaaacattgcataatctttatgatcttctgcttaggtagtgtatcagatactgaaatatgcttacgcatattctttgttctgctaatgcattataataatactttttatataaaacaatatgttttctcaataaagttatattcatgtgtatgtggccaggtgctattttatacgcttagtgcatgacattgtagcataatggtggcatgtgcatcatcttcaaacggcgcagcgtagtgcgcatttctttctagtatctttggaatggcaagacaaacctatacccttttaggtgctaagctatacataattacttttatgttacttcaaagatgcaattcacaatattttaggttttgaaaattggacatactagagtgcttaggatgcaataacatacaaaaccttcgttagccgcatatgatatataatataattatgttttcagatgggccaaatgacatgcatctgtagctcatctcctgatgaaggtggtcatcccagagcttcagtattgtgcgagctattctgagatacactgccactggagtcgctcaaatgtaagtaattattttaaacagttatgttctacttgtttggttatttgtttaaacaagtactaactgcccattcactttatatttggggctcccatgtaatattatcccacctaccatggcaagaggctgtctcaaatatagcaatgctcacgcttcggccactctttgttttgtggtgggaagataagaccaaggatatgttcttctgtattggcctggggatcaaccaactgatgttctagctattgctagctcaccatgtctaataggcaaacactaaatgattcgtatcgccgattcataatattgagcttctaaaaattatccctacaaaggattgtgcatattcagtcaatggtgcttgccatttctgaaacctgcaggctactttcactaaatggcacaaaatgcccctttgtgttatttgctatagctgcaactgttgtgatcggagatgttttgcgatatagttactacatgtattgattcttccatgctatatatcccagcatggcacatcactctgtaaggatataatgcacctccaacagactgtatgtaatctaagcatgagaacatgcttacttactgagtgcctgaatctaacaggaggtgtacatccttaaatcatagcagtacgtctataagagcctaaatttaaacataaaaccaatcaagctcattacagcttgaaatgagctacttgttctgttgtcccacacaggctaaattgccagctaaatataacactttcagtaagctccaataacatgcgtcttaggctcttttagacacgtctattacacccgcgcggcgtagcgcgcgagacctttctagtgtagtcaaagtgtccaggcatttcaagtttgccatcattcgagttacaagcttctaattatgtacctaatacatttgatattaccttttcaaatcaaatgaacgaagggaaacactcaatcaataaaaactatttggaattaaattttttcttaaaccgtatttgttttgtatgcacagctgaccgcagcgttacgccgcacatccccttctagttggtattaatctagtagtaaatccaatcaccggtccctaaacttgtatacttgtactgttgtgttatctcggtccctaaactcgcaaatcgaccgttcaggttctcaaacttgttcgactgtgtcatctcggtccctaaacttgcagatcacttgtttaggtcctccaacttgttcagttgtgtcaccccggtccctaaacaggacggtctaaaaactttatatcaaaaaataattcataacttttttatgtgaactctaatgaaaataaactttatatcaaaattgtagccctcgacgcgaccgacaactttatagttgaaaagtttttgaattaaaactgtttagggtcccaaaatattgttgcatgtttatagattttgaaattttaattaaattacattttgggacaaaaannnnnnnnnnnnnnnnnnnnnnnnnnnnnnnnnnnnnnnnnnnnnnnnnnnnnnnnnnnnnnnnnnnnnnnnnn

SEQ ID NO: 36913 - DNA, 1830 bp, Oryza sativa
ataaagtttgtcttcattaaagttcacatgaaaaagttataaattatttttaaatataaagtctttagatcgtcctatttgacccagatgatattcaaatccaagtttagggaccggggtgacacaactgaataagttggaggacctaaacgagtgatctgcaagtttagagaccgggatgacacaatcaaataagtttgaggacctgaacggtcgatttgcgagtttagggaccggatgacacaacggtacaagtttagagaccggtgatgaactttactcttaatctagatttgttcagctcttcagagacatcatctggcttgctggagctgtgctgatacgcgagcttatgggagaaactgaacttctttcaaggccgggctgcggacggcagagttcgaggagagtttgcccacgccgtgctcaccaacgaccgacgttcttgactcgccgtcaattccagccattgctgtccaggtgctttattttttttaagacagctaggaaggaaacccgcgcacatgcgcgggcacttatttaatgggtttgaaattttcttatgaatgttttatgggtaacctttttattgaaatgttttctactctattctaaacatgttttttttgtcaatgaattatttttcctaattatccttgcggcatataaattataaactaaaattacatggaactttttggtttttaatttatgagaaaatattgtgtcgtaataacctactcccttgagttttaaaattattgacgtcttaggctttgacattaaagttgccagttcttgacgttctaaacttagcctacttataagccattaaagagcatgtgctgcatgcatgttttctcattgctacagcacagctgctttgccttcctctattcgtgcttgcctgcttgcattctcgtgtgtttttctttttttttttgaatatttggcataccttgatatttttagtttctaaactaacatttttttctttgtatattatatatgtccttatggattttaggatatattaattgaagatttttctattcaaaatatggctagtaagactacttaggccccctttgaattggaggaaaaacaaaggaattgaaatcctacactattcatgcctttgattcgtaggaatgagaaaaagaaaaacgtaggaaactttcctattcctacaattctagagcaaaaacgtaggaaatttaacatccactctaacctcttggaaaactttcccagagtctatctctctcatctaattcctgcatttttcctgtggtctaatcaaacggtcattcctatatttttcctgtgttttgcaatcctctgtttttacacttgcattcctaccaaaatcctgtgtttttcctattcctccgttttttcaatcctacgattcaaaggggcccttaatgtcactaaagatagacttatatttatttcgattccctcctgcgcaacaaattcgagaatccaaatttttgtctcaagatgttaagggttgagtaccacatgtcacatctacaaacatatattgtttattacccaatcttattccaaccaccttacccaatcttattacggatatcatagtacttttccttcctccttagttgctcctaaaatcctagtatcccttatattatatgatatagatggtaattaccaagagcattatttataggcattgacatagccatttatgttggcaataatagacacttctttactaagtctactctcatcactccaaagtgatttccatggatcccaccatgcctgttaaaaagaagtcaaatgacaggtggcgtagtg

SEQ ID NO: 36914 - DNA, 3053 bp, Oryza sativa
  unsure (1)..(3053): unsure at all n locations
nnnnnnnnnnnnnnnnnnnnnnnnnnnnnnnnnnnnnnnnnnnnnnnnnnnnnnnnnnnnatcaaacggtcattcctatatttttcctgtgttttgcaatcctctgtttttacacttgcattcctaccaaaatcctgtgtttttcctattcctccgttttttcaatcctacgattcaaaggggcccttaatgtcactaaagatagacttatatttatttcgattccctcctgcgcaacaaattcgagaatccaaatttttgtctcaagatgttaagggttgagtaccacatgtcacatctacaaacatatattgtttattacccaatcttattccaaccaccttacccaatcttattacggatatcatagtacttttccttcctccttagttgctcctaaaatcctagtatcccttatattatatgatatagatggtaattaccaagagcattatttataggcattgacatagccatttatgttggcaataatagacacttctttactaagtctactctcatcactccaaagtgatttccatggatcccaccatgcctgtttaaaagaagtcaaaatgacaggtggcgttagtgatcggaggtccctggagctgagatatatagatgatgcgagagagagagagaggatgatcgatcctatatgtctgatgcggtgtgattgtcacaataaaggtggacgatagacctcaaatttaggagtggtgggagttgatattggggcatactatagcaaaggagttgactacgtcagctcttcaattgtgccttttgaactttggatgtcatgtgctataataaattaaaattaaggatataaatatgtattttataaaattatagatttggataacacccatttgagaagaaaagagaggggaagaaacacatgatggtggaggcttgagggatagggcaatgactatactttggctttttaatggcccacaaacttaattatggttttagttgttagagagggaaaaaaaaaaggaaagatgtgtgtgtcgtggaagggcgcaagctgcatggaggagggtggggaggacagaaatcttcacttgttgaaataattggtccgccaatttgatttaatattaagggttagatgttgtttttcttcagaattttcagaatttgtacaatcttttctaatctttacagctcgatggcattacagggcgttcttgtttttatgaaagtccttttccagcaatgttgattaataattaaactaacaataaatgtggttagtgtcatgtatgtgatatccttatgttcatatttgaaaacaatccagcttatgttaatttggtactcaatacaggtctttaattgttcattcaattaatagaaatacagtggttgaaaccaattataaattgcatgtacaattaaaagttgtggtaaaagaatcaaatcatcaataccacataaaatcctcgtatgcatgccattaaatctttaatatcttaaaattaaatatttttaaagtcattaatagttaaatttataaaagtttgaccacaacattgttcaaaacgtcaagaattatggaaccgaaggtagtaaactttattgttgaacattgtaaagcaaattttgatagagtcatatgatatatatatatatatatatatatatatatatagtaaatttgtttggtgctccatggtgcccgggcaccattgttgaaattgagtatatacctaattcaaatgagtatgaaactttttcaattacttagatattaacattagctactttactaactagttcaaagcaagtttgaactgaatttgaacttgtttttgttagattttgattctaggtatatagcatccatacatataattagttaggtatgtaatcatggattgtgaaataaagttaaatttgagttgttttgttgttaggtataggtatgaatcgagttattataactaggtatatactcacaatttgaaaattttgaaaaatttgagtgattttgtgtatttgatatcatggtgcccgggcaccatggtgccccatatgagtaagaattagtataattatttaaaatttattatcactaatattaattgttatctcacctgtactcatggagaaaagaatgaaaaagagggaagaaaaagtatttatggttttcatggttttctcggctttatcctcatttaatttccaatcgtactttacgtttgtaaaagtagagtagtctgcatagatatgcatcggatccatattaaaaggaatgattctttttttttttgcgagtagtacgtacatacataccttgatcaccatccatatgcatcggatccatattagtaggaaatattttaatagatttaatctaatggtctaaaatatcgggtccaccaatttaagtgaaaatatgttttgcttttttcttagaatttatttgatttctctaatttattagagcgccaagtggcggcttaggagcgtttataggaagtttaatggacttttagtatataatagatagatagatagaagatagatagatagatagatagatagatagatagaagatagatagatagaagatagatatatcattctgttcatgtgaaattttggaattatcttgcgtagtagtaatcctgttgcttaaaatacagttcttgtatgagctttcaagtcttagtttgctatgccatgatgcttttatttgatctaataaagttgagaggttccactggattttctaggcaagtatttttgttctttttttttataatgttccataatactcttttatatgctctatatatgcaaatactgtaagttttttcatgctttacttatgttttttttttcaaccaggatgctttactcatgtataagataatcccttatatgctactgaaaattggtctgatcccttatatgccactgaaaattggctcttcccttatatgccattggttcaaatttatgcaccatctcatgccactaccgtcagttgaccgtgtgttgaccgttaactctcaagtaaaaaagacatt

SEQ ID NO: 36915 - DNA, 715 bp, Oryza sativa
  unsure (1)..(715): unsure at all n locations
nnnnnnnnnnnnnnnnnnnnnnnnnnnnnnnnnnnnnnnnnnnnnnnnnnnnnnnnnnnnnnnnnnnttggttaaatgtctagtagaccgaaaggtaggtggacgggtgaaaaatttactatgataaagctcttaacttaccaatcattggtatgaccaattgagttccttttaagcctcttagcagcatgatggacttcctagattcatcatcaagaagacattccatatcagttaccatggtccagactttcattccttctttggtcttttcagactcttgtcctttgtgctgttcagcaacaaaaattaacttagttcagattccttatcagaagaaaaaaagggaaaaaatatgtaaaaaatggaatattattgacaagaacttactggaacattattcagttcaccctccaacttcattgccacatcaactgctctaggattaacctgggtactatcaagtgaactagtgtgtcttaagggagaattcgacaagagtgtctggaaggggagcctatcaaccacccttttctttgtgatagtactttccattcgtgcacggttttcagacaaatcctttgttttccgagaagcagaagatactggcgtcaagttctctttgtcagagtagaaggcctcttgatcttggtcagcatccactgtgaggctctttggaagacatctccttgctttaatgcctcctgaagatata

SEQ ID NO: 36916 - DNA, 625 bp, Oryza sativa
  unsure (1)..(625): unsure at all n locations
tgaactacctcaccgtacgaatgctggtcaacgcaactacaagtcatcagtttcacctatggttgacctatctcaccgtgtagatgatggtcaacgcaactacaagttatcagctttacctgccactaatgaactacctcaccatacggatgctggtcaacgcaactacaagtcatcagtttcacctgtggctgaactacctcaccgtgtagatgatggtcaacgcaactacaagttatcagctttacctgccactaatgaactacctcaccgtacggatgctggtcaacgcaactacaagtcatcagtttcacctgtggctgaactacctcaccgtgtagatgatggccaacgcaactacaagttatcagctttacctgccactaatgaactacctcaccgtatagatgctggtcaacgcaactacaagtcatcagtttcacctatggctgaactacctcaccgtgcagatgatggtcaacgcaactacaagttatcagtttcacctgctgctgaactacctcaccgtgtagatgatggtcaacgcaattacaagttnnnnnnnnnnnnnnnnnnnnnnnnnnnnnnnnnnnnnnnnnnnnnnnnnnnnnnnnnnnnnnnnnnn

SEQ ID NO: 36917 - DNA, 861 bp, Oryza sativa
tgcgactccatagaccacacatatgaatatctatacattgccaaacaattattgccgttcatatactagataccaagaaactagacagtatgagtcaattattgagatcgagataacagtcaaagaaaacgtttacacagtatagcgcagacactcacaacagacgcacactcactcctatgattgaaatcctgaaaaattctctcatggaaaatttgctcccatggggagtcgaatccaggatctaaggtgctactgagactcttgtaaccactaggctacatgcccttttgcatccatagcaaactttgatcattcagtacccattttggtttttaagagatgatattgttgactcatatgtcgacgggggatacccgtggaccatattatgaggttattggggtatgttggtataaggatctacacgatacgatattaagcatataaaaagacaaggattatactggtttagattcctcgtaagataatagccctaatcctgtttatatgatattatagagaaaatcacagagtacaaaagagaacaactaaactccgaaattaccgaaaagatccttgtcgagagagactcgacgagatctatcggcgaataggcttcaaatcctccggattgcttttgtcgtggcgggtgtcttacacttaggattcggattcgatgacctgtacctcctaggtagcctatatttatactgcaaatccccttagtctgcaaatataactcggagacaacggaccccgcacggtaatatagtttcctaatctttttcgagtagaactctattatttcccctttcatgaacactattttcttaatctagcaaactctttccatatact

SEQ ID NO: 36918 - DNA, 958 bp, Oryza sativa
  unsure (1)..(958): unsure at all n locations
nnnnnnnnnnnnnnnnnnnnnnnnnnnnnnnnnnnnnnnnnnnnnnnnnnnnnnntgatggcacctgacaagcctattgattctgctgttttgtcaagactgaagcacttttcggcaatgaacaagctcaagaagatggcattgagggtacggagatttgtctataagtttgtgattcaattatttgcttatttcaattactctcaggttgaccttgtttgcctcatatatgaaaggcacctgacaagtctcattttctcccctgatttgtttgtaggaaatgaatctcactgttaacttcatttacttataaaagtcttgcatctgtggaattcaaaaaataattaagtgttgatatattctacaaccatgtgcatttttagtagagagagctatctgatctcttgaatcatgatgcctcttttcatccattgacaccacctttgtttgaacccaggttcatttggaatatatccagtaactattctgttcaggtcaatgttaactaagatgatgtagcaaactgattctttctgacatttgtttggggctacacgaaacctgtttccttggcagcccagacacttaatgcattataggcatcgtagtttttcttttcttttgaaatgctcgatctagcttgtgaaacatgcaatgatcatcttgagctctttacatattgttaagtatctttcattttgcaggttattgctgaaagcctgtctgaggaagagattggaggactaaaggagctattcaaaatgattgatactgacgatagtggaactataacttttgatgagctgaaagagggcttgaaaggggtgggttcagaattaacagaacatgaaatccaggctttaatggaagcggtaagtgcttctttgttagttgatccttcagggaaatgtaacttgcaggggccttctgatcctcagcattttgtatttcttgcatg

SEQ ID NO: 36919 - DNA, 2281 bp, Oryza sativa
ccagatgtatcataaatattggctcgaggatatattccacatcgtacctcgaaatactaaacatttcaaggtatcgaggatcatatgatattaaaatgtatcacagagatctcattatgatattgcactagtatcgattaatcgttttagcacaaacgtttagcctataatcgtcaaaccaaagcacacggcccaaaacttagatatatgctttgtgtttcacgatcacatcatatcagagacgtgtatttactgaaaatttgagagagagaaaaagtcaaaagaagataaactagtccaaataaattatccaacctacctcctcgtgactcgtgagcacacctgatcatgtacacaagcccaaccaacacactaggtacaatcacggctagtaaagacatgtatgcatgcattgttgcgctaggtgacaggtgactgtcaagaaaaggcactactctgatgtaggcctcgcagaggtgagcaaagatggtaaggaaggcgaaggagttggggttgaggtgcaagagagaaaggccgtaaaagttcaggatcaacaggaggaactctgaaggaggagggagaaaaccgcagcagacaaaatcctctaccgctaccatgcaccctagaatgggggaaggatccatacctcctgcttcccaggccatggtctgcttcggagggatagccccctccgtgtacagcttcttcagggcggcagcgtcggtggtggattcgttgaggtccgccatcggttggggatcgccggaagaaggttggggattctgggatgtgaaaggtgcaaggaagccaaggaacagtgagggttctgggcaaacggacttaaaatgaatcccagaattcctttaaataggcacactatctgacggttcgtattttgaggaaggagagagattgccgccgaaaattttggagacccgttgcgggtggctgtttgacttcgatttaaattcatatcttaaccgttgaacttccttcagcgttgtcgacaacctcatgtctctacggttttacatcgggatcgatcaaatgggtacgacaagacgctatcaggtgaagtcgcggacgacaacatgaattcatttaagttgaagccgggggttactgtcaaggttacggataaggcatgcctcctattgtaacgtcctgaaaattcctaacaataaaaatcactaaaattttgaatttttttaaaacttttgcatcatgctggttgttatgattgctattgcttgccaaaccgtaaaatatcacaaagaaagtaaagaaaagatctaaatttaagcaatagatataatttacgagaatatgttatttattaataaccctacaaatattagtgcacaagaaagcaagccaaaccaaggataagtcaaatattaatttttattataaatcacagatcaaatattaaatattcgaaccatgattgatagcttgatgtcacaattagctaaagaaatagtaagattaaatccaattcatttgaatccaatctcacatgaaatataagaacacatgaaatgatgatcaccacccactataatgatcgtgtttataaataagtaattcaccggaatatatagattgatacttacaacatttcgccgagctcctcataacatgaaaatcactcatataaaataatggtcatataaataaaataagctttatatataaataagattatgtgagttttaattaaacaattagattaataatgtaccgagtctcaatttactatttatagaataaatggattaaacctatttgtgtaaaatgtattgctatacaaataaactcgaccaatctaccattgtattattaaggacacaacgttatattaaatagaatattacccccaaaatcttcaaaaatatataagttcactttagggccaataatataaaaagaaattatttgtgagatatataaataaaatatgggtaatattaatcttgggtgaatccattggttggaataacataaatattgagtaaacctcatttatgcaaaaattaggatttatagaatagaatttatatggaaaataggctaaaattgggataaataggaaaatacactgctcattgcactctaggtgctcgacgaggtccctagccctacccccttctctgccgtgccccctcgcgtcccctgccccgcgcgcacgccgccccgagccccgtgccgccgatgctgcgccgtgccgtcagccgcctgccgcagctgccacgccgacgctgcctcgagccccgtgccg

SEQ ID NO: 36920 - DNA, 490 bp, Oryza sativa
accccacaccctcctccccatttctctcttcctcccctctttcccctccacagcgccgccgctttcgtgccgtcgcgccgccgccttagtgccgccgcgccgcgccgtgtgatgcgccgagcgtcgccgccgccaccttcgccgcagccgccatcggtaagtcgccgccccctttcccctttgcttggtcgccatcgccgccccgggggagccaagagccgagagagagaggaaaggagaagccggtaaggagagagagaaggaaagaaaaagaaaagaaaaagaaaagaaggaaaaagaaaacagaaaagagaagagagaaaaaaaaagaaagaaaagaaaagagaaaagagaggagagattagagtgggccccacgtgattagagagtagtaatccccttcttaatcttcattagttgagtattacatgtgggtccgggtggttagaaatctaattaagggaggttctgtagtctcgggtctatgaca

SEQ ID NO: 36921 - DNA, 1284 bp, Oryza sativa
accaaatcctagtcaataccttgctagtcaaattccactcgtcttccaagctccatatcagctacaatattacctatataccactttccataatcttcctcacccccaccatatattctccacctacctacaacatatacataaattatagagccgagctgaaatgctatcctatttcagtatcgactcgagaacaactaaaccttagtttccatacgacctaaacctagctaccaccaaccaataccagtcacataccctcttaaccaataccattatccaaactagttacttctcatcctcctactaatcaaacccacacatgaaatataagcgacagtagttgcttaatcccctctagcctccaaccctttagaacctacacataaaatatcagcccagtaatccatataccctataaaagagataggctataccctaaaccctagccctcctaaccgtttatctctttctttctattttatagcttttattgaatttggttcttcttcttcttcagtagagtctattatatttggatggcagcctgtggtatttcgagcatcggataatcaagttgcctatctcggatttatttgcgttggagcaaggcaagttattattcctcccctttgagcataattatgctatattctatatctccattatctcatgcattagtcattcatgattttgaatgcataacctgaacatatagcaaaccagatatgctagcttttgcttagccctacctagttagactgtataaaatataatgaacttagattggaacagtatggtagaattggttgatttccgggtggctagtactgttccaaccgacataagactgcccaaatacttgtgaagaacaaacgagtacgaccacagttctaggatggggacagtggttctttttaagtcctcgcgcaggaggaaaacttatgccgagcagggcaattgtgatatttaccgaggcgcaagtaaatatttgtttgagataaattatgatgtcatatgacttgtttgtaaaccctaattgcgatgacatggtgtcatacaatcagtcctctctaaataccccgggaacgccagaactcctatcgctgctgataacgttacgttcagagcatatggggactagagttcatggaacaggtgccactattgttagtaacctaatgctgggctatgactaaagctgatgattatcgacaagtcgtgggccgtgggtaaagcgtacatttactacagtaaagtataaatgaatctattcgaatagcc

SEQ ID NO: 36922 - DNA, 672 bp, Oryza sativa
  unsure (1)..(672): unsure at all n locations
tcggtaccccaatatgattaattgtaatgcatgacttgccttgctctcgcactgatgagaccacagcaacgtcttcgagaaaccgcagatcgacaaaactgccgaaatctacgcgacaaacaaagcacacaagcaaaacatgctataagactactgaaacagaatacaaaaccatttttaatggattctttgcatttttcttgatctactgagacttgaatggacttaagtggagctcggatgaattagatataaattttagaagataatatgtgtttttactaataaaaaaatccttattcgatttattgcgcaataatacccagggctgacattatccaaggggcgggggcgccgacaggtgggccccacgggtcaaaggcacaaagggcgccggtccaccgtggaccgggaccacacgggtggtccacccccggtccacgggaccgacggtccagatcagccccgaggccgataggacggtgcggcggcggcgaggcacggcacggctcggcacaaagcctgctggccggccatggcaagcggcggcggtgcatggccgccgacggcggcgaccggcggagcgaggcggcggcagacagcgcgaaagnnnnnnnnnnnnnnnnnnnnnnnnnnnnnnnnnnnnnnnnnnnnnnnnnnnnnnnnnnnnnn

SEQ ID NO: 36923 - DNA, 685 bp, Oryza sativa
  unsure (1)..(685): unsure at all n locations
acttgctcatcatcaataaattaacaaacagggccatcgaacaagcttaaaaattgaaaatggtggacgtccgtgctgtgattgaatcattttttgtcatgctgaaagagaacatctatgtcttgatccgcattgagtccttggtggcactggtgacattgatattccttgcaatgttcatcatagacttctaccgctgccgaactcgtagctcaatcttgaccaccattcttgaaagcatcgacgaattatctgatcagatagtagtgtacctcattggagccatgcaatccgcgaggtttgagaatgagctgttcccggtctgggccatcgtgctggtgagtctccgtaccagcctcggctatctctctgggtatggcatctcagaccgtgatcgacaattcatggagctggcaaatgtgatcaagttcataggggcaggggtcttggctggcactcgtggcttgaagtatgcaaggccactctggtcattttgggccatcctgcaactgaagagcatgtaccggttcttcgcacatggcatggcaaacgaatccttgtggcatggccggagctcagagtttattcctgagtacatgcgcaccttcattcctgaggaccaggagacaggcgtcaatcatgatgatagnnnnnnnnnnnnnnnnnnnnnnnnnnnnnnnnnnnn

SEQ ID NO: 36924 - DNA, 2017 bp, Oryza sativa
atcccccaaaaaatcccaacgcttcaaacccagcgagtcgcgccgccgtctcgtctccgatcgcggcgcacgcgcagatcgctagccctgcctgcagcatggcgtccgcggcggcggagggggaggaggccccgatcgcggcgttcgcggtgtccaaggggggagtcgtgctgaagaacatcttcctcaacgcgcccccgtcgccgctgcctgtggaggaggcggcgcgggggcggggtggggaggaatacgatcctcccgttatgttcgtccaacgcccgaagtgcgctgaacaacatgttcatcacagcgcccgcaggttccatgtctgaggacgatgccgccgccggcacgggcggatcaccgtcaccgacctctcctccggtgagattccgctcctcccccgcgcctctcgctccgcctctccctcgatctccctgtgcgcgtggctggttttgattgaggcttcatttggggatttttggtggacgcgtgcgttagctcatttcgattatcactcgattagctcctgcgatgatggcgaatatttgcttgcgatttggatcaaaatgaggcaaaagctaacatggcattgacccatttttgtcctgtgaattttacacagtgcatgggacttggatctcgggacgaaggatcccaccgaacactccggtggagctgacagccggtgatgtactgcggcttgggagctcgaggagggaataccggcttcactggctgtcgctcccggaagcatttgacatggaggatctgctgccaccgctgctggaggaggataaggaggagcttagtacttgtcaggtagcagattctctattctgatcagtgccatagctgtgattattttgggggcatggttgttgcaatataagtgtttgttgaaatgctcaggaggcaagcaagcagttggagcctgatcaaaaggagtcagcggatactgagactcatcaggtctgatccccgtaaactcatgtaactggatgctgaaattatcagtgtgttttgtcatgttatcatgttctatagtttggtagaattctggacatatgtgttgagcgttttgaaacgctaagcaataggcttgattgccgaaattcatatgatgcaggcgatagaaatgtccttggctgctgctgattgccaaaataataaaatacatgctaaattctttcatggcaaatgactattagctcatccactttattgatactctatgctcacagttttatgaaatgcattacaaactattttgaagtctaatatgtgctactggattccctatttgctctgctctgttaattcttaactgataactaaataatccagtacccagcaattttgaattagtagttgcttagagtagtgcccctgcccctttcattggaaatgtcaagtttctaataaacgatgacttttagctgcttttgctatacactgtcgttctggagttctgcctaatgctattttagtgatgcttttaccatctatagaaatcttctgcgttgtggttttgaaaatctcggccacttcataatggcctaaatgcgttgtgcatgtgagcagattagggtaaaaatctatgtgttatattgggagctgctgattatattgtgcactatctaaattgctccaaagtgatttcatatggcttgcgaatggttgttactttagatgcattgattataaaaataactttcatctcaagctaaacaattagtttggctatttgtctgaatgttatacgcccatgtgttgcactggatgcatggtatatattttgcatgttgaagttaaatcctaccaaatcaaaatctccattgcttacagtcaaatactaatcgcactgttgacttaggttctactacttgattttctttctttccctttggaattttgagttcatattctggaaggctaactatctgatataattctcaggagacaagccaacaagttgtgtcagaacaaattgattttcatgctaatgtgataccct

SEQ ID NO: 36925 - DNA, 1409 bp, Oryza sativa
gaagaaaaggaaaagatgaatatcttggacagaattatgatggaggagaatcaggaacagacaaatcatcttcaatccaaagaatttgtgcattatgttgcccctctgaatttggactatgaaacattttcagataatgaaaactgcgtgctgagtgttgctaaggagacagagcataatgatttcaactctgtgaattgtatctcacaagattcagtttgtgaaaatccacagaagatatcagaattattgcattttgtttcccctctggttttcaaaggcgatgacttcactgacagcaaaatcctacagctttgtgcttctgtacataaggagttgtctgggcccatcttagaaaatccattcatgcaagacatatctgatgaaaatacaaacagcaacaaagacacagggcatgaaggtttaacccttcttaacttggatgcaactctcacaagcaatgagaattttgctcaaagtaagatttttgtggctcctgaggactctgagagtgaaggcacaatcagtgagaatctatttgaaatttcgaacatgaaaggaaatgaagaaaatgaagagaacagtccatgggacaaggagaacatcaccccctttgtctcaggagatataatagtggagagaagtcagctaaggttgaagcccactaccatttcccaagaattgatggattccatttcccctcttaatttggaacataacgacttttcagatgatgaaagttccatattgagcattggagaacagatgaattcaaatgaacttatcgccaagaatcttatcccgctaacttcagttgatgcaaatatgcagaagagccatgcagggtttatgacaattgcacatctagatttcaaagatagcatccttacagacgaggaaacctcagtgctttctcctgaaaagtatgatactatatcccctgtgagacaaggaaacctgttcccagacaaagagaatgtgacaccagcctccagggatctgaagcccatcattggtaggaaggttcttggaccaagggtggataattcgctgtctgtagaatgcacttcaaaaaggaggatccatagacaagaacccaatgaattatcagcaaagtccaaagtttgtcacgcagtagatgatgatgttttctattctgataaggaaaatttgacacctatatcttcaggaggcattaaagcaaggagatgtcttccaaagagcctcacagtggatgctgaccaagatcaagaggccttctactctgacaaagagaacttgacgccagtatcttctgcttctcggaaaacaaaggatttgtctggaaaccgtgcacgaatggaaagtactatcacaaagaaaagggtggttgataggctccccttccagacactcttgtcgaattctcc

SEQ ID NO: 36926 - DNA, 5935 bp, Oryza sativa
tccatcatgctgctaagaggcttaaaaggaactcaattggtcataccaatgattggtaagttaagagctttatcatagtaaatttttcacccgtccacctacctttcggtctactagacatttaaccaatgctttaacttggttgcctgcaatatcttccagcgtatattctttttatgtactgtttatatctgaattcatgatctgtcattctgtcgtgctgcttagttctaacaaatatgccatgctagattttactacctgtaatccatggattttgtgatgttgagtgaatgacaagttgcttctgtagctttaactgtcttgctattctcttacaacctctgccccaaaatataagggcttttggctatgcatttatattgccaaaagcccttatattttgggatggagatagtactaaatagatgcaattaaccttgtatgtttggttcttgtgctgtttagcatgcgcacgctcacctatgtataaagtggtccattgcattgcatttctcactatgtttgtcgctcacagtgcaatatgctttattgagtttagtgcagttgtcacttgtaatccatacccttgtttttaactgaaccgactgcatcttccatgctatgcttcttgtttgttagctgaaagcttgtttacccttttgtcagtgatcagggagcttgagtgcttgaaaaagcgggagagattgttcagaatgttatcaaaggccacctccatgctccaatggatcaatgagtgcatggaaaaggagagctggtggatccatgttcagagttcaaccgagatgctgccagtagcaccaactccacctgcaacccctacagcgctatgcaacaatggagaaagagaaatctctgccggcaccttcaatccgatagccttgttctccccgagaagcttctcagatatcgtctccccgaaaacagaagatcgcgttcttgactgcgccctccttttcaacaaactaaaaggaaaccagaacatcgtcatcctgtccaacagcgtcacgcttaagatcaaagctatggcagaggtaaccttaaactccttaacttgactcggtccttgcagttcatgcaaattagagccactgaaccagagtataaaccatactccacccatttaaaattgagttcattgtgtttctgtcttattgaagggattcccttgcgagggagcaaaggaattcagggagaccctggtgaacccgtgctccagcaggttcatgtgggcggccagcgcgccgagaggttcagcctggtcgtgcctggacgagactaccctggaggagaactactacaacagccaccatggagccaggaggaggatcccaaggcccatggagcccgccaagggcctgaagctgatcctgctgcacaattctcactatgggcaggcgacgaacttcgtcgagaatcggccattggctccaatggcctcgtggtgaactgacgatggcacgatgccattgggctcagttaggccttgtgtgcctttgtatatagatattggatttcttcttcttcttggtatgtgattagagtaacaccgctggacttgtgaggtggattttgagggcggtggctacatttctgttggtatgatttccatgcctaatgaaagtctgaaagaaactagtatgacctgtgaaagttggaacatggaatggctgtttaaagtctccatttcacactagtggtggtggtggtgatatggtcagaggcatcttatctgcaagttgatcccatcctattagctgataaaatttggttccaaagcagcgctcaggatggaaaacctgcaatggctcacatggatatgatgatgagccggctggtgaggttcagatgtacttactcattactactcaagaactctggattcttatatattatcagtctgtagattctgagcagatagctaaactggacagcaatagaatagtgaccaagctctctttgctgggaacagaatcttactctactgctcaggaatgtttacatgcaataaaatactccctcccgcccataaaaatcaatctagtaccgaatgtgatacatcataatactacaaatttagataggcttttgttcagacgtggtactagaatatattacatccggtactagattattttttatggacaaatggagtatatatatcagccgtgggttcagcactgtcctgtaaaaagttacctttccatggagcactatccggggtcagtactaactaaagtttatgttttcaaccaaaacatgttggaaaccacacaatttcgatgttttgatatgggacaaaagtagattccaaattaagtttcattttgagaattcaaatttgaaacagtaaaatttgaccaaaatttatcaaattttggaaaagaaaagtcataccacaatggttcggaatccaatactaagtcgaagaggtgaaccctgatacaaactaaaaataactacgagatgttcacaaaatcgtcagggtcgactaaccccaatgattcgactgtagcgttgcccctgtcccggagttaatgaatatggctaaaatttgtgttgttaggtgttgtataatcaattaggttgctatattttggtaggataggagtatattgtttagggcaataatttaaactccattttttttctgagctaatgagatgtttatgtgtaccacgtcaactgaacttgattcgtaacgttgacttcatagaagagagaatctatctacacttcaatttttctttaaaaaaaccttgtattttatccctcaactatgccaatggtctaagttcactgctcctttgatttataggaaaaacatagaaattttggaagattttaatcctataggaaaaaaaatcttaggaagatctttgaaacaaaagattgaatcctatcatatcttttaaaatttctatggaatgaacaatcctataaaaatttggaggaaaattagcaagagctctaacctcatagaaaatttcctttccggtcattcatatgtttttgtaatcctttgttttgcccgtttttctcattcctacgatttaaggggggcctaatttttttaattgtttgagttacattcgtggaactatggtcgtgtttagttccaaactttttcttcaaactttcaacttttccatcacatcaaaactttcttacacacttaaacttctaacttttccatcacatcgttccaatttcaactaaacttcaaattttgacgtgaactaaacacagcctatgcaagctagacacaaatatatctttaaggtactcactcggttccataaaaagccaattagtactagatatctagacagagacatgtccagattcgtaatactatgatatgtcaacatggttattttttatagaacagatggagtaggcaactcgaacgatatgtcaacatggttattttttatagaacagatggagtaggcaactcgaacggtttcaaagttcaggagatgaaacctgggatcattggttgtgtgtgtggatggagtttttttttccctttcattatatttgacagcataaaattgatcaagttttttgaagactagatgaccgtgttgaacgggtcacaagactagattagatgctgctcagtttaattagcccacgcggagtgcttcaggttagctgtagacgtgcgtggcagatggtgctaagtgctactaacatgtgtagcagtagcactcaccttttctctctggtcaccatcttgaccatgttaaaagttggctcctgtttatgctattttgagaacagcgatgccatcttgaccatgttaaaagttggctcctgtttatgctattttgagaacagcgatgcaagatatttcttgtgaagtttctttctagctggaaaaaaaagtttatttcatccatcagactgttcttccatgtgcaaaaaggaataaaagataacaatgtcacagaaaaagatgggtgtgttcttgactctgtctcctgttgattccctgtcctagaggtatatttcaagaaacagacagtttctgagttggcatgcatagttatgatatctgttgagcttacattttcttttagctgttcaggaattagtgagaaatagtggtgctcgttacaccctcgattattgttctgtgtcatattttgtatccttctgtacatgactgacaaggaagagtaggtaaaaaaaaaattctgttgattacactttttccatcattgctagatttgcacatctgggtaaattgtaaattgtcgacatgaattcaaaataagtactagtagtgctatgaaaaccactacttgtttggtcaaaagcttatcaatgtgctcacacggtttgactgtgattaggaattgaattgaccaactaaacaatccccacaggaacaagcttggaactctcaacttttgaagtctacttcctcagtcccacgaagactgcattttttatttctgatcgtccgtcttatttaaagaaagagataatccaataaatgccattgacaagcgtccaacttcagaaataccattgacacaagtgtgagttctaagaaatactatcatacaaacgattttgtcccaaaaatgtcatcgccgttagggtttcatttattttacaccgttaaatacactgttcatcatatagaacttaatggcacaggatggacggaaccctaacgacgatggcatttttgggacaaagtcgtttgtatgatgacatttcttggaactaacacttgccgatgatatttttgggacttggacgcttgtcaatgacatttcttggattttcttttaaaggatttatgaattttttttaaaaaaaatagtcatgtattaagtaatattcatattttatcatctaataacaataaaaatactaatcatagaaaacttttaataagacgaagaatcaaacgttgtatctaaaaactgaaaaatagtgtctttgtgggacgggaagtagaatatagatcgatccaccacttgttacttgacttcaaagttttctgtgttcattcacaactgcttagcttgagtgactgaccaagtgtaacgcggaaaagcatcatgaatggccattacgtacagggtcattttctctgaaggagaacgatgtctcagacatggaagaggactgcactggccataaaattcggatgctgatctttaaaaaaaaacccgtagttttcaagcttttgatctactttacacgtgtaaatattagttgcccttgattgcgcatttcaaaagcgacaaatccttaatcattctgaatatcttcaagttttgtcacgttagacgaagtcggtttcgacgaaccgtaagacggatggcatgcatagttgaatttcagtttaaattttaaatttagggaataataaaggtggtcagatggtgcgaagtaaagtttaaagcttgttcctacactgaatctctcaacatcacactttcttcagttgtgccattataaattgaaattgccaacagttgcagaggcaactcaaggtctcattctcagaaaactcatcagtcagtttcagtgaaaaccaagggtggttaacagtaaccaccccaccaatgagtccatgatctgatgatcacacctcttgcaacatctcaagttattaacaggcatacatatcatctcccataaacaaagaacatatatcatccctgattaaaacatgagtttatccttgcaggtttggtagatgatcacaaagttgacagtgatggaaatggggtccaatccaatgccatgctcagtgtcctcatccactgtctcacacaatctctatcaccatttgtgggcaccatgatttcatcatctcctcctttcttgcaagctatcattagtagccacttcatttcaacaagagagtactgagggggtgttt

SEQ ID NO: 36927 - DNA, 4362 bp, Oryza sativa
agaagaagggaagtgtccgaaacaaagaaagagctaatggatccaatgaaacctttggacattatctaaaaaaaaaaacctttggattcctactgttgtctgtgtcgtcctaaccttatacagcaacaatttcccgtgaactcatgttcagagaaaagaaaaaaaaatcgtttgtacccattgtctgaagaaatattccaaatccgagattccagtaaagtatagctgaaatatgaagaaaactagcagtgactaaaagaaatttgttctccgcataaaagactcttttcgagaggacataatattgataatatacaggaccaagagaagcagtttattggaaatgcaattacaaaataaaagagcatagagcatagggaaagcatatgaataactttatagatagattatagaaaaaatacatgaatttatggagaaatagagactcagagaaaaatatttcacaaggtcagctccattatttgctattcagcttatccgtcgtaaccaaaatttaaattttagagttaattttatttttaccgtactttattttttaatattgtcttttaaattgctaataacacatatataaaagtttacccatactgttttttatcgtaaatacgcattacggtttataatcggcttccttaaggcattccaacgaaactttataggattataaaatttgatatagacaaaaataacttacatagcaaatgctaaaaatttcatacacaaaacctactcgatttgaatctttttaggacaacgcttttcacttcatattataaaagctttgacttttttttgtcaaattttttaagtttgattaaatctataaaaaaagtatagcaatatctctaacaaaaataaataggatgggcgaacgacgggaattgaacccgcgcatggtggattcacaatccactgccttgatcaacttggctacatccgtcccttatccagctaaaggattttctcatatcatcaaaatatattcaatgttatatttaataaaactaacttgatattataaatattgtcaattttttaaataaacttagttaaacctaaataagcttgactagaaaaaaaattcaaaatgactcgtaatatttacaaacggagtgagtagaaaataggttgacacaaagaaaaatgtaaggaacagcaaaaaaaaaaaaaaaaaacaaacaagaaagaaaatagaaattcgaagagaaggttccaaccaagcataccatcttctccttctccttcctcctgccttcgttcttgtcttgtcacacccatggaggaggagaaaaaggcatagatacgacctggctgccctcacaaaaatacttcaccaaaccaccctcctcctcctccccctttaccatttccaagttccaacccccaaaaaaaatccaaccaaaaagcggagattttccaactcttatcatctcctcctcctcctcctcgtcatcgtcatcaccagcacacacccgagagaaaaaaatcctataaagaaatggattgagccatcacccaacgccgccaagatcctgtcctcttgtgtgcgcaacctgtagctccacctccacgcaggatcaacacccaaatccccccatcttcttttctttttcgtttcgtttctgcaagatttgcatcttcttcttcttcctccgaggagtgagtgacacctgagatagcgagagcgagattttcttcggtttttttgttcctctttttggccataaacctcccataaagctcggtttcttggttcgttttttctttctttcttcctctccttcgagaatcgcccgagtgtgaaatccaagatcccgaattccgtgtcttcttcttcttccgtagaaatcccggggtgggcaaagcggtgggatttctggagaggggtaaatgagcttccgtttctcgattggttcttgatcgcgtctcctctctctctcgaattcattagcttctcttcgattctttgatttcagggagagcgctacaaggcaagaagcttgggtgtccgtagtccgtacggttcttgatctggggtcgccgccaatgcagccggacccgagcgggagcggcggcgacggcaacgccaatgcgaaggcgaagctggcgccgccgccggtgacggcggcgggaggtcggccggtgtcggtgctgccgcacaagacggcgaacgtgcgcgaccactaccgcatcgggaagaagctcgggcaggggcagttcgggacgacgtacctgtgcgtggacaaggcgagcggcggcgagttcgcgtgcaagtccatccccaagcggaagctgctgtgccgggaggactacgaggacgtgtggcgcgagatccagatcatgcaccacctctccgagcaccccaacgtcgtccgcatccgcggcgcctacgaggacgcgctgttcgtccacatcgtcatggagctctgcgccggcggcgagctcttcgaccgcatcgtcgccaagggccactacaccgagcgcgccgccgcgcagctcatccgcaccatcgtcgccgtcgtcgagggatgccactcgctcggcgtcatgcaccgggacctcaagcccgagaacttcctcttcgccagcgccgccgaggacgcccccctcaaggccactgatttcggcctctccatgttctacaagcctggtatgtgtggtttcttagtttcacatttgctcattttggtaagcaattcgttgttgttattgttcatgtgtttgcattaaaattgtgtactgcttatgttgcattcaaatgactaagtcggagctttgtttatagcttgccttggttgaatcaattaagcttagtaatagttctttcatacattgttcatttggctgtcttcagattaattgaactcagcaatagttcttgcatacattgttcattttgctggaagacagcttacttgtctgctagattcttacttacttgtggcccatctgtccttctgttacaccctggtctgcactcatacattgggttttgggtttgaataaatgaggctgagatatgtgtgtggtatgacattgatatgataatgggagagggaattgaaacgttcttgggttctagctggaaactcaatctgtgcaagttagtccatttttgagaaaaggaataccacaaacagttcctacatcctagtactagtaactttgatgtaaatggcaatagtactgcttttgtggtttatctcatttgaactttttaatgcatgtcaaatattttttatgatattgtgatagttgccagctggtaattttcgcaaggaaccattaagtatttaagtgctcttatgattacgttatgtaaccttaaaatgggtagggaagaggtatctttgtctccatgtagtcactattcagctaagtctagttcaatggtagtgttatgtattgttggacatgagattggttgcaaattgcctaatttaggaagatgatgtgaaatgcagtgtcatacctactgctaccaccatcgccattgttgttgttccttatttgtttgtatctgtactgtgtattttgacttggatcttgtcaggaatgctgtatgagtcatgttaagtttatgaaactctgattttcatttcctcaggtgataagttctctgatgttgttgggagcccctattatgttgcacctgaggtacttcagaaatgctatggtccagaatctgatgtctggagtgctggggtaattctttacattttgctatgtggtgttccaccattttgggcaggtaaattatttgccactaaacaactaaattagtaggtccctccaaattctcacgtttccattgtcatattgtctcttgccttgcagaaactgaagctggaattttcaggcagattctacgaggcaaacttgattttgaatctgaaccctggcctagcatctctgacagtgctaaagatctagtccgtaatatgctttgccgggatcctacaaagagacttacagcccatgaggttctctgtaagtcaaccctgtttcctactcttactcgccataggtctgctttgcttaaatatgacataggtaggatgtcttcttttttctccttgtgatggcattgcctattccaggtcatccatggattgttgatgatgctgtggcacctgacaagcctattgattctgctgttttgtcaagactgaagcacttttcggcaatgaacaagctcaagaagatggcattgagggtacggagatttgtctataagtttgtgattcaattatttgcttatttcaattactctcaggttgaccttgtttgcctcatatatgaaaggcacctgacaagtctcattttctcccctgatttgtt

SEQ ID NO: 36928 - DNA, 13027 bp, Oryza sativa
ttttcttttcttttgaaatgctcgatctagcttgtgaaacatgcaatgatcatcttgagctctttacatattgttaagtatctttcattttgcaggttattgctgaaagcctgtctgaggaagagattggaggactaaaggagctattcaaaatgattgatactgacgatagtggaactataacttttgatgagctgaaagagggcttgaaaagggtgggttcagaattaacagaacatgaaatccaggctttaatggaagcggtaagtgcttctttgttagttgatccttcagggaaatgtaacttgcaggggccttctgatcctcagcattttgtatttcttgcatgctgtaatttttatgtctcgtaatttacatctcggcatctctcttgcctttgctaaaatggaaaagaaaaatccttcactaggaaagaaaggtgttttgtattaagatttaagatagcatgtcttgctgcttttgctaaattgtaatatgttcatttgtttcaggctgatatcgacaacagtggaaccatcgactatggtgaattcattgctgctactctccacatgaataagctagagagggaggaaaacttagtatcagcattctcatttttcgacaaagatggaagtggtttcataactattgatgagctgtcacaagcatgccgcgaatttggccttgatgatcttcaccttgaggatatgattaaagatgttgatcaaaacaatgtgagttgttcttatactctgcattctgtagtttgtccaatttttgacttgtttgttcaccaattgatttcttcacccgttttcaggacggacaaattgactacagcgagttcacggcgatgatgagaaagggcaatgctggtggagctggaaggagaaccatgaggaacagcttgcagttgaatcttggtgagatcttgaaccccagcaacagctaaactcctacaggaaggccatggctgttacatgccatcattgtctgaatctctgcacgcctcatcagctggactaatctctaagagggcaaagccgttgagtgaattgtgctttggcgttacatgagacgctgaagaattttcgtagcagtaatagctacagctactagagtgtaagagaaattggcgttatgtgatcgtaatatcctatcagtgtaactgatcttagatgatgctggagatgatagtacaatgaacagcttatatgtattcctgtccttgtagactgaacattgttgatagttggggaatgctcttggcatcaattctgtctcttctatctattattctatcgttagtacaggttgttgatgttaaatgtcactccaagttctaaacataattttcaggctctgctattgagcaatcttaaacttatgcttaaaatatgagccagtattcttaaacagttttataaaaattatagtaaatgtcagaaaacaatgtttaaatagctttcaaatgctgtgttctaaattgggtttaggctaggttaatcactcgtttaacgtaagcacgcttttcaaactgctaaacgatatgtttcgtgctaaaacctcatatagagaagtttcttaaaaatcaattgaagtttacaatatataatactttattaattatatattaatggtttaactagcttaatcctaaccgctatatagaaggcccctcttattgattctgaaacgggcctgtattttactccaaaatcacggcccatcaacgaaaatgggccgcgcattgtggggcccaaatctggataagaaggtgaggagagggaatccatccaaaatcctctcccttcccaaatgccgccgccgccgccgccgccgcggcttctcgccggcggcgaccaccacccgtcacccacctccgcgtcctcgccggagcacccgttcctctccgcccacctcctcctcccttccccctccccctccgacctcccctcccttcacctccctctcgccctcgccttctccttcctcgccgacccttcccccctcccccgccgcctcctcgtcgtgctccacgccgccggcggccgctaccccgccttctaccacgccttcgcctccgcgcttctctccctccccttcccgctcctcctcccccacccgcgcaaccggctcctcctcgccgcctccgagctcgcccgcgcggcggcgccggggttcgcgccattgctcgtctcgctcctccgccgcctccccttccccggcgacgcccgcctgctcgatatcttccacgagcacgcctccttcctcgccgacgaagagccccagctcctcgcctccgccgtcttcgccttcctccgcctcctcgccaagaaccgcctcgatccggccccgcagtgtctcgagtgcagcgactgtggcgagtgcaagaacgcgaagaatcttgcaggatgcagggagaatctggtgtcgttttgcgcctccgtgttgcgggatcacacccaagtgtgtgagctgatcgggagggacctcgtgaggtgtctccatgaactggtgctcgtgcaggagttccatgaactgtggaaggactcgatgctgggccgtgcggcggagatctgccgcattggcatgccgggttggtgcaccgcgatggccgtctcaccggagatggagacgcagctgctgttcatgatgaacaatgtgaggtgggggaatcagaagaggtaccagctgtggtttgcgaggaagcatttgatggtgcctggaggggaggagaggatacccgacattgtccggttcatctgttgcgggtatcacccaacaaataaggttatgcagtctggtgtcattgcccgatgggcggtcataggttggctgctgacaagctgcaataagagctatgtgcaggcgaatgcaaaggttgcgctgttctatgactggttgtttttcgacgagggtaagggcaatctcatgaatattgagcctgcaatgctcctgatggtaaactcagtgtctcagtatactgatatcacaaacatgctacttgagttcttgtttcttcttgtcgagaactatgacgtgcggaggaaggaggcgattgctgagtgtgtaaggaacgcatttgcggtactggtgaagaaaggagtggtcccttccttggatatattgacatgctgtgagaagctttcaccgatgctgaggcagaaacttgtggcatttttatcttctgctagtcctgaagaaaccgaaaaaacttgtgggcaacccattgatgaggcttctaaagcaatggatttgaacaacagagtttgctcaaactagacccttttactgttcaacagagtagcatgttaggaatgaactcaacaccacttgcccgcaatttctccttttgggatcttcaggaagacctggaaagaggacttgaagattgtatggcatcacgtgtagaggtgaacgcatgctttgaaggtggaagaatacggattgtagaatgtggcttaccaacagctggtcatatgagcagagctacgcatactaaatctctgctgacatgttacatcgcatcacagacacatttgtttacagagttacagtctaacccatccagtgaactacacaaccttgttagcatactcatattcatggttatggagataatgaactggccttggcattggtttctcacctgaaggatggaaatggaatacatttaactggacacaatatgtgcttcatgccatgtatttacctttgttttaaatataacaaattcatgtacagcagaaaactaggtcttcatacaaatttacaatctgcctgaactgattgaagaaacctcaatatgagcttttggatgctacaagcctaagacaaaaatatacagatcttatgttcaaatgtgctgcagagacaacatgcactgcatccttgtgatgctgaacgtttttgtgtgggcgtgatatattttcttcagaaacatagccacaggtgtatgtgtggatgaatttctcctgagttataggagttcatccgatttaagtaggccacaattatgcacttgtaaatattttgtaactatcccagcttttgttattcaatagtaaaatctctttcatggtactttgtctctttccttttcattgagaccaataggtgccatctaccaacttggatctctgatatcaatgtttttggtgggtagtagaataatatgtcatttatgtttgttttttggccttcaattttctcaatcatctttcactctgattatgtgcatgatttctcccatccttgtattacattcagtagcttcagacatattagtggagctagggaaaggcatatctatcctaattgtgattatcatatcaagtgctaccacagatgatctgcaagactactacatggctggaattgtttgaaggcactcttggcatagacttgtcaaattagtggtgaatatgtcttctgcagccatctgtctcctgatctactagaacaatgtgtgccacagaagggacccagcatacaacaaacaactcactgctggagttgttatcacccaaacaccaacaggaaattcttgtgaatttcaatggtcaggacaggttcatggatgtcatatatcaggacatctccaccgtcgaaactcgaaagacgcctatgggcaacagttcctggtgaaatgcacccacagaaagccagaattcttcatcatccagccagggatgatccttatttatggaccgcgtatcgcgaagaagaaaaaactctgtttttacatggtacacaaaaaaaagggaaaggaaaatcatggggaggaaatcatgttgccagggtcaggacaaaggaggtggtggcaagaggattggagcaaccaaagcagagccattcatatccaggaggccaacctccacctcacaactcatatcccttttgcccttaaatctgagaagttgctgcacttctcaccccccctctaaggaaagactgcaaagaaaaggcctgtgtcaaggagagggtagtagcaccttgctctcctttgccttcagagaaaccggaagcaatggcgtctgctactctcctcaagtcatctttccttcccaagaagtctgaatggggtgccacccgccaggctgccgcccccaagccggtgactgtctccatggttgtccgcgctggtgcctacgacgatgagcttgtcaagaccgcggtatgctttctgaatatcatccgtactgttctatggtttttggcatgcatttgtttcctctttatatcaatgacaagtgaaggaactttatgtagttttatgatagatataagcactttatcgtcaggaaatcaaataggatgtgcagtcaagctaagttatatatagcagaattcagtgaacataaaacacttgttttgatataacatgattcaaatatactggcatctctagttcaaatctactcttcaaagttatataatgcatttgaaggaaaatttctatcttcaacttcacagaaagcaaaatagatatgatttgtgtataccaaatgaacttagagactcaaaatatactagtaatacatttgtaaactcgacatctgcatcaagacatgacatgggttaaccactagcagttgtaaggataaagcatgaagcattcatgtgtcctgcttatgttctatgaaccatctgcaggtcataattcagaagaaaagtttggaacttctaatcctacaacataacaagcatacttttatcaactttggataataaattcttaagatgagtttttcattcaattatggttcagaactagaagattaaaaactttatccttcttgctgtagaaaaccattgcatcaccaggaaggggtatccttgccatggatgagtcgaacgcgacctgcggtaagaggcttgcgtcaattggccttgagaacaccgaggccaaccgccaggcttaccggaccctccttgtcaccgcaccgggcttgggacagtacatctccggtgctatcctcttcgaggagactctgtaccagtcaactgtagatggcaagaagattgtcgacatcctcactgagcagaaaatcgttccaggtatcaaggtcgacaaggtatgaatttcactccaaactgacccctgatccttgttgctcattcaaagtagtatcaaatttattaaagctgttaaagaactgaatgtgttagagttgttattactagagaaaatcattgttctagattgaaggaactacaacattaattcttctgaatttgtgctcgatgtcagggtcttgtgccccttgctggctccaacaacgagtcatggtgccaaggtctcgacggccttgcctcgcgcgaggcggcatactaccagcagggcgctcgcttcgccaagtggtgagacaaatttttcacctacaaatataatggccagttacctttcacatactatcatttgtggatatcattccagtgtctgacatgaagttcttcatcttcaggcgcactgttgtcagcatccccaacggcccatctgaactcgccgtgaaggaggctgcctggggccttgcccgctacgccgccatttctcaggtacatatcaaacttgattacagaacaaaaactgcaagaacataataaatctctttcctgatgatgctgcaagcatgaacaattttcttgaataatactaggacaacgggctggtgccgattgtcgagcctgagatcctcctcgacggtgagcatggcatcgacaggaccttcgaggtggcgcagaaggtgtgggcggagaccttcttctacatggccgagaacaatgtgatgttcgagggcatcctcctcaagccaagcatggtgacacccggtgccgagtgcaaggacagggccacccctgagcaagtatctgactacaccctcaagctcctccacagaaggatcccccctgccgtccccggcatcatggtcagcattctaccactgataaagaaactgaaactaaagcttaggaagctactaatattgctttacttcttgcaaaatggcttaacctgacttggaatgttgatcaagaaactgccgctgcaaatgttaaaagcttaacctgattcttcttgcaaaatggcttaacctgactggaaatgttgatcaagaaactgccactgcaaatgttgatctgctaattctgacatgattcttcttgcacaacgatactactaactgtctctgcagatgtagatgatcaagaataaacctgaaagtagagctgatcgataatattgattgattgttgtttggtgcagttcttgtcgggtgggcagtcggaggtggaggcgacgcagaacctgaacgcgatgaaccaggggcccaacccgtggcacgtgtcgttctcgtacgcgagggcgctgcagaacacgtgcctcaagacgtggggcgggcagccggagaacgtgaaggcggcgcaggacgcgctgctcctccgcgccaaggccaactcgctggcgcagctcggcaagtacaccagcgacggcgaggccgccgaggccaaggagggcatgttcgtcaagaactacgtctactaatccgatccaatccaatcaagacagtgaacctgctgctgctgctgctacgtactacagctactgctatactgctagtacctcgagggcactgtagccagtgtgtcgtcacagttacaggttgagatcgatggacaaagttaaaactatactgcattaattaattttaccttgagaacatacgtggttcatcatgtatttcatcacatgaatcttttctagagcgtttgatatacatacctcgtgttttccctctgcaataaccttgtgtgtagacgaatctgtatactacctgtatgtgtggcctgtgaatcgatttggttactgcaaagttttgcgtatatatacatgcttgtgattctggaattattctggttacccccttagccttgcttcacaatctgttccctgctctggcaccacataaattgaagcaaaaattgtactcacttcgctgactcatgcccttcactatgatttattctgtgttaactctgaatacgatgcgtatatatgttgctttctttgtgttcctctagtccaaatttctattttggcatgaaaagatttataaaaagcgtgaaaactgaagatcatgaccaaatgctgattttttttttgtttgataacttccattaaaaatgcataaatgtgttattctttttaagtttctcgtgaacatgcttaaatagaactcgtgtggtcatgtccataagttgcatatttgatcccaaagtggttatcatttcggcccataagtggcacaatttcagtgcataagtgcatgcaattttggcctataagcacgttaattttgggtgcgggatgggaaaacatccattcagatatattggtatcctgatgcatcacaacttcacaagagactatcaaacaaggatttggtaggcgatcaaggacatattccaaaagaaactgagtagttggaaaggaaattttttgtctattggaggaaggttgattttgatcaattaagcttcggaatcgctatatttgtggcaacagttttcttccctcattacagtcaaatttctaatcgttcgattggttttgcgatttgtgctgacatagacccaggaacccatatcatcatgtccatatccagttccttgtcacgttggcaggcccattaaaatggcgaggccaaaaatgtttgaataatagcatttctcaacttaaaatgacagtacgtgaagctaaaattacatatataatttagaaacttacaaatgtaactttggaacttacattgcaatacactaaaattacatatgtaatttagggacttacaatgtataaatacatgctaactatttttcataagaaatatggcactatttttcataagaaatatggcgacataaatataggtagtcccattaagttttaagtagcctagctatatttatgatctcctttaattgaggcacctaaaggtacactcaagaatctaggtaattactggtctagattcttttgcagtgtgatgagcataaaaagaaatatagggcctgtttgggggagctttagattctgagaagtagttgtttggtagccagcttctgagaatctggaaaagctctgaaacccaacttctgacttcttagttcatttttcagaatctgtaactacagattctcagaagttgtggactgtttggggcagtttctagcagacaagctcccccaaacagggccatagacttgctaaatggagtgtcttatgcagacctaaagaatgtggggggtctcagaatattaacctcgaggtacagaagaaatatttgctaagcaaagttaattaatgaagaggggctgtggcatgatcttcttagaagaaagtatgtgtccaaaaagaatatcactgaagtagaaaagcgacgagtgggctctcattttgggcaaggttcatggaggctaagaaatcctttctgccattgggatcctaggagattaggaagggttctcaagtgagattttgggaggattactggtgtggtgataggccattcaacttactatattcttccttgtattctttggcaaggaaaaggaacacaatagtggcagaggcttagtacaacacctctaaaggattggtataaactggtctcaagagtttgtgcatttaatctatctgaacaagatgatctttttaaatggaaagttcaaaagaatggaatcttcacggttaactccatgtataaggtgctcatgtatcgagatatcatacaattctattatctggaagcctagatttccgttaaatataaagacatttctatggtatatgggagaagatgtcatgttgacaaaagacattctagttaaaaggaaatgaaaagggatcactgatattgtttatgtaatgctaatgagactatacagcatctcttttttgaatgtcaagtagccaaaaacatgtggagtgccgtatcttttttgggccaattccctatatgcccatgtaatttcacccaatcccttctacgcccctgaaatttgtttgatctcttatatacccctgagtttttatttggatcccttacatacccattccgttagttgaccattagtttgaccgttagttattgtagaaattactttattgtccttgttatattgttaaaagctagaaatgttttatgtgtaaattatttgagttgtgaaaaccaataaggaataaattactaaatatttgtgatgaatttttgaaaataaaacattatttcattaaaataaaaaaagatttattgtaaaaaaaagttctgcataagatttgaaaattacttttcaacaaatatttagtgaaaaaagattcgttgtgaaaaaacaaaggggatataattagtttatcacaaattagaaaacaaatttaaaatttttaaataaatttcagatcaaatttgatgaatttcgtatatcttcccaaaaatttaaacctaaataacatttagtttttgctcttaattttctggtgaaactaatgtatggatttaatcataatttttaaaaaataaaaaataataagttttattttttaagttgggcattaaatgattatattgcttgtattttgtataagtttatttttcatatgaaaatttattgggtaggtaccacacatatgtataggatgggtaatatagtcattttaaaatatttaacggtcaactaatggtcaactaacggagatgggtatagaggagatcaaaatgaaaactcaggggtatataagggataatgtcaaattcaggggtattgaagggattgagtaaattttcaggggtatatagggaattttctcttttttttatatttgatgaagagaggctgcaagatgttggaggccagagtgtgatgagcttcttctctaggcaaggatggaacttcaggggaagattacaagcttaatctttgtttctcttcttttgtaagggttggaactgtttaagtggtggtcatttcggtactgcccattatatctaaaaaaaaaagaagctaagctacctcagtttgtgtagtatttatagagtggtagtggcccaatggggaatgacaaagatatgtcataatttgctcttaaacccaagtttattagcttgcaatatatgcttaaaagtacaatctgcctatgatatgatgatacaagctactccctctgtttcaggttataaaactttctagcattgctcacattcatatagatgttaataaatctatatacgatgcttcagcataattaggagttggtgaggtcagccgggtcgagcatttgatcgccatggctggtctcaccaaggaagccggcgtgcgaaaggagcacccacaggtgcgtggtgagctccccgctcccgcgcaggtgcacctgatgcttcgccgccctcgtcgatgccgacaggtgcagcaggaaacccgcccagaacttgcccagcctcttccatagctcgacctcggcgccgccaccgaacgccgccacgagctcctccgatagcagcgcgccaatgtcaatgatgccctctcaccgtcgtccccattgcaccgcggcctgttggagtttaggatgagctgatgcggaagcccttgcatcgcgttgcacccgcgcatggattgtgcggcctccctcctcacttcatggaggaccttgtaggcgacgaggccattgtccggcaccagtgcctgcctgaccaggtacgcacggtagttggacagggtgacggcggtgacataatgcggccacacatctgcgagttcaccatcaccaccgccctcgggcagagtgaggttatacaggtcgtctcgccagcgaccggtggcttgttgttccagtagtttgatctggcagaggctggtggcgatgtgccaggctagaatcttgtgggtctcgccctcgcccttgatctctctttggatatgctcgatctgactgacaaggtgttcgatgtcggcgaaggcattcccaaggtaagaccgcaatagctcgttctttttctgcgccaactcctctggtgaactcctcgtccttccagccgccactgacgctgccgcctcttgagaattcaggagggccttgattgacgaaaacagttccatcttcacctccctccgcagctaccttgttctgtatgccaaggtgaaaaattgatttgaattatatataatatataggagaactacaaattggtcatccgttgataatcatgatcaaaatagcatggtgattgatgactaataaaggggtcatctattcatcaattaactgatttttaaaagttcgacacactcttttcaataagccacttttcaatacaatggtgcaaacctccgaccctctccctctcccttgcctacatgacccaacccgcttatactgctccccaacccaacgcaccaccatcctttcccttgtcagcatcgttgaggcccacaacccaacacaccaccattctcaccgtctccctccctcatgctcaattcaggtagaagacggttgctatgccgtggatcttgatcaacattatattcattggtcaactaagattttaggggaactcttctcagtgcactgatgaataacgaaaatggattcaatttatttagaagagatcgataaattgtttacctaaagataactcttgtaacgcgggctatgcttccagtccgagccgacatcactaggttgcactggcgaatattgcggtcccgtcggcttcgtcccctcccgatgagccagaacatgatcctcgccaccttctccatcatccaaagccgcagcccctggatccagcagccttgacgtcctcgcaacctgatgtagctgcagatgatcaagacattggtccactgcgagaagacgtgcacgataatctcccagagctctctaatgacaagtatggcgatgatgcagtgggtgacgaacacctcatggctgatcctagcgaggcggcccttggcagtgagg

SEQ ID NO: 36929 - DNA, 4212 bp, Oryza sativa
  unsure (1)..(4212): unsure at all n locations
nnnnnnnnnnnnnnnnnnnnnnnnnnnnnnnnnnnnnnnnnnnnnnnnnnnnnnncagtgcactgatgaataacgaaaatggattcaatttatttagaagagatcgataaattgtttacctaaagataactcttgtaacgcgggctatgcttccagtccgagccgacatcactaggttgcactggcgaatattgcggtcccgtcggcttcgtcccctcccgatgagccagaacatgatcctcgccaccttctccatcatccaaagccgcagcccctggatccagcagccttgacgtcctcgcaacctgatgtagctgcagatgatcaagacattggtccactgcgagaagacgtgcacgataatctcccagagctctctaatgacaagtatggcgatgatgcagtgggtgacgaacactccatggctgatcctagcgaggcggcccttggcagtgaggcctgtgctaacactaggcatatcatgcactgcgtaggccaggtatgaggcagctgctgtcatcagaagcgatagcagcaacctcacgcaagggaagccactggcgaagacatcagcgtgcttgctgtagaagaagtcctggaggaaggacagctctacctccgtcacacggaacgccctctcgtagcccttcttgtcatctaggatggcgtccacaacgagctgccgggtgcctgcatggctggcctcatgtatggggaagttgaagaaccgacggcgcagcagcttgtacagggcgaaggagaggcacacgtccttgaaccggttgctgctgtcgccggcctcaccgagcagggcatcgctgctcccttggctccagaccttctccacagtgatgacctcctcctgcgcaagttgcgtctgtgtgaagctgggtggttcgacctttatctgctgcttcagcttctcctccccgagaacgatgtacttgtaccccgccatggtggccgggttggcatcgttggacgtgtgctgcgtcggcatcgccatgtagtcactgacaagcttcatgtcatcatctctagctctggcagccgcgctggaggtgatgtagtaccagacgatgcgcgaggcgtggatggaccacatgagccagagaggcaccctgaggtgtatcgccgtcttcgcccgaagctggttggccgaccacagcgaggtgagcatgtcgacgagggtcatctccttgggctggtacggccggccgatgcggatgctgtcctgcatggtgacgatgaggacggcccacaccttgaagaaggcgttcgccacggtaccttgatgggaggacgacgccggcatgagccccagggtgtagctcacagcataatggttcagtatccgcaggagctggacagcagggttgatgtacttctggaagaagaaagcggggcccgatggaatcgacggcgaacttgatcagcagcagcgttgtcgccgccgccacccagaactcgacactggctgcaccagtggtgctgtcatgacggaacaaccctcctacagttgtggagatcaagtggaggatcgtcagaacaatattagccatcttgcatttgcacactactgccgtctgacgaagcctacttagcaagctaaacacacattagcaacttaactagcaagctagccaaacacattaacactgcttgaactgaaaactttggtatagcaacttagctagttaattagctcatcccaaaatgataagctcaactcactggttttgacgtcaagtcaagatgcttactttaaaaaaagacataacgctagtatatggttgtcgcgttcccatagaattttaatgactttataaagaaaagttgctgccatgacttattgcgtcaatgaaaaatgttatctatcacatggttatcgcaatatagcattttcaaatgggaaactgttttaagtcctgagcactggatgccctcattcctttaaatgatactccctccatccctaaatgtttgacgccgttgacttttttaaacatgtttgaccgttcgttttattcaaaaaatttaagcaattattaattcttttcctaccatttaatttattgttaaatatacttttatgtatacatatagttttacatatttcacaaaagtttttaaataagacgaacggtcaaacatattttaaaaagtcaatggcgtcaaacatttaggaaaggagggagtatcatacaatgagtccaatcatacaaagttgggcagacaatagtagcctatgaaaattactaaattagagaacatatactattgtcttagatattcctctataaatattcaaaattaaatccgctgcacacatctaactgtgagtgagattacaccttttatcgagaaataaaaattgtaaatccaaccataaatgagattgcactattctattttgttatttttacttctctctacatagattcactctagattaaatattatggagggtgtatgagacaatagtctatgttgtcatatttttaagaaaactttataactattaaggctatattgaaatactacaattatttgcagtcttactcccacaagtaggtgtggaaatggtcgagaattccacactgactaaggctcatttctgatttctaccaatatagcgctagtcaaaaacagtggtgggaacagtttcagtctttcaccatccctttcctcggtctgtattgtattcatccagaaattattgaatatctagacgccttaatggcacatacaaaatgaggttacaaaacttggggaggcaacatatgcgtgaaggttgtcctaacccaccccctttggtttgtaggaaaaatggagaaaaaaacatagtaacaagaattctatagaaatagaaaaaattcctgcacgtttcatccatttggtttgtacgaatggagcaaaggagaaacatagaaaaaattcctttggatatgtttccaaaggaaattcataggaaaacatagagctcttttttctattcatgcacataggattgaggcaaagcactcactgttctatgtacttggcctcaagatgcatggattaaaacattcaagtctgatttacatttacttactacagggtattcctgcattttcctcaccaattatgtgaacgtatgatcattcctaaatttatcacgtttttaatcctctgttttacatatgcatttttcccatgttttttgcattcctgggttctaaggagacctttgcataaattagagctaggacgcacgcgcaactagattcccgacatcctttttttccagaaaaaaaggccttctacaatatgaccgcactcacaaaaagttgcaaaaaagtagctgcaactatttagctcttgatataatcaaggtctagggctttggccagtattatttatttgcagtgtgtccaccagataacaaattaagagaagacacgcacaagatgcattaggcatacatgatgatgcgatgacgaagactagaatcttttgcatctaactaaaagccaaaagggagaagcacatacttgtttaagaatggtaaggttggttaggccatcaccaacccccaccacataatttatttaagaatggtaaggtgggttagaccatcatcaaccccaccagaattctggaatgatcatgcattatccttaaacgttaaactaaacaacacatcatcatatggccatccgacaacgccgccacaagccttcgagctttatgagccaaatacaaactttccttcgagctttatgagccaaatacaaactttcatgatgatttctctaacttcaatataaaccatcttagacttgtgtacaaattttaagaaaataacttgattgactttctttttggcttcatttattgacgtttcaaatatatggatttcctaatttatttgaggaatatcgttatttcctaagagcacatatgggagaaaagtggaaaaagttattcaaagtttcgaaatgaatcaaatttaggaaaaagttgagaatactaaataagttacatttggtatcgaagggaagtattacacagcggtttttgacagtctactgatgttgaagtaaggccatagctgtttgatagcttaatcataaatatatttagatgacattggctagtaaatacaagatatctatgataagattataagaaaatccaagaaacaccattgacaagcacccaattacaaga

SEQ ID NO: 36930 - DNA, 1693 bp, Oryza sativa
cttgtgtacaaattttaagaaaataacttgattgactttctttttggcttcatttattgacgtttcaaatatatggatttcctaatttatttgaggaatatcgttatttcctaagagcacatatgggagaaaagtggaaaaagttattcaaagtttcgaaatgaatcaaatttaggaaaaagttgagaatactaaataagttacatttggtatcgaagggaagtattacacagcggtttttgacagtctactgatgttgaagtaaggccatagctgtttgatagcttaatcataaatatatttagatgacattggctagtaaatacaagatatctatgataagattataagaaaatccaagaaacaccattgacaagcacccaattacaagaaataccatcgacaagtgcaagttccacaaaatatcatcgtacaagcgactttgtcccaaaaatatcatcgtcgttatggttccgtccatcccacgccattaaatgcaatgttcatcctatagcacctaacggagggctgctaacaggacctaacggcgatgatatttctagaacaaagtcacttgtacgatggcatttcatgaaactcgcgcttgtcgatgtcatttcttggaattgggcgcttgttaatggcatatctgggattttccctaggactattagcaaccaattataattcattagtccgcattgcatgggcatttttatctactttactcctaattttttttaaaattactaaggacaaaatgatatcaaacttaataatgattgcaaaatcatatgtagagtccatcctaatattcagttactttcatttttaatttaatatttaaaaaatccaaaagtaaataagtatttagttgcatttgtgctagagtcacaatttagtatgctttataacttaatgtttgcatttgtgttggagtttcacttggcttcaagtctcaattatagagtggttttttcatgatttaataggttcttgattccaaattaataaacatctagttgtgctatgttaggagtctcagttatagttttcacttgatttaataattaaaaattttggaattaatagctggtaggttgtactccctgcgtcccaaaatacaagggattttatatggatgggacacatcctataactacaaatctggacatatacaaatctagatagacttcttccctatctagattcgtattactagggtgtgttcaatccatccaaaatccaacagagatttcattactcatttttttcctggttctctaggggtaagacagtggttgcgtgttccctgtgatgggaggagaaggcggacagacgactcattgtaagatgtgggatgcttgtttcaatctaactatgtaagctttcaaaaaaaatgtcaagtacagaaactaaagtgtagagtatatttctagggtctaatggcaagttagacaataggacactcaaatagcaggaccagcacaagagtcccaaggcaggttagccacctgagggccgacttttagaatactggtgctaagctttactcctgtgaagggtgaatgcaaactgacagttctaagctttattccaatgacatgtggatgcatgattaattggcactacttagtgcaaaaggtagttgtggaatataattagtagaagaccactgaccatgactctgtga

SEQ ID NO: 36931 - DNA, 19159 bp, Oryza sativa
aatttcctgtttatcttttacttgctcatcatcaataaattaacaaacagggccatcgaacaagcttaaaaattgaaaatggtggacgtccgtgctgtgattgaatcattttttgtcatgctgaaagagaacatctatgtcttgatccgcattgagtccttggtggcactggtgacattgatattccttgcaatgttcatcatagacttctaccgctgccgaactcgtagctcaatcttgaccaccattcttgaaagcatcgacgaattatctgatcagatagtagtgtacctcattggagccatgcaatccgcgaggtttgagaatgagctgttcccggtctgggccatcgtgctggtgagtctccgtaccagcctcggctatctctctgggtatggcatctcagaccgtgatcgacaattcatggagctggcaaatgtgatcaagttcataggggcaggggtcttggctggcactcgtggcttgaagtatgcaaggccactctggtcattttgggccatcctgcaactgaagagcatgtaccggttcttcgcacatggcatggcaaacgaatccttgtggcatggccggagctcagagtttattcctgagtacatgcgcaccttcattcctgaggaccaggagacaggcgtcaatcatgatgatagaaacacatcaactatgatgccaggcaaaaaatatctgatctgcggagagtccaacaaagacatcaccttaaagaagcctcaatacactataaatatcagcaacagcagcgctcagtcactggtcacactgggcaagattcaggagtacaattggaaggggatgaacaacagagatggagacagtaagtttaaagacttgagcatggccttctcactgtcaaggctgcttcggtgcaggcttgaagatgtgacactgaacaaagatagcattaacgacatgcagcatctaatcatctcggagttcattcctgacagccgaggacaacggcaggaggagaaggtggacgggcaccaggctgtcgaggctgagcggacattcaggatccttgagttggagcttgcatttgtcagagactacttctacaccctctacccattggtcttctgggaagggcttggttctctctgtttgagtctgctcctgtccgctgcaactttcgccattgccttctggctggccgtaggaatccgcaaggtctatcaacccccagagggcaatcttgtgctctgggtggatggatgtaattttgacatcatcatgacatgggtgttcatgttctgtgtgatgttcaaggagatctgggaaatagtcacatacctggtatcaaactggacaagattacttgtcctgtgcaagtatgtgcaggaccaggcttggtttgtgagtgaacgactcacgaagcatctagtaaggtcatttttcgagtcaaaaattggcgaaccatggcatggacgtatcgatcagtatgacttcttgcagcaaattacttacaagccaacattatggaaactggcaaatgtcatcaccctgggaaagattaaaggcaaattggatgggaaaaaaactggtgaagccatcaagatccctcaatgtgtaaagctagcaatcctacaggcaatccgccgcatcggcctcaccagtagaccgttaccgagagaaatcccatcactgagaagctacgtacatgctctcaagtcattctagtgtggcacatcgcaaccagcctctgcgagatcaagcttgcgcatgacaagaaaattgacttaaccaaacctgggttcttgtgttctgcctggtcgtacatgaaaaaaaagctctgctgcttctcttcctacccataccttataggcgagaacagtggcctgtctgctgggctcaaaacaaactaccatatcgcgatcagcttgtcacggtattgcgcttatctacaggtttttcgttctgaactgttaccagatagttttcttgtccctgaagtgctatttgtggaaaccttaaagcatgcccgcgaacaactcaaggattgtaacctgaaatggtgtagatataacaaactcatgggaattgcactgcaagcaacaccaagcagtgtagatgagaaattgaaaatgaacatactgcagcaaggtgttactctagccaaggacctgatcggaatgaaggatgatgaagcctgttggaagatcctagctgaggtttgggctgatttacttgtgcacatcgccccaagctggaatgcatcagatcataagaataatctcgagtctggaggcgagttcattactctaatctgggcattgctttggcactgtggcatcgaaaagagcagcctgtggcacaaggatgaagcatttgaaaacaattctcaagtacctcaagaaagcagtactgaaaccagaaatgttatacctatggatgagccagctaatgaggatggaatcgagagttcagaagagctcaagacaagaagctttaggaggggaaaggagagcagaaatggtccaaaagatacagcaaagcaatcacatggtgagaatgaagaaaagaatggcatatcttccagcagcttcaggagttaatgtgccacaaatactatggtgagcgtgtaaaaccaagtgtggttttggtttatttgtgatggaaaattggcaacgaaatatataaccatgagttggttttgagtgagaaatttgctttggattgttggcgattttaggcatcagtgcttatgactaatgtgggtcaggttgcgatatctgtgcccagaatcggatgtttggtttacgtgtgtgcaggtgatcgaagtcaacctcggtcaatggcgaggaccgggactatgctcagggaggagcataggtccggcacggtcaagaggccatgtgacaaggtgggactgacgtcatgatccctgatggtcaacctaagtcgacggcggatcgggactagactgagggggagttgaggtccagaatgatcgacgaagctgtgtgacaaggttaagatcaaggtgacacatggtggacgaacaccgtgtcgggaagactttgcgacgggcttcgcaaggtcaagtgcaagtgccgggattcgcgaagaaagccgacggatgaaaggagcaagcagtgctacagtacacgtggtactgtagcatgcagccaatgagaaaagtgcacgtgcatgcacttggttggaagacttggtcaagcaagctagcatgcaagctgtgcatgtgtgtgcattggtttgagcagtgcatgcatggacaaggtgatgtgcatgtgtgttgtgattggttggtagggaggccaccaatccatcgtgatcatgggctcggccaggatgccacacggctggaccggactggcccagtccaagatggagcagaggccagcatgatccaagcaacgacggcccagctcggcaagcaagggcgtcaaggcaggaggtctcggcgacgacgcgcgcgtgagggacacgcggcaggcgcggactcgactgcgcgctctcgcgcgggagatcgactacatgcgggacccatgccaaattcagatggcgtgcgcgggaggagaaggtgcgcgggagcggctgggcgacgtggcagcatcggtttcgcgcgcgggcgtgggacccaagcgactccgcgcgcgcgcgggagatggcgctctccctcgctgtcaagtgggcccggccgggagcacgagctcgcgtgagggacgcgcgtgcggcacggctggcgacgtggcgtgcatggattggtttggattgggatcacacggatcgggagtgcgaggagtttttggattgactaggtggcagcgatctggagcttcctttgagtagaaggaacaatggatggaacagatctgttctgagttaggttttcgccctaggggtatttgagacaatgtcttaggggtcttaggctataaatagagagatggatgcaagggtggaggttgctcctttcgtaatccttttgagatgctcggtgagagagttatggtgtgagtttggagtgtgtttgcctgagaggcttttgtattaggattagtttggagtgtgtttgtccgagagattttaagtctgtgttaatgttcctctgaaggtgtatgtttgctcctagttgagcgattattttgcatcacctatgaatgaaatgatttgaaggatttcgtttttgtcttgttcatttaaattccgcaatttaaattccacttgcaatttgaactttgcgatgatgagttttgctcactcctcctcacctctcttctagtttcgggaattccttttctcttcctcttctagtgtcgggaattccttctctcttcttttctagatccggcttctctaatagccgcggttccagtaaggattttgagaaatccggcttgataagtattttcgggggcaagatttgaattgctatattcacccccctctatagccgttcttggtctttcagagcgcatgactccatatacttcctttctgtatgtacttttaacatgtacctgaattctaacgctgtggttttttttttcagaatttacaagagcaagctggatctagttcaactactgccttcccgtgcctggaaactggaaagattttttcaaaagaaatacacagaagctatttgaataaagttagtccttttgggggggctctttgaataagtcaagtacacagatgtatccttgaaactttgaaagcctcttggttggtccctacttgccgtttacatgtttgtggtctttttatgttgtcatgattttcacactcaattggagaagtcctctattttcccttcgtttattgtgatgtatttgaatacctatatgtattttgcttgtcctacgtcctgcatgggattgatagcagattggaattaagtcgacccctttctatgaattgctcttctttattatctttgtgttaccgtcaaactcccagcgatattgtacattatatagaagtatataacatagaacatttgtgagtcgacagcttcggaggctcggagctcccactttttttttcgtttattcctaagttaaagtgcagtgaactgaaatgcagtgatgtagctctcacctgaagttactgaaccaatatctccattaactgaaggtgatgcaggcttttgcattcgcaagaattgcaacagaatttctgctccctttccattttccgaaaagataataattcaggtggaatttcatatctgttagcacttctccggtgccaatttgtggcactaccagtggtttactagactcgaatcgaatccaccacccctccccctctccgatccttaacccgatatcattagctggttgtttcaactttcaaccctacaaaaatttttgacaaattttctactaaaaattttaacagatgtaataatgcacacatcaaaacccaagaacacgaaacgtcgcacaaattgtagtgtgtacttggggataactaatactccacattatataagctacagatttaaggtcatatatcatagaactacatatttacaacaaatttatcacaaaactacatatttaagactaaatatcacaaaactacatatctaataataaaattatcactaaactacatattttgggggttaaattctttgcactaatgttatgtttgagttgtaaatgtctaagttttatgattaaattgatattaaacctgaagtttttttataattttgttactggacctatagttttacgatattttaccttaaatctgtagttttgtgataaaattagtgctaaatctgtagttttatgatatattacgttaaatctgtagttttatgataatttgaccaaagtacttgtagttttgtgaaatttactcttaaggagtgcagattaagactcggtcgcagtattgccgtgtgttctatggcagggcctagagtcccggttgaatactaccatgtaatatataaggtgggcagggagcctcgaagggcataacaactatcagatcgtcaaatcaatgcaacatctggtgaatacaatcccaaacagtagtagggtattacctcttatcaagagggactgaacctacctaaacccttatgtttcacattcatctacttttaagtttcatgtgctaccttttttttgtcattgccaattttcagaatcgacatggtgtgaaaagtaactgaaattccttaccacaattatgaaaaattcagtgacctgaaatctatgacactctcattgccaaatatagttgaatggcccatatatatacctgtatctcatttaggtgtccaggaactagtcactatgatcttaaaattaattatcaaggaaagaggtcaaaagcattaaatggcgagagctatacgtgtttgtcacccttttctgccaaataacaatttacatatatctatatatatcatcaacaaaatcattttcttgtttaccatgtgtatatgcccattgcgataccattaacaaatgcttactcttatttcagtatttgaactctttgcctatttaaattattgatatttttggcatgattttttatgcgtgcttgtacagtgtgctgtcatcattagagataagggtttacagactgttgtttctttaatcgtggacgtctttgcttttctgttttgtcatcttttggatgttcagatgcccatcaccgtcaggagcgaatatggattgctgtgtcaactagcaattgttctcgtaagtggacaatacggatcaggatcgtatattcgtatatagcacgcactgcagagaagtcctgtttatgtgagagaaacagcggattaatgccatataaacagtgtcatttcgctgtagctatagtgaactaatgccatgaacagtgaattaatgctgtgatagaggcctcctcgtaaatcttatctctttcctacggacaaatgccagcaagttgcatagttgaagggataggcaagtgcgtatataaacaatatcgccaaagtacatatatgaattaatgtggtacccatctttaatgctggttcgtaacttcctgtagtcccagttatatgaatctaggtttattttagttccgattaaaataactaggattaaattttttagtctcggttggtaagatggagccaggccaggtccggttggtagttttttttctttttttcattgtttttaactttgaatgttaatttcactacatccccaaatcaatcatcacaaaacaaaaggaatcatttccaaatctccaaatcaatcatctccaaatacatcacaaattctaaaaaaacattacaaatacatcacatattcacatctcacacaaatcaaatacatcacatattctcaaaaacaaattcatcacaaatcttttaaaaataaatcctgctccggtccagctgcagttgtacagccgcgtccgcctcccctgcctccggatatagggtaggggagggaagacaaactgcctctccagcccagccgctcctatccacaaacggcgacggcaaccgcttctcccaccgccgaccccgcccgaccgcctgccctcccggatccggcgcgcgcagaccgctgtcgcccgacacgcagaccgccgcggccctctgtcggcctcgctcgctcctgctcctcgctcctcaatctgcagcgaaaggaagaaggagaggataagaagaagagaagagagagattaaagaaaaggataagagagagatcaagaatagaaagatgaggaatttgggaggataagtccaaaggattatatatggtgcatcggtttttagtcctggttggtgttaccaaccaggactaaagatcgccagccccctgatagcctctgacagtaaatgaaccgggattaaagattatccaagggcgataggcgatagagttttaaaccgggacaaaaaaaccatattaagtcctggtttctatttaaaatgggattattgtggtttttggccaacccagtaaagatggtttcttcagttgtgtcatttgtttcgtaatatcttcattatctaaaagttactcatttaaaattttaatacgacccagtaatgatgtcagggttatggataaggtataccctctatcgttggagtcatgtgatatacgggcctgtttggcacagctccagccaaacagtttcagctccaccaaaactaggagtggagttgggtggagctctctcacaaaatatactagagttgtggagctgggtttaggcagctccacaactccactctagacccaacttctagagctaaatttaggagttagagctgtagcaaacagaccctacgaatacaatatatctatgagtatatggaaagagtttgctagattaagaaaatagtgttcatgaaaggggaaataatagagttctactcgaaaaagattaggaaactatattaccgtgcggggtccgttgtctccgagttatatttgcagactaaggcgatttgcagtataaatataggctacctaggaggtacaggtcatcgaatccgaatcctaagtgtaagacacccgccacgacaaaagcaatccggaggatttgaagcctattcgccgatagatctcgtcgagtctctctcgacaaggatcttttcggtaatttcggagtttagttgttctcttttgtactctgtgattttctctataatatcatataaacaggattagggctattatcttacgaggaatctaaaccagtataatccttgtctttttatatgcttaatatcgtatcgtgtagatccttataccaacataccccaataacctcataatatggtccacgggtatcccccgtcgacatatgagtcaacaatatcatctcttaaaaaccaaaatgggtactgaatgatcaaagtttgctatggatgcaaaagggcatgtagcctagtggttacaagagtctcagtagcaccttagatcctggattcgactccccatgggagcaaattttccatgagagaatttttcaggatttcaatcataggagtgagtgtgcgtctgttgtgagtgtctgcgctatactgtgtaaacgttttctttgactgttatctcgatctcaataattgactcatactgtctagtttcttggtatctagtatatgaacggcaataattgtttggcaatgtatagatattcatatgtgtggtctatggagtcgcatgcatgtttcttgatgttgcgtgagacgctagcaaattttctctgttgaacgaatccagatccggtgcagtcatagaagagactgcaggtttagcagttggaaccatttttcatcattggatcaaggcaatcaacggctgaaacaaatgctacggttgttttaaacaataattgctacagcacctgctacaggaacgaactttgtacggtcatttgtgaacagtatcaaggaaagatctagaacgttaatttataatccaatggtgtccttaggactgcataagttgctatagccactgcatgtgatcccaatccttgttgaacgcttgtctgagaaggtcacatatatatgtattgtccgaattcagtgctatcttccactacgcaacttgctgccatttggctataaataccaactttgcacggttggcatatgcatccttcgtagtgcaattcacttatacacggagtttaattagtttattgccttctacaatggataggatcttcgcccgtttcttttgcttcctactggtttgttttccatcagttcttaccatataatagacatatatatatatatatatatatatatatatatagacacacacatatctcatatagcattatattactgtttcaaccaacattttcttttattttcttcttctttcgatataatttatgttacatatgttgagaacagatcatgtcagagggggcaagctagtattgcaagtttcattttcagaaagcaaataatttcaaattcgatcagataaatttattaatagatttaattaaatacaatgacaatcacgcacattctaacttaactgatccattgttcctgtaattatttaaattgcatgttactccaagtttatatgatatttatatgaaattttttatggtgctccaagtttgtttaatttagaccgtctatatattaggatatatgttcaactgaatcaaattaagaggaggctattagtcatacgaactagctaggtaaatttgctgttatgggatctcaatccaagaatttgctgctatggaagagagaatagaggagagggaaacatcgatcttatcttaacattcgcttgagattggctcttaccttctatgaaaagattttttttattgcatgaagttaggaggaaaaaaggaaagaaaagtaataatgtccctaaaaatattttgaagggtttatatttagagtctttactatctttaactgttgctagatgattatctctaaatgacatgtattacctagctaagagaatttatcccactttaacttatggcatatgcgctcaaagtagagtccgatatatattctcttttttaatagtggattattccttttcttttgcaaagattaaagaagtaaaaaaatatacaggtgatcgtacaaaaggtgacaggagaaagaataaatacaaaatttattaggtaagaattaaattagtacaaaagtggtaggcagaggattaaatcatacaaaagtaaatagttaggagataaaggattgtctcgggatcacaaaatggcctgtcaaaaacttatctacaaacgtatatatctacagagatatatatctgctcgtatataaatacaaacgaattttacctattatttgtacctatgatcatcgatctgaataaaaatataaaatattgaaatatacatattcataaataattcgtgtatttaaatgcttatagcaatttgaatagtttgaaatctgaatcatattttttgaccaaacaatctgaaacacattttagttttattctcttatttactagaacttgtaattttaaaacactacagtaatgttttgtaaaatgtgagacatcttgttttgtaaagtataagaattgaataacgcaattttgacatgtacaattatcgtgggaattagtacttttcttgtgttgctatgatttactacatcagttttttaatggatgacgtggttgacttttaaataatatttaactatttttcctattcaaaagaaatttatataaataatacttattttgttgtgacatgttttatcattaaaaaaactttaagtacgacttatgctttagcatatttacgctatttttttaatacgacgagtagtgaaacgtcatgtaaaaaattagcgtgtcatgtattaaaaaaattgaagggagtagtaataaaagtttcaaatatattggttaataaataaataaaaccaaaattaatggttaagatttactgtaagctcttataccaccctagctaggtggagcatcttaattaaaaaggtcttgcataattttgaaagcatcttaattaaaaaggtcttgcataattttgaagttttatgtgtgtagattgcggcagtaagccatgcagctgatctgtcccccgagcaatactggcgatccatcctccctaacaccccaatgccaagctccatctcccaacttcttaactacccttacttgcctgctgttagattacctcgccgtacggatgctggtcagcgcaactacaaatcatcagtttcacatgtggctgaacgatctcaccgtgtagatgatggccaacgcaactacaagttatcagctttacctgccactaatgaactacctcaccgtacggatgctggtcaacgcaactacaagtcatcagtttcacctgtggctgaactacctcaccgtgtagatgatggccaacgcaactacaagttatcagctttacctgccactaatgaactacctcaccgtacggatgctggtcaacgcaactacaagtcatcagtttcacctatggctgaactatctcaccgtgtagatgatggtcaacgcaactacaagttatcagctttacctgccactaatgaactacctcaccatacggatgctggtcaacgcaactacaagtcatcagtttcacctgtggctgaactacctcaccgtgtagatgatggccaacgcaactacaagttatcagctttacctgccactaatgaactacctcaccgtatagatgctggtcaacgcaactacaagtcatcagtttcacctatggctgaactacctcaccgtgcagatgatggtcaacgcaactacaagttatcagtttcacctgctgctgaactacctcaccgtgtagatgatggtcaacgcaattacaagttatcagttttacctgccactgaactagttcactatacagatggtcaacgcaattacaagtcatcagttttggagacgccagaacttctcaaagaccccgacatggcgctcttcttccttgagaagaatcttcaacaaggtaaaaaaattaataacgccctccacttcgccaacttgttggccactacgaactccaagttcctgccacgaggcaaggcggactccatcccgttctctctaaagaactacccgagatcctggaccggttcggggtgcggccgggctccgacgacgcggctgagatgagtgctacgctgcaagactgcgagctgccggcgaataaagaagagaagaaggcctgcgccacgtcgctggagtctatagtcgacttcgtcacattcagctttggggccagtgacgtcgacgccgcctccaccgttgtgctcagtaagcggtgaagtcttcttcgctggcgcaggactacacggtgagcggcgtgaggcgaatggccgaaaccggccagctcatcgcttgccatccggagtcgtacccgtacgctgtgttcatgtgccacctcacagaggcgacgacgagggcgtacaaggcctcattggtcggcaaagatggtactgcggtggaggcggtcgccgtgtgccacaccgacacgtcggactggaacccagagcacgctgccttccatgtgctcggcgtcaagcctgggactgtgcctgtctgccacttcatgcagcctgacgctgtcgtctggacccgcaggggctgatgtatgtatgtatgccatatagtacctacttcatcgtactgtactgcgtacgcatgctgccagctgctttgcataccttgctgctggagatatataattaatatccagcacttatatactcgtcacttctatcgtgtgtcgaaggttatatacttgtagcatttggggatgcagtacgtacgtgtgtctgtaataagtttcgtgatatgttgcttcatccatatggaccatatgtaccaccaatcccagtgatatataataatataatatcgttgtctagtactacttgcttatctacctacactagtcagcttgcacatgcaagtcacgtcgatatatattgaattgagtaaattgaaaaatatatatacatccatcttaaatcagtttagttaaagtttctgttataatatatccatacgaggagagaggcaccagtgacagggactgattttcatgctatgtttaggctacattcataatttggattattaagagactataaaaaatgcccgtgcgttgtaatgggcaaaaacatttttgaatcgcatacatcatacactttgttttaggccaaaagctcatttcttcatttcttttcagtttcagtgtagcccgctacctctctgcttagcctgcctcttttttacctagtccacaagtggtcaagtggagctgtagacccgggtatcgctaatacacgacctctactgtatgtacgtatgtatatggtacgtataaactttttatacacgtacacaaagtttatacatacgtatatacaaatatatcttttttatatgtatatttttttaatgtataaaaatatatcatacacaaagtttgtatacgtacacatacaaagtttgtacccatacatatacaaactttgtatatatatgtgtatatacaaaatataccaactttgtatacgtatatatacaaagtcttcttgcatagccgactgccatctttaaactccggccggaagagtgtccgtatgatgctcgaacggatcgaatctttctcgatcttccaaaattggttgaggttgtttgatacacttgatcaactcttttcgtttttatcaaaatgagtaaatccataaaactcggaataaaaacggtcacttttaaatgaagattaaatctggtaaattgtaacatcctgaaaattaactatttttctagtcttgcatcatgcatattcttatgttcttaatatccttctaaacctaggaaaatatgattagagagacctcctaaaactaacttatataaaatttctctttggtatttaatttcttttatgattttcatttaagatttatcttgaggtatttcttgatttggttttaatctaaaaaccttctttcgtctaaaactttctttatttaaatttagtttgaaaacccttcttacctattatgaattatggtccaagaaaccttcctatattgtgctagaacctaaaccaaagcaattccaattttattggaattaattgttaacctatcctttgatcttagacctatccttagttcttgatccaaatatctgaattcctccttttgatctagccgctcatttatttcctgtggcttgatttccttttcagcacaagaataatattattacaaatattgtgaataattgctcttgtgctaagaaaatagattatatccttgtcatccaaatttcttattagcctcaaacaattctttgaaacccatgccatatatttcggggctaaaaatcttgtttatcttcctccatttatttccctcccacattcccaacaatatataggttcaattttaggaatcatagtactcatgcaataatatatatatctctctcccatttgagtgcatcaatagattccaccatattccacttctaagaatattgcactcaaactagaaaatatctcttttagaaattatattcaaatataatttcctttctgtcacgcccagaaatttacgaaccagaatttctaagctggatgtgcattaaacccctgtccaggaccagccagggtacacaaacgacaattgttgacatacagtccacgtcttacaaaaaagtaaaagattacaaatgcagcggaaaagataaaacgagctaaacttggaaacttgacttctgcagcggggcgactccactccacaggcatccttgacggtagcgacgaaaccaacctttttgagacagctccaactgggaagaacttccgctctggtgtggggggaaagagagcaagactgagtactacccactgtactcagcaagtcataccggaagaggaggtatgatgcaggatataaccaaaggaggctaaaggttcatttgcataaagcaggcatttaaaaatagtagttgaaaacaataaaacaattgcagtagattaagcaatattaaccaatcactgtccaacgctacaccacgttgcaacaggcccaaccaaccacctgaactacaccagttcattaagctaaactaggggtgagactaatcacggtgaatctggttgatcgcccataaccgtgggcacggctattcgaatagttttactctggccagaggtgcacaactgtacccacaagacacgattccacacatgtcgccatgccccgaagtaccaccatggcactgcaaagggggaattcgtgacaagacccttcgcataacccgcccctaaccatccacaccacgctaaggtttcaccctcacccctcaaaaagcagtgggcagtcccctcgtgcgccgtggtgaatccggcagctggacaaccggacaccccggctgacccaactccatcacgcccacgctcgccaccggtgcctaggaaagggtcgagctatacttcagatcaagtagttacccactcccgcttgtggtaagcacggtaagtctcccagggtttcccgtgaaccggtccttaattgcaatgggtgcgaccatcaaaaccatgcacccacagcccaccattcagtatattttaatcaaggggcaattgtgttcttacccttgctttacagttcaattgtgattttacccctactttttagggtttgtgattttgcccctgctttttttaaatgaagcagccgcttgcccctactctgttacctcattataatggtgttaaatatgtggtgaatggacaaatatacccctactataattttggcatgaacattggacatgtttcaagttaaattcgtgcgtatttttcatatgggacctaaatgttgataaattttgtacaagttgacagaacacaatatttaggatagttttgacagaattttagcaataattttgacataatttaaaaaagatgacagaacacattatttgggacaatatgtacaccctctccgtcatatgattagaacacattatttgggacaataaactcctccgccgtcgccctgccgatgccgctggcgccgccggtgatgacgacgaccttcccggctagcctacaaacccgcaaatcacattcacatccatccccgattcgcaatcaagaagatgaaatcagcgtccccaaccaatggctcaatgcaactccaagctgaatcgatcaaatcacctctgcgaatcggaggcggtagcgaaggcactgacagaggaagacgaagctgcaggtgtcctcctccccctgaattacaaaagtcttgatccctgcgcgtgcgcccgccgcgctgcgccctcctgcgcgctggcccatggcagttggaccaccgggccgccacgtctccctgccgcgcgctggcccgcggggccgccgcgcctccctgccgcgcccgtcgccgccgccgccgccgcttgtcgctaggttttcgatttggggaaatcgttccagcaagagaagtggttaatggtaagcccttttagtaaaccaagggtagaatggtcattcacaaattataatatcattttctttcttcgctttattgggaaatttcgggcccatcaaactaccgtcaaaaaaaaggggcaaacgggtgcttcatttcaaaaaagtaggggcaaaatcacaaaccctaaaaacaggggtaaaatcacaattgaactgcaaagtaggggcaagaacacaattgcccctttaattaactaacacccttgcggtggcaccaatccgaagctatgctaatagtcaaagtctatgtaataatgtgatccctatttatgtactagttgaactaagcatggctaagtatttcctaaaccaacatctaatcattttgatgcccaagttatcaatggcataaggtaaacaatatatggctgagtagtaggacccatcccacatgacattgtaaaagaatacaaaatttaatagaaatgcgggatatttgtaaattgggtacaatatgattaattgtaatgcatgacttgccttgctctcgcactgatgagaccacagcaacgtcttcgagaaaccgcagatcgacaaaactgccgaaatctacgcgacaaacaaagcacacaagcaaaacatgctataagactactgaaacagaatacaaaaccatttttaatggattctttgcatttttcttgatctactgagacttgaatggacttaagtggagctcggatgaagtgagatataaattttagaagataatatgtgtttttactaataaaaaaatccttattcgatttattgcgcaataatacccagggctgacattatccaaggggcgggggcgccgacaggtgggccccacgggtcaaaggcacaaagggcgccggtccaccgtggaccgggaccacacgggtggtccacccccggtccacgggaccgacggtccagatcagccccgaggccgataggacggtgcggcggcggcgaggcacggcacggctcggcacaaagcctgctggccggccatggcaagcggcggcggtgcatggccgccgacggcggcgaccggcggagcgaggcggcggcagacagcgcgaaaggcggcggcggacggccggagtggcggcacagccaagggcggcggcgcacgcgggaaggggagaaaagggagggggagggagtcctcaccggagggggtggcggcgaccggtgcagaaaacgagggtggcggcgacgaccggcgatgccgaggcgcggacgggcagtggcgacacctagagaaggggaggagaggagttagggatggagaggacgaccgcgacgaccaaagtggccggccggagatggatgaaaatggagagctcaccggtgagcgagggaaacagggcttcgggggtgattggtggcaaccaagcggcggccgaggagcgggcggcacccgcgagcgcgatgacgacgacttcacggtgcggcggcagctctagcggcggtggcgctcgttcggagtgcggtggcagggggcggagctcggtgtgacggcgcgccggcggtagaaagcacgggagggcgcggcgaatgtggaaaacgggagaggaggctcgggggaaggattttatgggcatggaaggggagaacgtggctgggagggtggttgatttggctggccacgtgggggagtggagggagagagagaggggggaggggattcgaaacgaatcccgcccattctcgggcgtgcgcgagggcgggaaacgacgggacatggtcggcaacgtggggaggtgcgtgggtgtgggaaagggcgaggaaagcggcggcatgggcggccacgtgcgcgggcggcggttgccggcttgaggagcggcggctggaggtaagggaaagggctgacaggtgggccctacctgtcagcgcccgagagagagggagaccgggtgaacttcggagggggagggaggagcaggccggcgcgagaagaggtgggccggcggcccaagaaaaaggaaaatagggaaaataaagaggaaaaagaagaaaggattttccccaaggattaaatattgcactttgatgtttttaattggttaaaattatttctaaggctctg

SEQ ID NO: 36932 - DNA, 3553 bp, Oryza sativa
  unsure (1)..(3553): unsure at all n locations
gggccctacctgtcagcgcccgagagagagggagaccgggtgaacttcggagggggagggaggagcaggccggcgcgagaagaggtgggccggcggcccaagaaaaaggaaaatagggaaaataaagaggaaaaagaagaaaggattttccccaaggattaaatattgcactttgatgtttttaattggttaaaattatttctaaggctctgaaaattccactaaaaatcctgttaatcaattgtgacatgtggaacccaagaaaaatcccacaatgccatttccaattattaattgcatttattaattaaggaattagctctaggttaattaaaacaatttcttcagacgatttatttaataaatttttaaagcaagaaaaaagggggaaaacttcagggcgtgacactctcaaactttcctattcaaattctctccaaatataaatcctattcaattccattacccaaatccccttcaaaattcagaaacagtttctattcactttgggcctcctttttattctccccacagcgcaagccggcccatctattctagccgagccaccgctctctcctcacctatgggcgtgcgtggcatgcgcacatgccaccgccgccatcgccgtaatttgcgccgcccccaccgccggccacagctcggtgccgccgccgttgtcttgccgtcgacaccaaggaaccaccgccgacgtcagccaccacctcacatcaccaacgtcagccgcaatttgtttccgagccgaattgccatcaccggccaatcaacggacagagccggcgccatgctcctcttcttcacgccgccgtcaccatgtccttcttgacctcctcttcttcgaaccgacctcttgccgcctataaattgacggcaaggtcccctctttttccctacatcaacagagcttgaagctctgcttctctctctcttcccttgtctggccatcatcaccaccagtcgatctcctcctccgtagctcctctttcagttncctctcaccaccagcctcgcctngccgaggagaatgttagtagataaaccttgtgtgttggcatgtttctctttctgttttgcatgcgtgcgagccccggtttgtggaagctgtgcgaatagatgtcatggcgcgagaatagctcggcgtggcgcaggcgacgggggtgtgcacgcattctgcggatccgtgggggtggacacgatcaaatccgcgacgtgggaacgtttctgaagcacacgtttcccttctttgcatccttgtatttgctataaataaggagaagaaaaaacctgaaaagctgcaagcagtttgcagcgccaaactcctctgtttgctctgttcttcgcgttttcagacggtgtacagtgttccacaaaggtgttcgtccaaagtgtcgcgtgtgttcggctcgccgattggttgggtgattcctgacaattggtatcagagcgaggtttagggcgtggacacgtgatcgcgcactagaagcagcattcatgcctcgccgtcgctcgtcgtccccgatcgggcatactctaggaagttccggcggccgcgccatgggcagtggcgggaatgatcgcgggctgttgattcaccgcgtggtcaaggaggcgggaggtccggcaaacaacccggtgctcatgaagacgaattacaacgtatggtcactgttgatgaagatcaagttgcaagctcgctgcttgtggggagcaatcgacccaggagaggttgagctccatgaagatcggatgacactcgatgccatctgcagcgtggtccccgcggagatgatctccacgctggcgaccaaggagacggcgaaggcggcgtgggactgcatcaagaccatgcgcgtcgtcaacgaccgcattcgcaaggcgagtgcacagaagctgcgctcggaatacgaggctctcgcgtttcgcgacggggagtcggtcgaggatttcgccatgcgcctcaacaccgtcgtgacgcagctgtccacattgggggatcccgagccagatgacaaagtcgtcgagaaatatctctgcgtcgcgcgtcccaggttctcccagctagttctctccattgaaaccctacttgacatctccactttgacgctggaggaagtcactggacgcctcaaggcggttgaggactccggccagtcgtcgtcctcgtcttcaccaggtgccggggccaagctctacctcactgaggaggagtggcttgaacgtcacaagaagaagcagcaggaggccaagaagaggaatggcggagggaacggccgtggcaagcgccgcggcggacaagggcacactagcggcggcggcggtggcgtcgggaacgcggacagcactggcgttggcccagctcgcaagaccgacaagtgccgcaactgtggcaaacttggccactgtgccaaggattgcaggagcaagcccaagcaggagcaggcccacgtggtccaggacgaggatgagcccacgctcatgctcatgacaggcagctgcattgatgaggtggaggagacgggcgcgcagtgcgcgacgccatcgccgctcgcgccgcagcctcgcccagacgtcatcgagctggttgagcaaaaggtgttcaccgcgctggacgacgccaccgaccacgacaacaagtgctggatcctcgacaccggcgcgtcgaaccacatgaccggctcgagggcggcgttctctgacatcgacaccaatgtcgctggcaatgtctggctcggggacagcttactcgtccgcatcggaggacgcgggacggtactgtttgcctgcaagaacagcgaacaccgcatgctgcacaacacatactaccttccgcgtctcgccgccaacatcataagtgtggggcagctggatgagacgggcttcaaggtggtggtcgaggatggcgtcatgcgcgtgtgggatgagcggcgtcgtctgctcgcttgcatagctcgcagcccgggccggctttacttgctcgacatcaaccttgcacggccggtctgcctgatggcgcgcgcgggggaggacgcgtggcgttggcatgctcgtttcggccacatcaacttcgctgcattgcgcaagatgggccgtgagtccctggtacgtggtttgcctgtcttgtcgcaggtcgaacgggtatgcgaggcgtgcctcgccggcaagcaccggcgtgcccccttcgcgcaagaggcactccacaacgccactgagctgctcgcgctgatccatggcgatctttgtggtccgatcacaccggcgacacccagcggcaaccgctacttcctcctgctcgtcgacgactacagccgctacatgtggctgacgctcctcgccaccaaagacggtgcaccggctgccatcaagcgcgttcaggcggcggccgaacgcaagagcggccgcaagctttgggcactccgcaccgatcgcgggggcgagttcaccgtcggccacttcaccgagtattgtgcggagctcggggtgcaacgcgagctgacggctccctactcgccgcaacaaaacggcgtcgtcgaacgcc

SEQ ID NO: 36933 - DNA, 1310 bp, Oryza sativa
gaccacgatgacgcgccacttcgtttccatcgcattgacgacgtgcttgggcccgcgacgccgccgggacaggccgttcgcgagctgagcgaggaactgttcgcggtaacagcggaggagccggcgtcgttcgctgaagcagagcagcacagctactggcgacaatcgatgatcaaggagatgcgctccattgaagcaaacaagacgtggcggctcgttgatccgccggctcgccaacatccgatcgggctcaagtgggtctataaggccaagaaagacgccgccggcaacatcaccaagtacaaagcatgcctggtcgcgaaggggtacgtgcagcggcagggcatcgacttcgacgaggtgttcgcaccggtggcgcggctcaagtccgtccgcttgctgctggcgcatgcggcgtgtgagggcagggccgtgcatcacatggacgtcaaatcggcgttcttgaacgagcttctggaggaggtctatgtcgcgcagccgccgggattcgtcgtcgacgggcaagagcacaaggtgctccaccttgacaaggcgctctatgggctgcgtcaggcacagcgcgcttggtacgccaagctcgacgcgtcgctgctaatgctcggttttcaccggagcgactcggaacacgctgtgtacatgcgtggcatgggtgtgcatcggctggtggtcggggtgtacatcaacgacctcatcatcacgggcggccactccggcgagctcatgcagttcaaggaggagatgaagggcacttttcagatgagcgatctcgggctgttgaaatactatctcggcttggaggtgaaccagtctgaggacgggatcacgtgtgccagagtgcctacgctcagaagattcttgaggtggctggcatggccgggagcaatccaagcctgactcccatggagacgcgcctgaaattgagtaagtcaagtactgctcctgctgttgatgccactgattatcggcgaattgtgggctctttgcgctatctggtgaatttgagaccagacttggcgtactatgtgggctatgtcagcagattcatggagaaacccaccgtcgaacacctggcggccgtgaagcgtgtgctgcgatacatcgctagcactatcggctacggctgccactacatgaggaagaaggaggctgcaagtctcgtcggcttcagtgacagtgatctcgccggcgacctcgacactcgcaagagcacctccggcgttttcttcttcctcggcgacaacccaatcacctggcagtcgcagaaacagaaggttgtggcattgtcgtca

SEQ ID NO: 36934 - DNA, 868 bp, Oryza sativa
tttacacaaataggtttaatccatttattctataaatagtaaattgagactcggtacattattaatctaattgtttaattaaaactcacataatcttatttatatataaagcttattttatttatatgaccattattttatatgagtgattttcatgttatgaggagctcggcgaaatgttgtaagtatcaatctatatattccggtgaattacttatttataaacacgatcattatagtgggtggtgatcatcatttcatgtgttcttatatttcatgtgagattggattcaaatgaattggatttaatcttactatttctttagctaattgtgacatcaagctatcaatcatggttcgaatatttaatatttgatctgtgatttataatagaaattaatatttgacttatacttggtttggcttgctttcttgtgcactaatatttgtagggttattaataaataacatattctcgtaaattatatctattgcttaaatttagatcttttctttactttctttgtgatattttacggtttggcaagcaatagcaatcataacaaccagcatgatgcaaaagttttaaaaaaattcaaaattttagtgatttttattgttaggaattttcaggacgttacaataggaggcatgccttatccgtaaccttgacagtaacccccggcttcaacttaaatgaattcatgttgtcgtccgcgacttcacctgatagcgtcttgtcgtacccatttgatcgatcccgatgtaaaaccgtagagacatgaggttgtcgacaacgctgaaggaagttcaacggttaagatatgaatttaaatcgaagtcaaccagccacccgcaacgggtcctt

SEQ ID NO: 36935 - DNA, 743 bp, Oryza sativa
  unsure (1)..(743): unsure at all n locations
tggttccaattgctaaacgtgcagtctctttctatgactgcacggatctgtattcgttcaacagagaaaatttgctagcgtctcacgcacatcaagaaacatgcatgcgactccatagaccacacatatgaatatctatacattgccaaccaattatggccgttcatatactagataccaagaaactagacagtatgagtcaattattgagatcgagataacagtcaaagaaaacgtttacacagtatagcgcagacactcacaacagacgcacactcactcttatgattgaaatcctgaaaaattctctcatggaaaatttgctcccatggggagtcgaatccaggatctaaggtgctactgagactcttgtaaccactaggctacatgcccttttgcatccatagcaaactttgatcattcagtacccattttggtttttaagagatgatattgttgactcatatgtcgacgggggatacccgtggaccatattatgaggttattggggtatgttggtataaggatctacacgatacgatattaagcatataaaaagacaaggattatactggtttagattcctcgtaagataatagccctaatcctgtttatatgatattatagagaaaatcacagagtacaaaagagaacaactaaactccgaaattaccgaannnnnnnnnnnnnnnnnnnnnnnnnnnnnnnnnnnnnnnnnnnnnnnnnnnnnnnnnnnnnnnnnn

SEQ ID NO: 36936 - DNA, 721 bp, Oryza sativa
ccgggactatgctcagggaggagcataggtccggcacggtcaagaggccatgtgacaaggtgggactgacgtcatgatccctgatggtcaacctaggtcgacggcggatcgggactagactgagggggagttgaggtccagaatgatcgacgaagctgtgtgacaaggttaagatcaaggtgacacatggtggacgaacaccgtgtcgggaagactttgcgacgggcttcgcaaggtcaagtgcaagtgccgggattcgcgaagaaagccgacggatgaaaggagcaagcagtgctacagtacacgtggtactgtagcatgcagccaatgagaaaagtgcacgtgcatgcacttggttggaagacttggtcaagcaagctagcatgcaagctgtgcatgtgtgtgcattggtttgagcagtgcatgcatggacaaggtgatgtgcatgtgtgttgtgattggttggtagggaggccaccaatccatcgtgatcatgggctcggccaggatgccacacggctggaccggactggcccagtccaagatggagcagaggccagcatgatccaagcaacgacggtccagctccgcaagcaagggcgtcaaggcaggaggtctcggcgacgacgcgcgcgtgagggacacgcggcaggcgcggactcgactgcgcgctctcgcgcgggagatcgactacatgcgggacccatgccaaattcagatg

SEQ ID NO: 36937 - DNA, 693 bp, Oryza sativa
  unsure (1)..(693): unsure at all n locations
nnnnnnnnnnnnnnnnnnnnnnnnnnnnnnnnnnnnnnnnnnnnnnnnnnnnnnnnacttagggagaaactgaacttctttcaaggccgggctgcggacggcagagttcgaggagagtttgcccacgccgtgctcaccaacgaccgacgttcttgactcgccgtcaattccagccattgctgtccaggtgctttattttttttaagacagctaggaaggaaacccgcgcacatgcgcgggcacttatttaatgggtttgaaattttcttatgaatgttttatgggtaacctttttattgaaatgttttctactctattctaaacatgttttttttgtcaatgaattatttttcctaattatccttgcggcatataaattataaactaaaattacatggaactttttggtttttaatttatgagaaaatattgtgtcgtaataacctactcccttgagttttaaaattattgacgtcttaagctttgacattaaagttgccagttcttgacgttctaaacttagcctacttataagccattaaagagcatgtgctgcatgcatgttttctcattgctacagcacagctgctttgcctttctctattcgtgcttgcctgcttgcattctcgagtgttttctttttttttttgaatatttggcataccttgatatttttagtttctaaactaacat

SEQ ID NO: 36938 - DNA, 688 bp, Oryza sativa
  unsure (1)..(688): unsure at all n locations
nnnnnnnnnnnnnnnnnnnnnnnnnnnnnnnnnnnnnnnnnnnnnnnnnnnnnnnnnnnnncggcgaccgcggcggcgggatcatcggacttctgggaggaggccaccgacggcgggcggctgcgggtgcggcggttcagcgccacgccggcggcactcatggcttcgtccgccgccgcctccgctgctccggaatcagcgatgtagttggcagtgggcggagagagggatcgtcggcggcggtggcggccgccggaaaaattggagggggggagaggtggccggttcgactgggctcccacacgccacgattgatgaataccccacgtgggagttttttcacatcgatctcttgatgacgtgtcaatgtcaggtgggtcccacacatgcacttgatgggaactaataaccagatggaaaaagtccactttgaccgaatctaatagccgaatctaattcgtacccctcaactaaaaaaggggataggacgactcctcgaactattgaaaaatcagtgtaatttaactcctccaagacagttaagtacaaattgcggagattcgcacccgatcggaaacaggccatacgagaagaactcgacaaacttctcaaagctggtttcatcagagaagtcatcaatccagagtggctcaccactccagtaatggtacgcaaagccaacagaaag

SEQ ID NO: 36939 - DNA, 836 bp, Oryza sativa
  unsure (1)..(836): unsure at all n locations
nnnnnnnnnnnnnnnnnnnnnnnnnnnnnnnnnnnnnnnnnnnnnnnnnnnnnnnnnatacccagagagatagccgaggctggtacggagactcaccagcacgatggcccagaccgggaacagctcattctcaaacctcgcggattgcatggctccaatgaggtacactactatctgatcagataattcgtcgatgctttcaagaatggtggtcaagattgagctacgagttcggcagcggtagaagtctatgatgaacattgcaaggaatatcaatgtcaccagtgccaccaaggactcaatgcggatcaagacatagatgttctctttcagcatgacaaaaaatgattcaatcacagcacggacgtccaccattttcaatttttaagcttgttcgatggccctgtttgttaatttattgatgatgagcaagtaaaagataaacaggaaatttacagttattactcctacactagggaccattttattattaacttttttttttcattttggcaagcaacaactcatgatacggagaatgcatcaagcaaacagtatatgagtttacattttggacaattttcatctcgctggtagcacatagtgtgtacatgatatatgctgctcttattcttttgcaacaagatacataataatttgaagtgcagaaataacatctatctaactactactgcatttgtcaagggatctgtagagacttgtttttgtgctagttttgttttaggttgtaagagttgggctttctaggtttgtttttttagacaatagatctttcgatgaatgaacccagctagctttataaagaactaaggaag

SEQ ID NO: 36940 - DNA, 784 bp, Oryza sativa
  unsure (1)..(784): unsure at all n locations
nnnnnnnnnnnnnnnnnnnnnnnnnnnnnnnnnnnnnnnnnnnnnnnnnnnnnnnnnnnnnnnaaatacactagatagttgatatggttaaataggcatgtggctaacatgggtcaaggttggctttgatagaatagtggctaggatttagttgtttatgccgatatcgaggtaggataaatatcggctagggttttaggtgtttgctagtcgtcgctagagttgggcagcatgacgactaggtttggtatcatttctaaccgtgtcgatagacagcatatcggctagaagaataggaggtgggtgcaggtttagtgggacggaagtgttactccgacaaccgtgagtggcagcagagcggctaggatcacacagagctcaagagctaacagtgcggcgtgcaatggaggtcgaggggatagtgaagctccgaccgctgtacgcatcaaggcgtggggtgccaggagcagcacttcgaccttgggtttggttgatgccgggctttacaaccaacgatccgacgttgaggtccgtagactgcgcaaacgtccccatggaaggcgtaaagttccaaccggcggctttttagtggctacagggtattttggaaataaaagaaaatatttgaaaagcaaatataagtttaagttgtaaattcaattataacattaaatcaaatatttattcaaatggtatttgaataaattaagaaaattcaaataaaatcttaaaatagaaaatttgacatcaaaatgaagagtttgaaattagatgaatttaggtc

SEQ ID NO: 36941 - DNA, 737 bp, Oryza sativa
  unsure (1)..(737): unsure at all n locations
nnnnnnnnnnnnnnnnnnnnnnnnnnnnnnnnnnnnnnnnnnnnnnnnnnnnnnnnnnnnnnnnnccccaatgacattcaaaaataaatgcaattgttgaatagaaacaatagctttaaacgagatcaacatgctcaaaggattgtttgggatctgtgtgacttgccttgctggccttggaactcttcaaagtcttctcctgcaaattcggactctcgggaacgtcggaatctaaagagaaaagaacaaaatcaccaaaacagcacataaacaagcatgaacagtatatgtggatatttttaacatgtagatctcaattttagaaaaatttagagacttgaaccaactaaatccgagctaagatgaattagttatgaattttcaaagattaaatcggattaaaacatttatatagattttaattgaattatgacgcaataatgaattatttttgaaaaggaaaaaggggattattgcgtcagcgggtcggctcacggtggaccgggtgcatggcggcggttcacggaaacaaacggccgtgatcgatctatccaaaacggacggccaagatctaacggtctacgaccgatctacgacggacggcgtcgatgacgtcagcgatgacgtcatcaccgacggcggctccgcctcgcgtgctcggcggtgaacgacggcgtgcgacgcaaatgaaggacacctacgggttgctggcgacgcgcgaactcaccggtgaccaa

SEQ ID NO: 36942 - DNA, 866 bp, Oryza sativa
caatcacttttgagggtcaccaagtgaacttattcctagcaatatatatgtcacagcccaataggagggaggaaaattagtcttattctgaggaaaagcacgatgggccatctctacctttgggccggcccggcacggcccgagtcgtgttgggccatgcctgggccgtgagtgcggcacgtgggttggcacggcacagcccggtgcgtcggtcggaccgtgccggcccgacaagctgcccacatggccatctatactgacaggtgggcccctacacagtaacttttcgtattttccttatttaattcaaatcctattctttagaagcccatatctcctaaagtgtagatccgattatagtgaaacttatacctaaattcatataaattcaaactctacattttgataccaaatttagtattttaatattttatttgaattttcttaatttatttaaataccatttgagtttatatttgatttactcctatatttgaatttccaatttaaacttatattttattttcaaatattttattttatcccaaaatacctattagccactaaaaagccgccggttggaactttacgccttccatggggatgttcgtgcggtctacgggccccacgtcggaccgttggttgtaaaatccagcagaaccaaacccaaggtcgaagtgctgctcctggcaccccacgccttgatgtgtacagtggtcggagcttcactattcccttgacctccacaacacgccacacagttaactctcgggctctgtgcgatcctagtcgctccgtcgccacccacgattgtgaagtaatactttcgcctcgctaaacttgcaccaacctcctattcctctagc

SEQ ID NO: 36943 - DNA, 1130 bp, Oryza sativa
gggcgaattcgagctcggtaccatgttttgtcaaagcctagatgcaagctaaggtctttccaagaaaggtgatattccttgcagaataaccggaaattaacaccatcgcctacctttagcaaggtacataaaaactgcatggtaagcaaacgggaaccggttcatctacacatgcaaatttatcccatcctaaagcacgccaaacagtatgaaactcagcatccatacctatccttttcagaaggtccaggtcgtatgcttgggtgtgagcaagcattcggtattttagcatgtaataggcttgcagttcccggtcgcccatgaggtcgagatcggagttgtcgtatagccttggtggaacgtccgcctcctccatcgatgtatcggcggaagagggtgtgctgggctcatcgtgtcgccttaactgtgtgcttgatcctctcttgaatatgcccgaaaattgtttcttcatggctacaaagagcaaggttacaagactactcgagcgggggttaagcaagtacccgccgattaaccttgcaccgaactaaagcaaacttgtatatgccaagtgtctaaactaaatgcagcaaatgaagattgagataggctaagttgaaatgaacttgagagcaaatgaatttgggggagagtattagaattgagttgaattggtatgaatgtctcccccctagccatgcggctgaaaattttattttatttttgctcataaatttattttaaatttgttgtctccaaattcatattaaaatgcaaaactttgaatggaaaaactaaaaaggtaaatatgcgctaatgcaatgcggaaaataaatatgggataactacaaatttacctgttggcaagggcgacatcgttttaagtccgacgagcatgatcgtaccttcatcgttttagcttgatgaggtacccggttccagagatacagggacgggtgccttcttcttaactcgccacacctttttgtttttggtgcggtcggtgacctcttcgaaactgggaacgcaggttgaccggcctgtatttcccgcttttttgaatgccaacttgaggtatcgacggatccttgttttttcccgctccaggaagttcaccatgaaatcgatga

SEQ ID NO: 36944 - DNA, 705 bp, Oryza sativa
  unsure (1)..(705): unsure at all n locations
cccttgccatggccggccgaccagctttgtgcctagccgagccgagccaggcagccaccgcaccgtccgatcggccccgggccgatccggaccgtcgatcctgtggaccggtggtggaccacccgcgtggtcccggtccacggtataccggccaccccttgcgccactgacatgcgggtcccgcctgtcggcgccgacccccccccttgatgacgtcagccctaggacttattgcgcaataaatgatttaaggactttttgttatagtaataaacacagtgaatcttctaaaaatcataactaattcatccgtgctccgtttaagcccaatcatgtcttagtaaatcaagaaaaaattgtagaatccattaaaaatggttttgttctctgtttcagtagtcttatagcctgtttgcattgtttgccttgtatgtcgcttagattccggttcttccgacgctccggtgtacttcgagatagttgccgaggttcctccagcagcagagcaaggtaagtcatgcttgtcacttgaacatgttgatcctatattgcaaatgctctattgtttttcttcaaatactgcattgttttataatgttactatgggatgttcacctattgttacagccatgctattttggtannnnnnnnnnnnnnnnnnnnnnnnnnnnnnnnnnnnnnnnnnnnnnnnnnnnnnnnnnnnnn

SEQ ID NO: 36945 - DNA, 1003 bp, Oryza sativa
gaaaaagaaaaggagaaaaagattttccctaggatttaaaattgcatgtgctcaatttaaattggttaaaattatttcgagggctctgaaaattccactaaaaatcttgttagcgtatttcgacatgtagaactcaagaaaaattccacatgctaattccgattattatttttattaatttattaaggtttactcttgctttacactggtattttcttgagaccatttaaaactccaatttaggcttgggaaagaacttcggggtgtgacaatcaatgagggtgggcttcgcttctaaggctgcaacgaaacctctactgacaattcccaaatttaatctttcaaattccttgcataactccaacggcaactgtcgtccttctgtagcattacaatagcctttcctgctgagagcatctgctacaacattagcctttcccgggtgataattgtcggctcccaaaactaatgattcggaaaccgacatgtttaactgtttcaagccctggatcagtagattgatacaggttcaacaatctagatcttcatcgcatacatttggtaaagactccaaaggagatatctttatataaaataataggacatttacaagtttgtggctaactattacagcagaagctatatgatgactcaactctgtcgttttactatagaattaaaccatctaactatactactagacttgaagactaggtttaaagggaactaacttatgtgattgaactcccagcttcggcaaaaactccaattaaactctgaaaaagaggggttgaagcaagggtgagtacaacgtactcagcaagctattatattattcaacaatgaatgcatgagaggtaatatctgtgtagagctagatttacttgcagaaggctgagaataaagaggtagaactcctgaaatgtttgatatgcaacagtatttaagaaaatcttgaattatatttctaaccaaagtaccatatgagtcccgatgctcaatc

SEQ ID NO: 36946 - DNA, 11112 bp, Oryza sativa
acttgaagactaggtttaaagggaactaacttatgtgattgaactcccagcttcggcaaaaactccaattaaactctgaaaaagaggggttgaagcaagggtgagtacaacgtactcagcaagctattatattattcaacaatgaatgcatgagaggtaatatctgtgtagagctagatttacttgcagaaggctgagaataaagaggtagaactcctgaaatgtttgatatgcaacagtatttaagaaaatcttgaattatatttctaaccaaagtaccatatgagtcccgatgctcaatccgtaagcacggctattcgaatagattcaaggatattcatactgcagtagatgtacgctttacccgcagtccacgacttgccaataatcattagcttagtcatggcccagtattatgttgttaacaattgtggcacctgttccatgaactctagtccccatgcgctctgaaagtaacgttatcagcagcgagagaagttctggcgttcccagggtttttagagagaactggatgagagaccccacgtcatctcaaccaggttctcataaattcacacacacatcgcgcgataatcaagatatttacctgcgcctcggtaaatatcacatttgcccttcgcggcatatatttgcctccttcgcgaggacttacataagaaccactgtacagaggtaccacattgttaattaacataatatctaggtctgtccccattctagaagctgcggtcgtactcgttcgtttgacataagtacttggtaaacttatatcgaccgagacagtactagccacccggaaatcaaccaatcttacgtactgtcccaatctaagttcattatgttttatgcagtctaactaggcagggctaagcaaaagctagcatataaccgatttgctatatgtttagattatgcattccaaatcatgaatgactaatgcatagaatagaaatatagaatacaggacatttatgttcaaaggggaggaataataacttgccttgctccaacgcaataaatccaacataggcaacctgattatccgattctcgaaataccataggttgccatccaaaagacaatagactctactgagaaagaggaagaactaatttcaataaaagccataaaataataagaaaacgataaacggttaagagggctagggtttaaggtataacctatctcttttatagggtatagggattatggggctagtatttgctagtggtaggtttaggtggtataatacctagggtttagttgtatgggagtcgtttgtggagtaggatagcatatcggctaggctctatattttatgtggaggctctcgtggtttggacgataggaaatacactagatagttgatatggttaaataggcatgtggctaacatgggtcaaggttggctttgatagaatagtggctaggatttagttgtttatgccgatatcgaggtaggataaatatcggctagggttttaggtgtttgctagtcgtcgctagagttgggcagcatgacgactaggtttggtatcatttctaaccgtgtcgatagacagcatatcggctagaagaataggaggtgggtgcaggtttagtgggacggaagtgttactccgacaaccgtgagtggcagcagagcggctaggatcacacagagctcaagagctaacagtgcggcgtgcaatggaggtcgaggggatagtgaagctccgaccgctgtacgcatcaaggcgtggggtgccaggagcagcacttcgaccttgggtttggttgatgccgggctttacaaccaacgatccgacgttgaggtccgtagactgcgcaaacgtccccatggaaggcgtaaagttccaaccggcggctttttagtggctacagggtattttggaaataaaagaaaatatttgaaaagcaaatataagtttaagttgtaaattcaattataacattaaatcaaatatttattcaaatggtatttgaataaattaagaaaattcaaataaaatcttaaaatagaaaatttgacatcaaaatgaagagtttgaaattagatgaatttaggtccaaatttcactggaatcggatctacggtttaggagacataggcttctaaagattgggatttgaattaaatctagaaaatacgaaaagttactgttgatgggcccacctgtcgatctccttttctttttctctctccttctctcgtcttcttcttcttctcttctctgttccagagagagagccgagagaagagagaggagaaggcgagcggggcggcggcgctccggtggctggagggcggcgacgtcggcgtccacgcgtgttcccgagcaagacacacccggggagggcggtggctggcggagagagtgaaggagttggccggaacggcgcagtcaagagcttgtcttcggcggcaaagagaggtggcggtggtggttgctatggagtgggggggaaggggaaaacgggaaaaatggaatcacctcgtcgaggcgaactcgatggcgcgatggtttggcttgcgaagctccggtgagggagatcgggtggtggcgaccatggccggacatgggagagaaagagagagagatggagctctgattgtatgtagagaaggggagggatggccagctatttataggggagagaggcggtggtgaaaggcggttgtggaggaggagatcgataagtgcacgggcgacgatggcgtgaagattcgaactacggcggccggcttcgtttccttagcggcgaaggaagaggagttggcggcggcgtgagccgtgcacgacacgcgcacgggaggagggggcggctcggttggggtgtgggctggtttgggccggctcggcttagctgggccggcagcccaagaaggaggaggaaaatagaagataaaagaaaaggaatttggccaaaaaggaagaaagaatggagtttcggcccgatgacaaaaagaaagaagtctaatttgaatacctgatttggataactaggttttgcaaagaatttgaatttggaaagaattcacaaaagagatttcctaatttatttgagtgcaatatttagaggtggagtttgagggaatttatttggaagcactcaaataggaagggaagttaataatattcctcaaaatatttttgggaatattgaagggaattagttgaaggcaataaataggatttgaattctaaaattggtgtgatgtgtatttgtggctaaaagagaaagttgaatgaagagtataagttggaattttcttagcacaagagcaattattcacaatatttgcaataatactattcttgtgccgaagaggaaatcaagccacataaattaaattggtggctagatcaaaaggaggaatttggatatttggatcgagaatcaaaggatgggtttaggatcaaaggatgggctaacaattaattccaatgagattggaattactttggtctaggttcaaggacaaaaattggaggatttcttggaccataatttgcaatagtaaaaatggttttcaaactaaatttgaataaaagagttttagtcgaaagaaggtttaatattcgaaaatagaattccaacaagaaataccaaatatgtttttaaatgaaaaacacaaaagggattaaataccagagaggttttatgcgagttaattttaggaagtcccgctaagtatattttcctaggtttaaaaggttattaagaacataagaatcagcatgatgcaagattagaaaatgacacattttcaggatgttacaataatgaattcccatatcataatccttaatcaattccaaccatctccgctgtctcatgttcagatccggctgggtgaaaatatacttcaaacttttgtgatccgtatacacctccgtacgagtaccaaaaagatagtgacgccaaatcttcaacgcatgaaccactgcggctaactcaagatcatgagtagggtagttcttctcatgcgggcgtaactgacgagatgcataggcaaccaccttcccatcttgcatcagaacacaacctaacccaagcttggatgcatcgcaatacacttggaaacccttctttggatcaggcaaaatcaaaatgggtgctgatattaggcgacttttcaactcttgaaaacactgctcgcactcttctgaccacttgtacttcacatctttctgaagcagtcgtgtcatgggcttggcaatcttggaaaaattctctatgaacctccagtaataacctgcgagacccagaaaactacgaatctctgaaactgtcttcggttgtttctagttggttacggattccacattactaggatcaacggcaactcccccggctgagatgacgtgatcaaggaacttcacttcagacaaccagaattcacatttgctaaacttggcatacaactgatgttctcgcagcttctctagtgcaagacgaagatgttcttcatgctcttctttggttcgggagtaaatgagaatgtcatcaataaagactaccacgaacttgtctaggtattccataaacaccttgttcatcaagttcatgaagaaagcgggggcattggtaagtccaaaagacataacagtacattcaaacaacccatacgtagtggtaaaagctatcttaggtatgtcttcctctttaatcctcaactgatgataccctgatcgaagatctatcttggagaaaacggtggcacctttaagctgatcaaacaaatcatcaattctgggcagcgggtacttattcttgatagtcacatcatttagttcacgatagtccacacacatcctctgggtatgatctttcttttccacaaagatcactggagctccccacggagacgaactcggtctgatatatcctttctgaagcaaatcatctactttcctcttgacttctgctaattcattggctgccattctataaggtctcttatggatcggagttgttcctggtaccagatctattctgaattctatatctctcttgggcggcataccaggtaaatcatccgggaacacatccgggtactcctgtactataggaatctcttccaaagttatttggttcagacttgaccttaaaggctcagaaggcaatgcatgaacagttacaacttgaccatcattgctggtgagagttacttttctattggcacagtctatcacacctttatatttggctaaccagtccatccctaggatgacatcaaggtctttggattctaacagaataaggttggccaaaaatggtactccttgaatctctattctgacagaggggctacgttgtgatgagagtgcttggttactcggtgtactaaccatcaaaggacgtctaagatcttctacttccatctcatgatttcccgcaaaactcaaagataaaaaggaatgcgtagcaccagaatcgaaaagcactgttgcaggaactgagttaacagggaacgtacccaaaatcacatctggagcaccttgggcttctgcggcagcaacatggttgacacgagcctttgtcgctggtgcggaggggttgttctgagcagggacaaccttcgcgcggtggggcttcggacacttgtcagcataatgtcctgggtctccacagttgaagcacaccccgggcttactgccttgctccctcttggcaggctgatgctgtgtcggagctgcaacagggcgtggagcttggttgcggttgttgttgccagcattgttgttgaagaactgacgctgcggacgaacaacagacgaagaacctccctgtggcactgactaaggtcccatagcaagacgcggcctctgactattcccctgctgagccttgaagtgagcaatccggcgtttcttctgctccatgcggttgtacttgtcctcctggcgaatagccttatccaccaacttctggaaatcatgataatccccagtcatgagtgggttagaaagctcatcattcagcccttctaagaacttctcttggcgctcttcatcaatgcgcacatcttccggagcataacgagccagacgattaaattcatgcagatatttagtgacagagcgagatccctgagtgagcgccctgaactccttcttcttgagagacactactcccgagggtatatgcgtcttacgaaaagcagcagtgaactcaagccaagtgattggttcagctgtagtcctgttgagacggaagtgatcccaccattcagaggcagggccatgaagccgatgtgaagcaaaagagactttctcttgatcagtgcactgaagtaggtccaacttcttctctatggcgtgcagccaatcaccagcttcaataggattggtggtgctagataaagtaggcggcctcacgcgaagaaattctaccagcttattcgggggaggtgcatggttgtttccctggttctgctggttctggagttgctgcatcatcagattcttaagctgtgcctgttgggccaggacttgagcaagcgtgggattctctgcattgttgttgtttttgttggggttggggccattcccgttgctgcgagtaagcaccatctggcatagataggagcacaagaagagaaacaggggaaaaactacttaggacagggaatttactagtttaacttttattgatcttaactgagtttcattattacaaaactgaagactctcacaccattaaactcaccagctccctaacacacgaaagcaaacaaacgcatgcatttacatcccaccaatgattaaatcacatgcaagacccacacacacaaccaaacttaaacaaacaaactaacacaacgatctaaggcaacgacttgacaaggcgttctaggtcttccgggcatcagagttgattgaaggctcgttcgcacatccccatcatcttgagtagctccccactcgaccttggaatgggtgcgcttggattcttcttcatcatcatcactcacgttgacgaccggaggatccactggggctggggtagcttctttttccaccacacgaacctttggcgccaactggtagcgagggacgaatagagctctcttccttgctgtaagacgaaccctggccttctgcggtggtgcttctcccttcaatgctgctagctccttctccaaacgatccaccttgtcctccagcttgcaaatcttcccgcgattccggtcttcacaatcttgagctgctatcacaatctcagcacgggtttcatccatggcccacagcatctcaaccaaatgccttgtggtagcatcattctcaatctctgcaggttcaaggtagctgccacggtcacttccctggggttgacgaggatggtagcgatactcggtgtcagccaaccgatcgttgtagctttcgtggagctctcctatggcgatccttgccacctcctgacaagcatgaatgtagcttccccctccagcctcgaacatcaccgaagggatatcttcacgattactgttcaaagtgactttgacacggcacttctcttcatcacaatcatgaggaatctgggcatacaaaggggcagtcccaaatcctatgaggaaagacatcgtacgcaactcctggacaaatcctggacaaatccttcagtaccaaacaagtactcaggcttgtagcacggcatctaaagacagtgaagggagggagttaagacatttatccaattaatagcacaagtttttggattaatttgaataaagttagaaaatcaaagtaataggtaaataaataaagtaaaccaatcttgcaagataagttgaaacagttagaaacaggatcacaaactttgcacttttgaataacagatatcaaaagaaataaaataaaagagagttataaaatcaatatgctaagcttagtttattgcagcaaaattaaataaaacaatgttataaaacttttgctggtaaatggccattagtacagtaatagatgtacagtactaacaacaccggaataataaataaattttgaatgagaacaattaaaggaattataaactgcatgtgccattagtttggtttaaataaaagagaaagagaggagaacaattctacttttcaacatttttagagggcttctataggtaaccatttggcataacctagggtcaaggaggctctgataccaacttgtcacgcccagaatttctatccaaaattccaaacgcttacatgtgtgtaaaccctcgtccaggaatcagccgaggcacacaataacaaattgataatagagtacaattattactctaattaataagcgaataaaatgtcattacagaggtagatagttcctctcaatcaataaagttctaagcagcggaaaataaaagaaacagcgcaagcgactcctctccacaggcagcttgaccaggactaggcctaatcctccacaccatcagtatcactgtagaactcctcctctgatgaatgattgcaaggtgagtatatgacatactcagcaagccacgcagcaaatatgcaagtgcacaggataacaaaggatggcatagtatagtctcatttgcataaatagcatttaacaaatatttcagaatttaataaaacagttaaataataattaaacaatattaatccaacgctatacaacataccctgttgcataggcccaaccattctgaacaaccaatcccggctgcacagttctatctccaaaccaggaattaaccattctaaaccaggagctaaacaagttattaacatcataaattaatatggtgagaaatgtgagactaattacgaaagacattgttagacacgcccataaccgcgggcacggctattcgaatagtttaaactccggccagaggtgtaccactgtacccacaagacacaacctcaacatcatgtcaaccatgtgtcgcgatacttgacaagtacccaaatagagattgtgacaataccctctatataatacaattcaaagcagtgcaccgttcccggatcataatcacccccttataaacaaggtatggactccccagcgacccccgtgggcttatctctgccacttcacagtctggtgctctactatgaaccatgctatacataaagtaaagccgttgcccacgccggcttgtggttggcacggtaaatgtttcacaaccgaaaatcgtgaaccggtccttaattgtcatgagcacaaccatcaaaatcatatgctcacaacccaccattatcaatttttagttggcaaattaattaattaaccaatcatgattaaccatcatgagctaccattaagccatcattaaataatagtgaagcataagttatcccagtagtgtgctaatgtttctaagcataagttatctaatatccagctgaacccatatatataaagctcaactagtcaagttataataacccaaggtatcaaagaatagggtaatcaagaaataacaaagcaataggttatttccacccaatgacattcaaaaataaatgcaattgttgaatagaaacaatagctttaaacgagatcaacatgctcaaaggattgtttgggatctgtgtgacttgccttgctggccttggaactcttcaaagtcttctcctgcaaattcggactctccgggaacgtcggaatctaaagagaaaagaacaaaatcaccaaaacagcacataaacaagcatgaacagtacatgtggatatttttaacatgtagatctcaattttagaaaaatttagagacttgaaccaactaaatccgagctaagatgaattagttatgaattttcaaagattaaatcggattaaaacatttatatagattttaattgaattatgacacaataatgaattatttttgaaaaggaaaaaggggattattgcgtcagcgggtcggctcacggtggaccgggtgcatggcggcggttcacggaaacaaacggccgtgatcgatctatccaaaacggatggccaagatctaacggtctacgaccgatctacgacggacggcgtcgatgacgtcagcgatgacgtcatcaccgacggcggctcggcctcgcatgctcgccggcgaacgacggcgcggcggcgcgaacgaaggacacctacgggttgcgggcgacgtggaaaactcaccggtgaccaaaacagcggcggaaggtcaacggacggcgacggcgacgaggaagaagcggcggcgaccttcagcttgacgacgacggcggggctccggcgatctacagcgacgacggaggggtggacgaggtcggcgacgacttgacgatcacgacggcggctttcccgagcgacgacgacgaccagagcgacggtggcacacggctggacgaacggcggtgacggcggcactaggctacacggcgctagagcagagctattgatgtctccctgtacatgcatcagattgccacctcggaatatgcatggcaagtgcatgcatgtatccttgccgtgcttccaatacaatgtgccagcaactcctctgttctctatccgttgcattgctcattggtgtagcttgtgtgcatatgacgtgcactttgtgtacgccgtccgtgcctctcttacgcatcgcagtccgcagccctcgtggtcaccgtccacgaccccatcgtcccggccctgcatgtccgccgcgccatgccgcgctcgctgacttcacccttccatcactggcctccctgccgtcgctgatgaaccctgagttccactcgacactcaaggctgttgttggcccgatctttcggtgagttgagataactacgatttgggagacacgttgacgacccgactacaaccgtacgagacgttgtgttgcgccttagcgatcgatacacctctccgtgggttgttgatcttgccggtgcagatcaaccctattcctgcaagcaaatcgaagaaacaagcaagaacaagataaaagcaatctgatattgcaaataggaatttaatacaaatgataagttggggttccgaagaacaagcagacggacggtctagccgacacgtgcgctgcaagcaagtagcaatagctaaactttaatctatcaaaacccaagaa

SEQ ID NO: 36947 - DNA, 4439 bp, Oryza sativa
  unsure (1)..(4439): unsure at all n locations
tgatcagcaaatccaaaccagtcatgcactaccctgttttcacataaaagagaaaacaaatatgggttgcctacaaaggacaatgatcatacagaggtaatatataaaattattagcatgtagtaaactcttaaatcatttatccttgttagcgaccaaatttggtaattcaagtatcgaaggtgaagataaaatcaaagcggaatctaagagatagatcgttccggaaacagagcaagaatcggccgaagtccgaatcggctacgaccagaatcgacagagttcgagtcggacaaggtagccgattgagccgattccgacaatgtgactcggtacacgttgtcgggttgagttaatgtgcttcatatggattgccatgcacggattgagtcctgaaaaggcaattgtatctattaattagaatattttatgtaacttccttagagataagtttgggcaaaagtctgccgtaaagacttatggtgtcttagagtttgttaaagataagagtcgtgtccgacaaggacatgttttgtatctcgggtataaatatgactcgaacctatgtaatcaaacaacacacattcaatacaatctcgacgcatcgccaccctttttactttcgtttcatctcgacgaattcttgctttcgggttgagttgcatcgtttcgatcttcaactagaggtaaacttgtcatgacggcttgcgttctcgggattagtgcttccatctttatgacactctaatcctatttatgtaaatcgtcgagttatcatatatcctatataatctctggcaatattgttatttaatccttaattagctaacatatattactggaaggcagccgattaggttaaatattaacgttgacctagattatatagggtatccaccaccctatgaaacgtccaacggcttgattgtctagatattgtccttcttttctgtcacgcccggaatttctatccaaaattccaaacgcttacatgtgtgtaaaccctcgtccatgaatcagccgaggcacacaataacaaattgataataaagtacaattattactctaattaataagcgaataaaatatcattacagaggtagatagttcctctcaatcaataaagttctaagcagcggaaaataaaagaaacagcgcaggcgactcctctccacaggtagcttgaccaggactaggcctaatcctcaacaccatcagcatcactatagaactcctcctctgatgaatgattgcaaggtaagtatatgacatacttagcaagccacgcagcaaatatacaagtgcacaggataacaaaggatggcatagtatagtctcatttgcataaatagcatttaacaaatatttcagaatttaataaaacagttaaataataattaaacaatattaatccaatgctatacaacataccctgttgcataggcccaaccattctgaacaaccaatcccggctacacagttctatctccaaaccaggaattaaccattccaaaccaggagctaaacaagttattaacatcataaattaatatggtgagaaatgtaagactaatcacgaaagacattgttagacccgcccataaccacgggcacggctattcgaatagtttaaactctggccagaggtgtaccactgtacccacaagacacaaccttaacatcatgtcaaccatgcgtcacgatacttgacaagtacccgaatagagattgtaacaataccctctatataatacaattcaaagcagtgtaccgttcctagatcataatcacccccttataaacaaggtatggactccccagcgacccccgtgggcttatctccgccacttcacagtctggtgctctactatgaaccatactatacataaagtaaagccgttgcccacgctggcttgtggttggcacggtaaatgtttcacaatcaaaaatcgtgaaccggtccttaattgtcatgagcacaaccatcaaaaccatatgctcacaacccaccattatcaggttttagttggcaaattaattaattaaccaatcatgattaaccataatgagctaccattaagccatcattaaataatagtgaagcataagttatcccagtagtgtgccaatgtttctaagcatggctaagcaattatatctaatatccagctgaatccatatatataaagctcaactagtcaagttataataacccaaggtatcaaagaatagggtaatcaagaacaaaagggctataacaaagcaataggttatttccacccaatgacattcaaaaataaatgcaatagttgaatagaaacaatagctttaaacgggatcaacatgctcaaaggattgtttgggatctgtgtgacttgccttgctggccttggaactcttcaaagtcttctcctgcaaattcggactctcccggaacgtcggaatctaaagagaaaagaacaaaatcaccaaaacagcacataaacaagcatgaacagtacatgtggatatttttaacatgtagatctcaattttagaaaaatttagagacttgaaccaactaaatccgagctaagatgaattagttatgaattttcaaagattaaatcggattaaaacatttatatagattttaattgaattatgacacaataatgaattatttttgaaaaggaaaaaggggattattgcgtcagcgggtcggctcacggtggaccgggtgcatggcggcggatcacggaaacgaacggccgtgatcaatctatccaaaacgggcggccaagatctaacggtctacgaccggtctacgacggacggcgtcgatgacgtcagcgatgacgtcatcaccaacggcggctcggcctcgcgtgctcgccggtgaacgacggcgtggcgacgcaaatgaaggacacctacgggttgctggcgacgcggcgaactcaccggtgaccaaaacaacggcagaaggtcatcggatggcgacgacgatgaggaagaagcggcggcgaccttcggcttgacgacgacggcggggcttcggcgatctacagcgacgacgaaggggcggacgaggtcggcgacgacttgatgatcacgacggcggctttcccgagcgatgacgacgaccggagcgacggcggcgcacggctggacgaacggcggcgacggcggcgctaggctacacggcgctagagctctaccggcggcgagagacgaaagcgagggtggcggcgggtagaggagacaccggggtccttttatagcggctaggggtggcggcggaggcccacgacgaccggcggtgtgaaggaaagtctagggttcggggagagagacgaatccgattcgagatcgaatccacagatttccaaacgattttagccgacgatttcaaaagagaaaaggtagagtggatctcggggatcattttccctctatcaatttcaccggatcgagaaaggggatgaacgaatttggaagggcggcggcggcgcggctcggctagggttcagccgggcgacggctggaggttgacgacggccctctcagcgggaggacgcgcgagcacgcgcgagcggcgctcgactgcgggccggcttgggccggggagagagagagagaggtttgggccgactttcggcccaaagccaaaagagaactttttaaaacctttttcaatttaaattattcatgaaatgcaattccatttattaaaaatacttccttggctcaaataaatctcagaaaaatctaggaactatagaatcaagcaaagtatttaataaaattttatctagcccacttttatattggaatttattatttaaaattagatcttctcttctaggcttttaaaatcaattctaataattctaattaaacaacaatttatatatttgggatttttagggtgtgacaaacctatccccctaaaacggaatctcgtcctcgagattcggaagaactggcgaacaaatgcggatagctgactttaattcatcttctcgttcccaagtagattcttcctctaagtgattactccattgaaccttgcaaaaacggataactctattcctggttcttctctcatctgtttccaagatacggattggtttctcaacatatgtcagatcctcttggactcctatctgttcaagattagcttcttcggtaggtacccttaaacactttttcaactgcgacacatggaacacattatggactcctgccaaagattgaggtaactccaactgataagcgacctctcctcttctactgacaatcttataaggtcccacaaaacgcggtgccaatttttctttggtgtgaaaacgatgaaccccccggagaggcgtgacacgaaggtacacatgatctccttcttcaaaacttaattctgtgcggcgattgtncgcataactcttatgacgagactgagc

SEQ ID NO: 36948 - DNA, 11203 bp, Oryza sativa
  unsure (1)..(11203): unsure at all n locations
nnnnnnnnnnnnnnnnnnnnnnnnnnnnnnnnnnnnnnnnnnnnnnnnnnnnnnntatccccctaaaacggaatctcgtcctcgagattcggaagaactggcgaacaaatgcggatagctgactttaattcatcttctcgttcccaagtagattcttcctctaagtgattactccattgaaccttgcaaaaacggataactctattcctgggtcttctctcatctgtttccaagatacggattggtttctcaacatatgtcagatcctcttggactcctatctgttcaagattagcttcttcggtaggtacccttaaacactttttcaactgcgacacatggaacacattatggactcctgccaaagattgaggtaactccaactgataagcgacctctcctcttctactgacaatcttataaggtcccacaaaacgcggtgccaattttcctttggtgtgaaaacgatgaacccctcggagaggcgtgacacgaaggtacacatgatctccttcttcaaaacttaaatctctgcggcgattgtcggcataactcttatgacgagactgagccacacgcaatctttcttgaatgatctttaccttctcttctgcttcccttaggatatcagtcccgaaaacctgacgttctcccgtttgatcccacaaaagcggagtgcggcacttccgaccatacaatgcttcataaggagccatttgaagactagcttgataactgttgttgtacgagaattccgcgtaaggcaaattcttatcccaacttccaccgaagtctaaagcacaagctctcaacatgtcttctaaaatctgatttaccctttcagtttgtccgtctgtctgcggagataagcagtactaaagttcagcttggaacccatctcttcctgaagcttcttccaaaactttgaagtaaactggctacctcgatcggatactatcttcttaggaacaccatgcaaacacacaatccttgccatatacaattctgccaaccgacttccggaataggtggtcctcaccaggatgaaatgagccactttggtaagtctatcgactatcacccaaatagagtcatggcccgatgacattctgggtagaccagtgatgaaatccataccgatttcctcccacttccattctggtatcttcaaaggctgcaaaaaacctgcgggtttctgatgttctgccttgactcgctgacaaacatcacatactgctacatattctgctatctcacgcttcatacttgcccaccaaaatcattccttgaggtcttggtatatcttagtactaccagggtgaatggagtataaagtatcatgagcttccttcaaaattgcatctttcaaatctttgttgtctgggacacagatcctctcacccaaccatacagttccttgctcatcttccaagaaaccgatagcttttcctcgtctcatattcttcttgatctcatgaatatcaggatcattgatttgagcttctctaacttgatcaatgtcacgcccagaaattcccgaatagaattccaagcagaatgtgcattaaaatccccgtccaggaccggccggggtacacaaacgacaatgttgacattcagatccacgtcttacaaacattatcaaagtcttacataaatgcagcggaaaaacgagatataactggagcaaagccttgacttgatctgcagcgggaacaccactccacaggcatcctcgacggcacggacgaagcctactcctcggagaaaccaccatctgacacatactcatactctagggttggggtaaatagagcaagactgagtactacccactgtactcagcaagtcataccggaataggggtatgatgcagggaattatcaaggggtagctataatggttcatttgcataaagcaggcatttataaacagaagtttaaagaagtaaacagttgtaataattaatcaatattaatcatccactgtccaacgctatcccacgttgcaacaggcccaaccatccacctaaactatccaatttcattagactacactagggtgaaactaatcacggtgaatctggttgaccgcccataaccgcctgcacggctattcgaatagttttactctgatcagaggtgtacaactgtacccacaagacacagccccacgacacgtttccgtgtgccgacatgccaccacgacatatcggaaagaggccgtgacaggacccttcgcataaccccctctaaccaagcacaccacacctcaggtttcacccccactcctcgcaaggcagcgggcagtcccctctcgtgcctaggtgaatccggaagtgacagaggccgtcgcagggcccgtcccgctccatcacgcccacccttgcctggatgcgtcagctagaggaaagctacactacaagcccagctgttgcccacgctggcttgtggtaagtacgataagttcttccagggcatcccatgaaccggtccttaattgccatgggtgcgactagcaaaaccatgcacccacagcccaccatgtgattcattttaattaatcaacaccaaagcggtggtactaatccaacattaccattagaacctacagtctaaacagtaataggatctccctcattgtgtgctagttgaactaaacatggctaagcaattcctagtccaaagtctattcatgttataacccaagctaacaaggagcatggtaccaaaatagcatggttgtaacaataggtgaacatcccatagtaacattataaaacaatgcagtatttgaagaaaaacaatagagcatttgcaatataggatcaacatgttcaagtgacaagcatgacttaccttgctctgctgctggaggaacctcggcgactatctcgaagtacaccggagcgtcggaagaaccagaatctaagcgacatacaaggcaaacaatgcaaacaggctataagactactgaaacagagaacaaaaccatttttaatggattctacaattttttcttgatttactaagacatgattgggcttaaacggagcacggatgaattagttatgatttttagaagattcactgtgtttattactataacaaaaagtccttaaatcatttattgcgcaataagtcctagggctgacgtcatcaagggggggggtcagcgccgacaggcgggacccgcatgtcagtggcgcaaggggtggccggtctaccgtggaccgggaccacgcgggtggtccaccaccggtccacaggatcgacggtccggatcggcccagggccgatcggacggtgcggtggctgcctggctcggctcgactcggcacaaagccggccggccggccatggcaagggcggcggcggcggacggctccccggcggcggcgacgaccgaaggcgacggcaagtgcgggtggcggcggcgcacggggaaacggggaaggaaaggaaaggggagggagtcctcaccggagggggcggcgacgaccggcgacgagaggcgatggagggaggtcgacaagcggtggacggggtccgagacgacctaaagaacgaaaaggacaagattagagagggagagaggggccatagaaggcgggaacgccggccgaaggcgacggacatggcggctctcaccgtcgcacggcgggaatggcgctccggcggcgaacctcgacgaaggaggggtggacggggtggatctcggccactcgaaccaacggaggcgacggcgcggtgtggcggcgagcctagcggcggctagaggcggccggagtggcgggaaaggcggcagcgggtggatgcacggtgcgggagcgatggggaccacgagagagttcggcgagatggggaaaaagagagaggggatggcggtggagcttatataggggagggggaactcggacatggccagtaggggcatgattcgccggccgacgtgggggaggtggaggtggagagagaggcgggattcggaattcgaatcccggccatctcgggcgcgggagcgagcgggacataggggggagtgggtccagcagccgcggggcatacccgggtgtgcccgacgtggcccggaggaggcggaacgtggaatcgtcggcggttcgacggtggtgccaaccgtggggacggccggccggaggaaggggacgaccccgacaggtggggcccacctgtcggcgtcccggggagagagggaaggcggcttgggccggcccacaaggaggagggcgcgcgcggcggcggcggatggactgggccgacggcccaagaagaggaaaaggagggaaaagaaaaagaaaaggaggaaaagattttccctgggatttaaaattgcatgtgctcaattttaattagttaaaattatttcgagggctctgaaaattcaactaaaaatcttgttagcgtatttcgacatgtagaactcaagaaaaattccacatgccaattctgattattatttgcattaatttattaaggtttactattgctttacactggtattttcttgagaccatttaaaactccaatttaggcttgggaaagaacttcggggtgtgacaaacctactcccccttaaacggaatctcggccccgagattcggaggggctggcgaagaggtgcggatgggcggcgttcaactcatcttcccttatccaggttgcttcctcctctaaatggtgactccactgaatccggcaaaacctggtgaccttgtttctagtcctcctttcgctggtctcaaggatacgaactgtcttctccacatatatcagatcttgttggatatcgatgtgctccgaattggcttgttcttcgggtaccctcaagcacttctttaattgggatacttggaacacgtcatggataccgatcatattggatggaagttatagctgaaacgcaacttctcctcttcgttccaagattttgtatggtcccacgaagcgtggtgccaacttgcctttcgtctgaaaacggtgcactccccggagcggagtaacacgaaggtacacatagtcccctgcttaaaacgtgagctctcgtcggcggttgtccacgtagcttttctgtcgagactgggcaatcctcagcctctctctgacaatcctgactttctcctctgcttctgttaacacttccgttccgaacagttgacgttcgcctgtttgatcccagaagagaggtgtgcggcacttccggccatacaacgcttcgaacggcgccatttgtagactggcctgatagctgttgttgtacaagaattcggcataaggcagacttttatcccatgctccaccaaagtcgagtgcacatgctcgtagcatatcttccaagatttggttgaccctttcggtctgaccatctgtctgcggatggtaggctgtgcagaaattcagccgggttcccaattcctcttgcaatttctgccagaactttgaagtgaattggctccctcgatcagatactatctttttgggtactccatgtagacacatgattctcgagaggtagagctctgccaaccttttgcccgtatacgtggtatgtactggtatgaagtgagcaaccttagtgagtcgatccacgactacctagattgaatcgtgacccgatgatgtccggggcagtcctgttataaagtccattccaatctcctcccatttccattccgggatttgaagaggttggagtaaacctgctggcctttggtgctcttccttcactcgttggcaaacatcgcagagcgcgacgaattcggctatttcccttctcatgctgactcaccaaaacttttctttgaggtcttgatacattttggtgctgcctggatggatggagtactgagtctgatgagccttggtgagtatcagatccttcagttacttgtcgtcaggtacacacaatctttctcccatccaaattgtgccgtgttcatcttcgtggaagtcccaggcttttccgaccctcatattctttttcagttcagctatctcaggatcattcacttgggctactctgacttgatccacgagcgtaggtcgtgcctctagggcagccacgtacccgtgttcaacaagtcgcaagttgagacgctcaagctcctgctgcaattctccacacatgccctcgatgcatagggcattgcagtagcttttcctgcttcgcgcatttgccaccacattgactttacccgggtggtagtgaatgctcatgtcatagtctttgattagttccaaccatcttcgttgtcggagatttaggtccggttgggtgaagatgtatttcagactcttgtggtccgtatatacttcgcagcggttgccaatcaaatagtgcctccagatcttcaaagcatgaaccactgctgccaattccaggtcatgagttggataattcccttcatgtggacgcaactgccgcgaggcatatgcgaccactctgccctcttacattagaacacatccaagcccgtggcgggatgcgtcgcaatagacttggaagtctttcatctggtcgggcagaatcagaactggggcggatactaatttcttcttgaactcctcaaaactcttgtcacactcagctgtccatttaaacttctcatctttcttaagcaactgagtcatgggtcgggcgatcctcgagaagttttcaatgaatcgacggtaataacccgcaagtccaagaaaactccgaatttgcgacacggtcttcggtggggtccatttggtaactgactccacattcgacggatcgactgccacgccctgagctgtgatgacgtgacccagaaatttgacttccgacaacaagaagtcacacttgctgaacttggcatataactggtgctccttcaacttctcgagtaccagacggagatgttgcttatgttcttcttcagattttgaatagataagtatgtcgtcgatgaacaccacaacaaacttgttgagaaattccatgaacactttgttcatcagattcatgaagaatgcgggtgcgttggtaagtctgaaagacataaccgtgcactcatatagcccgtaccgagtggtgaaggccgtctttggaatatcctcttcccgaattctcaactggtggtagcctgatcacaagtctatcttagaaaacactttagctcctttcagcttatcaaagaaatcatcgatccgcggtaaaggatatttgttcttgattgtgacctcattgagtgcgcgatagtcgacgcacatcctcttcgtcttatcctttttctccacaaaaatgaccggtgcaccccaaggtgaagtacttggtcgaatgtaccctttctgcagctgctcatcgacctgcttcttgacctctgctagctcgttggccgccattctgtacggtctcttgtaaataggggcagttcctggtgccaaatcaatccggaattcaatctctctcttgggtgcatggtagtgaggtcttcagggaacacttctggatactcgcagactatggggatatcctccaatttccgcgaacccttctcctcggtggtcacagggttttccaccttaatctgattcaaggaaaccccttgctttggtgagactagtgacttgtacaccacggtttctcccttctcattggtcaaggtgactgtgcgattcgcacaatcaatgacacccttaaacctggtcagccaatccataccaagaatgacatctaggtctttggattcgagaaggatgaggttggccagaaagagtgatctttgaatttctatcgttaccgaggggctgaattgaaccaaagtggagctattccctggggtatgaacccgcattggtgtactaagttcctctcttattaacccatgcatcccgacaaacttctttgaaatgaatgaatgcgttgcaccagaatcaaaaagtactgttgcagggattgagttaacaggaaacgtacccagtacgacctctggtgctacttgtgcctcctccgcagacgcgtggttgacacgagcctggacaaaccttggcccagcacgcctaggcttcgggcatttgttagcgaagtggccaagctcgccacagttgaagcaggaccctggctttgtcccagtctccttcttggcttgcgtggacgaagctgactgtgctggtgccattggtgggcgtgaagctgcactgcggttgggctgaccgccatggtggttctggctgccactagcgccctgatggaagttgctggcattgaaagggcggtgctagtggacgatcagggtggtaggtccaccctgctgtccgggagtgaagcgcggtcgctggtggctcccttggttggaccggaactgcgccgccttcctcttcctatccattttgttgcgctgatcctcctgacggattgccttgtcaaccagcctctcgaagtcggcgtagtctccagatatcaactggttggttagctcatcatccagacctgctaggaatttctcctgcttctcggcgtcagtacggacatcctccggtgcatatcgcgcgaggcgattgaactcatggagatactccgtcaccgtcctgttgccctggtggagtgctcggaattctctcttcttttgtgccacgaccccatctggcacctgcgccttcctgaagctgcggcagaactccacccaagtgacttccgtgcctggcggacgtgtggccatgtgattgtcccaccaagctgatgcgggaccctggagctggtgtgtggtgaaggcggccttctcctgatcattgcactgcaggagatttagcttcttctctatggcatggagccagtcatttgcctccatagggttggtggtgctagaaagggtgggtggtctgacgcgtagaaactccggcagtttggactgagggggagagggaccaaactgctgctgctgctgctcggcttgctgccgcatcctctggtacatctgctggtgctgctgctgcatctgctgcatcatggctgtcatcatctacgtctgatgagccattacttgggcaagggtcggattctcggggagtggtggcggaccattgccggaaacgctgttgggatgcacaccatcagtgcgctcttcgccgttgctgccctcgcctgttgtacggctaccattcctggtgtagaccatctggaggaagagcggacggtggaaaagaagaaaagcagatgctcaagaactaagctttattatataggaatttaaactacaattgttctgatatgaattaaaacacttaaaaagcaagcaaaaatccttattaagacagccatatcataggcacatgatatcgactgtcgactaacccacaagcaagcaacctaaatacgcaaactaacaagcagaagctagacagtcgataaactaatggaaagcgagcctaatgcttggaacggctcctgcggtcggtggagtcgaaggcgtcctcctgctcgtcaccaggtccctctaagcggctcctggagtctggcagatacgtctcgccactgcccggctctgtgccactagaactgctgctgctatggtcgcggctgccactgggagtagcaggcaaccaacccccgttgccactagctgggcccctggctgctgacgctagagcgaaggagagagcgaacgcgggagctgacactggaactggagctggggctagagctggagctgcaggaattgcgggcggaggtgggttcctgggcgcaagctgaatgcacacgggtgcagtcgtcgtcttgcggggcgtggtgcggatccggactcctgctggcgctgggagacccttcaactgagcattctccttcttcaggcgtgctatctcatccttcagagctatgatcctcacgagcttcccatcgttcaaggccttggacgccttgtgtagatccgagtgcatcctgtccatccccctcatcacggcgcacatgtgaccaaaggtggtgtcgttctcgccggctgtcggatggaaagtactgacatcatcaccgctggctcgacgagggtgaaatcggtacgccgtgtcgtgaaagatgtagttgtggtgctcctgtagtctggccatcatcaggtatgctacctcctgacaggcgtgatctgctgtgcctccggacgcctcaaccaccatattagcgaggcaggtgcccacaaagccatggacctccaggcggacacggtgaggaagctcgccactgagcggtggaacagtcgtgtactctggcgcgttggggtagcccaccaccagtgtgatgcgagccaattctgccacgaaatcatccatgccttctccgcggtggttgggtgggtggtcggccatctagagaaaacaaaggagtaggatcaatgcatgctcaaacccaattttaaacaaagcaataaaaactcaaataagagaagcgaataagaacgaaattttatgcatggatcattttgcatgagagcgaataaataagacagacttacataacgataaaataatggggaaattagagacatactaataataacaataaaagcataaataccttgcaacccatattcctgagctaggacctaatgcatttcacccatcaaatcccaactgactgtcgaaaatatctcaaataattttactgaaaccctagactaacttgttttgacaaatctcacttaaacgagtgaccaagatttttcccttgaaccacaagaacagaccccaattttcccgaaacaaatccaattgcaaaaaacatatgcaatgaaaaggattcagagggctcttaggtttttccatttggcttgtcctatggtcaaggtcggctctgataccaacttgtcacgcccagaaattcccgaatagaattccaagcagaatgtgcattaaaatccccgtccaggaccggccggggtacacaaacgacaatgttgacatttagatccacgtcttacaaacattatcaaagtcttacataaatgcagcagaaaaacgagagataactggagctaagccttgacttgatctgcagcgggaacaccactccacaggcatcctcgacggcacggacgaagcctactccttggagaaaccaccatctgacacatactcatactctggggttggggaaaatagagcaagactgagtactacccactgtactcagcaagtcataccggaataggggtatgatgcagggaattatcaagggg

SEQ ID NO: 36949 - DNA, 848 bp, Oryza sativa
  unsure (1)..(848): unsure at all n locations
atggatggagtactgagtctgatgagccttggtgagtatcagatccttcagttacttgtcgtcaggtacacacaatctttctcccatccaaattgggccgtgttcatcttcgtggaagtcccaagcttttccgaccctcatattctttttcagttcagctatctcaagatcattcacttgggctactctgacttgatccacgagcgtaggtcgtgcctctagggcagccacgtacccgtgttcaacaagtcgcaagttgagacgctcaagctcctgctgcaattctccacacatgccctcgatgcatagggcattgcagtagcttttcctgcttcgcgcatttgccaccacattgactttacccgggtggtagtgaatgctcatgtcatagtctttgattagttccaaccatcttcgttgtcggagatttaggtccggttgggtgaagatgtatttcagactcttgtggtccgtatatacttcgcagcggttgccaatcaaatagtgcctccagatcttcaaagcatgaaccactgctgccaattccaggtcatgagttggataattcccttcatgtggacgcaactgccgcgaggcatatgcgaccactctgccctcttacattagaacacatccaagcccgtggcgggatgcgtcgcaatagacttggaagtctttcatctggtcgggcagaatcagaactggggcggatactaatttcttcttgaactcctcaaaactcttgtcacatcagctgtccatttaaacttctcatctttcttaannnnnnnnnnnnnnnnnnnnnnnnnnnnnnnnnnnnnnnnnnnnnnnnnnnnnnnnnnnnnnnn

SEQ ID NO: 36950 - DNA, 629 bp, Oryza sativa
cgggggacagatctgtcatatacatcgtggtgattgatgaaacagatgtagcttctattcaccccaccatctgtcgaagtttttgcttctgaatccagccaactcaatattttcaatgctgccaagaggaggtcccgatagattgagtagccgatccatcattagagcagacgtgatttgtcctcggcactgaatcttgtcggcaaaaaataagccgattgggagttggcctaatccaagttgcctagccgagctcattgggtgataaaactcgtaggagacttggatgtttctcccttggtgaatgccgacaggaaggatgcaagggctgattgcggctataagaacttctctggatttctggaatttctcatggttaatatcttcgaatctaaaatctgatggaagttcgaggtctgctgattcttcataagggaaccagatccgggtatctttcttaaagccctcatagaagctgcagaaccagtccttaagcagctcagccgataactttgctccagcatcggttggtgtggatgcatattccccatatcatgtgcacctgcgatgagtacattcttctccgtcgtcacccacaatcggctctggcagtgggaactcagcttctg

SEQ ID NO: 36951 - DNA, 860 bp, Oryza sativa
  unsure (1)..(860): unsure at all n locations
atggtcacatcagtcgcggatccgcgatcgccgcgtgcgttgggcgcgtcgtccatagcgctacccctccaatctctctggtcgccttcagccacacctggacctgtctaatcgtgagtgaggtcatcgtctccgcgacgtcctcgttgtcgtcatcgatctcatcgccatggctgacgatcttctgtcgatgtgcgatcctcaccttgtgtttcctcctccacatgtcttcttggtccaatgttgaaaacttctgctatgataccacttgttataaaagttagtcaatatagcggaacgacgactaactttctcgatcgcttcagtcattgatcagctaagacatgccagatggcaacacaggaacccacgatatttgttaacgaggttcagccgaagcttacatcctcggggctctggttatgggcgcgcctccccaatcaatatagctcatagctgctacgagtctatagccgcgcaccatcatctccctgcgtgcctacgctatattgtagtcaccatggttatattgtggtgcctcctctctatttaagagagttgccgggttatagagtccgactctaacttcacccccaccacctattataactccaagtccaactgtaaccaattaggactagtatattcgacacctattctaacactgacgggtgggtctcacagggtgactcaacaggttggacctagttaaagtgccatgttagagaaattacccttcaaaacagttgagagagagagaaagtcaaattgcactagttttaatagctaggattannnnnnnnnnnnnnnnnnnnnnnnnnnnnnnnnnnnnnnnnnnnnnnnnnnnnnnnnnnnnnnnn

SEQ ID NO: 36952 - DNA, 506 bp, Oryza sativa
  unsure (1)..(506): unsure at all n locations
nnnnnnnnnnnnnnnnnnnnnnnnnnnnnnnnnnnnnncaactcttctaggataatgcttgttatggcctcctttacatttcaatccttcattaatatccccatccaaatcagaaataatcccatcatcactctccgagccaaaagattcccttctgtggttgttggaaccattgcagcttacaggtttcctccaagaagcagcaagatgactagatctcagggaagggtgatcaaattcctcatcctcaggagaccctattatatcctcctcttcaccgtgcttagagttcctaattttagcacgcccatttaggtctgccgagtcacaagcatcttcaaagtccaaataactcatccttgacattccatctgtctgaccaccctttgataaatcaagctcgtaactatcaatatcatcctcttcgtcatcaaagtcatcaaaaccaactctttctctttctgaaaaccttctctctgttccctctctccatgtttcattaattc

SEQ ID NO: 36953 - DNA, 11133 bp, Oryza sativa
  unsure (1)..(11133): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcggtagtcttagggacgagcgagtgatttccaagagacgagcctctgcccccggccgaactcacgagaaggggggtctcacgactcctcgctattgaggatctttcctcgatagtatcgatggtgttgatgtcctcatcactttaaattcgatgcatcgagtttggatggcttggataacgtatcaattatcccacattctctcttttttttttctcatagtacaatctatttgtatttgtaactcataggtactaaatctaggaagacaactagagtgttagaaaagatatatcaagccaaataaactgtaatattacttgtgagctgataaaatagtgattaaccaatttttcattatatttgtaggtagatttaaaatagatttcatatatctctactatataaaaattgaaaatgtttttgccggtattttgatacgtcatccgtatttgagtcggtttttaagttcattcccttttggaaatacagatccgtgtatgagccggattttaagtacgtttgcttttaaaaatacaaaagaagtcgtatgagaaatttctttaaaaaaacttacatgctaaacttgagataaaagtcgaactccttattgcatctcatgatttttttaaaaaaatattcaagcgaattctcacagtgaatttcatcttagctaaaccatataacaataataagattaaaaaaatagcattcacccattgcaacgcatatgcatttttttctagtgtttgataatatagaatatacacgagtatataactcttcgtatatcctaatattttttttgggggatttggattcaaactcaactcttctcatattctaatctatattttttggagttatgattcaaactcgaatattaccgtgtatctctttttactctccaatatgctttgcggattcagattcaaactctgatactaccaggtatcccatttttctctcccatatcctttccatgagtctcgggttgagcgagcgtaaaaatactcttctcgttttcacttctaaaatcacccattttttccacattagtcgccacatcaccattgcagacttattacaagaagcaacacatcacattgaagcatatgacgtgatcatgtgaataagctcttactcatacttccctctccttgaaaatacgatggaacagaaattcgtataaaatcgagaacagttcttttcatacgaccctaaccatgatgaatacttacacatttattttactgggaatgcttaaacatctttgtctcaagaccagaaatgcttagtcggggagaaaaggctagaaatatattctaggcacacattttagccggaccttgggattcaatagcatcaatcccgtattgcatgcaggaaatttagcatgtggatctttggattgagatcaaccgcagatctgcatgcaatctcatagctctatgtttccaattaaaaaagctgcaccttacatcggagaacactaatacgacagctagttggaaggactgcacagtaactggattcccctatcttctgttcaaacgcctgagcggcctgttgttatcatcaaatccaccacttttaacccaatttcttcttgcgttactctgtagatctcttgagccatcatgtagttcagtagtacctcttgtacgagtcctatcaaagggcgggtgaccatcacgcatatcagaactcttgaatcgttcattcattttcttcctatttgagttggaggccctggcatggaattcatcactgaactttgttgagaacctgttcctcctatctgactgaacacagccacctatgtcacaatccatatctgaaaatggtacatcatcaagttcattatgcctaacaacaactcttctaggataatgcttgttatggcctcctttacatttcaatccttcattaatatccccatccaaatcagaaataatcccatcatcactctccgagccaaaagattcccttctgtggttgttggaaccattgcagcttacaggtttcctccaagaagcagcaagatgactagatctcagggaagggtgatcaaattcctcatcctcaggagaccctattatatcctcctcttcaccgtgcttagagttcctaattttagcacgcccatttaggtctgccgagtcacaagcatcttcaaagtccaaataactcatccttgacattccatctgtctgaccaccctttgataaatcaagctcgtaactatcaatatcatcctcttcgtcatcaaagtcatcaaaaccaactctttctctttctgaaaaccttctctctgttccctctctccatgtttcattaattccaaattcgttgtcctcagagaacttagaaccacctctagaagacgtgttgtccacagacaagctattcctggcctttgatgaatcagcaaactcaaatgctgcaacatcagcaccatctgattcattgtcatcaaaatcaaagttccatgcattacaaacttcagatttgtgagcaggtctttccaatcgctttcgtggaacagattgattagcttccatttggctgttggtgtattcatctggtggacggttgtgttcacaatggaagcacgacatattccgcctgtagttcaaaaagttgcacctgaaatttgaaggacacattagcttatgtggataataccatgcacatctaccgttgaaacatataaattccatcatttttccttccatgattaccagaatgtttcttcagaataatgacaatacagaaatattttaaccacggttatgtaatgaaaaagatggtcacgatatcacctttaccagaaacaacacaatggcaaaaactctttctactgactgggtttattttaaattcagaacaactttgttagggtaccggttgatagcttcataagataaataatgaatgccagtcaattcttctaacagtgagaaagaaaaataagatgaaaggatggcaatttcactgtcagatccttctacagaggtctgaaaaatagcttttcccttcaagaaaacgtggaaatataaaatgctgttgaaagttaaaaaaataactctgttctgcctcacaagcagtattctgaccaaggataacttatacaaaagaggctggaggaaagcggacaataaatgtcagtttttgtagcaaattaacacaattgatcacttgtttatacactattctctagcctgacttaatatgcctttgatattggtcccatagataatatgaataatctttttggcccttggcttaagaagtttgatgcagaaacacagaacatggtggtggtaggatagctacagttatttgggccacctggaaaactaggaatagaacttgtttcaggaatacactacccaaagaccatgtgggtgtatcttctatgtttgtcattggatttctacttggcccattttgcaagggttggagggaaaggaaggaaaactgcaggagggagtaactctactcaagcaggtggcaaaggaggtatatgatgctcagcatggttggcagctttaggactggaagacttgaaggatgaagattgaggacggtgaaacaaccaggatggaggatgagatagtgtggtagtatatctttggcttctggttgccttttgcagaagatttgttttgttggcaaccatgagcagtaaaacctagcttagacctgcaaatgagatggatggcatctcagtttgcaaatgccatggaagatgatcgtctctaggaagttactgtttgaacaccggttttgttgccatttctgataatagaaatgggggttctcaaaaagaaaaagacgatggtcaaacaagtaaagacttgtttcaattcacaggtaataaaacaagggtgtggaaaaatatatgttaaaatgtattaggggtcactagtgtgtcttgcatgatgtagtagataataatttgacaaagttgtggttgatcaaactaaccgaggacactcccattctccagggagaagttgccttttgggacgtttagcatcgcattgcaagcaaatagtgttttttgcaaagttcatgaagtcacacctgcagccaaattccagaaaatgagaacacaattctgagctcaataagattctacagatcacaggaggaagttgctataagtactttgggcagagccaatctcctttcttcatctctacatcatcacgtcccactcgtttctttggtggtggaggtggttgtttcaccttaggtggtggctttctgattatagggggcggaagattgggatcaatggggacagcgctcagcttggcaatgtcatgtatcaatttacgaacaactgtcttcacagatttcagtttgaggagtggcttgttctccacagtttcctttacatgatcaaaaccatagaacaacaaaatacgcataacatcaagagttcgagcttcatcttctttgcgtgtaagaatatagccccttgagcatagatttcgtaaattacaagaactgcatacctgcaaagtaggaggaaaacaagaaattcagaatgtcacatgttcctagtgttaccatcttcactaatatttaaagattttaggttagcattggattatttaactaaacaaattgtctagcttagcttttacaagctacttggaacctgagaagataaggctgcaagaatttgtatcagtaaaactgaggcgtgtgtttcaaccctaacatcagcaagcccctctactccataacttgtacttcctccgtccctagaagagtgcctttttagctatgtacctggacattggtaatgtacaagttcatagctaaaaacacacttttttatggacggaggtagtatgtcttaatgcatattttgtaatatcatggaaaacgccatcataaattcatggctagttaaagatggctaatcatgaaatcagtcactgagaactgaataatccaacaaggagtatgaaaaacagttctacatctagaaacattggctcactataaatttcaagtcattatctaaaagataaatttcaagtataaatgaaatccgcaagggaatacccatagcatagaaagacacctgacatttagtattggcaacagttttacatggcagaatcttagttatctataatataaatgtatatggctatgcctcagaaaaatttgaaattggcccaagctacttccacagcaagcagggtggtgtcaactatacctgcctttcatttccatgtgttttatagaaccaagtggggtgttcctaccaacagtaactcaatcaattcaggtaaaaacaatttggtctggaatccattgataagcagcacagaaaggtagcaccagtttactgtactggagcaagttaggtctagatgaatatttattttgttaagaagtctagtttgttttaggtaatggtttattagtaagtcaatatatgttgcacaattatttgttgctggtgtcatctctgcagcagtgaacgcacacagcttgtacagcccatacaaggatgcagacgttattggacaggtcatatcccagactgcatttatatggtgaggccgacctctccttcagtgctacatggtttttctgttgcccttcctgcacagttcattcatgcacatttgaatagggagatagagaatagggtcgggggagtgggggatgaggttcaggtacactaacaaaacatcatagcagctcatgcctcctaaatgctagcagctgacttcaagatgtgttctccaacgttccagaccaaagactaatgttgtttccaaagcagccaaataagatttgtgtattcatggacttccaaccgataggcagcaggcatactgggcatagttatctatcgattagttgtaacgcctatttcattaatttctatattatttagtatccttatctgttagggagtttatttaacaaactgggaaactatgcatggataagaatctgagagcctcaacataatcacataacatgaaaggatgagtctccactaccatgtaggttctcatctggaatcagaccacctggccatcccttacttcacattcaactgagcatagaaaagagagaatggataattgatgctaatggaaaagaaggccaagaaaaatggagatcaagtgggacttaatgtgattatgctacccatgatcattaccacagcccactacaaacatgcagtaaagatacttttactgttccagaaaaacaacaaaaaacaagcagttttgtttccttatgaacttcagttgaattgctacctaaagtcagatatgcatgtctttatatgtttagatgttatatagatgtgcatggtgtcgtacatggagtgtgaacatgtcacacgtggtcctagtggagctagagataatctgtgttctggaatctaatttggactttggagaccagtcatactttggtcagtggtaccaacgaggcaacaaggcagagatagtaaaggccttcgtggcaggcaagcatgtccaaactgtcctcatcgatgtgggctcatgctaaccatgtttagctccacatctcaactttcaagctggcagatctgccatcactgcctatgggtatgtttcacctcctggtactgagtacacctcagacatacaaacttgcgcccaatgaacaccattaattttgcatgaacaccactggttccataactgtacttcacagacaccaaactccagctctattgcatccatacaccagcctccagatattcccttccctgccttcctgcatgtgcccattccctgattgccagcatgcaaatcggtcaactaggtggaactcttcttggcgcctagctacctagtgtctttactttaggaaaaattaccaggtagcaaaggtgatgatagtgaggctagcaacattatcatcttcttacaacctcttcaaatcttgtcctgggtgaatcattaaattatattggacacaaacatggccaagaagaggcaaaaaactacaggacggcttgagaaaacatttcaggtagctatgcaagggagaaattacacttgtccctaaaaactcaacagtgactctatttatattgataaattgagaaaatcgatcctccccagtttgtttttcctatttctgttactttccatgccatatcgactggccaaaacattttttttctcaaccagcaataaaaaaagcagcaatatggtaatttttgaacgataggaaatgaaattttggtttaggagcaacttacatccccctcatcaagatggacaagttttcttatcagctttgcagaaaacacaactttcggatccatgctagggcacccatggccaaccaatacctgaagatccttcctaggcaatgacctggattgataagattaaggaaccattaataatggtgttaatacaatattatttgattatttgttattacatctattggctgccattccagtaccatttttccatgtttaaggaaattaattgccttttttccagaaaatggaatggaacttctcttagattttcaaaacaaaattccaaattctgttcaagtggtctttactaattctcaagtaggaaagatttgtatgtctgtttgcctgtgctttaggcaagaatatacacaacaaaatttatataatttgcatgcgtttccagcagtctttggagtctgtttatcacaagtacttcacacaaccacatagaaatttatacagcggaaagtataataatggttatagagggttgtgaactcgtgatcaagtgcagtccttgcttttactgcgatttaagcagtaggagcccatctatgtcatccaaaaatcatctaggattcactgtccacaccttttcccccctttgttcaccaccctcaaagttccacgaagcaccaaactcagccgtgattttgacgctcaagccgagccctgcaaggtgcaagcatcttgaagccagtggccgtgaagtcgtcatcaacatacagttcagagtcgtatccttgaggggctcgtcgatgccacgttcaacacactgttaccagaactcagactcgagagtcggaatcttactcggactcgggtgtccaactcggcaaactctagaaaataggatccgggaactcgtctaacatatataatttttttattaaaaatattacatagtaataccaaataccaacaccatagttggtcaaacacttaaaactttaatatcagtagtcttgtgcacaaaggatccaattgctttgtatcttgtgccgctgaacagtgacgtattgcaaaaaaggagaaaagatggtgcatatgctacagcctacagatactctcttctctctagcctgcggctatccctcttccagagcctgaaaaagctacaacttgactctctttcccagcccttctcttactttacctcctacaccaagtcatcttccctactagaacaactagagttttctctaccatacagcggctgcagagcccctgcaactcctctctcccaccttgggactcgccaacccacgtcagatgcgtgtcgtcccgagtcggacgcgagtcgacacgcagatacacgtcgacgcggcaaatttttttcctgacacgtgtgtcccggtaacactggttcaacactaaggccagacaagcacttgccagtggcagcaaggtgctcattgatatgaagctcattgacctgcgcttgaaactgtctctgcatcgcagcagccattgtgagctccttcaagagatcagataatgctggttaaggctgcgtggcattgggtttgctgcctgacagagctctctggagtggaccaggtgggattgacatgttgtccctaaggaaggacttgccgtttgatctcttttggaaggggctacttctaaagttgactgcacctgatgtcctgatccccatccgtgtagggacatggagaactcaattagtgtttaatatttgttctgtgttttgagaataggacgctgtccagaattttaagcaaactataagaaaaatcaaggagataatttcaaagggaatgaattgctagtaccgagcatggtaggaggggttatccacacgtaaaaaaagggacgactcagtgaagacgttcaagaattatgctttcgtggaagtatcttgttagtttcaacagattgcaatgtacagattttcttatgcctacgatctagaggtaagcagagggcgttgagggttcgccggcttacgttggcgccgcggccagcggcagcgaaggcgtcgacggcctgagacagcgtcgtcttcgtgacaggaacaggaagatcgcgatgctcggactcggcaaaaactttcacggttcgtcgagatggccggctacaccaaccaaaccaaagactacttacatggatcccctttttcaccactgtgggcagacagcgataaagaatccgtctggtcctcgtcttcgtactcgacggcggtgttcataagggaggctaacgagactggcttcatggtggaaaagctcctacaggcagaataagatatttctcttttagggcacaagatgggtttgacggcaaggcgagtgaacgaattgatggtcagtcatcgcttggcttgtcttccttggcgtggtcggctgccagtgcccagggtttcatcgtcgctaaccattggggacgtcattgcttcggccaagcaaccaaaggtacgtcaactcttagtttcgatgcagcataattctccggtgatgtattccgcatcggcgagacttcagtctttgccggcggtgaggtatgctcgatccgatgatgtcagtgagtatccgagtcttctgggggatatgcaaatttcaaaatttggtttgttttcacgtgcaaaccaggcccattctcctccaaagcccaacataccctttaggcccatgctcgcattagtttccctactcgctagaacggggacttctcaacttgtggctcctagggttatcgccacacaatcgccatacacggacgttgtgcgcgagaaacaacatcaataatggagagaattgatgaagagacctatcgaggtggtgcaagaggtggaggtcaaggttcgtttgcggcaggcggaaggggtggtttccagggctttaatcacggctatgcaaccggtggtggctggtcatatggagtcggcgatcgtggtagatcgatggtggcagaggcaacaaagatcgtggcttctacgacggtcgccatggaggtgggagatacggtggcaacttccaggggaattggcaaggcggtagaacggtcagcgctttccgatgttcacaggcaacatgccgccggtgtcgccaacgattggagtcgctggggcagcaagtgcaactggagtggctaggactggtgccgtagcttcgaagggtttggctacaacagctagtggcgtcgtcccaccgatggctacagcatcaggtggtcttcgtccactggctggagtgaccggcaaatggagcagtgtttggagtggccagagggcctaccttggccaacaatatggcaggaataggcagcatggctggcaacattgccggcggcatggcaagcatgggtggaggcatggtcagtggcgtggcgggcatggctggcggcaatgtggatggagggatgggatcgcaaggtgcagcaggtggggcacctagctctttgcctgcagctatcttgttcgcttagccaggtatgggcataataggtaatggggcagctgctgtcgtggcccaactgaggtctttgacagtggtggcgcatggaggttcaacacctatggttctaactgggattgagacaggaaagaagacaggtttgatagaggtccatgcaggaggtgtgacgagttcaggacagccgggagtgatgccagaagcgattgtgtcgcatggtggatcaatggctcaggtacatatgacaagtatggcaggggagaacattaatggtgatgtggacgtta

SEQ ID NO: 36954 - DNA, 1397 bp, Oryza sativa
gttctagatcattctttaattcctgaatctgttgatgtgataattggagatttcttatacgaacttcaatttaaagttgggcctaagaatgatgatgaaccggtgcctatggagatggataattttgatggtcctaatgatgacacaaagaaagagggggatgatttggatggaaagaatggtaagaaatcattatggtaagggaaaggagttatctaagtccaatgatggaaaatcttctggagttaaaattggggcacctacacagatatgggactgacggtttctgatgagtatgatggacttagaaaacacaatgatggtggagactggccagcaaccttcggcacttgtgctagcgacggttccgtaggtagtgggcaaatgattcggagcaggattctcttgagatggcagataagcttaaggtgatgtgcaacctagagattctatcttcaaaaggtaatagcttagttcataattcttttttgcaattttctgatgagcaattaactagtaaggtcactaaattgggaattatgttgggggtgatgatacttgtgttaggactatactacatgatagtaaatcttcagaacttttacggttacaaaatgttaacatgcaagaaaattgacatgttaatgttgaagtggaagaggatgaaatgctagttgaacaggaatgtcatgatattatggaggaggtaatggatgtgggtggtgatcacttgtgtgattttaaagccataccatcttcagaactttcttgcctttttgtttaatgtcattatagatggtttaagtctaagagagttatatatgtctggaacgatatatacttgtgctaataatttgaatgtgcctacttatgaaaaacttgatagaattcttatgtctaccgaatgggagcataagtttcctctttctactgtcaatgttcttactagagacatttcagcaagcaaactcacatctgtctctaaagaaagatccattttgttcgtgctgaaggtttctccgtggaacaatccacgacttaatccatatatatctgatactatgtggtttccaactaacaaacaaacaatgcatgcaagctccacgagatgcggctaaggaagagcaaacttacttgacgatgtcgaaacggtcacggccgaagttcatacaggcattcttgacagtggtccagtccctagagaagtcaaaaccagtctcttgagtgacttccgctaggtccattggcacggaggcggcgacgcagccctcgtcagcgccgccggtgcccccaaggtcgaagtatttttgctgcaccagccgatccatcagctcgatccactccggccagggatgcacgagctccactttcctccttaacacctacgccacgctcat

SEQ ID NO: 36955 - DNA, 763 bp, Oryza sativa
  unsure (1)..(763): unsure at all n locations
nnnnnnnnnnnnnnnnnnnnnnnnnnnnnnnnnnnnnnnnnnnnnnnnnnnnnnttccattggcatggtataacctttttgctcctcacccattcggctgcagctatctcagaatcatcttcttcgtcatccgacccatacatatatggacaaacgtgattaactttcttagagcttttcctgacttccgctgacctatgctcatgcaaggtcaccttctgtatcaggtgcgataagctatcgaagtcttcggatgagaatttctccctgattggagggacataccctggaaagccaaatcggctaactgagcatcggtcaaactcaagctaaagcacttgttcctcatctttctgaacctttgaatatactcgtgcatgggttcatcatgccgctgcttgatcgctgtcaagtcggacaacttcatctcatggaccccgctgtagaaatagctgtggaattgcttctccaaatcggcccaactattgatcgacccatacggcaaagaagaaaaccaagtaaaagctgatccggacagagataaccgaaacaaccaaactctcaaggcgtctacagccgatgcttcaccccactgagcaaggaatcggctgatgtgctcataagttgacacgccctcttgtccaaaaacttggagaaatctggaactttaaaccgattgggaagaggaactctttcaaaccactcagggtaaggctgccgatacaaacttctagtttcttttggtttaagtccaaactgctcc

SEQ ID NO: 36956 - DNA, 20746 bp, Oryza sativa
  unsure (1)..(20746): unsure at all n locations
nnnnnnnnnnnnnnnnnnnnnnnnnnnnnnnnnnnnnnnnnnnnnnnnnnnnnnnnnnnnnnnnnactcttatctttaacaaactctaagacaccataagtctttacggcagacttttgcccaaacttatctctaaggaagttacataaaatattctaattaatagatacaattgccttttcaggactcaatccgtgcatggcaatccatatgaagcacattaactcaacccgacaacgtgtaccgagtcacattgtcggaatcggctcaatcggctaccttgtccgactcgaactctgtcgattctggtcgtagccgattcggacttcggccgattcttgctctgtttccggaacgatctatctcttagattccgctttgattttatcttcaccttcgatacttgaattaccaaatttggtcgctaacaaggataaatgatttaagagtttactacatgctaataattttatatattacctctgtatgatcattgtcctttgtaggcaacccatatttgttttctcttttatgtgaaaacagggtagtgcatgactggtttggatttgctgatcaatttcaaagagaatccggaatcactcctgagaagagccagacccagagtcatctctcctcaagtgactttatcagcaaccagatcagtcataccagcgtcatcaacacttaacgatatggctaagaagacccttcacaagttcactgctccctctgctgacaacatgcccgttggactcccgaagtcagcatgggagatggtgaaaaccagcctaatcacgatggtgtaggctagcccattatgtggcaagcctaataaggatgcaagtgctcatctccagtaattcctagatatctgtagcacggagtcagtccagatactatcaggctccgactgtttccgttctccttccttggaggagcgaaatagtggttctacgccaaccgtgcaatggtgaataccagaaataagtgctcaacgacattcctctcaaaattcttcctaatgggcaaaaaccaacgctcttcgtggaagaatatccagctttcagcggatgagggatgaaaccaatcctgaagcttgggaaaggctgcagtagtacgtcaccactcgtcctcatcggatggacgagtggctcatcctgcaaaatttcttcaatggattaatcctctagtcctgggatcacatggacgctgctgctggaaagacattcttctcaaatatggttagaggtgccactaacctgattgagaagatgatctcaaacataggttggagcaaggaacgactcttaacccatcaacgcggcatgcacaccatcatggagacggaaatgctcgctgctaagttggatctccttaaaaagagactagacaacagtgagaaatacgccaagcagggtactgttaaggccctgggctctcacatgacatgtaaggtctgtggaaatgacggtcactctgggacagatcgtccggaaacccataaggatgtcatgttcatgaataacaacaacggtatcgtccacaaagagatgaaggatggtacattgctccatagggaatattacgtacgaaccaaaaccaacagaacatgaggaaggtcaaagtaaaaccctgacggatagcctcatcgatttcatggtgaacttcctggagcgggaagaaacgaggatccgtcgatacctcaagttggcattcaagaagccgggaatacaggccggtcaacctgcgttcccagtttcgaagaggtcaccgaccgcaccaaaaacaaagaaggtgtggcgagttaaggagaaggcacccgtccctgtatctctggaaccgggtacctcatcaagctaaaacgatggaggtacgatcatgctcgtcggacctaaaacgatgtcgcccttgccaacaggtaaatttgtagttatcccatatttattttccgcattgcattagcgcatatttacctttttagtttttccattcaaagttttgcattttaatatgaatttggagacaacaaatttaaaataaatttatgagcaaaaataaaataaaattttcagccgcatggctaggggggagacattcataccaattcaactcaattctaatactctcccccaaattcatttgctctcaagttcatttcaacttagcctatctcaatcttcatttgctgcatttagtttagacacttggcatatacaagtttgctttagttcggtgcaaggttaatcggcgggtacttgcttaacccccgctcgagtagtcttgtaaccttgctctttgtagccatgaagaaacaattttcgggcatattcaagagaggatcaagcacacagttaaggcgacacgatgagcccagcacaccctcttccgccgatacatcgatggaggaggcggacgttccaccaaggctatacgacaactccgatctcgacctcatgggcgaccgggaactgcaagcctattacatgctaaaataccgaatgcttgctcacacccaagcatacgacctggaccttctgaaaaggataggtatggatgctgagtttcatactgtttggcgtgctttaggatgggataaatttgcatgtgtagatgaaccggttcccgtttgcttaccatgcagtttttatgtaccttgctaaaggtaggcgatggtgttaatttccggttattctgcaaggaatatcacctttcttggaaagaccttagcttgcatctaggctttgacaaaacatgcaaagttaatttcagtaacgcatttcctaattttaacaaacgtatgttttggcaaagtattttgggtctcccattctgtaaaaagcctagaactaatgacacccataatcctactcttaggcttatgcataagtggcttggttttactttgttccctagagccgatgtccagatagttcgtaaagacgaacttatcctcttgtatgccatggttaagagaattaaggtttcacccgttcagtgcatgattagtcagtggttagaaaacataaggttgaccggtcctgttgagtgtacatctttggttacccgtctagcatgtagagttggggctttgattaatatgcaagtatcttatattactactccccgctcttatgttgatgaggcctatttggttcaaggccacatactcaagcatggtccaaatgatactcttgtgtttttcttcctcggttatacaaatgagatcccgctacctaacccggggttttatttgtataactgccaagaactaaccatttctctccaagaggagttgtatcgtgatgtcccacgcagggtaacacgacgaatggcgatagaagcaccccaggaggcgtcttcctcttcaccaccagtgcggatgtatagagacagttgggacccaaccgcggatgcccccggttggaccaaagtcctgcagtatgatgccggagtttcgacctggcagagtgccagtgacaaccggtggtatgcataggagcactgggggtactcgcgttcctctagttcaagtggtctacctcctgcctcccggatgcgtcgctcagtctcctctcgaggggatttgggtgaacttacccaaaggatgggcatacttgaactgcagacagggagcatgcagcacacgctggagggacatgtggtgcagacacgggagtggcagcaatctgttgatgcacaacttgcaaatctcaacaccacgatgcaacaacagtaagctgattggcaagcgtactaccgctaccagggattcaatccctaccatgagccatagcaagaagcaagcttggggggagatgtcccccctccccctctcactaaggtgacttgtatctttcctttcattgcatgtttaaatttttgcattgcatttatacacctaaaaacaacataaaattttgcaaaatcaaaaataccaaaaagatagggtaatatgctaggtaagacatgcttagttattcatattgaaatgatgaatagttattctgttttatatctctcatatatgggtcatggttaagtgctctctcaaaatttgagtaagaataaccaacaattatcaggaacctgaggtaagtgagctgcactttgttgatctgagtctagctgcactttgttgatctgagtctaggttgttgcgagatatgagatagtaaataagagtttctatgatcctgttctaagtttgacttgaattccgaatgttttattttccgaaatgataaatttcaaagttcctcatttgatatgagttcctactagagccaaaaaatatccatattgattaagccatatacattttggttacttgtaagtccattgaaatttgtcaaatctttgtgacttctgtagatacttttcatgctctatgatcaagatcatacacccacatatatgcatatgctaaacttctacactgcaagctagcatccattctatctttatttccattataccatcatcaaaataaattcttcatgcttatatgtgctttcttctcctaaaaagaaaatcctttctgaataaaaaagaaaagagaaaaaggagggaaaggcatggttatgaaaataataatcataataaacttatgctctctcaaaatattgagcaagatgttaaaaaaaatgtagccatgccctctctatatttatgaaaggaggatttggagaagaaagtaagcacaaaggagaagaattttctttcttttccacattccatttccaccatatgtcacacacactttgcacaatcttgatcttgagtatgattagtcatctattttagtccaagtttttgacttagtaataaatgtgaatacaagtatgccatgtttgatccctaccaagctccatatatcaaaccttagagtaggattcaaaaaggcaaatttggtgaggaattcatattcaaacactctgagtgatcgagagaatcatttgaggaacttagatttcttttgaaaaatcatttgaaaacttccaagataaaagttaaataaagattgggtgactagcgctctaattgttgttctgtctctcaaccgctcaagacaaggaaaggcagtgtctcgcgggaattaggtgtaagggtaagccataatgccaaacttatttggtttgagagagagtacacataccttgcatctgtatctttgagatatacagcatagtagcaactcctaatcgacaaccaagtttaaatttttgtgagccctttactcggaacgagcaaaggttcaagcttggggggtttgttgacggtcgttatcgaccagtttcgaccgtcaatattacccaattagtaaatactagctatgtttgcgatgtataattcccgaataaaatatctacttccactatgtactatgctactaacatctatgtagaagaagcacatataaatagagaagaatcgacaaaaaatagatgaacgatcaatcagacgctgtcgagaatcagacttatggatagatgggctgagaactcagatatgacacgatccaataggaccaaaattcactattctggataagagaggagttatgggggctacctgccaaaaatgggccagagtagcccagcccatggttcggccgaacccaccttgaagccgttcgatgcagggtttgcgatggacggtgtggatcactccccaatgatggttggagggcattttcgaccattccaaccgccaaaaccgtcattgggaggttatctcattccattctccacacacctcaagaagaagatcaagagctctcccaagtttagtttagtagttctagtactagtggagtaggaaatagaatagtcttcatagtcctcgactcttcaggagatttcgggtatggctctactagctttcctcttttcttttgtaagacttattgaattaatacaatattcttctttatacactttcgttatcttattccattcatataattgagtaccgactttactttatacttgtacgaatatagttgtgtgactagcttaccagagaggtgtattggtgtgggtttagtgtccgagtattcgtttgctctatgtcggttgcaaggatacagagtagtatttagtaatgtaagtgcgatgcttagattattatataccattaattggggtaatatgcaatggttcagaggctggccactgatggtgacagctcaatacgggtgttcctctgcatgtgtatattatcctaagtacaatttcctggggagggtactcctccgtatttagcctcggttggatggccatgacagattgtcgtaaggaactcagcaacaaggggtggtctctcaaaacaccaggaggacactgttagagggtattggttgcatgattgtataccaacaagtatagactaaagatgtatatatactagaagtacaggaatgatactttttgttattctttctccacttagcttagactatattttagtgagaatatcttagttctttcttctgtgtgccaccctaccctttgaactaaattaactcctgcatagactttgatgtatataagtaatatttgaattattagcatagtactatcttatcatatcttcccttgggataaaataaatacgataccttggaatactcccaggtgaaatgctacaatggtatatccgtgcgcttgcagatcacatctgtaaccataatataccaggattatttctagtgctattgctgggaattatattttcagtagtgtcgctaagaaataccaacacgtgccgcctgagaccccctgtcacatcgtgatgatgggaggccgcttagcctcttgtcgcacaagtgaggcttgcctaacccggttatggtagggtttccgtttcccagcacaagtgaggacccaaaagtcctcatttattaaatatcgaatgacatacgtgtcccctgtgtcagccagatggatttgacgggccccacgccgcaacatggcatgcaagagacttccaaggcaaggaacgagacatgcatttaatgtgattatcctccctgaataggctcagtgggcccatgtagtaaccccttgagatataaaaggaggtgcaggcctacttagggaggggatgagccctttttcactagagcagtcgcctcccctcatcatcaacaccttccactccaacaaggagatcttgtaatctcactctctcaatcagcatagcataagagtagggtgttacgcttctcaacggcccgaacctgtataaaccgctattgtctcatctccctaggggggcccgaccccctcttattcacactccaccacagaatcctcgaataccaatcactacccccggccgaaccaaaaaaggggggcctcatggttccctggtggaggagttcacccgccgacatctattctcttaaatctttctctcgtcaccacttcaaattattttttcatctgtggagaaatggggggccagattggtataaagaatattctcaatggatcattaagcaagatcgtgagtggacttaagtgaaaccgaagtctaaggatctgagatcttcagtcgtagtatagcctagtatttcttttgcaaatgttgttcaatctgagcgttcagttccctcatctatgatccctgtctaaaaggtttttgattctttgaaaaagagtatactggataagaattctagatctgtcaaagatcagcttgatttcaatgtgccaaatcattcttcggtttttgataggctagtttttccttctgattccccaaaggcctctaaatcttctaatcagttttgttcacgatgccttaggcaggatcatggggtttcaaattgttctaatcctatccggtgtaacttctgttttagttatggacataaggcccattagtgtttggcccaaaagagtaagactacttccaagtggatagttaaagagacttgacagtggaaaggcgttaacaaatctatttttccatcttcttcacctacttcttctcgacagattactgttgctctagaaaaccccaatccttctcaatccaatatgctgtcggaaaatcttgccatggctaagggcatgtttggcatagctccagctcctgctccatccctcctagatctggagctcaaccaaacagtttcagctccaccaaaactgggagtggagctaggtggagctctctcacaaaatgaactagagttgtggagctaggtttaggcagctccagaactctactctggatcgaactcctggagctaaatttaggagttggagctgtactaaacaggtcctaagattgtcttcaatccggggtgattcgtgggagctggtcatcatgttcaagatggtagtccaaatcgtttgcacaaagctgacattacggttcctgctcgttaaaagcagcatgaagcctacgtgcttgataagattgaaccccaagtgcaaaagatgaatgggatgttcacagattgcagatttgtaaccatctctagaatgaactgggtattatggtcactcattacgctccgcatccccttggtgttggcctttttgctgtcagatcaactcttattagagatacattagttgcagcctttggtttttattataatgggggtcatgtggttaggtttgtgaaccatgatagaggtactaactggagagctgctcatgctgacaaaggagtgtggattatgtttctagggtatcctctagacttccgctctacaagttacatctctagagctatgggtctgtttggaaagttagactacttgcaggaggttgatgctatccctggtcgtgttctgttgcaggcatattttgatggtgttgattcggtccaaggaagaattgttcttaaatagattcctaatcatggtggtcaaggggaatcgtggacctttggagtgcttaacttaaataataagtttgctaatccacaaccgcaagatgaagatttgccccccattggtgtcccgccaccgccaccaggccccctcaacataaggtccagcttgggatgatattaatgagcagcaagaggatgtagggggatgggataactaggatcaacaggctaagaatcaggggactggtcagtctggtataagctcacatggaggaagtgaaaatatgcagatcataatgttggctgacaatactaaatattttccacagttttctataacacctgagatgcaggagaagattgatgagttccttttgagggtgaaacttttgagctctttgcaaaatagagcccccatcccaatgcccattcaaatagctgctcttttcaatccgctcctttccctaaaaggaaagctatcactgactgttctccacctgttattaaaagggacaacgtgggtgaggcctcaagttgggccatggaaaaaaagtctattagtggttgatgatgtcatgcatgctttaggggatctaatgatttctctagttcccctggctattctaccccctacccctctggatatttttgctcctgatgaagtccctctactgcgtggccccctgttgatatttctgcctctcaggagatggatgtgcacccaagttcacttgttgcctctagctctgttactttagtgttgggttacgcgtaggctacaatagcagaaatcaaaattttctatcgcgtaaaccaggaaccatgcaagtattagatcatagatcgttaccactcgacgtgctgcgcagcggaagaaggcgctaagaagtcgaaggaattctcacgaagtagcgtgcgtcgatgtagaagaagtagtcgatcgcaccagctcgaccttctcctcctcgtgcgttctcctcgctgtattcctacgctgatcagcaccgcaaaccagcagcgccgctaccggtatccacacgtacagggacggaacgccacgcgcagatgtgctagcacccgcgcgcggctagggttttgctcggggaggggagtgacggctaggatttctcacgtgatgcaatacctccgccggtcacacccctcacgaatatataggatccatcactcaggcctccaaggcccgtaggactcctattcggatccctatccgaattaagctcatattggatctccatccaatctccttattccggcccattaagtgtgcgacccagtaggttcatgtacactcggctgtaacccgaaaactccttttcggtccacgcgtcaacagcggcccccagcagaacgtattgacccaccgggcatacataaaaaccatattggctgaacctctagtgtatacttgtatgaatccctttgcctcacgatagagatatctctccataggaggggtaaatcccatcttgattattcatatcccactacatgtttcatagcatgcccgaaaactacttttataactacccaattacggagtagcgtttagcagtccctaagtaagctactacacatgttgggaaccatgataatctcaggtctaaggattcaacaccaacactaactgagatcaatgatgacacaacacatatggctcttgcagtgtctcatgttgggtatatccaacaacatgttcaccaacatgtgtccacattattaatttggtatctctataccatgatccatgagacatgatcatcaattaatatatgtgctgatcatctaaacatatttgttccacatatgatatttgatcagggatcctttagaaatagcaacacacaacataaagagcctcatgaaagaatcacatattcattaaccaataatgagttatctatttcaaggaacaaagttggataaatatgtaaacatagtatgtgatacaatcatctctatgattgcctctagggcatatcactaacatttagtgcttccaaaggctcctgctaagaaaagagatggtaaaacagttctttatgatcaagtgagaatgcaaagctcgaggttgagggccttgctgattgatgttgcggacttaaatcccaggatgggcattggtaaacctaggggaaaatttgcaaagaagttgaaataattggcatgtatttctaatgttttatcttctggcagtatccttaaggaatctaactttgattctgatatttattttgaaactgattattccccatctgattgtctgtttccctttttacaaaagatgggagttcaaacgtgcagtctatctcttgagaaggtggctaaaagcaagctgggaggagctaaattggacttggtgcccaggccagctgaagaagatgattagtttaaattgtttatcaatggcagttcgtttcaaaaaacaatttgttttaaatatggtgtttttatgtggttattttgtaatgatagttattgtactcagccggtcactagttttttctgtatcatgccacttatgccagacttgctttgcttggtctgttttctctctttgttcatctttttacttatgaatcagcagcgtagctcaaatatcctatgttagaataagggggatgaattcagtggacaagtgggctgctcttataaatattgatgatagtagctaccagctagggtttgcttttaggaaactaaaagagagattgtagactgtgcttctcttaaaaaagttgtgcccaaaagatttgatagttttcactttgtgccttctcatggtgcttagggggggcattttggtctgttggtgtggttccatttttaggggttctttgataacctctaataattttgcactttgcctaaaatttacttctaggcataactctaaatcttggttcctagcttcaatttatggtccttgtagaggccatgaaagagtttattttgtcgattggttaaaatccttccaaattcagcatgatgaagcctggatttttcttagtgattttaatttttacagatatgtggagaatagaaataaaccaggggctgatatgaataacattttcattttcaacaatattatcagttctttacggctgattgagaaccttttaaagggagaagttttacttggagtaatatgcaaagtaatcacctcttagaacagcttgattgggtctttacctctaatgactggaccctaaagtaccctaacattgtggtttatactatgcctagagctatttctgatcatgttccttttgtgatcaaaattgaatcctctattccaaaatcgaatgtttttcgctttgagaattattgggtccagatagagggtttctttgatcatgtggcacaagtatagagtgttgaccctagtttttttattcggctaagcgtatcacttttaagcttaaacggttaacaaagggtctgctgatttggagtaatggtttttctaaattattgcaattaatcaagtcttgcaataaagtcctagattttcttgatctaattgaagaagttagagctttatctctgatggaatggaattttagagaaattgtgaaaaaacagctttgaaacttttttcagtttggaagagtattggaagaaaagatgcacaaatagatggatccaacttggtgaatagaaactaagttttttcatgccatggctacagagaggtttaaaaataacttgatagctcaaattaatgataatggatccgttgtctcagcacatcatgataaagcctctctcttttctgacacttttcaatctagaatgggtgtttctacttatcggctatgagttttgatcaatatgatcttattccaagaaatgataaccttgatagcatggtagatcattttttcactcttgaaatggatgaccttgttaaaagtcttccgattgacaaagctccaggcccagatggctttaatggttgttttattaaaaattgttggccaattatagcccaagattattacagactggatgctcactttcatgctgagttggttgacctgcaatgcattaattcttcttatattattcttgtgcctaagaaggttaatctagaatgtgttaatgattttaggcctatttctcgtatgagtatcactctaaaatttttgactaagctaatggctgataggcttcaaggagttataaagaagattgtacatgaaaatcaatatggttttattaaagagaggactatacaagactatttagccgggtcttttgagtatattcatcagtgtcagcaatccaagagggaaatcctgattcttaaattggacttttaaaaggccttcgatacaatcgaacattcgaccattttgaaaataatgaaacatatgggttccctacaaaatggttgaattgggttaagatggtttttgaatcagcaagttcttctatcttactaaatgggattcctgggaaattccttaggtgcaaaagaggggtcaggcagggtgatcctctctctcccttgctttttgtgattggtgctgaacttcttcaggatgttttaagtagagccatgagtcttggtttgttatctaagcctataaatggtcaaggaggaggtgattttcctggtgttcagcatgccgattacactctcatcttcttaaaggcttcacaaagagaattgctttgtcttaaggccctcttgcacactttcaatcaagacactggtttgaaaattaactatcataagtccaatatttatcctttgaatgtccttgacgagaaattggaaaatctggctctgtgcctttcacttctcttggctttccaaagggttccacaaggccaagagtggttgatatggcagcagtggttgatagggtggaaaggaggttgactgccattgcttcttctcttccttatggaggcatgttactttgataaactctgttttatctgccattccaacctattgcatgtgctcccttaaattgccaaagactattatagaggccattgacactgcaagaagaaatctttggaaaggttctaatgttttagttaaaagaaaatctttggcagcataggatgaagtctgtagacctaaggacaagggtggtctaggtgtattaaatctgtatatttagaatgtggctttgcttttgaagcatttgcataaattttacacagcacaagtgtgacattctggcccagggcttaataggattaatagaatactcatatcaacaagttgcaacttcaagccgatatccaaagaactctgaggttaagcgtgcttggcctggagcaatttgggatgggtgaccgaccggaaaattcttccgggtgcacatgagtgaggataaagtgtgcagaaaagacttgtgttggtctgtgagggtagtctatgaactataaaagctattagatgtaagtgggcccagcctgggagaggcgggacgtgacaaaatggtatgaatgtaagtgggcctagcctgggagaggcaaaggcgggacgttacaacaagaccttccttgggttagacttatttgggcttcttgctacagaacaaaagtacctcatatggttttcaataaagggtctttttggtggaggtacataattcagttggccgatatttatagagctatttcccaatgtacaatacaatctggcacttcagtcttgttttgggatgatctctggaatggtgagattaagaaactaaagtatcgtgatcttttctcccaaactactttaagatgggaatctgtgaatcactttttgaatttacaacttgaagattactttaatcttcccctagatgatcaggcttatagacagtttcttcagttgcaatctgatttagtcattctgtctctcagtccaaataagggagatttatggactttcttctggaattcacacatctactctggccaaaagttttacaggactaattttgtgggactctatgttccaaggccttttatctagatttggaagaccaaatgtgtgaagaaaattaaggtttttatgtggttgcttttgtgggacatgctaaataccaacgacatgttggataggaggcattgtgctcctaaagatgcagttttaaactgtgtaatttgtggtggtcctagagagacgttgattcaccttttcttcacttgtccttttagtaagttgtgctgggagcgcctcagttggaatcgaaacttggaaatttcccaaatgtcgaattttattcagaagaaaaggttttctggatattatttgatttgcttgttggcacatttggaagcagcgaaatggccatgttttttataatgttcagccttatcttaataggtggtttgttgcttttacaaatgaaattcttctacatttctgcagaatgaaggattctcttagctcctccattcttagctagctacaaagtttgtaattttcaaaggggtattggttttgctttttgttttttcctctgtaaataactctttttattttaatatataattattaggcaaagctctggtagtattttacactaaaaaaagatatatggtattgctcttcagggatatgaatcagattagagctatagttgagggagtcaatgtggacttattcctgaggtgtcgcatgccagcctgggcatgattggggcacgtgggtcatgtgttggtatttcgtacgttcatagataaatctgcaagcgcacggataccgttgtagcatttctcccatgagtattcccaagggtatcgtatttatattccaccgggaaggcggcggtataaatatatggtttatatctcatgaatcaacctataattgataatgtagtgaacaaacaggagattcacctttataataatgtctagtggaaaataacattaggaaactatgatataactgtacttctatagtaatcatatttagtatcacttaacatatatatcctgacaacataggactttgttccaagcacctaggtactaccgagagatcactccttattggtctgccagcgtggttgtggcatttatgcactcttacgtcacccctccacctcctccaccaaatcccctacttttccccaatttttggcgccaaatcgagccccacttcgcccacggtgtcgcccacgtcgccggccgttgccgcttcaaatccgccacgtccggccacgatttctcctccccaagcctatcaaaagcaccctcgtgctctcctcttccgtttccctcccctccccgagctcctcgttacctctcccgtgctccccgcgcgagcccgtgctccgccgctttccggcgagctccggctgcacgccgccgtcgccgtagccaccgccacgctgcgctgcttacaccgccggcttcgccatgcctcgccgcacaccggccaccgctccatttgcacaaacctccgccgaaactccccttccaccatgcacccgagtcgccaccaccctaaaccgcctccagtcgcatgtcgtcgtcgcctgagccgctcccgcgtcctgccaccaccgcagccggcttcgctgccgcgcaggcaagcccggccaccgatcagtttttcccctccaccaccgaaaaccacccccaccgccaacctgaggccgacgctgcattttccgcctccagccgcctcctgctgccgtcccagaccaccttaatatgcgccgtcgcctccatcggcttctccgtctggtgccgccccttcgccctcgccattcaccgccggagtcctctccttcccgtcgaggtgagctacttcccatgttgccggcctctggccgctttttttccaccgcctcgcgcctcctccctttcccctaatcattccatcgccctcccaggtcatcccggcctccgtccgccgtttccaccccgtggagccgccgcgggagcaccatcccccagtcgtcctgaggagctcgccgccgcgctcatcgcccctcgccgcccggcgcacggtgaggcctccttcctcccttttcccttctgcctcccttgtccggcgccgcgtcgtgctgccatcgccggcggccgtccgcgcgtgtgccgccgccttgtcgggctggccggcgagcccgccccttgccgctctgttcgccacccatggaccactcccgtggtctgggtccacggtgccgccaggccgcggtggaccgagtccaccgtgcgcccgccccttttgtgtcgctgacgtgcggggcccgcgtgtcagcgccggcgccccttgctgacatcagcgaatgccttttcctttgagaaaataattgataattgcgcaataaatcattaataattatagaaatccatttaaatggctcaaaacttctaaaattcatatctaattcattcgaactccgaattgggccattcaaattgcaaaattcatctaaaattgagttctacatgtttgtttactttttatgtactgtttccttggtttttattagagtttttttcctcgttttgcgagccagcgtgtagaatccgtcgtttcggaagatcgcggtcgcgaggaaaagagttcaaaaaatccaagtgaagaagcaaggcaagtcacacattccccttgagcatgttgttcccaatttataaatgttttaccgtttgtaaataaatatgcatgttttgctaattacaagggatcagggtttacctatctgctcgcttgtgccatgtttacttgatatctgtcatttgtcaaccatgggtaatagatcgcctagcttgtgttactttgatgacctagctagaactatatgcttagccatgcttaattaccactagctcagtcgaagggataattgcagtattagacattctattatcttgttgagctgcgtgctcgagacatctggccatgtttcatggtcgtaattatccaactaaaatgtgactgaatggtgggctgtgggtgcatggttttgtgagtcgcacccatggcaattaaggaccggttcacgggaaaccctggaagacttacagcgcttgccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgcggagggttttgtcacaatcactcgacatggtgacgtgtgcatcatgggcacatgatggcacggtgacatgccggtggattgtgtcttgtgggtacagttgtgcacctctggccagagtaaaactattcgaatagccgtgcccgcggttatgggcgatcgaccagattcaccgtgattagtctcacccctaataaatcgacccaatgcactgtagttcaggtgggttgtttgggcctgttcaacgtggtgtagcgttgatcaatggagatttaatattaccttaattactcaactattttactgttttgctcaataaaatgatttacaaccgcatttatgcaaatagccacaaaccgtccttgtatccccttgcacgtctgcatcgttggtgtggcttgctgagtacggtggttgtactcagtcttgctattattcccccttttcagaagtgtagtgcttctgagctgaagacgaagttagaagaccaaggctcagaccccagttgagttttgcctgtggagtggagctgaagccccgctaggatcgccttttccgctgctgctgcttttgtttcggtgtgaggactaagtgcctcttctataagtattttatgctttatttacgtttggagctgtttattacttgtcattttgtgtaccctggctggtcctggacaaggatttaatacacaaaatagtctggaaatttgggctaaatttctgggcgtgacatgtgccgacaactccggtactcctccagaattcctcctagaaagctacactcgttgagatagaagtcggatggagcgccaaactttcgggcagtcctccaaagcttcccctcactctctacctattttctaatgttcaagagatacaatagagcctcttgtaattcagctcaaagttgtgtgtgttgaagtgtggatggagacctcattttataagctccatatgacagttatggctatgggaaatgtccaaactgccctccaaccgacattgggaaatgtccaaacgagctcagatactgatcccgtgcttgctgcatcattgcttcaaactcctgcttcatctcaagtgtgaatttctctggatcgattggcatgacattgtcatcaatgatgtcagtcaatcctggcttcaatgccttgcctttaatggaacctgggcttgatggtggtggtgcttgtttctcggccatgaggaagaactgacatctgacttctaatcaactcccactgggcgtgccaaaagtgtgttgacagaaaacacgtggcctgggagatctgcttaactccagtgcaggtccaaaactcgccttcggatgtattagcatgccagttgatttgatcctgtaatcaacaagaaataaaagcaaagaaaccatggttaaatctataaatgatagccgatcggctagatgccgatgacatatcatttatctttgggccgatgtcatctgtgtatcgatcggcagtcatgaataagtaaataaacactaaatctactcgatcggctgtagatgttaacgatatatactccttatattggtatatacttaaatcgagtgattggcatagatcggacaccatgctgagacagtataaatcacttagatcgaaatatatatcaataacatgattatatatgtttatagcgtagccgatcagatagatctagcgtgtatcggctaatactccgatactacctcatatcaggatattaaagcaggtataatatatcaaacaaagccctaacatatttagatgcagcaatatcttgatagcaagggcagatttagcatatcgatgagacatgtagaataaatatggctaaatcagatacgatcggctgaaaccccgatgctattcttatcggcaactagaaggcaggccagagatcgatattctaaacacgacttaatagatcaaactcaactgatgcagcattaagtatgaaaagaagaaccatatctagacaatcaagccgctagcagtttcatagaatggtagatatcttatataatctagatcaacatcaagatctaacctaatcggctgccttctgcatacagatattgaccgatagtagtttagatggcgatatcgttagagattatataaggtatatgataacttgatgaattacataaacaggactagagtgtcatgaggatggaagcactaatcctaagaacgcaatccatcacggcgaatgttacctcttgttgaagatcgaaatcgatgcagctcaacccgaaagcaagaactcgtcaaaataaaactaaagcaaaaggatggcgatgcgccgagattgtattgaacgtgtgtattaaaaattacatgtcacgcccgaaatttctatccaaaattccaaacgcttacatgtgtgtaaaccctcgtctaggaatcagccgaggcacacaataacaaattgataatagagtacaattattaataagcgactataatgtcattacagaggtagatagttcctctcaaacaataaagttctaagcagcggaaaataaaagaaacagcacagacgactctactccacaggcagcttgaccagggctaggcctaatcctccacaccatcagcatcacagtagaactcttcctctgatgaatgattgcaagg

SEQ ID NO: 36957 - DNA, 1008 bp, Oryza sativa
tccaacgctatccacaataccttgttgcataggcccaaccattctgaacaaccaacctcggctgcacagttctatctccaagccaggaatataccattccaaaccaggagttaaacaagttattaaacagcatcatttaatatggtaagaagtgtgagactaatcacgaaagacattgttagacccgcccataaccgcgggcacggctattcgaatagttttaactctagccagaggtgtaccactgtacccacaagacacaacctcaacatcatgtcaaccaagcgtcgcgatacttaacaagtacccgaatagagattgtgacaataccctctatataatacaatttaaagcagtgcaccgttcctggatcataatcacccccttataaacaaggcatggactccccagcgacccccgtgggcttatctccaccacttcacagcctggtgctctacaatgaaccatactatacagaaagtaaagccgttgctcacgctggcttgtggttggcatggttaatgtttcacaaccgaaaatcgtgaaccggtccttaattttcatgagcacgaccatcaaaaccatgtgctcacaacccaccattatcaggttttagttggcaaattaattaattaaccaatcacgattaaccatcgtgagctatcattaagccatcattaaataatagtgaatcataagttatcctaatagtgtgctaatgtttctaagcatggctaagcaattatgtctaatatctagctgaaccaatatataaagctcaactagtcaaattataataacccaaagtattaaggaatagagtaatcaagaacaaaagggctataacaaggcaataggttatttccacccaatgacattcaaaaataaatgcaatagttgaatagaaacaataactttaaacgggatcaacatgctcaaaggattgtttggatctgtgtgacttgccttgctcgccttggaattcctcaaagtcttctcctgcaaaat

SEQ ID NO: 36958 - DNA, 254 bp, Oryza sativa
ccctcgaaataattttaactaattaaaattgagcacatgcaattttaaatcccagggaaaatcttttcctccttttctttttcttttccctccttttcctcttcttgggccgtcggcccagtccatccgccgccgccgagcgcgccctccttcttgtgggccggcccaagccgtcttccctatatccccgggacgccgacaggtgggccccacctgtcggggtcgtccccttccttcggacacccgttcccacg

SEQ ID NO: 36959 - DNA, 1001 bp, Oryza sativa
  unsure (1)..(1001): unsure at all n locations
atctgtagactgtagctactaaagtttactcacagtatgctgaaaactgtaagatggaatcgtaagggaaatgcagcaaacagatatnnnnnnnnnnnnnnnnnnnnnnnnnnnnnnnnnnnnnnttcttcagccttaaccttatcaatacgctctgtgtgcagcttttctttctctttatcttgatccctgtctctttcagctctgtctttctccttctctaactctttttcttggtcatggcgctccctctcccgttcacccccagggcgtcgttcatgctcctccatacgttccttttcttttcccttgtccttgtcacggtcactttgagtcttctcccttttccttttcttaacaatctgttgcaactcttcaacattttttgtgattatttcaagaggttcaagaagggcaaaatccttcgcaagatcttcatcattctgcaacaagataaagagcatgatgtagcatgcatcagaaaaggtaatgaacactagaagacaaacaaacttacttcatccgtatttgcttctagttctatgtattggaggcctttctgcacgatagtgataagagcaccaggtggaactagatttccatcaatcccacccttatggatccctgcttcataccctaatgtgaatgcggcatgaatgaaacctggaaaggttgagaaaccatcagcaataactgtcatagtcatatataaccaaatatatatataagtcgggtgcagcataaagtagttgcagctacatcattggacactgacacagatcacatgtcagttatgtatcaggaaaaagtcagctaaaatagatgatgttttttttttccgatacagctttggaacttcattgacaagcatgcaaaaatttatcgcacatgcaacacaaccctgccacttcaacaaaaagtgaaaagcctatcactagaaacagacaactaaagtaatgatattatctttgatacagctttggaacttcattggacgcatg

SEQ ID NO: 36960 - DNA, 1214 bp, Oryza sativa
  unsure (1)..(1214): unsure at all n locations
nnnnnnnnnnnnnnnnnnnnnnnnnnnnnnnnnnnnnnnnnnnnnnnnnnnnnnnnnnntggctagatcaaaaggaggaatttggatatttggatcgagaatcaaaggatgggtttaggatcaaaggatgggctaacaattaattccaatgagattggaattactttggtctaggttcaaggacaaaaattggaggatttcttggaccataatttgcaatagtaaaaatggttttcaaactaaatttgaataaaagagttttagtcgaaagaaggtttaatattcgaaaatagaattccaacaagaaataccaaatatgtttttaaatgaaaaacacaaaagggattaaataccagagaggttttatgcgagttaattttaggaagtcccgctaagtatattttcctaggtttaaaaggttattaagaacataagaatcagcatgatgcaagattagaaaatgacacattttcaggatgttacaataatgaattcccatatcataatccttaatcaattccaaccatctccgctgtctcatgttcagatccggctgggtgaaaatatacttcaaacttttgtgatccgtatacaccttcgtacgagtaccaaaaagatagtgacgccaaatcttcaacgcatgaaccactgcggctaactcaagatcatgagtagggtagttcttctcatgcgggcgtaactgacgagatgcataggcaaccaccttcccatcttgcatcagaacacaacctaacccaagcttggatgcatcgcaatacacttggaaacccttctttggatcaggcaaaatcaaaatgggtgctgatattaggcgacttttcaactcttgaaaacactgctcgcactcttctgaccacttgtacttcacatctttctgaagcagtcgtgtcatgggcttggcaatcttggaaaaattctctatgaacctccagtaataacctgcgagacccagaaaactacgaatctctgaaactgtcttcggttgtttctagttggttacggattccacattactaggatcaacggcaactcccccggctgagatgacgtgatcaaggaacttcacttcagacaaccagaattcacatttgctaaacttggcatacaactgatgttctcgcagcttctctagtgcaagacgaagatgttcttcatgctcttctttggttcgggagtaaatgagaatgtcatca

SEQ ID NO: 36961 - DNA, 1171 bp, Oryza sativa
  unsure (1)..(1171): unsure at all n locations
nnnnnnnnnnnnnnnnnnnnnnnnnnnnnnnnnnnnnnacacggattgatgggaccacaaattaggccaaatgttgatggtctttaaatcataatatttgaccgtcaatacctgcatataatgaaataaaataatgaaataaaatatggtattcaacttagtggtagggattattactacccaattccactagtgttggtgaaatatgtgtatgcgggtattttaatgagaaaacacaccagtcatgcaaggaaacacacctctggccaattagacgcaagtacacggattgaagggcccataagtcaggtgaaaccgccatggaatgcgtcataactgtcataaccgccatcagggcccaccagtcagtctcctggccaaagggaaggccaggaggtggggcccaaggtttggccgaaccaccaccggcgcctttgatcctggccttccacgtgtgcgttcctgttaacaaccgaatttggtaacatcagcgtcgggagagaagagtagattgaagcaaagtcggaagaggaaatcgggtttgaaagcagagcaggaatcggctgaaatccagatcggctacgataagatcggctgggtctgagtcgtgttgggtaagtcgatgtagccgattccgacaatacgacttgtacgcgacatcgggttcaagttaatgtacttcaagatgattgccacgcatggatagagtcctgggaaggcaattgtatctattaattaggatattttatgtaaattccttatagacaaaagtctgccgtaaagacttatggtatcttagagtttgttagagataatagtcgtgtccggtatgggcatatcttgtaatcctcgggtataaatagaccccgagccctatgtaatttttaatacacatgttcaatacaatctctgcacatcgccatccttttgctttagttttatttcgacgagttcttgctttcaggttgagctgcatcgatttcgatctacaacaagaggtaacattcgtcgtgatggattgcgttcttaggattagtgcttccatcctcatgacactctagtcctgtttatgtaattcatcaagttatcatataccttatataatctctaacgatatcgccatctaaactactatcggtcaatatctgtatgcagaaggcagccgattagg

SEQ ID NO: 36962 - DNA, 14565 bp, Oryza sativa
  unsure (1)..(14565): unsure at all n locations
cacagcagcctatccaaccgattcagcaaacactgccaaggcagcggcttcagccgatccaacagactcaggtgcgacagcagatcgttcagctgattcagcacccggggtcggccaatgcatcagctgggttcgcagcacctggtgggcaacctgcgcagcaatttgtaaaccaagttgtctcagagcatttggttcaccatgcacagccggatggcactgtggtgcctcagatggtccctgagcacttggtacgcaacatccagccgaatcttcataattaccaagggggtaacttgagctatcagtatcagcctccttccccgcaagcccaatatcagccagggggattggctcagccccagttcgcacctcagtttggtcaattcgagcccatgcagcaacaaccgcaaggagcagctcagcaatgaccatgggccgatgtgattgccgatgtgatgagggagcagtttggacttaaaccaaaagaaactagaagtttgtatcggcagccttaccctgagtggtttgaaagagttcctcttcccaatcggtttaaagttccagatttctccaagtttttgggacaagagggcgtgtcaacttatgagcacatcagccgattccttgctcagtggggtgaagcatcggctgtagacgccttgagagtttggttgtttcggttatctctgtccggatcagcttttacttggttttcttctttgccgtatgggtcgatcaatagttgggccgatttggagaagcaattccacagctatttctacagcggggtccatgagatgaagttgtccgacttgacagcgatcaagcagcggcatgatgaacccatgcacgagtatattcaaaggttcagaaagatgaggaacaagtgctttagcttgagtttgaccgatgctcagttagccgatttggctttccagggtatgtccctccaatcagggagaaattctcatccgaagacttcgatagcttatcgcacctgatacagaaggtgaccttgcatgagcataggtcagcggaagtcaggaaaagctctaagaaagttaatcacgtttgtccatatatgtatgggtcggatgacgaagaagatgattctgagatagctgcagccgaatgggtgaggagcaaaaaggttataccatgccaatgggtaaaaagtcctgggaaagaggagaagtatgattttgatatcaccaaagctgacaagattttcgatttgctactccgagaaaagcagattcagcttcctgctggtcatacgatcccatcggctgaggaattaggcaagaagagatattgcaaatggcataattccaggtctcattctaccaatgattgtaaggtctttagacagcaaatccaggttgccattgaggggggaaagattaagtttgatgattccaagaagccgatgaaggtcgatgggaatccttttcccgttaatatggtgcatacagctggtcaagcaaccgatagggaccatgcaaagggttttcaagtaaattcggctaagattatcaacaagtatcagaggaagtatgataagcagcaggagaggcgttatgaggagtacgatgatggttttgatcctcattggggttgcgagttcttcagattctgctggaatgaagggatgaggttgccatctattgaaaactgtcctgggtgcagtgatatcatcgagagctcaagccgaccacgtaatagggatgatcggctgagacagacaagactccctgttcatcaaaggttgggtccgatgaatcaagatcgtggccaagaggatgaggtgatcaggaagaatcaatggtgtccttctggtattttcacgaagaatcagaaaaggagggtccagagattgaggagcagggaacgttttcaggaggttgaagaggaaatcaaccattggctgaggaaaccaaagccaagacaggagtggcgtgtcaagaatcaggttcccgtagccgatgatgctgcagccaatgaagtgaagaagttggcaaaaggaaagagtgttatagcggcaccgattaatatggtctttacattgccacctgaattctggatcgatcaggccgatgttgatgaggtggaagaggaatcggctaagttggtcttgtcaccagaacaggcagtattcgagaaacccgaggggacagagaatcggcatcttaaaccattgtatgtaaatggctacatcaacgggaagccgatgtctaagatgatggtcgatggtggggccgcggtgaatttgataccttatgctacgttcaggaagctgggtaggaacgccgaggatcttatgaagataaatatggtgctcaaagactttggtggtaatccatcagagaccaaaggtgttccaaatgtggaactaacagtcggcagcaagactattcctaccacgttttttgtcatcgatgggaagggttagtacaacttgttgctcgaaagggattggattcatgccaactgttgcatcccttcgactatgcatcaatgcttgattcaatggcaaggcaacaagatagagatcgtgccagccgacaggtcagttaatgttgccagtgccgatttagccctttgggagatggatggccttgattgtttatctggaaaattctgggatggagattttctaaaagtgtccgattctgatatacagccaatcgaagatggagaacccaagctattactttgagggcgttgtggagggttcgaatgtctacgctaaggatacagtagatgatctcaatgacaagcaaggtcaaggttttatgtcggccaatgatttggaagaaatagacataggtccaggcgatcggccaaggccgatatttattagcaaaaatttgtctccagagtttagaaccaagctgatagagttcctaaaagagtttagagattgctttgcttgggagtactatgagatgcccggacttagccgatcgatcgttgaacatcggccaggggttagaccacgtcagcaacctccgaggagatgtaaagccgatatgctcgaacctgttaaagctgagattaaacgattgtatgatgctggttttattcgtccctgccgatatgctgaatgggtttctagcatagttccagttattaaaaagaatggcaaggtcagggtgtgcattgattttcgagacttgaataaagctacaccaaaggacgaatatccaatgccggtagccgatcagctggttgatgccgcgtcagggaacaaatttttgagttttatggatgggaatgcaggatataatcagatctttatggccgagggagatatccataagacggcttttagatgtcctggtgcaatcggcttatttgaatgggttgtcatgactttcggcttaaagagtgctggagcaacttatcaaagggccatgaactatatatatcatgatttaatcggctggttggttgaagtctatattgacgatgtggttgttaagtctaaagaagtggaggaccacatagccgatttaaggaaagttttcgagagaaccaggaagtatggcttgaagatgaatccaacaaaatgtgcttttggtgtgtcggctggccagtttttgggatttcttgttcatgaaagggggattgaggtgaaccaaaggagcgttaatgcgatcaagaaaattaagcccccagaaaataagacggagctacaagagatgatcggcaagataaattttgttagaaggttcatttctaatttgtctggaaggttggaaccttttacacccttattgaggttaaaggccgatcaacaattcacttggggagcagagcagcaaaaagctttggataatatcaaggagtatctcagctctcctcctgttttgatccctccacagaaaggaatactgtttaggttatatttatcggctggcgagaggtcaatcggctcggttctgattcaagaattggaagggaaggagcgagttgtgttctatctcagtcgacggctcttggatgctgagactcggtattctcctgtggaaaagttgtgcttgtgcctgtatttttcgtgtacaaggttgaggcattatttattatctaacgagtgcactgttatatgcaaagccgatgtagtcagttacatgctgtcggctccaatattaaagggacgagttgggaaatggatattttctttgactgagtttgatcttcggtatgaatcaccgaaggcgattaagggacaagctatagctgattttattgtggaacatcatgacgattcaatcggctcggtggagatagtaccatggactttatattctttgatggatcggtgtgcactcatggttgtggcatcggcttagttataatttcccctaggggggcatctttcgagttcgcttatactatcaaaccgtatgcgactaataatcaagctgaatatgaagcagtgcttaaggggttgcaattactcaaggaggttgaagccgatatgatgaaccctgagttcctctcgacactcaaggctgttgttggcccgatctttcggtgagttgtgataactacgatttgggagaaacgttgacgatccgactacaaccgtacgagacgttgtgttgcaccttagcgatcgatacacctctccgtgggttgctgatcttgccggtgcagatcaaccctattcctgcaagcaaatcgaagaaacaagcaagaacaagataaaagcaatctgatattgcaaataggaatttaatacaaatgataagttggggttccgaagaacaagcagacggacggtctagccgacacgcgcgctgcaagcaagtagcaatggctaaactttaatctaacaaaaccccagaaaccctgaaggggtaactagctatatataggggtgggaggacgacctaggggtgcctagggtcgtgctccaccagcttggggcgcaccccacatgggccccacctgggccggggtcccaaatgaagttacaagcccataggcccattacaggtgtcgcagcaccttgtttcttcagttgctgccgactgagatggaatttggcaacgaggcttgatgcattggaaagaggactccgagagctttccatcaagtactcacgggccaaaaacggaggtcgtatggagcttcggcggccgtttgaagtcagcagtgtagcaggtggccgaattggattttggcacttggaggactcgaacttgatatcttgttgttcatccatgatgtgagcaacggatgtatccgtagtagccatggtcatatcatcctccccttcttcacggaaaaccgtcctcggtttttccatatggtgttctttatatagtccattcaaaataacctgtttcatccaatcaaaactagagaaactcgaagtagtgtgattagcaataacatgtttctctaaatccgaacaaatgaaaactctatgcaccaaatatattcctctatcattatatttgccaaagatatgaaaaatagcattagttggacttggcaaatcagacttagaaaataatttctccttcaaattatcgagctcacaaaaatcattaaactgaacatagcccaaagtatttaaagaagatagcaatttacgttcctcaacttcattagcaatgtgaacagcatgcttaaaatcagcacacaaagaaacactaggaatagcatgttcattcactagttgtggcatggatataagtgaagcattatcacacaactcttctttatcacaaggaacagcgagtaaatcaacttgtgacaaaggaattccagcatttggttccactaacggttgctctacttttgcatgaaaagtggacaaatttacttcgttaacaatgcactcaccttgattaatttcagtatcatttactttaccttggatgtcctctttagatgatggaggtgtctcgaacttgggtgtgaacaatggaattggtggctctttcatgtctctctcctccttttcgtgattacgcacttcctgcaaatagttagtaattggaggcaaagacatagcgtgtttctttttcatatcctcctctattttactttcagcattgcaagcaagttgtaacaaatgagaaagagatgtatatctttgacaatcaagcatgtcctgaatttctttgttaagcccacataaaaacctcaattctttagcttcttcgcattcatctaaaccacaacgtaataaacaagcttgcatatcatgatagtatgaagtaacagttctggtatcttgttttaaacattgcagtttgttgaacaaaatgtcagcataatacatgggaacataaacatatctgaaatatagtttcaggtctttccaagattgtggtattttgttatgcctacaaagatgtttccaatcattagaagcatgtttaattaaaacactagaggcacacataaccttttgtttctccgacaagacatgcttttgaaattcactatcaaccgctagctcccaattaatgtaagcacgaggatcatagtttccctcgaaataaggcagtgcagatttgatcttacctagaacatcatcacttacctcataatggtcatgttgatccctcctcatgtctcgacgaagatgtcgatgttgagcacagctatccccaattatcttgcgtatccctgccattgttagtagaaaacaagaaacatacacaaaaatatgcgcgttcctattaactactaggtagtggcagctcaaaaatcgcacacactcaagcttttaaccaagctcttacaagatcttaccaatgcaagtggaatggtgacatacaccgactcaaccaagcaccccaatgaaggttggatgtatcgatgccttggcaaacacttgcggtacggctgtaatcaaatatgtggagctctgggtaggcttaaatacgtagcaaaggaatagcaaatgctcaaatcagataatgcaaagttgaataattgttcaaagtcaagtaccgtgctggtcctaggctagaacgtactagagacgcgagcctagacacaaacggtaccacaaaatagcaccagaaacaactcaagcacactctgatgtatgaagttcagctcaaacaaaacaatattttctcttttctttctttcttctttcttcttttcttttttttttccttttcttttctgatttttttttggtgcggctttttttttcttttttttttgcacctttctgcccttttttttctcacttttttttttattttttttaacaaaaactgacttaaggaccttaatgtaagattacagggactcaaacataaatataaaatttatagggactcaaatgtaaaagtctaaacccaaaattaaaattatacaaaaaaatggaatgctgaatttatgccggttccgtttttccaaacagatctcgaaaccgacaccaaacaaaaattcgccaaggtgtttgacacaactcggaaccgtggaattgagggagggggtcagactcggccaaaggggcgagtgggactcggcaaggaggtggagtggatggcagccgaatttggtgtatgggataaaacggaaactgatttttaaccaatccaatctactatatctttccaaaacaaacttgactacttccaaaatcagatatggtaattcaccttcctcctcttgtgcacgacacaggcacggccaaaacaaacacacacaaggatcggcaaactctagatgcaactcaataactccaaaactaaccgacagaaacttctgaaaactacaaaaatagaaccgtggcagcgagccgattccgttttcgtaggtcccgacaacaacagagacacggtggcagcgacgactgtggtacaaaaacgtgaccagaactcgaaactctaaacgaactagacgctaagaccagcaacacgacgtgacgatgcaacacaaaattcaacaaagcaaaaactgaaaagaacaatgcaatggcacaatatggctaggtaaatgatacgaatttttttgtatggctattttctggttataggaagataaaaactcaccgagcaacgaaagctctgataccacctgatgaaccctgagttcctctcgacactcaaggctgttgttggcccgatctttcggtgagttgtgataactacgatttgggagaaacgttgacgatccgactacaaccgtacgagacgttgtgttgcgccttagcgatcgatacacctctccgtgggttgctgatcttgccggtgcagatcaaccctattcctgcaagcaaatcgaagaaacaagcaagaacaagataaaagcaatctgatattgcaaataggaatttaatacaaatgataagttggggttccgaagaacaagcagacggacggtctagccgacacgcgcgctgcaagcaagtagcaatggctaaactttaatctaacaaaaccccagaaaccctgaaggggtaactagctatatataggggtgggaggacgacctaggggtgcctagggtcgtgctccaccagcttggggcgcaccccacatgggccccacctgggccggggtcccaaatgaagttacaagcccataggcccattacaggtgtcgcagcaccttgtttcttcagttgctgccgactgagatggaatttggcaacgaggcttgatgcattggaaagaggactccgagagctttccatcaagtactcacgggccaaaaacggaggtcgtatggagcttcggcggccgtttgaagtcagcagtgtagcaggtggccgaattggattttggcacttggaggactcgaacttgatatcttgttgttcatccatgatgtgagcaacggatgtatccgtagtagccatggtcatatcacgatactattgaaatcatgggggattcttatctagtaatcagccaattggctggagaatatgaatgcaagaatgatacattgatggtttataatgagaagtgcctggaactaatgaaagagttttggctggttactttgaagcatgtatctcgagaacaaaatcttgaagctaatgatttggcccaaggggcatcggggtataagccgatgatcaaagatgttaaagttgagattgcagcaatgtcagccgatgattggaggtatgatgtgcatcagtatttgagtaatccatctcaatcggcttctaggaaattacgatataaggcattgaactatacactgttggatgatgagctttattatcggacgattgatggggtattacttaagtgcttgagtgccgatcaggccaaggttgcaatcggtgaagttcatgaagggatctgtggtactcatcaatcggctcacaagatgaagtggttgcttcggcgtgcagggtacttttggccgacaatgctggaagatttattcagatattataaggggtgtcaggattgtcagaagtttggagcaattcagcgagcaccggcgtcggctatgaatcctattattaaaccatggcaatttagaggttaggggattgacattatcggtatgataaacccaccatcgagtaaagggcataaatttatattggtggcaactgattatttcaccaagtgggtagaagcgattcctttgaagaaagttgattcgggggatgctattcaatttgttcaagagcatataatctatcgatttggtcttcctcaaactatcactatggatcaaggttcaatcttcgtgtccgatgagtttattcagtttgccgatagcgtgggtatcaagttgttgaattcttcaccttattatgcacaagctaatgggcaagccgaggcatctaataagagtttgattaagttgatcaagcggaagatttctgattatcctcggcaatggcatactcgattggccgaagcattatggtcttataggatggcttgtcatggatcgatccaagttcctccttacaaacctgtttatggacatgaggctgttttaccatgggaagttagaatcggctctcgacgaacggagttgcaaaacgatttcacagcagatgagtattacaatcttatggctgatgagagggaggatttggttcagtcacgattgcgagcccttgcgaaggttactaaggataaggaacgtgttgctcggcattataataagaaagttgtacctaaagatttttcggaaggtgaacttgtatggaagctgattttgccgattggtactcatgatagtaaatttagcaagtggttgccgaattgggagggaccgttccaaattcataagtttgtgtctaagggggcatatatgttgcaagggcttgatggtgaagtttacgggcgagcgctcaatggcaaatacttgaagaaatattacccaagtgtgtgggttaacgcatgatcggctactactgccgatgcgtgacagccgatgtgtttacatcgccttgagatggccgatattgttatatcgcccttagttgtttttataatgtaatcggttgtggtttgccgatgtacaatggccgatattgttatatcgcccttagttttttttataatgtaatcggttgtggtttgccgatgtaaaatggccgatattgttatatcgcccttagctgttttataattttatcaatgctcttgacattgtaaaactaggggggcatatatatatcaaaatgcagtatgcagtacaaaattttttgagcaaatttcaaagtcatattaatcggcgcaaagggttgttaagacaataaagtatcagaatgttttagccgattacaaaagtcttaagtattattacataaagactactgagataagtatcgctagatggccgaaatagccttctgcctaatctgctctacttcttctatggcttgggcatcttgagcatcggttcgagggataacttttagggacttggtcagttcagcaacatgcttgatagccgatttaagtcttgctttctgttcttcaatagacttggggagatcggctagcttcttgcgctccatatccagctcggcgttacattcttcaagttgtgctaagaggtcaatcttgtgagcctcaagccgatcaatgttagacttgattgggccttcagataattggtcaagcttggatttctcttcatgcacaagttgtcggctggcttggatagtggcttcaatgttcttacattctcgccgttcgactaatcttaacttggctttctccagcttgaattggtgttgctcaaggtaaacagctggagtaaggatgtcggctaactcatccgggattaaggcttgaatctcatgcagccgagcctgattgagccacagtcaactactaagctgtctagtgatgatgcctctagccgatccaaaatacttccttgagttttcttcacgtcatcagataaaggagccaatgctttgcttgtagtatcttcttctccttcatcaagatagtctctgatattgaaagagaaaagatcggccaatgcctgcaataacaatttagaagcagattagaggttaaacgattatagccgatttgaatgcctgttgtgataaaagaaacttactaagatagcaggagcagttggttgttcttcttcctcgacgtgatgactccctgcagctgaaggggtctgatcacttgatgattgttgaataaaaggagaaggaggaggtgaaggctgaaagggagacaagtgtcagatagaatcggctaaaaattaactaatgaaagttaaatctatcttactggtggagctggtttagatgttgttgcagccgatttcttcttcaccgcagtcttctttttctgcaattataagacttgggaatgatcggctataagacaaaataatcactaaaaggattaacgagaaacacttacccttgagaagtggactggggcagaaggagttggaagggtttgcttaggcgaagccgatggtgttctttcagtatcgcttacttcagctgcggcctgatcaacttcgtcttcaattatctcttcatctaaggcttgttcaatagatggatccaaggtgggcagatcatcggccggcttgtcagtcggtttggttttcttgaacttggcctttttctttggagccaagattgaagtgctcacagccgaggatctggttttcctttttgggcctgcatcggctggttctctagttaggccgtgaaggagagttgaggtcttgggggcatagtagccaataacaggggggagatagcccacctccatttggaattaagcccgaagcatactcaatgttcttgccactattgctttggtgaggaggggaggactctgttgtctgcaaagcaggagcaaaagattggttaagtaataaatcgattaattgactacgcaatttgatagtaacaatgtttacctagggtatgacgtcgggggacagatctgtcatatacatcgtggctgattgatgaaacagatgtagcttctattcaccccaccatctgtcgaagtttttgcttctgaatccagccaactcaatattttcaatgctgccaagaggaggtcccgatagattgagtagccgatccatcattagagcagacgtgatttgtcctcggcactgaatcttgtcggcaaaaaataagccgattgggagttggcctaatccaagttgcctagccgagctcattgggtgataaaactcgtaggagacttggatgtttctcccttggtgaatgccgacaggaaggatgcaagggctgattgcggctataagaacttctctggatttctggaatttctcatggttaatatcttcgaatctaaaatctgatggaagttcgaggtctgctgattcttcataagggaaccagatccgggtatctttcttaaagccctcatagaagctgcagaaccagtccttaagcagctcagccgataactttgctccagcatcggttggtgtggatgcatattccccatatcatgtgcacctgcgatgagtacattcttctccgtcgtcacccacaatcggctctggcagtgggaactcagcttctgttacagaaggccgattgacaaccttcataaccatcaggtttaaccaagtttgcagtagccaccagggtccacctgctccaactgccgagccgacggctattctagccgatgtgttgttcaacatctggtacagatagccgagaaggattttgcccaaagggaattctttctttgactccagggcttcggctacgaactgccagttggttgtagggccacaactggatccacagaaaaggaacttttccagccacatgagcaaaaaggctacgtgctctcgaggggtaacggatccttgacccatatatgctgccacatagccggaccaacaacctatgctcttggttttgaaatcgaattggttcttggtattcatgctcatggggttggccgatgaagttacatctagtccggtgatcatagtgatgtcaattaaggttggagtcatcggcccttggttgaacaggaaagcgttgatggtgtttgaccagaagtaggtggcggcagccatcagaggttcgtctttggcagaattggctatggtgagggctagtgcttggccgattccaatctcatcccagtgaactttcttactagccgatacacgttgataccaagtggaccaactcctgtcgggtgtgggtttttcgagagatggccaggatttaaaggtgttcttccaatgacctaggttagggttggatagcctaaagggaatccggttggtctcaccagtgatgaaatcggtggggtcgagattgccgattgggccaaggaagtagtggttctggtgtgaaaggcttggaattgcgacttggtgggaaagatgttacgaatccaaagcaatcgaaaagagaggggaggtatgagatgagagaaaatcaatctattgctaaggaaaggggatttagccgatgagaacttacctcggcgtactcggctattggcgcaccagacgggctggcggaggatgacatggccgcgggcggagatctcgtcgaaggagaggttgcctgggaatcgcctttgcgtcggaagagtcgccggagaaggaaggggaataagttctgcttgagcggtgaaaacgggtgtcacggtgtgaggtttctcgggggtgacggttagtatttaaagcacggcagtaacggtcggaaaacggtaaagtgcgaaacttgctcggagtcgatttacagcaaatccgaaacattaccaaatattccggacttggggggcatgtgttaacaaccgaatttggtaacatcagcgtcgggagagaagagtagatcgaagcaaagtcggaagcggaaatcgggtttgaaagcagagcaggaatcggctaaaatccagatcggctacgataagatcggctgggtatgagtcgtgttgggtaagtcgatgtagccgattccgacaatacgacttgtacgcgacatcgggttcaatttaatgtacttcaagatgattgccacgcatggatagnnnnnnnnnnnnnnnnnnnnnnnnnnnnnnnnnnnnnnnnnnnnnnnnnnnnnnnnnnnnnnnnn

SEQ ID NO: 36963 - DNA, 2900 bp, Oryza sativa
ggggaataagttctgcttgagcggtgaaaacgggtgtcacggtgtgaggtttctcgggggtgacggttagtatttaaagcacggcagtaacggtcggaaaacggtaaagtgcgaaacttgctcggagtcgatttacagcaaatccgaaacattaccaaatattccggacttggggggcatgtgttaacaaccgaatttggtaacatcagcgtcgggagagaagagtagatcgaagcaaagtcggaagcggaaatcgggtttgaaagcagagcaggaatcggctaaaatccagatcggctacgataagatcggctgggtatgagtcgtgttgggtaagtcgatgtagccgattccgacaatacgacttgtacgcgacatcgggttcaatttaatgtacttcaagatgattgccacgcatggatagagtcctgggaaggcaattgtatctattaattaggatattttatgtaaattccttatagataagtgtggggcaaaagtctgccgtaatgacttatggtatcttagagtttgttagagataatggtcatgtccgctatgggcatatcttgtaatcctcgggtataaatagaccccgagccctatgtaatgtcacaccctaaaaatcctaaatatataaattgttgtttaattggaattattagaaataattttaaaagcctagaagagaagatctaattttaaataataaattccaatgtaaaagtggctagataaaattttattaaatactttacttgattttatagttcctggatttttctgggatttatttgagccaaggaagtatttttaataaatggaattgcatttcatgaataatttaaattgaaaatgttttaaaaatcctccttttggctttgggccgaaagtcggcccaaaaccctctctctctcctccccggcccaagttggcctgcagccgagacgccgctcgcgcgcgcgtcccactcgctgacaggtggggcccacctatcggactcgtcgtccacctccagccgtcgcccggccgaaccctagccaagccgcgccgccgccgcccttccaaattcgctcgtccctttctcgatccgatgaaattgtttgaggggaaatgatccccgagatctcctctactttttcccttttggaatcatcgcctaattcgcttttgaaatcgccggattcgagtttgattcggattcgttttcttcccctgaaccctaatgtttccatcgccgtcgccggccgccgtgggcctccaccgtcaccccctagcccctataaaggacccccgagctctcctctacccgccgccaccctcgcctcgccttccatggccggtagagctctagcaccgtgagctcttgcaccgctgtcgctgccgcaagtccagccgtgcgacgccgtcgctccggtcgtcatcgtcgcttgggaaggacaacgccgggttcaccaagccgtcgccgtcctcgtccacccctccgtcgtcgccgaggatcgccggaagaccgccgtcgtcgtcaagccgaccgtcgccgccgcttcttcctcgtcgccgtccgccgccgttcgtgcctcggtaaggatcgctgcatcgtccactacgcatagaggccctccgtttgcgccaccgcgccgttgttcgccggcgagcatgcgcgcccgagccgccgccggtggtgacgtcatcgccgacgtcatcgtcgtcgtttcccgtgagccgcggtagaccgattagatctcggccgtctgttttggatagggttgatcccggccgttcgtttccgtagaccgccgctgtgcacccggtccaccgtgaacccgagccactgacgcaataatccccttttccttttaaaaaattattcattattgcatcataattcaattaaaatctatataaatgatttaatccgatttaatctttaaaaattcataacttattcatcttagctcggatttagttggttcaagtctctaaatttttctaaaattgagatctacatgttaaaaatatccacatgtactttttatgcttgtttatgtgctgttttagtgtttttgctcttttctctttagattccgacgttcccgagagtctgaatttgcaagagaagactttgaagagttccaaggccagcaaggcaagtcacacagatcccaaacaatcctttgagcatgttgatcccgtttaaagctattgtttctattcaactattgcatttatttttgaatgtcattgggtggaaataacctattgctttgttatagcccttttgttcttgattaccctattctttgataccttgggttattataacttgactagttgagctttatatatatggattcagctggatattagatataattgcttagccatgcttagaaacattggcacactactgggataacttatgcttcactattatttaatgatggcttaatggtagctcattatggttaatcatgattggttaattaattaatttgccaactaaaacctgataatggtgggttgtgagcatatggttttgatggttgtgctcatgacaattaaggaccggttcacgatttttgattgtgaaacatttaccgtgccaaccacaagccagcgtgggcaacggctttactttatgtatagtatgggtcatagtagagcaccagactgtgaagtggcggagataagcccacgggggtcgctggggagtccataccttgtttataagggggtgattatgatctaggaacggtacactgctttgaattgtattatatagagggtattgttacaatctctattcgggtacttgtcaagtatcgtgacgcatggttgacatgatgttaaggttgtgtcttgtgggtacagtggtacacctctggccagagttaaactat

SEQ ID NO: 36964 - DNA, 638 bp, Oryza sativa
  unsure (1)..(638): unsure at all n locations
nnnnnnnnnnnnnnnnnnnnnnnnnnnnnnnnnnnnnnnnnnnnnnnnnnnnnnnnnnnnnnntggaggacgtggaggggatcgtgcccacgtcgttggatgcgagctcgggtgcgggagggcgccggattttgcggcgacgtggacggcaatggcggttggggtcggccggcgagaggtaggaggaggagctgacgggtgggaccgtcggtcccacctgtcggcgaagggagagaaggagggacgcaaaacagacttttgcgagcgggccaagtgagaggggagcccgcccgagagagggagaaggcgcgcgggccgcgggagaagaaggaagacttgggccgaaaatggcccaaagagaggaagggggattttaattgttttctttttattttaattgatgcaatgatctttgtgctattaaaactatttctcgagctccgaaaattcacggaaaattccggagagtacattagggcacaaagaatattacaaaatattcccggccaataatttttaaaggaaatttttaattccctcaataattcacttgattaagttgatttaacttttatttaatttctagaaaatgtattattaattgatttttattcccgaacgaaaatcggggcgttaca

SEQ ID NO: 36965 - DNA, 785 bp, Oryza sativa
gcaaaccatacccctacacacaagcaaacaacacacgatctagaatctaacgaactactcttccgggaaggattaggtttaggtgaacttcgggaaaactcttcttgatcttcgcggaacgatgactctgaactaatcttcccgctccttgcacgaagcttgagactcgacttgacttctggacgggcatgaagctggcggtttctcctacatgtttgacaactaaaagagttggagggacagggaggaaaaattttaataaactgtttcgcaaagaaatgccgaagggcgagaggagacaatttgcgaatagggttttcagaaaacttgtccttagggtttgaccatttggctcaacctacagtcaagttgcctctgataccactttgtcacgcccagaaatttagtccaaatttctagactattttgtgtattaaatccctgtccaggaccagccagggtacacaaaacgacaagtaatatacagttccaaacgtaaataaagcgtaaaatacttacaaaagaggcacttagtcctcgcaccgaaacgaaagcagcagcagcggaaaagggcgatcctagcggggcttcagctccactccacaggcaaaactcaactggggtctgagccttggtcctctaactccatcttcagctcagaagcactacacttcctgaaaaggggggataatagccagactgagtacaaccaccgtactcaggaagccacaccaacgatgcagacgtgcaaggggatacaaggagggggttgtggctatttgcat

SEQ ID NO: 36966 - DNA, 710 bp, Oryza sativa
  unsure (1)..(710): unsure at all n locations
agtctatttaaggtccctattctttggacatcgacatctctaatactaccaattgcagggttcaggatcaagtttttcattgggccacatgccaacttataaatttcgttagggcccatctgaaaatctgccacgtgtccccttctctgattctaggatttgctccgacgcatcaaagccttcaaaggtagagatggtgcaaaggacctaactgtaaattttgctattcaaagggagttgaatgcaaaaggtacgatccctatcttccacatgattcgttccccctcctgaaacatcaagagcctcatgctaagatcatcagatcgatataaatcaggtcatgtgtgaaaaaaaaatagcatatctaccctaaatccacattgagaaaactaaaaaaaaatctaagaagattaaaaagcacggcagaagtaattggtgaaaaaaattgaacacaatctccttgcatattgcttgacttcttcagttctttgatatcagctttctataacgccgatcagaattgggaaaaaaaacaaggaaagcaaaaaaccaggaaaaacaatttaagcaatacatctccaaggagtacttcccaactatctgctcccttaggcaaggaaaaaaaatctgttgctccgtcctattcgannnnnnnnnnnnnnnnnnnnnnnnnnnnnnnnnnnnnnnnnnnnnnnnnnnnnnnnnnnnnn

SEQ ID NO: 36967 - DNA, 914 bp, Oryza sativa
catttgcaatataggatcaacatgttcaagtgacaaacatgacttgccttgctctgctgctggaggaacctcggcaactatctcgaagtacaccggagcgtcagaagaaccggaatctaagcgacatacaaggcaaacaatgcaaacaggctataagactactgaaatagagaacaaaaccatttttaatggattctacacatttttcttgatttactgagacttcaatgggcttaaacggagcacggatgaattagttatgatttttagaagattcactgtgtttattactataaaaaaagtccttaaatcatttattgcgcaataagtcccagggctgacatcatcaagggggggtcggcgccgacaggcgggacccgcatgtcagtggcgcaaggggtggccggtataccgtggaccgggaccacgcgggtggtccaccgccggtccacgggatcgacggcccggatcggcccggggccgatcggacggtgcggcggcggcctggctcggctcggctcggcacaaagctggccggccggccatggcaagggcggcggcgcgcgcgcgtcgaccggcgacggcaagcggcggcgcgggcggcggcagcggacggtgccccagcagcggcgacgaccgaaggcgacggcgaacacgggtggcggcggcgcacggggaaacggggaaggaaaggaaaggggagggagtcctcaccggagggggcggcgatgaccggagacgaggagtgacgtagggaggtcgacaagcgtcggacggggtccgggacgacctaaagaacgaaaaggaaaagattagagagggagagaggggccatagaaggcgggaacgctggccgaaggcggcggacatggcggctctcaccgtcgcacggcgggaatggcgctccggcggcg

SEQ ID NO: 36968 - DNA, 1710 bp, Oryza sativa
ggtctccacatgttatcctctttcaacaagaagctgggaacgaaccccacgacggcaacgagggatgtggcggtggcgggagcagcggcggagtcagtggtggtagcgttggagaaagaagagagaggaaaggggatagagatgaagagaaggagatggggagagaggaggaagaaaggaggggtgagaatgacatgtgggtcctaccattctttattattttatgtgtgaaactgacatgtgggtcccatgagtttttattatttttctggatcaaattgccatgtaagcggcacgtgaatgccatgtcagatgaagaccgagtcaaattagccacgtaggcgccacgccagccaaaaccgccatctaaaccgctgagggacctcatctgcaccggttttgattgttgagggaacccgtggtatctggatttccgattgaaggatgaaaatcggattcgttgacaagttaagggaccttagatgaacttattccgtagggaaaagaggtggggaagggagaagggagaggacttcggcccaaataaatgttttctgaattttagaagggctttagaaaatttggtttggatagaatttgaatttggaggaaattcacaaaagaaagattttccaaaagacatattatctagtttatttgagtgcaatattttgagagaaagaatacattggactaaatattaaagcactcaaataggaggggaaataaataatatgattactcacaaaatatatttttgggaataaggaaggaaaatacttagaggcaaaaaaaaaaggatttgaatccttaaattggtagtatgaatatttggggaattatttgtggctaatagggaatttagattttggatgagaacgatgaattaaaatctattttcttagcacaagagcaatcattccaaaatttgtaataatactattcttgtgccggggaggttgaagccatagggattaaattggaggctcgatcgaaaaaggaatttgactattggaatatctacagaaggattggtaacatgtcaggatagagaagaattagagataagactagatcaaaggtttggtcaaggattaattccaatgaaattagaatcatggttgttggtatttcttaatgatattactagaaatataattcccagcaatagcgtagaaacactcttcgtatattatggttacagactttatctgcaagcgcacggatataacattgtagcatttcacccgagagtatttgtaacgccccgattttcgttcgggaataaaaatcaattaataatacattttctagaaattaaataaaagttaaatcaacttaatcaagtgaattattgagggaattaaaaatttcctttaaaaattattggccgggaatattttgtaatattctttgtgccctaatgtactctccggaattttccatgaattttcggagctcgagaaatagttttaatagcacaaagatcattgcatcaattaaaataaaaagaaaacaattaaaatcccccttcctctctttgggccattttcggcccaagtcttccttcctctcccgcggcccgcgcgccttctccctctctcgggccggctcccctctcacttggcccgctcgcaaaagtctgttttgcgtccctccttctctcccttcgccgacaggtgggaccgacggtcccacccgtcagctcgt

SEQ ID NO: 36969 - DNA, 12999 bp, Oryza sativa
  unsure (1)..(12999): unsure at all n locations
caagtcgagtctcaagcttcgtgcaaggagcgggaagattagttcagagtcatcgttccgcgaagatcaagaagagttttcccgaagttcacctaaacctaatccttcccggaagagtagttcgttagattctagatcgtgtgttgtttgcttgtgtgtaggggtatggtttgcatcattggtggggatgcgactatactaggttgtttgcttaagcaacttgaacaataaaaatctattaacaacatatcagtaggcaagtggtttagtaccttatctttagcgacccctctcttccacctctcttccgtcctggcagcagatggtcagtgttagagataagatcaattaaagccacagatcaatggtttagttgaaagctgcaaggtgccccaatgccagatgaaacctgctcatgatcaacttttggtgtccaagatcagaagatgggtgtatcgatgtgggagatgcaggttcgacacctagtcaaatgtagcggaaataactccagcagtagtgtgttgcagtcagagtcagtggatcagttcaagacaacaagctaccagctaagtcagagcacctcgctctggttagccaagattggaagatggatgtgccagatattgatgtagcaaccgcagagtccaaagcagcagatgcaacgacaatgtctccaacaacaagtacaagctcagatgcaagccggaatcaggatcagagcgaaagtcagtttgttttccaagagcaagcacctgcaacctcagacagtacgccaccaagtctttagcagaccagcacagctaagtcacccccaatcccagaggcaacaagtgctacctatagtggttatggtttacaaggtcagttcttgcaaggttgttcaacggcaaggcgttagcgtcatcaagacaacagctctattcgcagcaccccagttcctcaagttgtgtcaattccaatgcgagtcggtcagtttagttttgagatatcaactacacaacccatttaggtggatgacaccgaagtcaggtcagaagaaggacagtcatgccagcagttattactgatgggatagtcagttaagagttagtaagatcaggagctaaatgagaatttctttatgtggaatttcctatcagcaactgagggttaagttccaaatcttaatgggatgaaagtgcatcgttgttactctattttgatcgatcggcgaagtttttagttttcaaagtcagggctcttcgcaaaacagagaagtgttggttatattcgaaggacaacagttcaaccgatctcagccacgcgaaagtaagactactccttgtaaggggggtaggtctcggagaagagttttgcctcacttcgtcgctgttttagttgaaggttcaaccagtgccgcaatcagggtagcacttgaagaagcatgttgcaaggtatcagaagaactaagccgatcccagggcatccgatgagcccagttcaacagcttagcttagaggagcaacagtgaggacagttgcagttcagacgaaagacaggtcaagcaggtttcctggaattacgtgtcactcgagtcagaacccgttcaagcggatgtaggatcaatgagttacaaatgccagatgcaagattcaggaacaactccatccttctctagccaacttggtgaactgtcaggttatcaaattgctagcatcaacggttcagtccaagataagtaagttccaggagcatccgcagttctggcctgggtcagttcaagcagaaccaatcagtccagttttggcaaagcaaaggaacagaaaggtcgaatccagccagttcaatcatgcaggtttgatcaaccagtcaatcaatcagttcgaagcagaatgtggcagttcaatgtgcagatcagtcagatcgcccaccagcactggctttctttctagccatcccagaatctcgggacgagattcctgcaagggggggagatttgtaacgccccgattttcgttcggcaataaaaatcaattaataatacattttctagaaattaaataaaagttaaatcaacttaatcaagtgaattattgagggaattaaaaatttcctttaaaaattattggccgggaatattttgtaatattctttgtgccctaatgtactctccggaattttccgtgaattttcggagctcgagaaatagttttaatagcacaaagatcattgcatcaattaaaataaaaagaaaacaattaaaatcccccttcctctctttgggccattttcggcccaagtcttccttcctctcccgcggcccgcgcgccttctccctctctcgggccggctcccctctcacttggcccgctcgcaaaagtctgttttgcgtccctccttctctcccttcgccgacaggtgggaccgacggtcccacccgtcagctcgtcctcctacctctcaccggccgaccccaaccgccattgccgtccacgtcgccgcaaaatccggcgccctcccgcacccgagctcgcatccaacgacgtgggcacgatcccctccacgtcctccaccatttcccccactctccccgcgaaaatcggcgccagttaacccctccaccaccccacgtcggcgccccacttcgccggccgattccgccacgtccggcctcgatcccgccttcccgagcccataaaaagcatccccgtgctcccctcgtccgtttccccatttttcccgagcccggcatactctccctcgctctccccacgccgcacccacgcgctgccacactccggcgaactccggtcgccgtttcccgccgccacagccgtcaccgcgccgagccgccgccaccgccagcttcgccaccgcaaggggaagtccggccgcctcttatttccccctctccacccctcgagcaccactcccaccgcacacccgaggccgccgcccctttcaccgccttcagccgcgcgccaccgccgccctagccgtcgccccaatgcgccaccactgccagtaccttcgccgcctcaaagtcaagctcggccgccgctcggttgtcgcctctcgccgcccgagcaccaacttcaccaccaacccgagatcgccgccgtgtttgtcgtctccatctgtgtcgccccgcctccccggtcgacgccggactgcgccgtttcctccctcggatcggcaactccgagccgcaccccggccaccgcttcctcgcctccgggaaccactgaaatcgccctctccgcgccccggtcgtcccggtcaccgtccgccgcctcgcgcccgtggtacgccaccggaccaccgttgcctccccgaggagcccgccgccggcttcctcgttgtagtctcgccgtcgccgcccttggtgagcatccctcctctcctccccgcgctgtcgccggccgtcgccgcgggtggccgcgccgccgcgcgccgtcgtttggccagccggctttgtgccgtgctgtgccccagccgcgccgcccctggccgcccgatcggtttgggccgatccgggccgtcggttcccgtggaccggcggtggaccgcctcggtggtcccggtccacggtggaccggcgcccttgtgccgctgaccggtggggcccgcttgccggcgccgcccctcccctttgatgacgtcagcaaccgtcttttcctttggaaaaataaataataattgcgtcataattcgttaataattatagaaattcatttaaatggctcaaaacttctaaaattcatatctaattcattcgaactccgaattgggccattcaaattgcaaaattcatctaaaattgagctctacatgtttgtttactttttatgtactgttttcttggtttttattagagtttttcctcgttttgcgtgtcagcgtgtagaatccgtcgtttcggaagtccgcggtcgcgaggaaaagagttcggaagatcaaagtgaagcagcaaggcaagtcacacattccccttgagcatgttgatcccaatttataaatgttttaccgtttacaaataaatatgcatgttttactaattacatgggatccgggtattacctatctgctcgcttgtgccatgtttacttgatatctgttctttgtcaaccttgggtaatgaatccactagctcatgttacttatgtgacctagctagaactatatgcttagccatgcttaattaccactagctcagttgatgggataattgcagtattagaccctttagtatcagagtgagctgcgtgctcgagacacccgtccatgcttcatggtcgtaattatccaactaaaatgcaactgaatagtgggctgtgggtgcatggttttgctagtcgcacccatggcagttaaggaccggttcgcgggatgccctggaagaacttatcgtacttaccacaagccagcgtgggcaacggctgggcttgtagtgtagctttcctctagctgacacatccaggcaagggtgggcgtgatggagcggggtgggccctgcgacggcctctgtcgcttccggattcacctaggcacgagaggggactgcccgttgcccgctggggacgggggtgaaatctgaggtgtggtgtgcttggttagagggggttatgcgaagggtcctgtcacggcctctttccgatatgtcgtggtggcatgtcggcgcacggaaacgtgttgtggggctgtgtcttgtgggtacagttgtacacctctgatcagagtaaaactattcgaatagccgtgcccgcggttatgggcggtcgaccagattcaccgtgattagtcccatcttaataaatcgacccaatacactgtagtccaggtgggttggttgggcctgttcaacgtggtgtagcgttgatcagtggagatttaatgttactttaattactcaacagttttactgttttgctcaataaaatgttttacaaccgcctttatgcaaatagccacaaacccctccttgtatccccttgcacgtctgcatcgttggtgtggcttgctgagtacggtggttgtactcagtcttgctattattccccctttttcagaagtgtagtgcttctgagctgaagatggagttagaggaccaaggctcagaccccagttgagttttgcctgtggagtggagatgaagccccgctaggatcgcccttttccgctgctgctgctttcgtttcggtgcgaggactaagtgcctcttttgtaagtattttacgctttatttacgtttggaactgtatattacttgtcgttttgtgtaccctggctggtcctggacagtgatttaatacacaaaatagtctagaaatttggactaaatttctgggcgtgacagtattccaagggtatcgtatttatttaatcctgcgggaagattataacagagagaactatactaataatttatatattacttgtaataatcaaagtataagcaggggttaagattataaatagggtagaatgacacacagcaagagaattatatactctcataataaattatctaagctaagtgggaagagaatagaaagaatctattcttatacttctaatatagatacatattatacatatacatccaagttatatgattacttagctaataccctctttccaataccgtcctggtgcttcgagaagccacccctgattgccgagtttcttacaacaatccgtcatgaccatctaacctgggctaaatacggaggagtagcctccccaggaaagtaacttaggagtatatacacaagcggaggaatacccgtactgagctgtcaccatcagcggcccaccttgatgtattcgtagcatttaaccccaaataacgatatctagtaatctaaacaccacgcttaaattaccaaatactactctaatatcattgtcatgacacagagcaatcgtatgcacgatcattatacccacaccattgcatttcccagataagctagcatcataatcaatatagtttgaatgtatgatacaattggtactcatatattcggaaagtagtacaataccagagtagtataaagaagaatattttaataaaagtataagtcttacaaaagaaagtaaagctaccggatccatacccgattcctatgaagacttctcggactaagactcctattctattcctactccactagcttgagaagactactaaactagagagacagcttgattcttcttgcttgaggtgtgtgaagaaatggagggagtgaggggtttatataggctggtaatgacggttggaaaggtcggtaatgccctccaaccatcattggggatcaatcccagccgtccagccaaaccctacatccatcggtgctacggctggttcggccgaaccctgggctggctcagttcttggcaggtggcctccccgtttgctcctctccgcagacttgtgaattttgggcttgttggatcttgtgaatttggtgttctcagcccatttatccataagtttgtttcttgacagcgtctgaatgattgatcgtatgttttgctgtcacttctccttcatttatgatcattctctgcaaaaagttagaaacctagtgctagtggaatatattttagtttgacatgaaatatgcattgcaagcataactagttctcctttattttaataatattgacgggcgaaattgatcgctaacgaccgtcaacaaaaccccccaagcttgaacctttgctcgtcccgagtaaaggactcacaaaaaaaaacttggtagctgatcaggagttgctactatgctgtatatctcaaaagtataggtgcaagaagatatgtgtactctctctcaaatcaaataaatttggcacggtggcttacccttacccctgattcccacgagacactgtccttccttgtcttgagcggttgagagacagaacacaaacaacaacttgaatatcttgtggtacctcctcaacctgcctacgcaactctttcaaaataaccatagctctttcatatgcgaccttcgacttgcatgctgccctcatcactccaaatgcttcaatcatcatcatgtttgttatgtaattttcatgcaccccatccggtcctgcagtctcacgatcacacttgtcactgtttgctttcatggtatacctctttaggaatagacaacagggatcttctccagttggatgtgtacgaacgccctaatcaggtgtgtgcaaaacattcctacaacacaataagaaaaaaacaaaaacaatttttgttttgcaatcaacatgtgtgagctactccctctattccaaaatataatgcacaaccacgcttaacccaaagaccaagaaataattattatcatctcgtagtttggatcatcctaataaatataatacatgcatccaataggattagataacatgagagtggagaattttaaaaagcaataatttaatacgtatatcaatgaataaagggaaaagaagttccggtcggtcattttttcatgttaacaagtctagattaaaagagtgagaaataggcctaaaatcattaacacattctagattaaccttgggctataattggccaacaattttttaataaaacaaccattaaagccatctgggcctggagctttgtcaatcggaagtcttttaacaaggtcatccatttcaagagtgaaaaaatgatctaccatgctatcggtcactcttatatgttgtcacgcccagaaattcacgaaccagaatttctaagcttaatgtgtaataaacccctatccaggactagccagggtatacaaatgacaattgttgacatacagatccacgtcttacaaaaatataaaagattacaaatgcagcggaaaagataaaagcgagctaagcctgaagacttgactgctgcagcgggcgactccgttccacaggcatccttgacggcagcgacgaaaccaacttcttcgagacatctccaactgagaagaacttcaactctgggggtagggaaaagagagcaggactgagtactacccactgtactcagcaagtcataccggaagaggaggtatgatgcaggatatatccaagggaggctaaaggttctttcgcataaagctagcatttaaaagcaggagttgaaagcaataaaacagttgtagtaattaatcagtattaaccagtcactgtccaacactacaccatgttgcaacaggcccaaccaaccacctgaactacaccagttcattagctaactaggggtgagactaatcacggtgaatctggtcgaccgcccataaccgcgtgcacggctattcgaatagttttactctgatcagaggtgtacaactgtacccacaagacacagtcccacgacacgtttccgtgcgccgacatgccaccacgacataccggaaagaggccatgacaggatccttcgcataaccccctctaaccgatcgcatcacaccttagggttcgcccccgtccccagcaggcaacgggcagcccccctttcgtgccgcggtgaatccggaagccgatcaaccggacaccccgaccgacccaactccatcacgcccaccctcgcctgggtacgtcggctaaaggaaagcaacactacaagcctagccgttgcccatgctggcttgtggtaagcacgataagttcttccagggcatcccgcgaaccggtccttaatcgctatgggcacgactagcaaaaccatgcatccacagcccaccatgtagtgtattttaattaactaacaccattgcggtggctctattccaaagctataccaataatcagagtctatgcattactgtaattcccccctctatgtactagttgaactaagcatggctaagcgttccctaaaccaacatctaatcattttaatactgttaacaaccaaatttggtaacatctgtgtcaggaaagaagattggatcaaagcgaaatcggatgcggagatcgagttcggaaacagagcaggaatcggctggagtccagatcggctacgattaggattggctaggtctgagtcaggctaagtaagccgataacgccgattccgacaatacgatttgtacgcgacatcgggttcaagttaatgtacttcaagatgattgccacgcacggatagagtcctaggaaggcaattgtatctattaattaggatattttatgtagattccttatagataaatgtgggcaaaagtctgccgcaaagacttatggtatcttagagtttgttagagataatggtcgtgtccggtatgggcaatcttgtaattctcgggtataaatagaccctgagccctatgtaaatgataacacacacgttcaatacaattttggcgcatcgccaccctttttactttagttttgtttcgacgagttcttgctttcaggttgagctgcatagatttcgatcttcaacaagaggtaaaattcgttatgacggcttgtattcataggattagtgcttccatctttatgatactctaatcttgtttatgtaattcgtcgagttatcacatatcttatataatctctagcaataccgccatctaacctactatcggctaacatctgttagcagagggcagccgattaggttagattttgacgtcgatctagattatataagatatataccactctatgagacttctagcggcttgattgtctagatattgttcttcttttcatacttaatgctgcatcagctgagtttgatctattaagtcgtgcttagaatatcaatctctagcctgccttctagttatcgattagaatagcatcggagtttcagccgatcgtatctggtttaactatattttttctatatgcttcattgacatgttaaatctgccctttatatcaagatgttgctgtatctaagtatattaggcctttgtttgatatattatatttgctttaatatcctgatatagagtagtatcggagtattagtcgatacatgctacatctatctgatcggctatgctataaatatatatagtcctgttattgatatatatttcgatctaagtgatttatactgtctcggcatgatgaccgatctatcccaatcacttgatttaagtatacatcgatataaggagtatatatcgttaatatctatagccgatcgagtagatttagtgtttatttacttattcatgactgccgatcgaaacacagatgacatcggctcaaagataaatgatatgtcatcggcatctagccgatcggctatcatttatagatttaaccgcggtttctttgcttctatttcttgttgattacaggatcaaatcaactggcacgctaacacatccgaaggcgagctttggacctgcactggagttaagcagatctcccaggccacgtgttttctatcaacaaatacccaagttatcatcaatggcataaggtaaacaagatatggctgagtggtaggacccatcccacatgatattgtaaaacaatgcaacatttaatagaaatgcgggacacttgtaaattgggtacaatatgatcaatctaatgcatgacttgccttgctctcgcactgatgagaccacagcaacgtcttcgagaaaccgcggatcgacggaacgaccgaaatctacgcaacaaacaaagcacacaagcaaaacatgctataagtctactgaaacaggaaacaaaaccatttttaatggattctatgcatttttatgaatttactaagacttgaatggatttaaacggagctcggatgaattagatatgatttttagaagattatttgtgtttttactattaaagaaaagccttattgatttattgtgcaataaagcatcctagggctgacatcatccaaggggtggggcggcgccgacaggcgggacccaagggtcggaggcacaagggagagggagggggtactagcaggcgggccccaccggccgcggctccaaaaagggggaggggcgacgtctgccgggctcggctcggctccaagccggccggccggctacagcgagcggcggcggtgcacggtcgccggcgatggcaaccggcggcggcgaacggcgcggaaggcgtcggcgtcggccgaaggcaatggcgcgcacgcggtggatggcagtggacacgggagggagagaaagagggaggacagggagttctcaccatggggttggccggcgcgggaagaagggacgacgaacggcgatggcgaacgaccgggagatggcggcaagtgccgaacgaggtccggaaccacctagttgtcaaaataagagagattagagggagaagggaggtccgcggcgagcgaaaactagggccgaaggcggcggcaatggtggaagctcgccggagtgcgaggagatgcgggctccggtgacggaattggacgggggagcggcggacgaggtggacctcagccgtgcgaacccgacggcggtgctagcagtggcgagcggtggccggaggagtggaaaaggcggcggcggctggtgtagcggtgcgggagcgatggagagctcgggagcggctgatggaaaaaggaaaaaggaggaggagaatgcggggatggtttatatgggctcgggagggacggacgaggccgggaggaggccggatttctcgccgacgtgggggagtggggagagagagtttgggggggggggattaaaaccgaatcccgcccttgcggggctcgcgcgtgcggaagaggagggggaaagcggcggcgagccggcgacgtgggtgtggggtggggcgcaaatgcggagtggaggaggtggggcgccggcggttggagctacggctccaacggctagaggaggaagacgaccgacaggtgggccccacctgtcggcgcccgaaggagagagggagggagggaggacttcggggaggggagaagcgggccggcgcgggaaggaatgggccgacggcccaagaaaaggaaaaaggaggaaaaagaaaagagaaaagggaaaaaggattttcccagggatttaatattgcactttgcttattttaattggttaaaattatttccaaggctctgaaaattccactaaaaatcctgttaatgtagtagagcatgtagaatctaagaaaaatttcacatgccgattccgattattaaatgcatttattaatttagggtttctctcttgcctttaaacaaataatttcttgcaacaatttattaattgaatttttgctaaggagaagaacttctgggcgtgacatacgtatacaatgaataaagggaaaattaacatttcttatacgtatatcaataataaataatgtagttgtactagactaagagaattaacatgaatgcggagattatacaccaaagtgaatgagaaatgaagctggcatgcaaagaaacacaccaccagcgaatcacgtgtgagcacacggattgatgggaccacaaattaggccaaatgttgatggtctttaaatcataatatttgaccgtcaatacctgcatataatgaaataaaataatgaaataaaatatggtattcaacttagtggtagggattattactacccaattccactagtgttggtgaaatatgtgtatgcgggtattttaatgagaaaacacaccagtcatgcaaggaaacacacctctggccaattagacgcaagtacacggattgaagggcccataagtcaggtgaaaccgccatggaatgcgtcataactgtcataaccgccatcagggcccaccagtcagtctcctggccaaagggaaggccaggaggtggggcccaaggtttggccgaaccaccaccggcgcctttgatcctggccttccacgtgtgcgttcctgttaacaaccgaatttggtaacatcagcgtcgggagagaagagtagattgaagcaaagtccgaagaagaaatcgggtttgaaagcagagcangaatcggctgaaatccagatcggctacgataagatcggctgggtctgagtcgtgttgggtaagtcga

SEQ ID NO: 36970 - DNA, 862 bp, Oryza sativa
gccgatcggctatcatttatagatttaaccagggtttcgttgcttttatttcttgttgattacagaatcaaatcaactggcacgctaatacatccgaaggcgagttttggacctgcactggagttaagcagatctcccaggccacgtgttttctgtcaacacgcttttggcacgcccagtgggacttgattagaagtcagacgtcagttcttcctcatggccgagaaacaagcaccaccaccatcaagcccaggttccattaaaggcaaggcattgaagccaggattgactgacatcattgatgacaatgtcatgccaatcaatccagagaaattcacgcctgagcagaagcaggagtttgaagcaatgatgcagcaagcacgggatcagtatctgagctcgttcatgcaaacccgcaagggaacgcttgttcagaagtataagataaatgtggttgctgatagtcctggaaccggttcttctaaagatggagaggtgaagcaagctccagaaggctcggctcagccgagcaacaaaggtgctactgatggttctctaggaaatcaaggcgacaaccctcaaggagtgcacggagctcaaggtgatgctgctcaagggtcgcaaggaggaaatcttaatcagaataatgagctagcacaagactttttcaacaactttcaagatcgggttgattacactgtgcatcatgctctgatcaatcagtccggggttttagtcaatacattgtcaaacatgatgaagacaatagccgatggttcgatagctaaacatcaggctacgggcccggtttacttgcaaggaggtgtcttcccgaattatcgatctctggtcatcgatgttc

SEQ ID NO: 36971 - DNA, 1610 bp, Oryza sativa
  unsure (1)..(1610): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgaattgcttccatacaatcaaatccctactgtgacaatatattggattttaactaagaaaatttataagctgaaaatgatacttagtactttgtccacatttctcaagtcgcaattgtcattctccgacttccaaaatacaccaaatgcatgttcaattgtcattctggtgtctgcattctttgcaagcacaagtgttatattaaattgagcaatctcacgcttttagatgcaataagataattctttgatggtcctgtttggtttcgggctaatattggctattacacaaagaaaaccaagtcaaaaaacttgacattaccaaaaaaaaaggtaaccagtttggtaagtatgtcttcataaatgaactggagagctaatgtggcatgttacccaaaactttcgcgaaccaagtgaaagataaatgtggtaactcttgcataattcgtcaaatcatcatattaatttgcatgttgctttgactgtaatatttatagtaaaacatacagaaaaccgatggacataattacataaggacattttcaagcattatcttgcaaatgctctgctgatccgcaacaaatgaaaacttgtcaacattgtaaaataatcagtaattaacatatttatcgcaaagaaaagacacgcacatatcaaacaactgtcacaaaaacatttctcaagttaacaaataaagttatcaagattcaatcatctgtagactgtagctactaaagtttactcacagtatgctgaaaactgtaagatggaatcgtaagggaaatgcagcaaacagatattagttaattacctccaccagcaagagaatcttcttcagccttaaccttatcaatacgctctgtgtgcagcttttctttctctttatcttgatccctgtctctttcagctctgtctttctccttctctaactctttttcttggtcatggcgctccctctcccgttcacccccagggcgtcgttcatgctcctccatacgttccttttcttttcccttgtccttgtcacggtcactttgagtcttctcccttttccttttcttaacaatctgttgcaactcttcaacattttttgtgattatttcaagaggttcaagaagggcaaaatccttcgcaagatcttcatcattctgcaacaagataaagagcatgatgtagcatgcatcagaaaaggtaatgaacactagaagacaaacaaacttacttcatccgtatttgcttctagttctatnnnnnnnnnnnnnnnnnnnnnnnnnnnnnnnnnnnnnnnnnnnnnnnnnnnnnnnnnnn

SEQ ID NO: 36972 - DNA, 2093 bp, Oryza sativa
ccctagcagaccctattttccccagggccgcacatctccaccacaatagcaccgaaccacactagagctactaaacatccagcagcggtaaatctccaacccacacgaaaatcctctcaacgtaaataaacacaaacaaaagaacctaatatccccaacgccccacatctccaccacaatagaaccgaaccacactagagctactaaacatacagcagcagtaaatctccaatccacacgaaaatcctctcaatctaaacacaaacaaaagaacctagtttccccagcgccgcacatcaccacaacagaaccgaaccactagagcagcagaggtaaatctccaatccacacgaaaatcctcgcaacgtaaccacaaacaaaagaactagggagaagaattcgagagtggacgaaccggactcctggagataccggaagatgaggaagttgagctcggccgaggtgattgcccccataggcgccggtcgacgaacgcgtggccgccgccgagacgggaaggctccggaggagaggggagaggggagaggggagaggggagagtggccaaggggacgaaaccggcgaagggatggatggtgtgggtataggaaaaattgatggattgagaattttaggtcatctcctgaagtcagtctggacacggtcaggatcgcgtgcagaaaaatcggacggggcatgagccccgtaggcatggacgggcctagaccgttcgtttgctttaagatccgtgcacaactggaatactaaatgctacaatgtaattctattgtatttaataacttttaagatcttgatttttctgttcgtcacacaaggcacacgtcgaccgttgccctttgagcacatagcatgagagcatgaatataaacccaaataatagttcgatatgaagtagatgtcaaattaatagtttcaccatgtataaccagattaacaattttgttggtcatctcgttatcgtcttcttttaagatctatatggcacgactattaaaatttgtcgatggcaaaagtaaatatttagagaggcatacttgttaacatagtcatggtattattccggtgcaaatgggcgcatgtagcacgagatggtatggagaagataatcacacaatattctacatgaatggtgatggcgtgctgtacagaacaagaggacattggtgagtaacataaagatcagcaatttactatcctctagattatgttttcgaattaattttgatcatgcgaacctatatttgctcactagtcaagaacgtctttatatacgatattcctagtgctcttccctgtggggtctacttctttctttggcttggctaaaatccttgttgtttgtcttgacacaccccttaacaatgcgacatacaactgaccatgtgaaaaaataggctatggatgatagatcccaacatttggggctgtgtcttgtgggtacagttgtacacctctgatcagattaaaattattcgaatagcagcgcccgtggttatgggcaatcaaccggattcaccgtgattagtctcacccctagtttagcttaatggaactggttagttcaggtggtggattggccctgtctcaacgtggtgtagtgttgagcagtgattggttaatattgattaattactattacagttttactgctttcaactactgcttttaaatgcctgctttatgcaaataaacctttagcctcctttggatatatcttgcatcataccttctcttctggtatgacttgctgagtgcagtggatagtactcaatcttgctctctcttccccacaccagagctgaagttcttctcagttgggctgtctcagagaagttggtttcgttgccgccgtcaagaatgcctgtggaatggagtcgcctcgctgcaggagtcaagtcttcaagcttagctcgtttttatctttctgttgcatttgtaaatcttttatatgtttgtaagacgtggatctgtatgtcaaaaattgtcgcttgtgtaccctagctggtcctggataggggttttaatgtacattcagcttagaaattctggttcgtgaatttatgggcgtgaca

SEQ ID NO: 36973 - DNA, 2528 bp, Oryza sativa
  unsure (1)..(2528): unsure at all n locations
ttatgtctctcttctttgggctgtgatatataaatagctaaataagtctatttaaggtccatattctttgggcatcgacatctctaatactaccaattgcagggttcaggatcatgtttttcattgggcaacatgccaacttataaatttcgttagggcccatctgaaaatctgccacgtgtccccttctctgattctaggatttgctccgacgcatcaaagccttcaaaggtagagatggtgcaaaggacctaactgtaaattttgctattcaaagggagttgaatgcaaaaggtacgatccctatcttccacatgattcgttccccctcctgaaacatcaagagcctcatgctaagatcatcagatcgatataaatcaggtcatgtgtgaaaaaaaaatagcatatctaccctaaatccacattgagaaaactaaaaaaaaatctaagaagattaaaaagcacggcagaagtaattggtgaaaaaaattgaacacaatctccttgcatattgcttgacttcttcagttctttgatatcagctttctataacgccgatcagaattgggaaaaaaaacaaggaaagcaaaaaaccaggaaaaacaatttaagcaatacatctccaaggagtacttcccaactatctgctcccttaggcaaggaaaaaaaatctgttgctccgtcctattcgattgaatatacatccaggattgtgaaggagaaaaaaagaaagaaaaaatatcagatgcccaaaaaagaaaaatcagtaccggtggttagctagacggatgaactagagcttgaccggctgccaacaacgagctatagctcagctcactttctctgtttcctctcagatgcggccagccacctaccgtcggccgtcacctccctaatccctatccacgccggattaggcccgctatggctagcggttgcacagcaccgaatctagcggacgaacatgtcgtggcccatgtgagcaacaggaataggggatcatggaggattggtggcgacggaatccgcagtgcgccaacgacggggaatgagcgagaataagactagttttattcttttctcctttttttcgactttcatctcggtgatttctctatgagctttatcagcatgggcaaaacgatatgggccaagagcccaaagagaggtaggttggatatggcagtagtactatgtgtgatttatttctaactcgatttgttcgccaagattttcaacatattgcaaaccccaacgctaggggggcttgggggaaaaaagattgtctaaaatacaatttcatttagaagaatctagaatacaatgggtctccttaacaattagaccaagtgaccagtccgactaggtagattagtcgtgctgtcctaaaacagcgtcaatataacttaatgctatttttctagattacacgacagagccacacatgtacacatcactatatacgcaaatacgcaataccacactgacaaattttgctataacttacaatcgtctaaattacatctaaaacaaaaatttagataaagaatcaattatccaaaatattaagttaattataactatcactgatcgattagtttgatgtatttgtgacatccgcatgcatagtgttactacatacccaccttgatcactacatatatgcatgtactgattaaccggccagcatgccatttggcctaattagaatactcaggagcatttgatatatttcccgtgttctctctttccgtccaacaccaaaactaatactccctccgtttctaaatatttggcaccgttaactttttaagaacatgtttgacctttcgtattattcaaaaacttttgtaaaatatgtaaaactatatgtctacataaaaatatatttaacaatgaatcaaatgaaatgaaaaaaattaataattacttaaattgtttgaataagacaaatggtcaaacatatttaaaaaagtcaacggcgtcaaatatttagaaatggagggagtaaaatagtgggatgatgtccagtagcaaggagccacattataacagtgtgtttctctaaataaatatttacttttacgctacaactaaaccacgaagtcgcaaaatccaataacagattttaccatatttggtgtttcagaaaagattaagtacacaaggataaaagataaatgtggcataaacaatatacataggaaatagaaaattgttagcatttcatgttcacattgtaaactatttaaatttatctcaagttaaacttctatagctttggctgacttcataaaaagaataataaaactacaacaccaaactaattgagttagatttatcatgaaatatgtctccatagtgcatttatttattattatagatattgctatacttttctataacttataagattaacttagaaaaaggattaatgaaaaggagcaatattgaacctatgctattataaannnnnnnnnnnnnnnnnnnnnnnnnnnnnnnnnnnnnnnnnnnnnnnnnnnnnnnnn

SEQ ID NO: 36974 - DNA, 1451 bp, Oryza sativa
ccacattataacagtgtgtttctctaaataaatatttacttttacgctacaactaaaccacgaagtcgcaaaatccaataacagattttaccatatttggtgtttcagaaaagattaagtacacaaggataaaagataaatgtggcataaacaatatacataggaaatagaaaattgttagcatttcatgttcacattgtaaactatttaaatttatctcaagttaaacttctatagctttggctgacttcataaaaagaataataaaactacaacaccaaactaattgagttagatttatcatgaaatatgtctccatagtgcatttatttattattatagatattgctatacttttctataacttataagattaacttagaaaaaggattaatgaaaaggagcaatattgaacctatgctattataaatgttcggataaacactacacctactatttggtaacaccaaaaattagaaattaaaaatattattaattacatatatttttgtttatagacgtatatgggcgaaaaaatcaggggcgccaacaggcgcaccgattttctagtttatatgtctatttttagtctctatactttgtgtgccgggcctggccttccggcccgaccgtgccgggccagcccagcatgccggtggggaggcccaggcacggcccggcggtcaggccgggccggcatggacccgacccaagtcgagccatgccgtgcttgggccgagccaaaatgccgtgccgtgggccggtccttcgggcctcgggtcttatgtccatctatacttgtcagggaatattctattctttttatttttatttttcatccttcctctcgtcttctttcttctctgtttcgttcttcacaggtagagcagagggaggagaggagcggggcgccggtgctccggtggctgggtggttgcgacgccggcggccaaacgtgttcctgagggtggcgcacccaggaagggtggtggccggcagagagagtgtgggatgtggccggaacagtcggtagaggagctcagctctggcgacaaaaagaggtggtggtggtggcttgtttcggaggggggaaaggaggggaaaatggtgaaatgggctctcctcggcgaggcgaggctggtggtgagagggaattggaagagttgctatggaggaggagatcggccggtgactttgtggtagccggccatggtggagagagaagagagagctcgaggagcttagttgtggagagggatggcgagcttgctggccatttataggcggagagaggcggtggagtaagtcggctgcggaggagaacggcgaggagtacacggcgacggctgcgtggaggagaaggggacggcgcggcctcggcttccaattggtcggccatggcggcgcgtgtacgtggagactgccctagggttgggcggcggaggaagagg

SEQ ID NO: 36975 - DNA, 610 bp, Oryza sativa
aaattcattaacaggatttttagtggaattttcagagctctagaaataattttaaccaattaaaattgagcaagcaatattttaattccagggaaaatcctttttcctttttctttttctttttcctctctttttcctcttttttccgaatgggccgccggcccattctctcctttcttccccctcctccttgttgggccagccgcaggccgaggcccatccaggccgtcccgcctccctcctctctcggggtcgccgacaggtggggcccacctgtcgggcccgtctccctcctccagccgacgccgcgcccgcaaccgccgcgcccgcaaccgccgacgcgtcgcctccgcctcctccgggccacgtcgaccacgcccgcgcgtgcgccgcgttccccgcgcccactcccctttttcttccgctcgcgcccgcgcccgagatggccgggattcgattttcgaatcccgcctctctctcctcccccacttctcccacgttggccggcgaaatcccgcctctcccggccacgtccggccctcccctcccctatttaagcttccccgtcactccctctcgctttttccttttctcgccgaactccctcgtg

SEQ ID NO: 36976 - DNA, 700 bp, Oryza sativa
  unsure (1)..(700): unsure at all n locations
nnnnnnnnnnnnnnnnnnnnnnnnnnnnnnnnnnnnnnnnnnnnnnnnnnnnnnnncctacaaagatgtttccaatcattagaagcatgtttaattaaaacactagaggcacacataaccttttgtttctccgacaagacatgcttttgaaattcactatcaaccgctagctcccaattaatgtaagcacgaggatcatagtttccctcgaaataaggcagtgcagatttgatcttacctagaacatcatcacttacctcataatggtcatgttgatccctcctcatgtctcgacgaagatgtcgatgttgagcacagctatccccaattatcttgcgtatccctgccattgttagtagaaaacaagaaacatacacaaaaatatgcgcgttcctattaactactaggtagtggcagctcaaaaatcgcacacactcaagcttttaaccaagctcttacaagatcttaccaatgcaagtggaatggtgacatacaccgactcaaccaagcaccccaatgaaggttggatgtatcgatgccttggcaaacacttgcggtacggctgtaatcaaatatgtggagctctgggtaggcttaaatacgtagcaaaggaatagcaaatgctcaaatcagataatgcaaagttgaataattgttcaaagtcaagtaccgtgcttgtcctaggctagaacgtactaga

SEQ ID NO: 36977 - DNA, 807 bp, Oryza sativa
aaaaataaataataattgcgtcataattcgttaataattatagaaattcatttaaatggctcaaaacttctaaaattcatatctaattcattcgaactccgaattgggccattcaaattgcaaaattcatctaaaattgagctctacatgtttgtttactttttatgtactgttttcttggtttttattagagtttttcctcgttttgcgtgtcagcgtgtagaatccgtcgtttcggaagtccgcggtcgcgaggaaaagagttcggaagatcaaagtgaagcagcaaggcaagtcacacattccccttgagcatgttgatcccaatttataaatgttttaccgtttacaaataaatatgcatgttttactaattacatgggatccgggtattacctatctgctcgcttgtgccatgtttacttgatatctgttctttgtcaaccttgggtaatgaatccactagctcatgttacttatgtgacctagctagaactatatgcttagccatgcttaattaccactagctcagttgatgggataattgcagtattagaccctttagtatcagagtgagctgcgtgctcgagacacccgtccatgcttcatggtcgtaattatccaactaaaatgcaactgaatagtgggctgtgggtgcatggttttgctagtcgcacccatggcagttaaggaccggttcgcgggatgccctggaagaacttatcgtacttaccacaagccagcgtgggcaacggctgggcttgtagtgtagctttcctctagctaacacatccaagcaagggtggg

SEQ ID NO: 36978 - DNA, 1009 bp, Oryza sativa
ctgctgtcgtggcccaactgaggtctttgacagtggtggcgcatggaggttcaacacctatggttctaactgggattgagacaagaaagaagacaggtttgatagaggtccatgcaggaggtgtgacgagttcaggacagccgggagtgatgccagaagcgattgtgtcgcatggtggatcaatggctcaggtacatatgacaagtatggcaggggagaacattaatggtgatgtggacgttaaggctaaaatcccatattggtaccgttgctacacaaagggtcatacccttaaggagtgtgtaactcagcttttctgtaacatatgtgaaagtgctgaccatgtaacatctagtgtcctgtttttaaatcagcaaacaagcacatggcgtctttgtgtggttatgcggtggatggcttgggattctattatatccctcttcctgcaggtcagaaggtgaagcatgagtctaatgtagctttgatacatattacaaaaggggttctaacagtgatgaatgtgacatcggagttagataggttgattccaagtaaatggaaatgggaggtttatgataatggtaccaatacttttagaactatctttccttctaaggtggaattgcacagaatggtagaatgggggcaagtgaatactaagtttgtgaaagctaagatggaaatgaaggagagagatgttgggaatgagataaaatatgctattccaaaggtgtggatacagtggattaactaaaggagctaagggaatactagatcatatgggctgttgggttcattcttggtgtcaccgagatagtggatatgaagttgaccaagagatatgatgcagcccatttgcaagttctggttctagatcattctttaattcctgaatctgttgatgtgataattggagatttcttatacgaacttcaatttaaagttgggcctaagaatgatgatgaaccggtgcctatggagatggataattttgatggtcctaatgatg

SEQ ID NO: 36979 - DNA, 305 bp, Oryza sativa
gacactcccattctccagggagaagttgccttttgggacgtttagcatcgcattgcaagcaaatagtgttttttgcaaagttcatgaagtcacacctgcagccaaattccagaaaatgagaacacaattctgagctcaataagattctacagatcacaggaggaagttgctataagtactttgggcagagccaatctcctttcttcatctctacatcatcacgtcccactcgtttctttggtggtggaggtggttgtttcaccttaggtggtggctttctgattatagggggcggaagattggga

SEQ ID NO: 36980 - DNA, 597 bp, Oryza sativa
  unsure (1)..(597): unsure at all n locations
ccgccgaagtggggccccaacgtggggtggtgaaggggttaaccggcgccgattttcgcgggaagagtggggcaaatggtgaagtacgtgaaggggatcgtgcccacgtcgttgaatgcgagctcgggtcgggaagggcgccggatttttcggcgacgtggacgccaatggcggttggggtcggccggcgaaaggtaggagaagaagctgacgggtgggaccgtcggtcccacctgtcggcgaaggaagagaaggagggacgcaaaacagacttttgcgagcgggccaagtgagaggggagccggcccgagagagggaaaaggcgcgcgggccgcggaagagaaaggaagacttgggccgaaaatggcccaaagagaggaagggggattttaattgttttctttttattttaattgatgcaatgatctttgtgctattaaaactatttctcgagctccgaaaattcacggaaaattccggagagtacattagggcacaaagaatattacaaaatattcccggccaataatttttaaaggaaatttttaattccctcaannnnnnnnnnnnnnnnnnnnnnnnnnnnnnnnnnnnnnn

SEQ ID NO: 36981 - DNA, 706 bp, Oryza sativa
  unsure (1)..(706): unsure at all n locations
agtgatgctgatggtgttgagatttaggcctagtcctggtcaagctacctgtggagaggagtcgcctgcgctgtttcttttattttccgctgcttagaactttattgattgagaggaactatctacctctgtaatgatattttattcgcttattaattagagtaataattgtactttattatcaatttgttattgtgtgcctcggctgattcatggacgagggtttacacacatgtaagcgtttggaattttggatagaaattccgggcgtgacagaaaagaaggacaatatctagacaatcaagccgttggacgtttcatagggtggtggataccctatataatctaggtcaacgttaatatttaacctaatcggctgccttccagtaatatatgttagctaattaaggattaaataacaatattgccagagattatataggatatatgataactcgacgatttacataaataggattagagtgtcataaagatggaagcactaatcccgagaacgcaagccgtcatgacaagtttacctctagttgaagatcgaaacgatgcaactcaacccgaaagcaagaattcgtcgagatgaaacgaaagtaaaaagggtggcgatgcgtcgagattgtattgaatgtgtgttttnnnnnnnnnnnnnnnnnnnnnnnnnnnnnnnnnnnnnnnnnnnnnnnnnnnnnnn

SEQ ID NO: 36982 - DNA, 374 bp, Oryza sativa
  unsure (1)..(374): unsure at all n locations
gttttatgttatgtaatcatttagatgggtaatgtaaatgaaccataactatgtaaacctattcctaatagattgataccaaaataacagatccaaattataagaaatcctatggaagctacaaatgctgacttcgtacccttccaatttggatttgttctactatgtaaataaattgcaaatatggtccaagtaataaatgcccaagtttctttaggatcccaattccagtaggatccccacgcctcattagcccatactgctccacaaagaatacctatggttaaaagggtaaaccctagactaatgacacgataactccaagaatccaaacgnnnnnnnnnnnnnnnnnnnnnnnnnnnnnnnnnnnnnnn

SEQ ID NO: 36983 - DNA, 609 bp, Oryza sativa
  unsure (1)..(609): unsure at all n locations
nnnnnnnnnnnnnnnnnnnnnnnnnnnnnnnnnnnnnnttgttatcaattggatatcttgatttaattcctattggatctggattaggtcgatttccataggggttcttcctctatttcaccttttattatgaattaaatgataggggaaaaaatagaaactcaaggatatcgaagaggaaagaaagaaggatggaatgaaagatcagttggttggaaagaaagagaaatagaataatgagtacacaaacctctaatgattagaaactaaaaaggagatctcgaagcagttcggagaattcagattatccgttcaatttgtactttttaggtacttctggccaatagagcttaaaaatatgaatttcttgggtgattgaatccttaaccatttcttttttttgacacgaggaactcatcatgaatccactaaatgctgctgcttccggtaatgctgctggattggccgaaagtcttgcttctattgggcctggaagtggtcaagggactggtgcaggacaaagctgaaaaagtattgcgagacagccagaagcagaaggtaaaatacgcggtactttattgcttagtctagcttttatggaagctttaa

SEQ ID NO: 36984 - DNA, 701 bp, Oryza sativa
aagcttgcatgcctgcaggtcgaatctagttaattccctttctcctagaagttggttagcgacttcccattttgttctaggattcttcttttttgtgggccatttgtggcatgcaggaagagcccgggctgctgcagcaggatttgaaaagggaatcgatcgtgatttggagcctgttctttacatgacccctcttaactaagattttcttatttatacctgttctactgtttttttctgttctggctcggttattctatctagccgagccattcattcctttctatgaaagaaagataaggggacagaacaaaaaaaacaaataaagaaacaaacgtattcaatacgcaaaagaaaagagagaggaaagcaaaaggagagagagggattcgaaccctcgatagttcctagaactataccgggtttcaagaccggagctatcaaccactcagccatctctccacagcctaatccttattttattcctacaaatagaacatagccatacgaaatgactcactaacctctagaaacatctcaaatacaaatcccttttcgatatatttctgtatactgtatccatgtatacaggatccgctatatccgcttgtgaaataaagcataaaaccccctcaaccccatatccaaataaaaaaagtggtgagtaataagttttaaagagaagaatcaatggattcatg

SEQ ID NO: 36985 - DNA, 280 bp, Oryza sativa
accccttgttggtaccgagggacggaggaggctaggttagccgaaagatggttataggtttaaggacacaaggtgaccctgctttttcagggtaagaaggggtagagaaaatgcctcgagccgaggtccgagtaccaagcgctgcagcgctgaagtatgagccccgtggactagccattgcttctccacgaggctcataccaggcgctacggcgctgaagtatgtaacccatgccatactcccaggaaaagctcgaacgaccttcaacaaaggggtacct

SEQ ID NO: 36986 - DNA, 1242 bp, Oryza sativa
  unsure (1)..(1242): unsure at all n locations
nnnnnnnnnnnnnnnnnnnnnnnnnnnnnnnnnctttatatcttctaaatatatagaatagaggaatcccgatttgtcaagtctcatgatcgtatcaaaatctatttaaactcggctcaatcttttttcagattgagccgagtttaattgcaatcaattagaagaaaaaagaagaattactgcattttcgtaactgatttttgatctttctatttctcttcttttttatttagaccttttttctatctaattttatccacttagtctagctatctagtttatctaccggctcgaactcgaatttgatcgctttccatatttcacaagctgcggctagttcaggactccatttgcaagctgatcggataatttcattaccttcacgagcaagatcgcgcccttcgttacgagcttgtacacaggcttctaaagccacccgattagctgctgcaccaggtgcattaccccaaggatgtcctaaagttcctccaccaaattgcaatacagaatcatctccaaagatttcggtcagagctggcatatgccaaacatgaataccccctgaagccaccggtataacacctggcatggatacccagtcctgagtgaaaaagataccgcgagcacgatctttttcaataaaatcatcgcgcaataaatcaacaaaacctaaagtcatttcgcgttccccttctaacttacctactactgtaccagcgtggatatgatctcccccagacatacgcaatgctttagctaatacacggaaatgcataccatgatttttctgtctatcaataactgcatgcattgctcggtgaatgtgaagaagtaggccgttgtcgcggcaataatgagccaaactagtatttgcggtgaaccccccggttaagtagtcatgcattacaataggaacccctaattccctcgcaaatacagctcttttaatcatttcttcgcatgtacctgcagtcgcattcaagtaatgccccttaatttcaccggtttcggcctgtgatttataaatagcttcggcacaaaagacaaaacggtccctccaacgcataaatggttgtgagtttacgttttcatcatctttggtaaaatcaagtccaccgcgtagacactcataacatgctctaccataattttttgcagataatcccaattttggtttaatagtacatcccaataaaggacgaccgtatttgttaacttatccctttcaacttggataccatg

SEQ ID NO: 36987 - DNA, 1161 bp, Oryza sativa
  unsure (1)..(1161): unsure at all n locations
nnnnnnnnnnnnnnnnnnnnnnnnnnnnnnnnnnnnnnnnnnnnnnnnnnnnnaacctcgattttattaataactacctacgagaccttctttggtacatatcccttatctcaagtttttgatcaaaccaatccattgacacaaacggttcatgggcgaaaagtgagttgtttgggtcctggaggattgacggggagaactgcaagttttcggagccgagatatccatccgagtcactatgggcgtatttgtccaattgacacgtccgaaggaatcaacgttggacttactggatctttagctattcatgcgagaattgatcattggtggggatccgtagagagtcctttttatgaaatatctgagaaagcaaagaaaaaaaaagagagacaggtggtttatttatcaccaaatagagatgagtattatatgatagcagcaggaaattctttgtccttgaatcggggtattcaggaagaacaggttgttccagctagataccgtcaagaattcctgactattgcatgggaacagattcatgttagaagtatttttcctttccaatatttttctattgggggttctctcattccttttattgagcataatgatgcgaatcgagctttaatgagttctaatatgcagcgccaagcagttccgctttctcggtccgagaagtgcattgttggaactggattggaacgccaaacagctctagattcgagggtttctgttatagccgaacgcgagggaaagatcatttctactaatagtcacaagatccttttatcaagtagtgggaagactataagtattcctttagttacccatcggcgctctaacaaaaatacttgtatgcaccaaaaacctcgggttccgcggggtaaatccattaaaaaaggacaaattttagcggagggggctgctacggttggtggggaacttgctttaggaaaaaacgtattagtagcttatatgccatgggaaggttacaattttgaagacgcagtattaattagcgaacgtttggtatatgaggatatttatacttcttttcacatccgaaaatatgaaattcagacggatacaacaagccaaggctccgctgaaaaaatcactaaagaaataccacatctagaagaacatttactccgcaatttg

SEQ ID NO: 36988 - DNA, 716 bp, Oryza sativa
tctctccacagcctaatccttattttattcctacaaatagaacatagccatacgaaatgactcactaacctctagaaacatctcaaatacaaatcccttttcgatatatttctgtatactgtatccatgtatacaggatccgctatatccgcttgtgaaataaagcataaaaccccctcaaccccatatccaaataaaaaaagtggtgagtaataagttttaaagagaagaatcaatggattcatgattaaacccctcctacttcttgtattttattacaattttgattaagtgagggatcaaatataatatgtagtcaactttatttgatggtaacttggaggattagaaatatgactattgctttccaattagctgtttttgcattaattgtgacttcctcagtcttagtcattagtgtaccccttgtatttgcttctcctgatggttggtcaaacaataaaaacgttgtattttccggtacatcattatggattggactggtctttctggtagctattctaaattctctcatttcttaaatgtgtttagtatttagtagcccgatacaaaataaaaaagggccgtttattcggattgtgagacgcattaaaatgcaatttgcgccccgaattgattgacagacaattaaattaataaaaagaaaactcaaaatgaaaatgaaacggtcgaaccagacatagacggtcgaccca

SEQ ID NO: 36989 - DNA, 1679 bp, Oryza sativa
aagcttgcatgcctgcaggtcgaagccctagatttttgggccgagctggatttgaaccagcgtagacatattgtcaacgaatttacagtccgtccccattaaccgctcgggcatcgacccaggaagaatttattctagggtttttgataatctatgattaacctcctttcataatactccctacccccaggggaagtcgaatccccgctgcctccttgaaagagagatgtcctgaaccactagacgataggggcatcactagacgatagggcggtatacaaccgctcctcattatactataatgatagtatgagcagttttttggaattgtcaatatactcgaagagtataactagatccaaagcaaggagtccttcctacttttccattatgcttttgtaggattttttttagttgatggttaggttaattcacggatcatcccctactttttagggaaattcgtttataaaggatatggaataagaatagattaataaaagggattctatattagttcagtacgggtagtgatttgattgatctaataggaaaaagagtccaatttcttttttggaatttacacccccctgcttcgcttagtgtttaaactaaaaatgcatgcatctcgcactaagttatcaaattcaataaaaaaagagaaattttcaaaaagaaagaaagtgaatgaatttagtagaaaagtactgtatcggatttgaaccactgactcacgtcttaccgcggcattactctaccactaagtaaaaaaagccctttatcggatttgaaccgatgacttatgccttaccatggcattactctaccactgagttaaaagggcttcttattcaattccaaaattagccactttcatttcccattataggtctactccataatgtacattatatctgtatatatcgagatatataagtctattcatggtcaggttcaaaaaaatcttaagaaaatcaagaaaaataggaaaatctttcatattctctcttatcacttgcacaaagtatagggttttttatctttaggctattgacttttcacatgctcagaacggtctgaaaaattagggacttttttcttctattggctgatcttatcatgaaaactttctccatttatgttttatttcctctaattgggtggggtataaacgaattcgcgcccttcatatacccatatggctgggtattaattttcagtgatatacttcttgtctgttttggtgagaggttgaaacaatttttaacaggcatcccttggaaaaaccttcgagttcaaaactttgcaatttttcttaagcggatttgttgaagcgattttcagcaggtacctcttctcttagaaatatcttagaaatagggtacttgaatattctcaagggattctgattggtgcattttgaacaaactgtagtggagttttatcaccaattttcttggaaaaggcgggcagtagaatttatactgcttctggttcagggttttccgtttccgaaaactagcaaaaaaggagggttctggaacccttaaggttcgatggtatatggatatggaaaatcccacatgccccatcctaataggaaaaggaagggaacagatccccatatgattattgggaagaacttttggtaatgggtctcggcccatatggtccttttt

SEQ ID NO: 36990 - DNA, 2912 bp, Oryza sativa
  unsure (1)..(2912): unsure at all n locations
aactttctccatttatgttttatttcctctaattgggtggggataaacgaattcgcgcccttcatatacccatatggctgggtattaattttcagtgatatacttcttgtctgttttggtgagaggttgaaacaatttttaacaggcatcccttggaaaaaccttcgagttcaaaactttgcaatttttcttaagcggatttgttgaagcgattttcagcaggtacctcttctcttagaaatatcttagaaatagggtacttgaatattctcaagggattctgattggtgcattttgaacaaactgtagtggagttttatcaccaattttcttgtaaaaggcgggcagtagaatttatactgctcctggttcagggttttccgtttccgaaaactagcaaaaaaggagggttctggaacccttaaggttcgatggtatatggatatggaaaatccaacatgccccatcctaataggaaaaggaagggaacagatacccaatatgattattgggaagaacttttggtaatggtctcgggcctatatgttcttttttgtgtgttcttagttctattcatcttctttgattcttttaaacaagaatctaataaactagaattgagtggaaaagaagagaagaaaaagttaaacggagagaatcgactaagcagagacattcagaatcttctttacatcaagtaaatccttcggctcctatgtgcctttttctttaagttatttattgtttctctcaagccatagggaaagtgtctatgataaataaaaaaaaacatctcactctttctctatggcccagatttcatgataagtgggggaagatgttttcttccccaaattctttgttcaattctgaacaaaaaagaaagtaaaggaaaggcccgcgatcgaagtaccaaccgctaactgtgaggaaccttctctgtttcattaactaagagggaattagcatctttctcgaatggctacccttgacaaagggtagcgttggtatcagaatttacatgtagcgggtatagtttagtggtaaaagtgtgattcgttctattaataactgaatttgaaatgatatacttaaggcgtccttaaggttttttatattccgatgaaaactttagttcttagaaaggatttactcctttttctctcaatagcatattgaggaagaatatgcattttcgcgatttgtacccaaagactaattgaaattgcatccaaaaaacaaataggatttggattatgagtacagagtcgcgaagcataattttgcattggattaaggattccaattttttaaatatgagtaaaggatctatggatgaagatacaaaaaaatttatttccaatcgtaactaaatcttcttttgttaaaaaaggaaatggaagccaaatagctaaaaaacggtagttttggtttactagaaccatcagcatattgtttcagctcggtggaaacccaattcttttcctcaggatctcttaaatgaaattagggaacgaagtaattagattagatagatttaggcaaatttctatctcctactctttagggatcatctagaaagcagagagccttggttccattcagacaaaaaagctgacttagatgttaagtggtgagaatacccataaaggatgccgaatgaaatcaaaatttcatgttcggttttgaattagagacgttaataataatcaaccaacgtcgactataacccctnnnnnnnnnnnnnnnnnnnnnnnnnnnnnnnnnnnnnnnnnnnnnnnttctgtataaaataactattctatttgtctagacatggtagaggcctgtattcaacctttttcgtccaccggtttccagcgctccagagcggagtagagcagtttggtagctcacgaggctcataaccttgaggtcacgggttcgattcccgtctccgcacttagcagtctgtataaaataactattctatttgtctagacatggtagagggctgggtggttgggcggtatccaaccctttttattcattagttcccgaccctataaggccaaattgagcaggttgcgaagtaacttgctaccacaagaggaactctcaaggccccctccctaccttgcagaaaagaaaaaataaatgaaagaaaggcacagtctatctcccttccctttaaaagctgtttgctggttgtttgtttcggtgaatccccggtttagggaaccctgttgccgagttcgattcccgccgctgtagtgctctttttttgagtggggtgcaaagggggttaagatagtaaaggggtacggtactagactaacacctattactttaataaaagtagactaaattttttatcatagtaccttactaaattaagctggcgagcggcgggaatcgaacccgtatcttctccttggcaaggagatgttttaccattgaactacgctcgctacgtcctatattttatagggtatatccgcctgggtcgaccgtctatgtctgggtcgaccgtttcattttctatttgagttttctttttattaatttaattgtctgtcaatcaattcggggcgcaaattgcattttaatgcgtctcacaatccgaataaacggcccttttttattttgtatcgggctactaaatactaaacacatttaagaaatgagagaatttagaatagctaccagaaagaccagtccaatccataatgatgtaccggaaaatacaacgtttttattgtttgaccaaccatcaggagaagcaaatacaaggggtacactaatgactaagactgaggaagtcacaattaatgcaaaaacagctaattggaaagcaatagtcatatttctaatcctccaagttaccatcaaataaagttgactacatattatatttgatccctcacttaatc

SEQ ID NO: 36991 - DNA, 15162 bp, Oryza sativa
ccctctctctccttttgctttgctctctcttttcttttgcgtatagaatacgtatgtttcttcatttgttttttttgttctgtccccttatctttctttcatagaaaggaatgaatggctcggctagatagaataaccgagccagaacagaaaaaaacagtagaacaggtataaataagaaaatcttagttaagaggggtcatgtaaagaacaggctccaaatcacgatcgattcccttttcaaatcctgctgcagcagcccgggctcttcctgcatgccacaaatggcccacaaaaaagaagaatcctagaacaaaatgggaagtcgctaaccaacttctaggagaaacataattaactgcattgatctcggtagctacgccacccacagaatttaaagagcctaaaggagcatgggtcatatattctgccgaacgtcgttcttgccaaggttgtatgtcttttttcaacctactcaagtccaaaccgttggggccccttagaggttctaaccatggagcacgaaggtcccaaaaacgcatagtttcccctccaaaaataacctctcccgttggggaacgcattagatatttacctaaacctgtgggtccttgggcagatcccacattagctccaagacgctgatctctaactagaaaagtaaatgcttgagcttgagaagcttctggcccagtaggtccataaaactcactcggataagctgtattattgaaccagacaaaacaacaagcgataaaaccaaagacagataaagcgcctaaactataagacaagtaagcttctccagaccatacaaatgcacggcgagcccatgcgaagggtttggttaagatatgccaaattccgccaaatacacaaatgaaacccaaccatacatgtcccccaattatatcttctaaatcatccacactaacaatccaaccctctcccccaaaaggggattttagtaaataaccaaatataacaccggggctaagggtcaaattggtaatttttcttacatctcctcccccaggagcccaggtatcatatataccgccaaaataaagagctttgagtactagaagaaaagcacctatacctaacaaaattaggtgaatacccaaaattgtagtcattttatttctatctttccacacataaccaaagaatggaaaagattcttcaagagtctccggtcccagaagcgcgtgataaatgccaccgaagcctaagactgcggaggaaattagatgaagtactccagatacaaagtacggaaaagtatctagaacttctcccccgggccctactccccaacctagagtagctaagtgcggaagtaaaatcaacccttgttcatacatgggtttttctggtacgaaatgggccacttcaaataggttcattgctccggcccagaatacgattaatcctgcatgggctacgtgagctccaagtagtttacccgacaaattgataagtctggcattcccggcccaccaagcaaaaccggtggtttcttggtcacgaccagctaaaacaaaagttccattaaagagcgtttccacgtggtagaacctcctcagggaatataagattttcatgaggctgatcctgagctgccatccacgcacgaataccctcgtttaaaagaatatttttggtgtagaaagtctcaaattcaggatcttccgctgcacggatttcctgggaaacgaagtcataggcacgtaggttcagagccagcccgactacgccaatagcactcatccataaaccggtgaccggtacaaatagcataaagaaatgtaaccaacgtttattggaaaaagcaacaccaaagatttgggaccaaaagcgattagcggtgaccattgaataagtttcttcagcttgagttgggttaaaagcgcggaaggtatttgcaccatcaccgtcctcaaatagagtgttttccacggttgccccatgaatagcgcatagcagagccgcgcctaatactccggcaactcccatcatatgaaatgggttcaacgtccaattatgaaatccttggaagaagaggatgaatcgaaatatcgctgctacgccaaaactcggcgcaaagaaccaaccggattgccccagtggataaatcaggaatacggaaacaaaaacagcgattgggccagagaatgaaattgcattataaggccgcaattgaacagaccgagcaagttcaaattgacgtaacatgaaacctattagtgcaaaagccccatggagagcaacaaaagtccacagaccacctaattgacaccaacgagtaaaatccccttgtgcttccgggccccatagtagcaacaaagagtgtgctaaactattggcaggggtggaaactgctgcggttaagaaattgcaaccttccaaataggaactcgccaatccatgggtataccaagaagttacaaaagttgtccctgtaaaccaacctcctaaagcgaaataagcacaaggaaaaagcaataggccagaccatcctacaaaaacaaaacggtcccttcgtaaccagtcgtccataatatcaaataaatcattttcttctttagtaactctaccaagggctatagtcatagtgatcctcctattcaattacttcaaccatttccgagcaccttatatcacttccaaggcatacgatagattatctgtggacgattttttctcgttcaatgccttttttcaatggtctcgaagatagaaattttgcatttttatctatggggtcacagccgaggtcgtggtaaatccatgaatttgattcaattagtttttcttatactatagaaataaacattggaattcaggattattccatgattcctatttccaagaaagcctattttttaagggaaaaatgaaaaaaagtaacctcccttttcccactcgctctctattgcatgggtataagaacaaaaataggattctgaaaaaaagtaaagatattgaaaagaaaaattgactttcgaaatccatttttatgtgtagcggaaaggggttgcgatttcttcttattcctatagaacatctagtaacaagaatatgaaatagtaaatagcgagaaattcttgccttgcgtggtctaagtctaaggaaatacaaaaaaatccacttatacaatttcatctacatcgaatttatatatcagaatagcggatagaggcctcattcaaggagtcaggtccacttactttatctttctttccaattttatggggtgggttggtttgataagacccctttttgctttgttgataaataataaaaaaaagagtttttttctataacctgcttgttttattataacaagtcctatatggaaatgcctgctgaagagaaaatctatctgattgtcttttagccaatatccaattttagaattagaaagaaaaaagaagaattttcttcttttttttattaacattaagaaaaaagaatataactaaaatggaattggcaatataatttttttgaacttttgaaagaaaaagaaaagattttttgcaatcgttatttcttgcctctgtcatatcacggaaacctttcgatttggaacggggagagatggctgagtggactaaagcggcggattgctaatccgttgtacaatttttttgtaccgagggttcgaatccctctctttccgccccctcggatcgtttgggactttcgaattggaaggaattctgacccccggattttctcgtagataaatgtatgaaacaaatccaatttgtaagaaaaaattttggatttttactcgtcacgcccaggattacgtcctggatcattagataagaatccaaagataaagagggaaacaaagaatatcactactgtataaacaaaaagtttgagagtaagcattacataatctccaagatttttttttaaggaatagattacccgtttttccttaccacacaaatccactaggatgggttttgtttattttgacacctaaaaatgcaaaaatcaatttttgaaaaaaattgcaagaattgatttataataagcactcttatcaataaattaggttaggtattgtgcggttacctaaagatacctgctcaacgtagatgcagggagtagaaaggctgatccaaatttattgctgcagctatacattcaatgtagaagaatttgaattttagaatcgaaggttcataatataagacttctcggctcttatccatttttcgaatttttttagaatgaatacatgattcaatttggcagacagagtagtaaagatttcatcgaaaacttacagcagcttgccaaacaaaggctaatagaaaaaagagtacaggtatgacaggcataaaatccacgattggattgaaaatggcataagcttcgggcaatttggcgaagaaaaaactagtcggataaataacagaattaaaacaaatacaggttaaactaagtatattaggcataacaagcgtttcgttcttgtagagtagataattggattttgattgagttatttttctaagggaaaaaggaaaaggaggattcaaaatccttttttcttcggactttcccaaacacaaaatacctccttgtattcgcactctcaaatgagagtggaagaaattcgactttcatataatatcttaatagaattccatgtaatgatcaatgcattttttggattctatattattcgcatgtctagaatcctaccaagagaataccccccatttttatgtaattgaagtaggattgacgaataagaaataaacataatactgtttattagtgtcgcataaaacccgaaatggggcgtggccaagtggtaaggcagcgggttttggtcccgtttctcggaggttcggatccttccgtcccagattttttctgatgaaacgaaagatgaaatcgtattgtattctgcacgagacataaagtttattaaagagaatttttttctcttataaactcttagattcgatgcagtcctaatgcgttcattttctgtctcagaaaacataatccagtgtcaagtccagtcaaattgaaaatctttttttcatgaaaaaattttaaacttgacgtagaacattgtataaaaaacgagacctattcctttatggtagagatagatttatgatagagataaattttttttatagtattttattagtaaaaaaggttccttcttctttttctttctttggttaagcaaaaacgatctcgatccgcgattttttaaatatccagaatgatccatcccggtaaagataagataagaactgctcgttagatagaatggattcaattttgatttggagttgcttcttttaggtaaaagaaaaaataagtaaaagcaaagaccttaattttactttacaggaaatgcgttttttttacttcatttttttctttcttttggtattcgagtcgaagaaatacgagaattctataactaccaaaaaactttcttttcattgcaatagtttaactagttaatagttaattagttttgttacggaaaaatggtatggaaaaatagattgctaatctaatatattaattaaattaattaaacgggaggttgatagtttatttgttggagaagagtcaattcttctcttatcatttcaggattggattgatcatctcgagtcctctgttgaggatggaaattccataataaataagtcttaagcaaacttgtttattcccttttttcgaactatatttcattcatatgatagaatatgggtttaaataaattggctctttgcggagtctttcccgataaatacttaatttcttttattcatatttctccatagatagcaaagcaagtttgaattagtatacaaaaaacgaaactaatgactattcatgattccatccatattggatcaattccctataacactttgcaatgaaattagaggaatgttatgttaaaacttcgtttaaaacgatgtggtagaaagcaacgtgcgacttgaaggacacgatcgattgtggattttgctatccaccattttccatagtaatgaaaatgctcttggctcgacatagtctgttctattcgtcccgaaccgaattttcgctgggttgtttgtaagtaagctaagtaaatagtacacgatggagctcgagaggacagaatttattttttatcaagggaaagaatctagggttagtgaaaactaataaattaggccaactttgtcattctacccttaatatagaaatcgaaataatatagaaatcaaaaggttaaaataagaagaaagtccaattttggaagatatgggaaaactcttttgattaaaagtctatcagaatcaatcgctcatattcgatttctatagaagagggaaatgctttatcgaaggaaataagaaaaaagggtatgttgctactcttttgaaagaaaaaagaataagaattcccgaagtaatgtttaaacccaaggatttcacaaatcaaagataaaggattcccgaacaagtaaacacgattttcaactgtctcaacaatagaattggaccggaataaggaataaaagtgaatttgttcgagatgaggcaaagaaaagagtttagagacgactcaaaaaatttcaaaggatttttttctttcaagtctgtcaatcaaaattagtcaacttgagtcatgagtataaatgaaatttgttttttctgtacggaaattaatgcaagtcatattctcgagccgtatgaggagaaaacctcctatacgtttctagggggggctttgtttatctacatctatcccaataagctgtctatcgaatcgttgcaattgatgttcgatctcgaagagaaggaagagatcttcgaaaagtaggtttttatgatccgataaagaatcaaacttgtttaaatgttccagctattctctatttccttgaaaaaggtgctcaacctacaagaaccgtttctgatattttaaggaaggcggaattctttaaagaaaaagaaagaactttgagttaattgaagaactaaatgaataaaaaactaggagaggctcactagtatcccttgttgtctaactatttagaaataatttgcctctttcttaatcctatttttgactggatttatgtcgtgccaatccaacataagcctttatttttttgagtttttctatctaatttttttcttaccattgtatttccattgacaaaggtccattgaacatctagaatttgtagatggataagtctctttatcctcactccctattaggttttttgcctacactttgctcaaatggtagggttgtccctcttgtttgtactctcatacaagatttatttatttatttaaataaaaatgctaaaaaaatgacaattttacgatcgtgattggtgccacttttaaccttagtgaaatttaaccagacccgttccttttggtatctgagtgttttcaatggtgataaaatctttcttttaatgtcttgctattttaagattttgacaggggtgtgcggtgtaattccattgatttttggatttcgatcgtatctaagatcctagtttatctgggttgctaactcaatggtagagtactcggcttttaagtgcgactatgatcttttacacatttggatgaagcaaaaaattcgtccagactcttggtagagtctataagaccgcgactgatcctcaagggtaatgaatggaaaaaatagcatgtcgtaataaaatcaatttcttattttggatttttggaatggaataaaaaaattctgattttctgggtctaatgaataaatggatagagcctggctccaattctggtaaaacaaaaagcaacgagcttaacttcttaattggaagaactccctgatctaattagacgttaaaaatagattagtgcctgatgtagggaaaagctggttttcctatgagtagacctttgattttttcttttttttttagaaatcctaattattcttgattttggattgaaaaggatgttatggattgaatgtgtaaaagaagcagtatattgataaagagactgtatcccaaagtcaaaagagcaattggcctgcaaaaataaaggatttgttctcttttgtaattagaacaaacataaacaaattggatagaaaaggagcggaaaaagatccgtggattagactccttttcttccccaggggtttgtattaaaaaatgcaacaccctgttctgaccatattgtactatgtatcaccatttgataaaccgagaaatatttctctctctctgattcaagtagaaatacaaatggaaaaattcgagggttattcagaaaaacttaaatttcctagacaatatttcgtctacccactactctttcaggagtacatttatgtgtttgcccatgattatggattaaatggttccgaacttgtcgaaattattggttctaataacaagaaatttagttcactacttgtgaaacggttaatgattcgaatgtatcagcagaatttttggattaatttggttaatcatcctaaccaagatcgattattggattacaacaattttttttattctgagttttattctcagattctatctgaggggtttgcgatcgttgtagaaatcccattctcgctacgagaacagtcttgtccggaagaaaaagaaataccaaagtttcagaatttacgatctattcattcaatatttccttttttagaagacaaatttttgcacttacattatctagcacatatagaaataccctatcctatccatttggatatcttgcttcaactccttcaataccggatccaagatgttccatccttgcatttattgcgattctttctcaactactactcgaattggaatagttttattacttcaatgaaatccatttttattttgaaaaaagaaaataaaagactatttcggttcctatataactcttatgtatcagaatatgaatttttcttgttgtttcttcgtaaacaatcttcttgcttgcgattaacttcttccggaacctttctggaacgaatcatcttttctaggaagatggaacattttgggttaatgtaccctgctttttttcggaaaaccatatggttcgttatggatccccttatgcattatgttcgatatcaaggaaaggcaattcttgcatcaaaaggaactcttcttttgaagaagaaatggaaatgttaccttgtccgtttgtggcaatattctttctctttttggactcaaccgcaaaggatccatctaaaccaattagaaaactcttgcttcgattttctggggtacttttcaagtgtaccaataaattctttgttagtaaggaatcaaatgctggagaattcatttctaatagatactcaaatgaaaaaattcgataccaaagtccctgttactcctctcattggatctttagcaaaagcccaattttgtactggatcggggcatcctattagtaaaccaatttggaccgatttatcggattgggatattcttgatcggtttggtcggatatgtagaaatctttttcattatcacagtggatcttcaaaaaagaagactttgtatcgactaaagtatatacttcgactttcatgcgctagaactttagctcgtaaacataaaagcacggtacgagcttttatgcaatggttgggttcggtatttttagaagaattttttacggaagaagagcaagttttttctttgatgttcgccaaaacaacttacttttctttccgtggatcgcacagtgagcgtatttggtatttggatattctccgtatcaatgatctggtgaatcctcttaattaatcattaaacaaaactaataaactagaaatgattgataaatgatcaaggtaaaactttcacagtttccattctgaaatgttctctgtactataataaatagtaagtgaatcaacttactactaaaaaaattagtagacttcctcttcggaatagaaatagcctatttctacatagggaaagtcgtgtgcaatgaaaaatgcaagcacgatttggggagaggttttttctctattgtaacaaggaataattatctactccatccgactagttccgggttcgagtcccggggcaacccatatggaaactagaaaggagcaatctgagttttgatttttcactcacttcatttacaaaattttttggtttggtaaattttgttgtatggatatacaactgtcggggctggcttggttgacattggtatatagtctatattatactgttaaataacaagccttctattatctttctagttaatacgtgtgcttgggagtccttgcaatttgaataaaccaagatcttaccatgactgcaattttagagagacgcgaaagtacaagcctgtggggtcgcttctgcaactggataactagcaccgaaaaccgtctttacatcggatggttcggtgttttgatgatccctaccttattgaccgcaacttctgtatttattatcgccttcatcgctgcccctccagtagatattgatggtattcgtgagcctgtttctggttctttactttacggaaacaatattatctctggtgccattattcctacttctgcggcgatcggattgcacttttacccaatttgggaagctgcatctgttgatgagtggttatacaatggtggtccttatgagctaattgttctacacttcttacttggtgtagcttgttatatgggtcgtgagtgggaactgagtttccgtctgggtatgcgtccttggattgctgttgcatattcagctcctgttgcagctgctactgctgttttcttgatttaccctattggtcaaggaagtttctctgatggtatgcctttaggaatatctggtactttcaactttatgattgtattccaggcagagcataacatccttatgcatccatttcacatgttaggtgtagctggtgtattcggcggttccctattcagtgctatgcatggttccttggtaacctctagtttgatcagggaaaccactgaaaacgaatctgctaatgagggttacagatttggtcaagaggaagaaacttataatattgtggccgctcatggttattttggccgattaatcttccaatatgctagttttaacaactctcgttctttacacttcttcttggctgcttggcctgtagtagggatttggttcactgctttaggtattagtactatggctttcaatctaaacggattcaatttcaaccaatctgtagttgatagccaaggtcgcgttattaatacttgggctgatatcatcaaccgtgctaatcttggtatggaagtaatgcacgaacgtaatgctcacaacttccctctagacctagctgctcttgaagttccatctcttaatggataaggcttttctgctaacatatagcaatttttgaagaaaggaaagctagaaatacccaatatcttgctgaagcaagatattgggtatttcttttttttttattttgaatctttctattctgaattcagttaacgacgagatttagtatcctttcttgcactttcataactcgtgaaatgccgagttggtacgaattcccccaatttgcgacctaccataggatttgttatgtaaataggtatatgttcctttccattatgaatcgcgattgtatggccaaccattgcgggtagaatgctagatgcccgggaccacgttactattgtttctttctcctccttcatattgaccttttctatttttgccaataaatgatgagctacaaaaggattcgttttttttcgtgtcacagctgattactcctttttttccattttaaagagtggcattcgatgtccaatatctcgatcgaagtatggaggtcagaataaatagaataatgatgaatggaaaaaagagaaaatcctttagctggataaggggcggatgtagccaagtggatcaaggcagtggattgtgaatccaccatgcgcgggttcaattcccgtcgttcgcccatcccattattgcaaattccaaaaatgcaattttccatattcctagttacgtatttacttacggcgacgaagaataaaactatcactatattttttccttttcctagttcttcttccaagcgcaggataaccccaaggggttgtgggtttttttctaccaatgggggctttcccttcaccgcccccatgggggtggtccacagggttcataactacccctcttactacggggcgtttacctagccaacacttagacccggctctacccaaacttttttggttcaccccaacattacccacttgtccgactgttgctaagcagttttgggataccaaacggacctccccagatggtaatcttaaagtggccgatttaccttcttttgcaatcagtttcgctacagcacctgctgctctagctaattgcccaccccttccacgtgtgatttctatgttatgtatggccgtgcctaagggcatatcggttgaagtagattcttcttttctctcaaaaaaccccttcccaaactgtacaagcttctccaaagcatacggctttctagatgtatatgacgatctctagacagatggatcttatatgaatcgtatgatgaagtaccacatgagtggatatataggaaaggaatccaaatctgccgaatcgctcatgttatgatcttctacatcctaggtctccgcgttccgtcatctggcttatgttcttcatgtagcattcagatcgaatgactctatgaaattacgtcgatacttctacatattatgggtaacgtaggagacatccctattttcccccgggggtcttaattaccactgcttagctttcaattcgcctctgaccatcaaattaaatgtgaataacccgtcctcctctctttgaaacaaggggcgcttccggttctgtgcgtgcttcaaacaattttgtcttctccatattaccatatctctagagtcaataattttctatgaggaactactgaactcaatcacttgctgccgttactcaacagttttctgttgaggtctatcccgtagaggtagtcaaattggatcagtgatcgatttctaggtttcgtcgtaaacctaattggttacttccaattacgtaaatcaatagttcaaaccgcactcaaaggtagggcatttcccattgatataggaacttttgtaccagaaacaatagtatctccaattatagcccctctgggatgtaaaatatatcccttctcaccatccccatagtgtatgagacaaatgtacgcatttcgattagggtcgtattctatggttacgattctaccagatatgtctttttgattccgtcgaaaatcgattttacggtataggcgcttatgacctccccctctatgccttgcggtaatgattcctctggaattacgacctttaccacaacggtgccgtccatggatcaaattatttcgtggattggatttcacttgcctatctatggttcccttgcgtgtgctcgggataggtgttttgtataaatgtttcgccgtattattaagtattctcctttagtttttttctctatctagaagtggaatagaataacccggttgaagggtaatgatcatacgtctgtaatgcattgtatgtcctagaatagggcccattcttctaccctttccgggtagtcgatggctattcacagctactaccttaacaccaaagaagagttcgacccaatgctttatttctgtcttagtgaatcccgattcgacattaaaagtatattgattctttcccaataaacgaagacttttttctgtaaatactgcgtatttgattccatccataaatcgactttccctcctatgctctgagttccagtatcgataagaattcgagttcttattgttcttatgttatggtatgaatataccataccaattcgttatgtatggatgatggatgagattccatggatagagagccagttccaatagacttatggaacgttccggttcgcgtgcatccagcaggaattgaacccgcaaatttaccaattatgagttgggcgctttaaccattcagccatggatgcttaacagggatcatcgtacatcgtaaataaccaattttcatatagaaagacatatcatagaaaaatgaaatcgaaaatattcggagatggcaaatattcggagatgactatgaaaacacctctctggatcctcgaattgaaagagagattgagagggatccagaatcctaattctcgctatttggaatggatccaattctattgagtctgactcatagtgatcatttctctttagcaaagaatgaccttggttatcaaaggattgaacaaccgggatccgtttacttatgatacctagttgacattgataacaaggatctaatgaattatgagtttaatagatcctctttagcagaaagacgtatattccttgctcatcacttattcccaaacctcgtatggggctaatcgttttcatttaccatctcagggaaaatccttttcgttccgcttagccctatcgggtattttagtgataggttctataggaactggacgatcctatttggtcaaatacctaatgaaaaattcctattttcctttcattaaggtacgagggcttcttattccacaagaaaagaacgaaagcaccttttcattctttcatatactgggggtttttacttggaaaagacaatgttccatactaaaggattcgggtccataaccacgagttccagtgcactagatcttgtagcacttagcaacgaggccctatgaatagacatatagaatttttggtcgggaaattcgaatgaatcattgagtgaaaaaggagcaaagaatgacaaaagacgagactctactagtcttcactcttgtggtttcctcggtttctgttttcttattcgggatcttgcttttcatggttctcatctctgcaactcgcgattttcgcgagagaaccaaatccaagttggtgaagatcatgatttgggctggcatagtagtgattacctttgcaattgcggttcgaatctatccgatctttatctttttgctcaaagaacgaataaaaccccttg

SEQ ID NO: 36992 - DNA, 2740 bp, Oryza sativa
aagccctttatgataagcttccctggatctgggaagtttctctttcacggtattgggatcgtttgatcgatttccttgatcgctacttatgggcgtgcgctcaaaggatacaaacagggattcgcaaacaaaaaggggaattcgtagtcactttttcctgtcgcgtaaaaaaaaggctttacgcgagagcaatagaggttgggatacatctatctcttctgagcaacctcttttggattcttaagaccacccttgcagtaggataccgtctgctttgggttctttattatattatctccttcgagggatttttaggatcgttcaggctatatttagtctattttggcttttactgtctccttttctcagggaagtggttaaggacctcagaagatagaggagagcgccaggcgcagatttccggaatacttctacggggaatgctcattgaatgcgcattctccgtattatgccttgaagaggactcgaacctccacgctctttagcacgagattttgagtctcgcgtgtctaccatttcaccatcaaggcatcttgaaagtgaatcatattccatgaatatgatatctatctaatgtgatatcttgaaagtgaatcgtattccatgaatatgatatctatctaatgtgatatatggaatatatgacaaaggtggagtcttggagtatttcgatcgatcggtcatataggcctgagtcagacatcaaatagcttcgatttgcattatccgtaggacaccttatatgtatcaaaatcaaaaagatgtacaatccaatttctcgattcaatagaagcccaaagaggtgcatatggtacccaaataaggataggatagatatgtcaaaagcaggtctgattacacctattcctaatcctaaatagaatgtaaggacgtggggatttctatgtaaacagagtatcctatttccataggctcgaatgaccccttctcataataagaatgtgcacggtctggtccggtatggaatgaacttataatctgatgatcgagtcgattccatgattataagttcattaccctagcgcccattcccattttgggcggaacagatctactaattcttttattccagttagtaagagggatcttgaactaagaaatagacctagcagctaaaagagggtatcctgagcaattgcaagaatggggttcattgatattcctggtatagtagatgctatcacacatacagtcatactcaattcgatggaattgtttgatcttaaaggggatcttctataatttcgcacataaggggttatttcttggtttcgtccagtcattaataacttgactatttttagataatagtagatagaaagaacgctcgtaaggagtcctattgaaaccaagaaatataggcctgcttgccatccacaccagaatagatagagttttccgaagaaacctgctagtggaggaaggcctcctagggataagagacatagggctaaagagagagccaaaaaaggatctttcgtgtataatcctgcataatctcgaatgttatcagttccggtacgtagaccaaataatacaatgcaagcaaaagttcctagattcatggagatatagaaaagcatataagttatcatgcttgcatatccatcatttgagtctccaacaattattccaataattacatatccgatttgccctatggacgaatatgcaagcatacgtttcatgcttgtttgagtaatagcaaggagattccccaatatcatgctaagaatagctaggatttccagaagaagatgccattcgtttgatgagaaataaaaaggaatatcgagaattcgcgtggctgaagctgaagcagcaactttcgaagtaacagaaagaaaagcaacgactggagtgggggagtcagagtcgaaaagaggattcctcgcttctttctctcatgcaaaaccgtgcatgagactttcatctcgcacggctcctaagtgataaaagaaagaagaacttgtcttctttcttttttgattaccttcctcgcgtatgtataagaccgaatccattctttttcgaaatcgatttcgaaaaagaactactaatccttaacttttcgaggaatccttcatcagtggttgtgaatgactgactttttcaatcctttcgaccttggttccgtaggagcaagtcagaaaggttgagaaatagaaccatctgatttgattcgttcccaatagccatgagatgatcatcttagggtgatccttttgtcaacggatgctcctattacactcgtagtctctgaaggatgagaacccactatgtagcatctacgtcgataattcaagcattgtatacgtcattagtccgattctttgtaggaactacccgtaataacgagcttgcaaaatggatctgtttatcataaagagattcgttgttcctgaccctgcttcaccttaattgttatttgaacaaaaagatcacaataaacttttggtaaaagttctgtcttggtcggagtggggatagcatttctcttctgcatatctatggagttttgcaaaacccaaacacctcagagatagatatagaggtaggaatttgtcgaacgaaccacactccttcgtagacgtcaggagtccattgatgaaaaggggctggggaaagcttgaacccaagtcctacagtgatggatataagcgcaattgaaattcctggggagttatacatttgggta

SEQ ID NO: 36993 - DNA, 3934 bp, Oryza sativa
  unsure (1)..(3934): unsure at all n locations
nnnnnnnnnnnnnnnnnnnnnnnnnnnnnnnnnnnnnnnnnnnnnnnnnnnnnnnnnnnnnnnnnnaactctgttgaagagatgaaatagaaccaaggtctatctttttgatcagaggttaaatcgatcatcagaagaagaattaggccaaaaattaggatacattctgggaaaatgaaacttccctggaagagaagcaaatgaaacgctttcataaaaattctcgtagaatcgagaatgaagttttcattctgtacatgccagatcatgaattagtaactgcatccaatctccgaaaagtcccgattgtttcgatttttggaatgggatatttacggaatccccatgaataggatcaaaccttattccatgctatttccataagattcctctttcttattcttaagcaagcccccgagagggcttagttgatcatgatttctgttttctctttcttttcctttttgtttgtttcgagaaagatatcgtccgattctccttctattgattcttttccgatcgagatgtatggatccatgtgtctacatacctagattctgttcatggattaacgaaaatgtgcaagagctctatttgcctctgccattctatgagtcgcttcctttttgcgtatggcacccccaccccctttggcagcatctactaattcggaacttaatttgaaagccatatttcgacccggacgcttttgggatgcttctaataaccaacgaatggcaagtgctcttccttgtttagatcctatttcaatcggaactttccgcgtcgatccttttttattacgtcttgtttttactcctatattgggagttactctacgtattgcttgacgtaaaaccaatagtggatttgtttctgtcttttgttgaatctttttcacggctcgatagagaatttgataagccaatgatttttttccgtctttcataatacggttaaccaccatgttaactaatcgattacgaaaaattggatcggattttgcagttcttttttctgcagtacctcgacgtgacatgagcgtgaaagaggttcaagaatccgttttctttttataagggctaaaaacgaatcacttatttttttggctttttgaccccatattgtagggtggatctcgaaagatagaaaagatctccctccaagccgtacatacaactttcatcgaatacggctttccacagaattctatagggatctatgagatcgagtatggaattcagtttactcacttaaaattgagtatccgtttccctccttttcccgctaggatcggaaatcctgtattttccatatccataccatcaagtccttaggtttccgaaatagtgtaatggaaaaagaagtgcttcgaatcattgctatttgactcggacctgttctgaaaaagtcgaggtatttcgaattgtttgttgacacggacaaagtaagggaaaacccctgaaagaatttccatattgaccttggacatataagagttccgaatcgaatctctttagaaagaagatcttttgtctcatggtagcctgctccagtccccttacgaaactttcgttattgggttagccatacacttcacatgtttctagcgattcacatggcatcatcaaatgatacaagtcttggataagaatctacaacgcactagaacgcccttgttgacgattctttactgcgacagcatctagggctcctcgaataatgcgatatctcacaccgggtaaatccttaacccttcctcctcttactaatactacagaatgttcttgtaaattatggccaataccaggtatataagcagtgatttcaaatccagaggttaatcgtactctggcaactttacgtaaggcagagttgggttttttggggttgatagtggaaaagtcgacagataagtcacccttcctgtccctctacagaaccgtacatgagattttcacctcatacggctcctcgttcaattctttcgaagggatccttttcctcgttcgagagtctccgcccttcttccactccgtcccgaagactaactaagaccaattgagtcacgttttcatgttctaattgaacactttccatttatgattaaaggagaagattgttcttttaccaaacatatgcggatcaaatcacgtcttataataagaagaaatctttctcggtatcaatccccttgcccctcattctttgagaatcagaaggatccttttcgagtttccatttcttcatttggaatctgggctcttctatcttcgacttattttttttttgctttattctttatttatttcatttcgatttttccctcttcctctatccctatcctctaggtacagcgtttgcatcaatagagaaccttttcctctgtatgaatctatattattccattccaatttcttcccgaaacttcccaagaaaaatcccgaattggatccaaaattgacgggttaatgtgagcttatccatgcggttaggcactcttcaaataggaatccattttctaactggctttcgtgctttggtgagtcgtccgagatcctttcgatgacctatgttgtgttgaagggatatctatatgatccgatcgattgcataagacccgcggtcgcaatagaacggggaaagtatacagaaaagacagttcttttcaatttcgattatctatatattagttcgtttctatttctagatatctatttctatatattagtattagttagtagtactattctattagttagcgatcccggctctgtgagttctttcttccgtgatgaactgtcggcaccagtcctccattttttctctgtggaccgaggagaaagggggctcagcaggaagaggattgtaccatgagagaagcacagaggtcaaccctcttcaaatatggaacatggattctggcaatgcaacgtagttgggtcctcatatcgatccgaatgaatcagtctttctacagaggtcaatctttgcctattaggcaagaggatagcaagttcgaaattctgtctcggtaggacatggatttctattactatgaaattcataaatgaaaatgaagtagttaatgggagggctaccattatcctttttcttgtatgtgttcctaagagaaggaatttgtccatttcatgtttcgaggtctcaaaaaagggcgtggaaacagatagaaactcttgaatggaaattgaaaagaaatgtagccccagttccttcggaaatggtaagatctttggcgcaagaagaaggggcgacccatatcatcttgacttggttctgcttcccctctttttttaagaataccgagtcgggttcttctcctaccagtatcgaatagaacatgctgaacaaggggatcttctacagtcgacctgctcgatttagatcgggaaaatcgtacagattttatgaaaccatgtgctatggctcgaatccatagtcaatcctattttcgataggaccggttgacaattgaatccaatttttcccattatttgactatccataatagtgtggaaagaaagcccggaggaagggtggccttgagtttctcgcccctttgccttaggattcgttaattctctttctcgaggggacggggaagggatataactcagcggtagagtgtcaccttgacgtggtggaagtcatcagttcgagcctgattatccctaaacccaatgtgagttttttctattttgacttactccccccgccacgatcgaacgggaatggataagaggcttgtgggattgacgtgatagggtagggttggctatactgctggtggcgaactccaggctaataatctgaagcgcatggatacaagttatccttggaaggaaagacaattccgaatccgctttgtctacgaataaggaagctataagtaatgcaactatgaatctcatgg

SEQ ID NO: 36994 - DNA, 447 bp, Oryza sativa
  unsure (1)..(447): unsure at all n locations
nnnnnnnnnnnnnnnnnnnnnnnnnnnnnnnnnnnnnnacttagttaacttcctttcctcaatctcaatctggattcgtgcggcaaaaatgatgatactagcgaaatcggaatgcccctcgaaaggggcatccccgaatctaacttccttgtttaatagtgtatgaataggcctgactaaatccttgtatggcttcctctatttctctataaaaagaaatatgaccaagagtggtgcgaatgtatatagaacggatttccttttttctatttcccactactagatagtgggcataaatctcacgataagtccccaaagattcatattgaacttcaatcggaacttctcttaacccaatgacgcgttgatctaggtttcatcggaaccacaagggactgtctaaacagatttggttctgtctataagctccagtgcatcataggaact

SEQ ID NO: 36995 - DNA, 816 bp, Oryza sativa
ttcagagaaaaaagatcctattttaacgaatcgcacgtagagatattgctagtacacaaaaagttaatgggatttcataactaatagattgagcggcagctcgtagaccacctgaaaaagaatatttattatttgagctatatcctgccataagaagaccaataggagcaatacttgaaatggcaatccataaaaaaacaccaatactaagatccgctaaaacaaagcgatatcccaaaggaataactaaaaaacttaataaaattgatatgactgctatagacggtccaatgctaaataagggaatatcccctcgggatggcaagatatcctctttaaaaagtagcttagttccatctgctatagcttgaagcagtcccagggggccagcatattcaggaccaatacgttgttgtatcgatgcggatatttctctttctaaccacacaattacgagtacttctattgtgattcccagtaagagggtcaaaatgggtagaatccatatcagtccatagacttcttttaataattccaagttcgaaaaagaattgatagcttctacctgtaccctgtctattatcatttcaacgatcaacttctcccataatgatatctatactacctaatatcgtcatgatatcagccaatttcatttttttgactagctgaggaagaatttgcaaattaataaaaccgggtggacgaattttccatctccaggggaaaagactatcatctcctaccagataaattcctaattcaccttttggggcttccactcttgcataaagctcttgttttgacaattcaaaa

SEQ ID NO: 36996 - DNA, 3268 bp, Oryza sativa
aagacttttgggaaaacgtcaacgtttgctggcttatttggcaaagaaaaatagagtacgttataagaaattaatcagtcagttggatattagggagcggtaatttcatcgttcgaattttttttcttattttattagtagtcttatagtagtcttagattttgcattttgatgagcctcgttttgaggaattcatggaataatccattttcatggaataatgaattaaggaagaaaggatatgagtctaccgcttacaagaaaagatctcatgatagtcaatatgggccctcagcacccatcaatgcatggtgttcttcgactgatcgttactctcgatggtgaagatgttattgattgtgaacccatattaggctatttacacagaggaatggaaaaaatcggcaaataggaaagctacttaggcaggagataggggaattccttaagaaagaaaaaagaataagaacacagatacataacataaaaaaaagaataaataagacgaaattcgacctccccctacatatttaatttcttctcctatacaaaaactagcaagacctactccattggtaattccatcaatgacacccttgtcgaaaaactgcgttagttcggttaatcctcttatacccaaggtaaaggtcctagtatagaaaatatctatataaccgcgattatatgaccaactatatatctttttttttagttgatggaaaaaatactttttcggacccccttttacaaaggaatttattaaatccaaattctgaaaaaaagagtaagcagatccataaaacatatatgctatgaatagaccaaaaatagctagacttacagaagaaattgcattagtgataaattcatatgaatttatggaagaattagaactttcttggaaaaagttgattgagggagttagccactttgataatatggttaattcccctatttcattatcaaaatggattcctatagatccaataaacaaagtacaaagcagtaatataagaagaggaaatagcatagtatttcccggttcatgaggatagacaaaagtgtttttagtccccaatgaagtactaaaggaccctatcctatttcctgtattaacatgaattttggatagattttgtgaaaaaaaagaaactccactcttcgctgttgataaaacgaaatctctattgactcctttagatatcctttttccccataacgatattgaatacaacgaatcctctttagtactactgtaattttgaaaatgaacacgcaaatacccatcaaaagtaagtaaatatatccgaaacatataaaacgcagttaatcctgcagtaaaagaagctattattccaaaaaagggtgaatataaccaactattactaaggatttcatctttggaccagaagcaagcaagaggtggaataccacaaagagaaagggtaccccataaaaaacaagttcttgtaattggaatgtattttcttaaaccacccataagaaccatattctgacttttatctggtgaatatccaacaagaggttccattgaatgaataacagatccggatcccaagaataataaagctttcgaataagcatgagtgatcaaatggaataaagcagcttgataagaacctatacctagagctaacatcatataacccaattgagacattgtagaataggctaagcttcttttaatatctctctgagcaagagctaaagtggctcctaagaaaagtgttagtgtacctattaaagaaatgaaactcattatcaaaggtagggatatgaaaagaggaagaagtcgagctataagaaaaatccccgcagcaaccatagttgctgcgtgtataagagctgaaatgggggtgggtccttccatagcatcgggtaaccatacgtgaagagggaattgtgccgatttcgcaaccgcaccaaggaataataaaaaagcacacaaaatagtaagcaaggagttaatctcattattaggaatccagttattagctattttaaacaaatcccgaaactctaaactacctgttatccaaaaaaaacctagaattcctaataacagaccaaaatcccctacacgattagttacaaaagctttttgacaagcactcgctgcaattggccgtgtaaaccaaaagcctatcaataaataggaacacattcccacaagctcccaaaaaaaataaatttgtatcaaattggaactagtaaccaatcccaacatggaagtattgaaaaaacttatataaacaaaaaatctcaaatatccctcatcgtgagacatataatcatcactataaataagaaccaggattcctacagtagtaattagtattaacataatagaagtaagcgggtcgattaagtatccaaattctaaggaaaaatcattattgacggtccaagaccatagatattgatagatagaacttccatttatttgttgaatagacaggtgaactgagaataccatagctatacttaaaagtaaaacactaggaaaagcccatatgcgacgaagattttttgttgctgttggaacaagaaaaagtccaaaccccattgacataataactggaagtgggagaagagggattacccatgcatattgatatgtatgttccataagaaaagaaattgcaatttttacttgaaaattttacttcaatttttctataaaattgaaaaaagtttccgattcaccaaactaattcttatctatttctgaaggaataaaaaaatactagaattcttaatttttcaaaaattttctcattgaaacaatcaaaaaataagaataggttttgttggttaaagtcaaaaagttaatgaaataacttcgttacctagttattacctaaagaaggacttttattaaaatacaaaaaaaagattgaatcattttactttaatatttttttgtattaaaatgaagcagctcccttgtttcgtaactcaaattgattggaattcaattctggaatactttaattaactatttgattgaattttcccttccttttatcctcccgtcttatatgggggataggcccccataccttatatctgtatatggagagtatacttgaaatataaattgatttaaatagaaaacctttgtatatattctatattattaaaacaaagtctaaaaaaaatatataatatgttaaaaaactcttgtcttatccgcattagacaaaatgaagtaaaaaagaattcagaatttcaatatcttttagta

SEQ ID NO: 36997 - DNA, 5709 bp, Oryza sativa
tgcaatttttacttgaaaattttacttcaatttttctataaaattgaaaaaagtttccgattcaccaaactaattcttatctatttctgaaggaataaaaaaatactagaattcttaatttttcaaaaattttctcattgaaacaatcaaaaaataagaataggttttgttggttaaagtcaaaaagttaatgaaataacttcgttacctagttattacctaaagaaggacttttattaaaatacaaaaaaaagattgaatcattttactttaatatttttttgtattaaaatgaagcagctcccttgtttcgtaactcaaattgattggaattcaattctggaatactttaattaactatttgattgaattttcccttccttttatcctcccgtcttatatgggggataggcccccataccttatatctgtatatggagagtatacttgaaatataaattgatttaaatagaaaacctttgtatatattctatattattaaaacaaagtctaaaaaaaatatataatatgttaaaaaactcttgtcttatccgcattagacaaaatgaagtaaaaaagaattcagaatttcaatatcttttagtatctaagtataaatactaagaaaaagaagaaagatggattgatttgcggcaatagatgtctttcacatacaactagaaaaaagtaatttcctttttgaatggcagttccaaaaaaacgtacttcgatgtcaaaaaagcgtattcgtaaaaatctttggaagaaaaagacttatttttccatagtacaatcttattctttagcaaaatcaagatcattttctggcgtcagcgagcatccaaaaccaaagggtttttctcggcaacaaacaaataatagggttttgggataatatgaattgacctatcccccaaaaattccaattatttaatatgaataattaggaataattaggattaattaatgagtttacttttatgtgtcgaattcctcggtacaatattcttagaacaaacctctttgatatataaaaaaagggtttttggtatactgtgacctaaatattcttttcctatcaatgaacttttcgtaatagaatccgtataataaataaaaaaaggggattctattatgaaaagtagagtattcctgcaataagacttacaacttctacctatcttatcctaaattaacaaaaaaattagttctatattgcaactgagaaaaaattgttccaactctttcaaagtttctattgggcaaagcaagaatttttttgttaaaaaattcgcaacgatactaccaaacgaagtctattttaatgaagattctaatgtcctaaattctatggaatcttccaatctcgacgattcgcgagaaaataacttaatattcttttaataaacctgttatttcaacttagccgccatggtgaaattggtagacacgctgctcttaggaagcagtgctcaagcatctcggttcgagtccgagtggcggcagtctcgaaaaagaatacaatagattataaaataaaatggattcaattcgaaatttccaattttgtaatgggaccttctccttatgctatttgcaactttagaacatatactaactcatatttctttctcaacaatttcaattgtgattacgattcatttaataaccttattagttcgtgaacttgggggattgcgtgattcgtcagaaaaaggaatgatagccacttttttctgtataacaggattcttagtttctcgttgggcttcttcgggacattttccattaagtaatttatatgagtcattgatcttcctttcatgggctctgtatattcttcatatgattcctaagatacagaactctaaaaatgatttaagcacaataactacgccgagtactattttaacgcaaggctttgccacgtcgggtcttttaactgaaatgcatcaatccacaatactagtacctgctctacaatctcagtggttaatgatgcatgtcagtatgatgttactaagctatgcgactcttttgtgcggatccttattatccgccgctcttctaatgattagatttcgaaagaatttagatttcttttcgaaaaagaagaaaaatgttttaagcaaaacatttttctttaatgagattgaatatttctatgcaaaaagaagtgctttaaaaagcaccttttttcctttatttccaaattattacaaatatcaattaattgagcgtttggattcttggagttatcgtgtcattagtctagggtttacccttttaaccataggtattctttgtggagcagtatgggctaatgaggcgtggggatcctactggaattgggatcctaaagaaacttgggcatttattacttggaccatatttgcaatttatttacatagtagaacaaatccaaattggaagggtacgaagtcagcatttgtagcttccataggatttcttataatttggatctgttattttggtatcaatctattaggaataggtttacatagttatggttcatttacattacccatctaaatgattacataacataaaaccttaatgaaatggaaaaaacttccatttttgtgtttgatttgagaaccccttgaacgccttctcaaagggttctcaaaaattcgagatagatctaattagactcttttacttttttctgaatttttgagtatttccactatggaatatagagcggactagtagaagaaaaaaaatcctatttaggataataattggataacagagcctctaccctgtcaacggatagcgagagaacaaaatctggataaataccgattcctattactggtaaaaagatacagattaaaagaaagagttctcgcgggccggaatcctcaaaattttcgtttggaacatgaaatagcttgtatccatagaacatctgtcgtaacatagataataaataaataggagttaatatcattccaattgccattacaaaagtaattagcatttttggcattaacagaaattttggactagtaattagtccaaaaaatactactaattccgcaacaaaaccactcattcctggtaaggcaagagaagccattgaaaagctactaaacatggtaaaaatttttggcattgggatagaaacccctcccagttcttcgagataaacaaggcgcattctatcacaagccgttcccgctaagaaaaaaagtgtagccccaataaatccatgggataatatttgtaaaatagctccattgagtccaatgttggttatggaaccaattcctataataatgaaacccatgtgagagacggaggagtaggctattctttttttgaaattgcgttggccaagagaagttgaagctgcatagattatttgcatcgctcctattattactaaccaaggggaaaatagataatgagcatgaggtaacaattccatattgatccgaatcaatccgtatgctcccatctttaataggattcccgctaaaagcatacatgtactgtaatgcgcttccccatgggtatctggtaaccacgtatgtaggggtataatcggcaatttgacagcataagcaataaggaagccaaaataaaatagtatttccaatgttgcagggtatgattgattaattaatctttccaaatctaatcttggttcgttggaaccgtataagcccatacctagaactccgattaagaaaaaaatggaaccacctgcagtatacaaaataaactttgtagctgaatagagacgcctcttccccccccacatggataaaagtaagtaaacaggaattaattctaactcccacatgataaaaaaaagtaaaaggtctcgcgaagaaaataatcctatttgaccgctatacattgctagcatcaggaaatagaataatcgggaattccgggtaaccggccaagctgctaaagtagctaaagtagtcataaatcctgtcaataaaatagatcctaatgaaagtccatcgattcccaatctccagtggaaattgaagacatctatccatttagaatcctcttttaattggattaagggatcctccaattggaaatgataacagaatgcataagtcattagaaggaattctaataaacaaatagacatagtataccacctaacgattttgtttcccctatgaggtaaaaagaaaattaatgaacccgcaaatatcggcaaaacaacaagtattgttaaccaaggaaaagaactcatgataaagtgataaagacaagatacgttttgaccagaaaagcccgtgctcgattattttgagcacaggcttcttcggtaaagaggaatcagacgattcaagtggaattttttgtaacgtatcaataagatagagccatgctgcgggttgtctcaggtcctaaataaacgcggacacttaaaaaatctgttgggcaggcggattcgcatctcttacaacccacacaatcttcggttcttggcgcggaagcaatttgcttggctttacatccatcccaaggtatcatttctaatacatctgttggacaagctcgtacacattgagtgcatcctatacatgtatcataaatttttacggaatgtgacattgggtctataaattttccttttcaacataaaaattttcgatctggtcaaaatgaaattagtactatatcaatcaaatgtattgtagacaccagacgaagcaatggtttatccaaacttcaacaaataatgcaatatatttcttaatccgtttgtgagaaagcatgaaaagagccaagagactttaattttgggcttcaacaatcataattatacgaattgtatatacgaattcgaattagccaataaattggctatcgtcttttcaatataaattattgcaatattcaaattgcaatatcaatgaattgcaaaaattcaactaagtaaaaaagaatactatggaataacctactcaaaaaatagatattctcaaataataaatagtattcatgttactatttcatattattattatatgtgtccctttgtttagaagattctatgtctaattattcaaaaaattagattgattgatacgagttgatttcctattacgatggatggaagaaagaatggataatccaatagctgcttcagcagccgcaagggctataacaaaaattgcgaaaatgtctccttttaattggcggctatcaaatagatcagaaaatgttacgagatttagattaattgaattcagtataagttcaaggcatattagagctctaaccatgtttcggcttgtgatcaatccatagataccaatcgaaaataaatagacactcaaaaaaagtacatgctcaaacatcattaactaactccttatcaatctcgattcatttcaatatggggacaagaattgaaccgattgaattaattagaatagaacaattacacaacaaaagagaaaagaaggtatttgttggcagtagatgagttttactaaatcaaaattgtggttctttagtgatttattttagatttgaaattcttataattttgactcattctaagtatttcttattgccgagccatagtaattgcacctattaaagaaactagaagaattatggaaatgagttcaaatggaagataaaaatcggttgctaaatgaatcccaatttgttgaacgttatttatgagaccctgtt

SEQ ID NO: 36998 - DNA, 7206 bp, Oryza sativa
  unsure (1)..(7206): unsure at all n locations
cattctgagccatttacgaacattacggcaaatatgatcaagacatttatagctcccacataaataagaagttgtgccacagctacaaagtaggaattcaataaaatatagaataaggatatacaaacaagaactaatcctagcgaaaaagcagaaaaagttgggttggtaagtaataccacccctagaccccctagtagaagaacaaatcccccaaatagcacaagaatttcatgtattggcccaggtaaatccattatggataagaagaaattaatagtataaattttttcatgaactgactaaaactaaaagattcaaggaagaaaaaagggattaggaaatttttttgtatattgtatataagttctttctatagttagaaatcacatcacgaaaatctactctggtttaaaatcaggaataatttgcaataagcagtaggtattcgtttttctttctagttagtaaagaacttttggattctaacaaaaaaattctagtaatcagtaatcgttcttgaattccaagatttttcttcgtctattttactttgagttgaattcctaattgtttgaattgtgtaatctcccattatggagattggtaaccgactcaaagcaatttgattgtaattcaattcatgacgatcataagtagaaagttcatattcttcagtcattgataaacagtttgtcggacagtactcaacacaattaccacaaaatatacaaactccgaaatcaatactataattaagcaattgtttccttttaatatccttttcaaatctccaatccacaagaggtagatctatagggcatacgcgaacacatacttcacaagcaatacatttatcaaattcaaagtggattcgcccccggaaacgctccgatgtaattgatttttcataggggtagtgaatcgttataggtaaacgatttgtgtgggataaggtaattatgaaactttgaccaatgtaccttgctgcgcgtattgtttgttgaccataactcatgaacccagttaccatagggaacatattcgaaatatctatgaaaaaggtatgtttctttctcttgtttgagaggacttttgtgttgaaaatattcttactgttattgtattatcttattttatagtgaaacaagttgggaagaagttgttaataagagattgcccagggaaataggtaaaagaaatttccatccaagatttaataactgatccattctcatcctgggtaaagtccatcttattgtgatagaaatgaagagaaataaataagctttagttaatgtaataaagatactcattgtcatttctaaaattccaaccattttattcatttggaaaaatccaaaaaaggatatatagggaatagacaaattccacccgcctaagtagagaactgttacaaataaagaggaaactaataaatttaggtaagaaacaagataaaataaaccatatttgataccagaatattcggtttgataacctgctactaattcttcctccgcttctggtaaatcaaagggtaatctttcacattccgccaaagaagaaattagaaaaaccagaaaacctataggctgacgccaaagattccatccaaaaaaaccatattttgactgtgcttcaactatatcaactgtacttgaactgttggataatcatagtcgacgataacatcacagttcccaccgctattccaaaaccgtacatgaaaccttagtttcatacggctcctctatgatcagaaaaaaggaaagtactgtttcatttcgttattatcttcttgggcgtagttagaattatctaagataaaatcgatttcaacgtcctaaattagaccaaaggaattctgtctgctagaataataaaaaacgcttcggaattcatctcatcctttataatataatggtactttttctttgttcagcaataacttaatcttggaataaaacactcgttataacaattaataaacgaaaagagttgggtattagttcatgaagaattctgtatgaatatggataaacgacggaaagaataaataaagatctttttttttgtattgcattccatatcttttgtcctattcttctttccccgaggggtatttaaaaagaaaaaaggaataaagggttaattcgttcttgatagccatttccttaacaagtgaatgggaacatactctggatcggaatccgaagaaagtactacttgctcatttccaccaatttcaagtccttattatgattccttttatgaggaaaaatatctaatgctttagattccctcattactaatcctttatgtactttagtgtttctaatccctcactaacttttgatggattcccttatgattacaactttctgtatcgggaatcccttattattgcccgcttcaagatatgatgactaatcaaaaaatctcaaccttggggtaaagaatttacaccgcttatgtttacttccattttttcttgtacataggaaatgagattttttctttttactacaaattaataagcagttttgtttcactcatatagctatctagtttaacttactaacctgaatatagaataagaaaaggaggataaatattcaatgaatttcagaggaaaaagatcctattttaacgaatcgcacgtagagatattgctagtacacaaaaagttaatgggatttcataactaatagattgagcggcagctcgtagaccacctgaaaaagaatatttattatttgagctatatcctgccataagaagaccaataggagcaatacttgaaatggcaatccataaaaaaacaccaatactaagatccgctaaaacaaagcgatatcccaaaggaataactaaaaaacttaataaaattgatatgactgctatagacggtccaatgctaaataagggaatatcccctcgggatggcaagatatcctctttaaaaagtagcttagttccatctgctatagcttgaagcagtcccagggggccagcatattcaggaccaatacgttgttgtatcgatgcggatatttctctttctaaccacacaattacgagtacttctattgtgattcccagtaagagggtcaaaatgggtagaatccatatcagtccatagacttcttttaataattccaagttcgaaaaagaattgatagcttctacctgtaccctgtctattatcatttcaacgatcaacttctcccataatgatatctatactacctaatatcgtcatgatatcagccaatttcatttttttgactagctgaggaagaatttgcaaattaataaaaccgggtggacgaattttccatctccaggggaaaagactatcatctcctaccagataaattcctaattcaccttttggggcttccactcttgcataaagctcttgttttgacaattcaaaattgggtgaaggttttttaccaagaaatcgatattcaaaatcattccattcggaattctttgctttcttaaagcgtcggacttctaaattctcataagggcccccaggaattttttctacagcctgttgaataattttgatggattccctcatttcaccgattcgtactaaatagcgtgctaatgaatccccttctttttgccattggactttccaatcgaattgattgtaagactcgtaaagatcaactttacgaagatcccattgtattccagaagctcgtaacatggggcccgataagccccaatttacagcttcttctccgctaataaaaccaactccctcaactcgttccaaaaaaatgggattctgtgtaataagttgttgatattcaataactcctcgtaaaaaataatcacagaaatctaaacatttatcgatccatccataaggcagatcggcagcaactcctccgatgcgaaagtaattatgcatcattcgcatacctgtagcagcttcaaatagatcatatattaattctctctctctaaaaatataaaaaaaaggagtctgcgcaccgagatctgccataaaaggtccaagccataacaagtgagaagctatacggctcaattctaacataattaccctaatatagctggctctttggggtatttgaatattctccaagaattctggtgcatttaccgttattgcttctgtaaacataggagctaaataatcccaacgtgttacataaggtaagtattgtataatagttcggttttccgcgattttttccattcctctgtgtaaatagcctaatatgggttcacaatcaataacatcttcaccatcgagagtaacgatcagtcgaagaacaccatgcattgatgggtgctgagggcccatattgactatcatgagatcttttcttgtaagcggtagactcatatcctttcttccttaattcattattccatgaaaatggattattccatgaattcctcaaaacgaggctcatcaaaatgcaaaatctaagactactataagactactaataaaataagaaaaaaaattcgaacgatgaaattaccgctccctaatatccaactgactgattaatttcttataacgtactctatttttctttgccaaataagccagcaaacgttgacgttttcccaaaagtcttcggagacctctttccgatgaaaaatcttttttgtgtaattccaaatgtgaagcaagtctccgtatcttattggtgaaactgaatacttgaaattcaacagaaccccagttttcttctttttcttctttaaccataaatccaaaaatttttctacctcctttctttttcatgtatttttctgatcaggaaaaataaaaaattatgtcagttattttgaagttattctaatctcgtacacacaaaaatttgcaattattcatctactactggaatttggatttattttatcgatgcaaattggatttggatagaagggtacattcttttattttagatagaagaaaagtttcttctatctaaaataaaagaattttgctgatttatttattgctatatccaatttatggaattgatacaccgtttaattgatatcatttagcaaaatgaaacatagcatatgcatccatctttcggctcgagaatttcacgggatagagatatggtataagaaataggctattaagtaactctaaatgaattgtggatacatctgtatccttaacatactgaaacaactgccattattcgtatcaaaccaatagcgattcatacaagttaaatcttctaatcaatggtgggccaataatgaatttttttgcatatgtattaagacgcttggcctgatttcgaaattgtccagagttttttatgtagttttcattgcaaaatgatggatctccttccgtaactttccaattacgagtacgagaattgaaagacatgaaaattctcaattctctacggcgtctaggagatagatagaatattttcaggaacaagaaaaccagaagaatctttctctctattcactaccattccgcgtcttcgacttctattagtttcttttcttctttaatgcaatagctatagtttgatatagaatccatttctcaaagtaatggaaacctttctcttataggaaatggttcgaaaatcgctattccaccttttaggtatcgtgaaaagtgatacctgtgaagatcgtgcatttcagtcacattcagatccgttttttgagtccatgatataaccaaattggatggatcttccacccgtttagctaagaaagaatagatgcagaggtggataatagatcgatatgaagatcatgagctgccccataatgaaaccaccaggagtcgcgaatatctccttcttccctaatccaagattggagaaagaagatctaagagggacccatggagaatgtggtcagaaacccataatagagtccgaccgcaacgaccgaattaattatcctcatcgagaaacttagactactaagtagaaaagatttgaaaatcatggcatgggtctcctttttttctttctttagagttttctatatgcacaatttctcgatgtttcgatgagaatttcttgactttccatatatagaaagagatagactataaatgacatctcttatgtcaataagaccaaagggatggatattaaatgataggaagtgctaggaagtgaaatagaatgaaatagagccactctgggcttacctatgaaatgaggcatggaacggagccactacgaagaaattccgggagttacgaaagaagcttcggactcatattgttcatgggttgagagcgggagttgaactctaggaggtcgaatcccccttgttcctcagtagctcagtggtagaacggtcggctgttaactgactggttcttagttcgaatcctacttggggagatttgattcattctttaatgtaagaataaagaattgaattaaagggcttgctttgacccttaggagtaggtaacccgttcgctatccttgtttctattgcattttatctcatcgtatcacattctgttctacgattccacttcgacaaaaggaaagagcatacccaagttcaatagctttacgtccgctatcccgatcatggttttcctaccctcagggggaaagtaaaggcccttcccctttggaaggctgtgggcgaggagggattcgaacccccgacaccgtggttcgtagccacgtgctctaatcctctgagctacaggcccaccccgtctccactggatctcttcccgggggtaccccccaaaaggaacctccctctcctcagccatttcatttcgggttaagaagatgggaaagcccctttctctctataagaacagtgcgttccgaggtgtgaagtgggagagaggggatgtgatgattgaggttttgaataagacgacctttgcattttggatttggatctttttcgtatttcaaaatagtgaaaaagtcaaataagaggtgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 36999 - DNA, 946 bp, Oryza sativa
ggggaaagtaaaggcccttcccctttggaaggctgtgggcgaggagggattcgaacccccgacaccgtggttcgtagccacgtgctctaatcctctgagctacaggcccaccccgtctccactggatctcttcccgggggtaccccccaaaaggaacctccctctcctcagccatttcatttcgggttaagaagatgggaaagcccctttctctctataagaacagtgcgttccgaggtgtgaagtgggagagaggggatgtgatgattgaggttttgaataagacgacctttgcattttggatttggatctttttcgtatttcaaaatagtgaaaaagtcaaataagaggtgttaagctttttatcattctggcatcgagctattttgccgcaggacctcccctacagtatcgtcaccgcagtagagtttaaccaccaaattcgggatggattggtgtggttcctctacgcctaggacaccagaatatcgaaccatgaacgaggaaaggcatgagagaaatattggctagtaattgtgaagccccaattcttgactggaagggacaccaaaggcctctgccctccctctctatctatccaagagatggaagggcagagcttttttttggttttttcatcttttcatcaaagagttgaacaatgaagatagatggcaagtgcctgatcgatttgatcaggtcgtgtaggaacaaggttcaaatcgttcgttcgttaggatgcctcagctgcatacatcactgcacttccacttgacacctatttaaacggctcgtctcgccgctaccttatcctatttccatgcttctgtcgctccatccccgtatgggtggagaacccgtcgctgtctcggctgtgctaccggaggctctagggaagtcggaggagagagcactcatcttggggtgggcttactacttatatgct

SEQ ID NO: 37000 - DNA, 745 bp, Oryza sativa
  unsure (1)..(745): unsure at all n locations
nnnnnnnnnnnnnnnnnnnnnnnnnnnnnnnnnnnnnnnnnnnnnnnnnnnnnnnnnnnnnnnnnnnnnnnntctctttattctgaaagaccagattggcccgttccgccataaataagtaccccctttttcggctgagtataattcgacaattgctgagtaggattcgacaatgggcctgagtcagtgattcgaaaacttagttaacttcctttcctcaatctcaatctggattcgtgcggcaaaaatgatgatactagcgaaatcggaatgcccctcgaaaggggcatccccgaatctaacttccttgtttagatagtgtatgaataggcctgactaaatccttgtatggcttcctctatttctctataaaaagaaatatgaccaagagtggtgcgaatgtatatagaacggatttccttttttctatttcccactactagatagtgggcataaatctcacgataagtccccaaagattcatattgaacttcaatcggaacttctcttaacccaatgacgcgttgatctagtttccatcggagccacaagggactgtctaaacagatttgtttctgtctataagctcccagtgcatcataggaactagaaaaaagagattctttatctttcgtatacttaggattattattattgtaatttactttttggtttggatagtttccgcaactattatatctattcgcacaaatacctcgacggtttccaatcgttatacataaag

SEQ ID NO: 37001 - DNA, 478 bp, Oryza sativa
catcgataatatctttcgttttgttcaagcaggatcggaggtatctgccttattagggagaatgccctctgcagtgggttatcaacctactcttagtacagaaatgggttctttgcaagaaagaattacttctactaaaaagggatctataacttcgatccaagcggtttatgtacctgcggacgatttgaccgaccctgctcctgctacaacatttgcacatttggatgctactaccgtactttccagaggattagcttccaaagggatttatcctgcagtagatcctttagattcaacctcaactatgttacaacctcggatcgttggcaacgaacattatgaaactgcgcaaagagttaagcaaactttacaacgttacaaagaacttcaggacattatcgcaattcttgggttggatgaattatcggaggaggatcgtttaactgtagcaagagcacgaaaaattgagcgcttc

SEQ ID NO: 37002 - DNA, 7553 bp, Oryza sativa
  unsure (1)..(7553): unsure at all n locations
ttttatctactaatagtggccaaattggcgtattaccaaaccacgcccccattaacacagctgtagatatgggtcccttgagaatacgcctcctcaacgatcaatggttaacggcggttctgtggagcggttttgccagaatagttaataatgagatcatcattttaggaaatgatgcggaactgggtagtgacattgatccggaagaagctcaacaggcacttgaaatagccgaagctaacgtgagtagagctgagggtacgaaagaattggttgaagcgaaggtagctctcagacgagctaggatacgagtcgaggctgttaattggattcccccatctaattgaagacaacccaacggtttagttgatacaaagaaaaagggaagaggggtagaaaaaattattagatagcgaagcgaagtagggccaatgctatctagtaatttttctacctacctacctactattggatttgaaccaatgactcccgccgtatgaaagcaatactctaaccactgagttaagtaggcaatttatcaccacaaaggaagaccctttacttcgatcgattatagatcgaatcctttttataagcaaataccgcttcgttattggtatgttattatagtaaacagatcaaaggatatcctctactattagagaatattcatcttgacaagaaattctctatatattaagatatctctgacaagggctatagctcagttcggtagagcaactcgtttacacgtgcgccaatgcttttcaagggagcttattatgcaatgaacatagtggatcttcttgcaaaatcaatgtcttacttcatggattcgagagaataggagaacagtcgcctgacaaatagttggttcagtccgattcaggtaccaatccaggtgcctaaacaaatagaacctttattgatttgctagttgataaggtaaatatccagcccactaaatgctaggcttaatgaggataagggcctccaaaaaaattcttttcgttctatgaactttaaggtgtatgaagtctcatagtcaactcttgtagcggaacgatagagactctatttcacttaggttgatttaatttaggccggaggcagacctaagtcaaggtaatcctcctttgaaacactttggtattgctcttagatagatcataatacaaataatcaatcagagcgcagggagccatctcattatctttccgtaaagaaaaactatggtggactaactgatctttctatcagttgataaaagagcccaatgcaaaaaaatgcatgttgggtctttgaaacagttcgaatcatttcgataataatccgtttgatctgttttaccgagaaggtctacggttcgaatccgtatagccctaatatgtccttttttagattttaggagagatatcctacgtttcctttagtatagttttcatttccctattagtacttgtttatagactggacaggcgcctgcgccataaaatagagataaaaggattaccagaggctcattcatcgaaaattatagagacaggaaaagaaaaatgaatttctatcaaatcaactgcaagatgttctccatcttgcaaattcctactttgtttgaagtatattactttgcttatctatatctatagattacctaaatctaaatcaatctacgttctgaaatagagttctttatttttatagaattactcctcattaggctgcatacattagtcatcctatcttaattaggctctaattcgtagtattttcgtttttattcctttttctagagattctagagaaaatgagacaaagtgaagcgagagagttttgtttctataagaattatgtctccaccatacctaaatagaaaggaaatcaaaaagaaagggggtcgggattccattggatgaatctttaaagaagacgtggcaaagaggaaacaaaggctaaactaagccctttggtttgagaaaaaccgatccttgtttcaccgaggaaaagagagaaattctgtataaattgacaatgctgacttgaattgactaattcagttccgcctattccacattaatgggagtacatttatgtttctgcttcacgaatatgatattttttgggcatttctaataatagcaagccttattcctattttagcattttggatttcagcacttttagctccggttcgtgaaggaccagagaagctttctagttatgaatcgggtatagaacccatggggggggcttggttacaattccgaatacgctattacatgtttgcgctagtttttgttgtttttgatgtggaaacggtctttctctacccttgggcaatgagtttcgacgtattgggtatatccgtttttatcgaagctttcattttcgtgcttatcctagttgttggtttagtttatgcatggcgaaaaggagccttggaatggtcttaactgaatattcagacaaaaaaaaaaaagaaggaaaagattccattaagacagttatgagtttgattgagtttcccctacttgaccaaacaagttccaattccgttatttcaactacactaaaagatctttcgaattggtcaagactctctagtttatggccccttctatatggtaccagttgttgtttcattgaatttgcttcattaataggctcacgattcgactttgatcgttatggattggtaccaagatcaagtcctaggcaagcggacctaattttaacagccggtacagtaacaatgaaaatggctccctctttagtgagattatatgagcaaatgcctgaaccaaaatacgtcattgctatgggagcttgtactattactggtggaatgttcagtacggattcctatagtactgttcggggagttgataagttaattcctgtggacgtctacttgccgggttgcccacctaaaccagaggctgttatagatgccctaacaaaacttcgtaagaagatatcgcgagaaatagttgaggatcgaactctatctcaaaagaaaaatcgatgttttactaccagccacaagctttatgttcggcgcagtactaatactggaacttatgagcaagaattgctctatcaatcaccatctactttagacatatcttctgaaacttttttcaaatccaaaagtccagtatcttcctacaaattagtgaattaggaggagctctttgtgccgaaaaagaaagagcagggcaatatttcaaacttgcattcgaactgcgaaatatttatacaaaggaggagagatcaagataatgcagcagggttggttatctaattggctagtcaaacatgaggtggttcatagatctttgggcttcgatcatcgaggaatagagactttgcaaataaaagcagaggattgggattccattgctgtcattttatatgtatatggttacaattatttacgttcccaatgtgcttatgacgttgcacccggtggatctttagctagcgtgtatcatcttacgagaatacagtatggtatagataacccagaagaagtatgcataaaagtctttgcccaaaaggataatcctagaatcccatctgtcttctggatttggagaagttccgattttcaagaacgcgaatcttttgatatggtgggaatctcttatgataatcatccacgccttaaacgtatcctaatgcctgaaagttggataggctggcccttacgtaaggactatataacccccaatttctatgaaatacaagatgctcattgaatgataagaaattcatgctcacttatacaacacaactccagattttatgcaagtcaaggaatatttttacgctctgttcctagatgaaacagaatacctattacattctaattaattccaattatacaaaaggttcagatagactaagcaaaaaagggcttcatttcgttggaaaatcacatattcatttccttcgtatgaacagaaaaatatgatgactcaaagaagttccctaccacgaactttgtaccgcgtgcattacttagaacaactagtaaagtaagataagataagcaagaataaaaaaatatttgtcggaatagcggaatagaaaattaagaaatgcaaaaatgcagaaaaagaagtgcctctatttagagatttatctacttagatgaaaaaatcatactctatctatattattaacgaatatgtatcccaacccatctcgaggtatttgtatcaatacctattcggaagatcccttttttctgtgccaggaaccagatttgaactggtnnnnnnnnnnnnnnnnnnnnnnnnnnnnnnnnnnnnnnnnnnnntgaccttttcttgtgcatcatcctagtagagtatttgtatctatgtcaatatccaaaatttggaaatggggagggggcagtcctatgcattgtacaaagaaagcctatttaataatatttaaatatcgagttaataatcgacattccttgccgatactataataaaaaagaaatgtattccattgaatcttaaacctattaataaaaaaacaggataaatactagagttagggaataaaagagggtttggggatagagggacttgaaccctcacgacttagaaagtcgacggattttccttttactagaaatttcattgttgtcagtattgacatgtagaatgggactctctctttatcctcgtccgattaatccgcttttaaaaagatttcgaaaactatgaattgaaggatttgattactcaatattcgattggaatggattcacaacaattctaaaaaaattatgaattttctatttcataatcattcctattttcattttaaaaaagaattaaagaacctatattatgatatgagttctgtgattaatcgtttgctatgccagtatctatacgtgtgtattagatttcgaaagcccttctttccctaatttagaagggagttccgctagcaacacaacgtaattaactcgattcgttagaacagcttccattgagtctctgcacctatccttttcctttgggttctagttcgagaaccgcttgttttctcaaaacatggatttggctcaggattgccccttttttaattccagggtttctctgaatttggaagttgccacttagcaggtttccataccaaggctcaatacaatcaagtccgtagcgtctaccgatttcgccatatccccattttctttttctttgagaccaggattccttgtgcaatttcctccatctgttagttttttttgaatcgttgaattcattactctatgtagtctagcggttcgtctctagttgagagactccgcttattgcaattcagcattgaattgattctatcgttgatgtatttgcaattcaatgcgaatcaatatatcccaaggtttttctctcccccacctaccgcgttccttttttagagtattcaaaatcatactataacgcttgatattcattctttttttttgctaatcagaattagcaatttcatttgctatgattctatgttctccttagtgaaatattaatcattaaattattagcaaataacaaaaaaaaacaaaatatctcaaaaaatgtctataatgatggactgaaaatacaagaaattcgcatgttctctttattatgttttcgtatataatatatattatttattcttttccatgtattagattattcgtccgagccatatcaaattaaaaatatctaaaatcaaattcaatatagaaattggaatagattctattagaaaaatagatttgcgaattagagaaaaaagaaagttcaaaaaaatctatctaactttattttatgaagttctagtatttttttctaagtagaacttccaatttcgaactagttaatagctaagattaataattaagatctgacattttacggatttcctatactatacatatttctatttgttacactatttctgttatgtaagcccacttagctcagaggttagagcatcgcatttgtaatgcgagggtcatcggttcaaatccgatagtcggcttttttctctatcaatgttccatgaacaaaaatacctctttttctccgaattaaatggagaagccaggatctattatgtcgttctaccctacaattttgctagatacaaaacaataaaataaataatatatatacaaaaattcagatgttgatgaaattccatttttttgtggtacttttagtagattttactctgtttatcctttactttaattcagttttaatttcgatgtattctgtaatgtaaatacaatgaaattaattgtgtaaaatgaaatttcaataaaaaaaggagtcttcatgtcccgttatcgaggacctcgttttaaaaaaatacgccgtctgggagctttaccaggactcactagaaaaacacctaaatccggaagtaatctgaaaaagaaattccattctgggaaaaaagaacaatatcgtattcgtcttcaagaaaaacagaaattgcgttttcattatggtctgacagaacgacaattacttagatatgtacatatcgctggaaaagcaaaaagttcaacaggtcaggttttactacaattacttgaaatgcgtttggataatatcctttttcgattaggtatggcttcaaccattcccgaggcccggcaattagttaaccatagacatattttagttaatggtcgtatagtcgatataccaagttttcgttgcaaaccccgagatattattactacgaaggataaccaaagatcaaaacgtctggttcaaaattctattgcttcatccgacccggggaaattgccaaagcatttgacgattgacacattgcaatataaaggactagtaaaaaaaatcctggataggaagtgggtcggtctcaaaataaatgagttgttagttgtagaatattactctcgtcaaacttgaacttaaggaaaaacggaaaggttcatagaattttcttccccttcccctttccccgaactaaatcgacctaaggctcttaattcgtattttcccattcacctaacagaaatggattaaccctaggattcctttttgttttttgttctttcctctatgtgtattttacataccatagtaatttggtatagagaatttctattaaataaaggtattgtattattgctggaataaattgtcatttgatttgatacattgtaatcattaacgttgctgaattaagaaaaacggaaagagagggattcgaaccctcggtaaacaaaagtctacatagcagttccaatgctacgccttgaaccgctcggccatctctcctccataatcttattatggaaaaaaaactgagtgaatagcgagttttcctattcctgcagtacaggtacaaccacaaccgcgcgagagttccattgttctattagatagaaaaattccttttcatctaagtggacgggtccaggatttttttactaggaattccgctccctcgaaannnnnnnnnnnnnnnnnnnnnnnnnnnnnnnnnnnnnnnnnnnnnnnnnnnnnnnnnnnnnn

SEQ ID NO: 37003 - DNA, 27496 bp, Oryza sativa
  unsure (1)..(27496): unsure at all n locations
nnnnnnnnnnnnnnnnnnnnnnnnnnnnnnnnnnnnnnnnnnnnnnnnnnnnnnnnaatgggttgggaattatgcctagatcccgtataaatggaaatttcattgataagaccttctcaattgtagccaatattttattgcgaataattccgacaacctccggggaaaaaagggcatttacttattatagagatggtgcgatttgactcttttttttgtttttttagccctacctacaccccggttttacgagaaagagtgggggttcgcggagagaaaaccaaattagtaagggaaacccacgcttagggaaggtgaggtgaactaacaactccttctgtcgtgtatcctcgactgacgcggcctcggatgcttcaattgtagattttagtattgagcgaaaggttacacctacaggataggttctgtattacaggctaatcctactctactagtactaataggtagcataggggataaaagcactacacctagaaataggaatcaacaagagaaaaactttgttagaaattaaccctttcctgattggtatcagggctgggaagaatggttgggataacaaacaaccatcaagtttgtactttggatacccctataaccatcaaagatcgttgaagtggctaattcctctaaataggaggcgttgagaacaaagaaattcttggagctatcgttttcctctagcattaatagaattcattggtgttaagaaaaacctcttgtgggaaggttggctagagatttcttggaaaaataccagcccctttcggtccataatgagatggaactaattctatttttattctctagattttttcgcttagtactatgtacagaagggaggagccgtatgaggtgaaaacctcatgtacggttttggaacggagattttttgaatagaacgaacgaccgtaacggatgttggctcaatccgaaggaaattatgcggaagctttgcaaaattattatgaagctacgcgactagaaattgatccctatgatcgaagttatatactctataacataggccttatacacacaagcaatggagagcatacaaaggctttggaatattatttccgggcactagaacgaaaccccttcttaccacaagcttttaataatatggccgtgatctgtcattacgtgcgactatctccactatagaaagaaaaataagaaaggatcaaattttctagtatttactagaaaagggggctttctacatagggatcgtcaaaacaacgattttgccctatcagctgtaggaagaaaggacacttcacgagaatcaaaataggaagaaagaaagtatggcctatactactctatggatagagttctcaaattgatagagaaagcaccgtaaagatcaattagtgaccgactgggtcgatacaactaaaaaaaactgcttacttatcccatgatatggggcaaaatttaggaatccgcttatgtaatagagccgatccactaagggattaagcagcggtgtagtatcagatcccaaagatagtaagttcttttttcttgcttatggggaaaaagtctttttcaaggattctatagaaatttcatatatgaaaccgagatagttacctttcagaaaattcggacgaaggatataggtctatctatgcttcatttttctgcaggtgggagaaaagatcaaactgattattgatcaaaatttagggtttgaaacttaggtaattaacttcttctgcgtaacccaagaagaaattggatcgatttttgagaaatcgaattcagttaagacaagggaaattaagatagcaatttctgagccgtatgaggtaggaaactctcaagtacggttctaggggaaggaactacctattccgaccggggagaacaggccattctacagggtgattcagaaattgcagaagcttggtttgatcaagctgctgagtattggaaacaagctatagcgcttactccgggaaattatattgaagcacagaactggttgaagattacgaagcgctttgaatttgaataagaccactctcctttttcagaaaatgggggtttggttgttgatccattaatcaaataaattaggtcggaagatcgaatcaagaatttcattatatctctttcctctgccttctattttatattatatttcataaggataaacgatagggtctagaatagaagtaataaagcgaataaaaaggggcaatataaatattgctaatatatcaggaccatcttattaataattctaatgagttatcttggaatttggaatcgaataaaaaaatctatattatgctcaaggaaagtagatatagatagggacttatactcttaaaaaaaatagactagctttttaaattaaaaaaaggtttttttgttacgtggagaaatccaagataaaaaaagtccgttaggcacccaatccttatgtcataatagatccgaacacttgcctcagattgacttcaatatataattgctccagtgaataactaaaaaaaaatagaaggacggtagatagtaaagaaaaggactaatcataatatctatctttcaaaggttcactaaaaagttggcgggtctctttgtatgtcttgtccggaaagaggaggacttaatgatgattcgttcgccggaaccagaagtaaaaattgttgtggatagggatcctgtaaaaacatcttttgaggaatgggccagacccggccatttctcaagaacaatagctaagggccctgatactaccacttggatctggaacctacatgctgatgctcacgatttcgatagtcatacaggtgatttggaggagatctctcgaaaagtctttagtgctcatttcggtcaactctccattatctttctttggttgagtggcatgtacttccatggtgcccgtttttccaattatgaagcatggctaagtgatcctactcacattggacccagtgctcaggtagtttggccaatcgtagggcaagaaatattgaatggtgatgtaggcgggggtttccgaggaatccaaataacctccgggttttttcagatttggcgagcatccggaataactagtgaattacaactctattgtaccgcaatcggtgcattgatttttgcatcgttaatgctttttgctgggtggttccattatcacaaagccgctcccaaattagcctggttccaagacgtagaatccatgttgaatcatcacttagcagggttattaggacttgggtctctttcttgggcggggcaccaaatccatgtatctttaccgattaaccaatttcttgacgctggggttgatcctaaggagataccacttcctcatgaatttatcttgaatcgcgaccttttggctcaactttatcctagttttgccgaaggagcaaccccttttttcaccttgaattggtccaaatacgcagaatttcttagttttcgcggagggctagatccaataaccggcggtctatggttgagcgatattgcgcaccatcatttagctattgctattcttttcctgatcgcaggtcatatgtataggaccaactggggtattggtcatggcctgaaagatattttggaggctcataaaggcccatttacaggacagggccataaaggtctctatgaaatcctaacaacgtcatggcatgctcaattatctcttaacctagctatgctaggctctacaaccattgttgtagctcatcatatgtactctatgcccccctatccatacctagctactgactatggtacacaactttccttgttcacacaccacatgtggattggcggatttctaatagttggtgctgctgcacatgcagccatttttatggtaagagactatgatccaacgactcgatacaacgatctattagatcgtgtccttagacaccgtgatgcaatcatatcccaccttaactgggtatgtatatttctaggttttcacagttttggtttatacattcataatgataccatgagtgctttaggtcgtccccaagatatgttttcggataccgccatacaattacaaccgatctttgctcaatgggtacaaaatctccatgctggcgcgcctagcgtaacagctcctggtgcaacaacaagtaccagcttaacgtggggaggtggcgagttagtagcagtaggcggcaaagttgctttgttacctattccattaggaaccgcagattttttagtccatcacattcacgcatttacaatccatgtgactgtattaatacttttgaaaggtgttttatttgctcgcagttcccgtttgatacccgataaagcaaatcttggttttcgcttcccttgcgatgggcctgggcgagggggaacatgtcaagtatccgcctgggatcatgttttcttaggtctattctggatgtacaattccatttcggtagtcattttccatttcagttggaaaatgcagtcggatgtttggggtactataagtgatcaaggggtggtaactcatatcacagggggaaactttgcacagagttccattacgattaatgggtggctccgagatttcttgtgggcacaggcatcccaagtaattcagtcttatggttcttcattatccgcatatggtctttttttcttaggtgctcattttgtctgggccttcagtttaatgtttttattcagcggccgtggttattggcaagaactgattgaatctatcgtttgggctcataacaaattaaaagttgctcctgctactcagcctagagccttgagcattatacaaggacgtgctgtaggagtaacccattaccttctgggtggaattgccacaacatgggcattcttcttagcgagaattattgcagtaggatagtggctaggaggatttgaaaggcattatggaattaagatttcccaggtttagccaaggcttagctcaggaccccactactcgtcgtatttggtttggtattgctaccgcacatgatttcgaaagtcatgatgatattactgaggaacgtctttatcagaacatttttgcttctcactttgggcaattagcaataatctttctatggacgtccggaaatctgtttcatgtcgcttggcaaggaaattttgaatcatggatacaggatcctttacacgtaagacctattgctcatgcgatttgggatcctcattttggtcaacccgctgtggaagcctttactcgaggaggcgccgccggtccagtgaatatcgcctattctggggtttatcagtggtggtatacaattggattacggaccaatgaagatctttatacaggagctctttttctattatttctttctaccctatccttaatagggggttggttacatctacaacccaaatggaaaccaagcctttcgtggttcaaaaacgcggaatctcgtctcaatcatcatttgtcaggacttttcggggtaagttctttggcttggacaggacatttagttcatgtcgctattccagcatccaggggagagtacgttcgatggaataatttcttagatgtattaccctatccacaggggttgggaccccttctgacgggtcagtggaatctttatgcccaaaaccccgattcgagtaatcatttatttggtaccactcaaggagcgggaactgctattctaactcttcttgggggattccatccacaaacacaaagtttgtggctgaccgatattgctcatcatcatttagctattgcatttatttttctcattgccggtcatatgtatcgaactaacttcggaattgggcacagtatcaaagatcttttagaagcacatactcctccggggggtcgattagggcgtgggcataagggcctttacgacacaatcaataattcgattcattttcaattaggtcttgctctagcttctttaggggttattacttccttagtagctcaacatatgtactctttaccttcttatgcattcatagcacaagactttactactcaagcagctttatatactcatcaccaatacattgcagggttcatcatgacaggggcttttgctcatggagctatttttttcattagagattacaatccggaacagaatgaggataatgtattggcaagaatgttagaccataaagaagctatcatatctcatttaagttgggctagtctcttcctaggattccataccttgggcctttatgttcataatgacgtcatgcttgcttttggtactccagaaaagcaaatcttgatcgaacctatatttgctcaatggatacaatcggctcatggtaagacgacatatgggttcgatatactcttatcttcaacgagcggtcccgctttcaatgcgggtcgaaccctatggttacccggatggttgaatgctgttaacgagaatagtaattcgcttttcttaacaataggacctggagatttcttggttcatcatgctattgctttaggtttgcatacaactacattgattttagtaaagggtgctttagatgcacgcggttccaaattaatgccggataaaaaagattttggatatagttttccttgcgacggccctggtcgcggcggtacttgtgatatttctgcttgggacgcgttttatttggcagttttctggatgttaaataccattggatgggttactttttattggcattggaaacacatcacattatggcagggcaacgtttcacaatttaatgaatcctccacttatttgatgggatggttaagagattacctatggttaaactcttcacaacttatcaatggatataatccttttgggatgaatagtttatcggtatgggcgtggatgttcttatttggacatcttgtttgggcgactggatttatgttcttaatttcctggcgtggatattggcaggaattaattgagactttagcatgggctcatgaacggacacctttggctaatttaattcgctggagagataagcccgtggctctttccattgtgcaagcaagattggtgggattagctcacttttccgtgggttatatattcacttatgccgctttcttgattgcctcaacatcaggcaagtttggttaatttagttaattttgttgtactgtatcagcacctagttcattactcttgatggagggggaggatccgccttcttagatttctttttctatttatttttccatctaggattagaaccgtatacttggtagatagtaggaacggcacattatggcaaaaaaaagtttgattcagagagagaggaagcggcagaaattagaacagaaatatcatttgattcgtcgatcttcaaaaaaaaagataagaagcaaagtttaccctttgagtttgagtgaaaaaacgaaaatgcgagaaaaattgcaatccctgccacgtaatagtgcaccgacacgccttcatcgacgttgttttttgaccggaagacctagagctaactatcgagactttgggctatccggacacatacttcgagaaatggtttatgcatgtttgttaccgggtgcaacaagatccagttggtaaggataaaataccctttcgtatttgtatggatttctggaattgatgatcgtagaagagccctctttaccattctgtataaatggactattctatttgtatagatatggtagaggggcgtattcaaccccccttttatccactagttcccctctctttagtttaacaggatagaacagtttggtagctgacaaggctcataaccgtggggttgctcgattcccactaccccgnnnnctcatattccttctttatgatatatgcatcatacatttgtatatgcatttgtttttctttcctaaaagagttttggtctaacagttttttctcttggtccgataaaaaatgaaaagaaagaagaaaatatgaaaaaagcgtccattgtctaatggataggacagaggtcttctaaacctttggtataggttcaaatcctattggacgcaatcttatttctatctattctttaaataactatactaaaaactaagaaaacttttttgcatgattcaaatgaaaaatctttctcaacgatttctcctctactacttctactaacaagagtagacgtgcaaaatttatgtttgttcctgaagggaaaaccgttcgagttgttcctgaatagcttccttcaaaaggatttccgcttcctcggtgaatgtcttgctagaagatataatttcttggaattgaggtttagtatcttttaggtgtttacgtaactcatccagaaatttctttacctgtccaatttctaaggaatcaagatatcctcttgttccgatataaatagtagctatctgctcttccactggaagaggatttgcttgggattgtttaagcaattctcgtaatcgtcggccccttgccaattgattctgacttgttttatcgagagcagaggcgaattgtgcaaaggcttgtaactccgcgaattgagctaattccaattttgatttgccagctacttgtttcatggctttaatttgagccgcggatcctactctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccagattgagtctcaactattggtaaagcagtcatacttcccttccctaaaagagaatttaatttagcggctctttctaaaaggcgtgaatgcaaataaaaaacatcccctgggtaagcttcgcggccggggggtcttcttaatagaagggacatttggcgataagcttgtgcctgtttgaagagaacatcataaattattaaagtatgccgttcgcggtacataaaatactcagccagggctgctcccgtataaggagcgaggtattgtaatgtagcaggggaatccgccatttcagctcactacaatagtgtattccatggccccctcttcatgaaaagtagttactacttgagctacggaggatgctctttgaccgatagctacataaacacatattacatcttcccctttttgattgagaattgtatctgtagctactgctgtttggccggtttgtctgtccccaataattaactctcgctgaccgcgcccaataggaatcatcgaatcgatagcaataagccccgtttgaaggggttcatatacagaacgcctggaaattatacccggagcaggagattcaattaagcgagattccgaagctacaatttcgcctctcccatcaataggtttagccagagcatttataacacgacccaagtaagcctcgctcacgggtatctgagcaattcttcctgttgcttttacaaaactgccctcttgtatcatcaacccatcgcccattaatacaatcccaacatttttggattccaaattcagagcaatacccctagtcccttctgcaaattcgactaattcgcctgacattatttcaccaagacctataatacgagcaatcccatcccccacttgaactacgcgaccgatattctcaatccctacttttctattatattgttcaatacgttcgcggagaattttatgaatttcgtcgactcgaagggttgccattagtgtttctttactatttttttttcggaagcaaggggaaaaataatgcctaaattctaaaggaaagtagaagttcaaggcctaattaatttaactcttccattccatggccccgagaatgctaatattagcacgaatcgtacggaaatgtaactcggtattcaaacaactattcagagttcctagagctccttgtacggcttgttggaaaacccgttgtcggacctgattcatcgccctttgtttttcaaaataaagggtttcgtttttagacttttctaattgttccaaactaatagaagtggcattaatcaaatttgctttttctcgttctatctcagagtatccattcattcgatactcatccgcttctagttcgactttctgtaatcgaattcgagctttttcgagctgctcaatggttcctctacgcaattcttccgaatttcgaatagtactcaagatcctctgttttcgattatctaataaatcttttaatgaaagtagattaccttgctattaagtttacaacttttatgatctcttcccgaaccaaacatgaatctttcgattcatttggctctcacgctcccttttttctttttttgctatggctacttccatattttttttaatgtaatgagcctatcctctaccctctcttttctgtttatatttcaatataccgaaacccatataagactagataaatattaagaggactcttccgcctagataaaaatctatcgtgggcagcaaagttgtttttttatttgtatttgccctttagttaaaattttcaatttcattaagaaaaactaaatagaaaaatggaaaatgaaaatggatagaattcctacttttttcttcaaatccaaaaactttctccttttttatacataggtcgtcgattcggcattggataaaaaagggcagggtgccccttctagtaaatagttcaaaccattttatcgatatgagtgttctatatcagataaattctacattagctatttcctgtttaaagcatttggtactaatactaatatagttgtagaaagagtacccccttttgcctagacttcaagcagtttagctttaaccgtgttaatggtctcatattattggtctatagagaatcaaagttgatttgatttaccaataggtcgcgaaatgctatggttctttcatatgatttctgcatttattcagaagtaattcgtcgagatcgtgcacccttttcttatttattcgaaaaatactaaaaaatattctaaagtgcagccggatagatccaatctattcttgaaatagacaactcgcacacactccctttccaaaataaatcaatacaccaaccactacagttagatttattagatttgttgctaaaatatcggtattaagcccgaaactcccagcggatggccagtgagctaaaaaaacgaaagaatgggttacatttttcatatgctctcctcttatagataggacgaacaaagaacaaagtttttcgatcacttacttcgctcgccctttttgatcggtttttttaatgcaattttttttaatagaaatagattcaatttagtaatttcttttagattaagtcttagatctcgtttgacctgtgaaagacctcctttgttgaaatgttcccaaaattcctaaaataaaaggaaaaatactttccactgccctaaacaaagggcgggaagcaagacggcgaacatatcctctaaattgatcatcctcaaatcagctattcctggggtggggtattgtctgtccccataaatagaaaactctaggagtaataaattaggagtaaagtattgatataattggaattgcagaagcaaataccaatttactaaaaaaagaagaaagtatctaatctaaaggactcgttttcttttttaggattaaacaaaagggttcgcaaataaaagcgccagtgccacaactagtccataaattgttaaagcttccataaaagctagactaagcaataaagtaccgcgtattttaccttctgcttctggctgtctcgcaataccttctacagcttgtcctgcagcagtaccttgaccaactccaggcccaatagaagcaagacctacggccaatccagcagcaataacggaagcagcagcaattagtggattcatgatgagttcctcgtgtcaaaaaaaagaaatggttaaggatacaatcaaccaagaaattcatatttctaagctctattggacagaagtaactaaaaagtacaaattgaaacgataatctgaattctccgaactgcttcgagatctcctttttagtttctaatcattagaggtttgtgtactcattattctatttctctttctttccaaccaactgatctttcattccatccttctttctttcctcttcgatatccttgagtttctattttttcccctatcatctaattcataataaaaggtgaaatagaggaagaacccctatggaaatcgacctaatccagatccaataggaattaaatcaagatatccaattgataacaatatgctgcatcgaattggatatggaatccgattccatatatcggattagataatgaatctaacttgggaatatataatatcccatatcaatttgtttcttctattttgtttgtgtattttctcattttctattgaatcggattcaaaaaaaattccttaaagtggaaacccatacaaaagatgactgaacttatagacataaaggatatagatctagcctgactccgcccctccctaatgcctatatactttgtttggcaattccgtaatatagcctattctctcttctacaactctagattgtatattcatacgcaattctaactattttgttttccaaccaagcgaattttccgcaaccatgcatgaattgagttaagctaaaaaaaagactattttgaaaactagtcaattcaatgatgaccctccatggattcacctatataggctgcggctaacgttgcaaaaataagagcttgaataccgcttgtaaataatccaagaaacatgaccggtataggaactactaaggggactaaagaaacaagaacaacaacgactaattcatccgccaatatattcccgaaaagtcgaaaactaagcgataatggttttgtgaaatcttctaatatgttaattggtaaaaggattggagttggtttaatatatttctcgaaataactcaatccttttttgctaagacccgcataaaaatatgccgctgacgtgagtaaagctaaagcaacagtagtatttatatcattcgtgggcgctgctaattctccatggggtaactgtataattttccaaggtaaaagagcacccgaccagttcgaaacaaaaataaaaaggaacatagttccaataaagggaacccagggaccgtattcttctccaatctgagttttgcttaagtctcgaataaactcaaggacatattcgaagaaattctgaccatcggttgggatggtttgtggattgcgaacagctatgataactgaacctagcaagatagtaattacgacccaagaagtgataagtacttgggcatgaatttggaaacctcctatttgccaatagaagtgttggcctacttctacgcccgatatatcgtataaccccttgagtgttttaatggaacacggtataatattcatattgtcccctgataaaaaatgaacttcaaaaaaagaattcttttgattcaaccatctttttctcaactcagcaacgtgaagtattaatcttatatttaggatatcaagaaatcacatcagatgataatatatatcaataccctctaatatatatcaatattccccgtcttttttctatgcaaaacaaaaaagaatagtaagtgattccataaatctacgcagttgcccaagaattaactattcttcttaatcaatgatttcttatatagagagaacggccctcacaaattgcaaatactaatttgttaagaatcaatcgaattgaagtcatagtgtcatcgttggctggaatcgatatattcgcgagatctgggtcacaatttgtatcggctaaagaaatagtaggaatccccaaaatggcacattcccgaagagctatatactctttttgctgatcgaggacgatcacaatgtcaggcaacctcgtcatatatttgatcccgccgagatatctttgcaaggtagataattttctcttcaagattgccacatctctttttgggagatggtggaatttttccatcttttcttctgctcttaagtctctaaattgagaaagtctagttttagtaatcgaccaattcgttaacataccactgaaccactttttattaacataatgacaacgagcccttattgcagctgatgctactaaatccgctgctctttttttggtaccaacaattaagaagctttttccctgacttgctgcatcaaaaactaaatcacaagcttctgataaaaaacgggtggttctagcgagatttgtaatatgagtacctttacgctttgccgagatgtaaggggccattttaggattccatttcttaataccatgaccaaaatgaactcccgcttctatcatctctttcaaattgatgttccaatatcttcttgtcattttttccacacttccttttgattttttcttttttttcatcctacctttccattacgaaatttctttcttttcgaagattaagaaagagccgaaatagcttgaaataaataataattgttccgatggaaccttctacatggtataagcataaccttaatgaattaactaaacttctttttaaattaaaataaaaatagaaaatctaacctcttagcgttctaaggtcaaaaatctagtttaaagtaaaaaatctgctttatgtatccttaaatcatataaatggggtaaatggtgattctgatgtctcatagaaattgtttgttacgtcagaatcagaagaaactaattctgtatggagaaacaaaatatctctcatttccgacgcaaatagtttttttttttgaatttcgaaataaaggttcttgttttgtgggtaacggtgcacaaatttttggaatccggtaccaacaggtataatcccccccagaactacgttttctttcaggcctttcaaccaatcaatacgacctcgtaaggcagcttttgctaaaactcgagcagtttcttgaaaacttgcttcagatatgaaactttgggtattcagggaaacccttgttattcccaataagattgcccgataatagatcgattcatccaaagcccgccctgctcgctctgctcgcaatagtccaattaattccccaggtgaaaaaacattagacattccatcttcggaaacccgcacttttgatgttacttggcgtataataatctctatatgtctattatggatctgtaccccttgggatcgataaaccttttggatcttattaaccaaagagatacgactttgggctatggttaactcagctccaatcaagaatccccaaggacccccaagaattcttggtatacgctcattccaatcctcaattctcctttcgagattcggcgatagtgaatcaattgaacgcgcttcgaagatttgttctacttttggaagaccttgcgttatgtcactagatctcgctttttcgtatataaacgtaactaacctatcccctttgtaaaggatttctccataatgaccatgaacagttgctcctgtagtggccaaataaggcttagctgctcttataacaaaggaatctatatttacaatgaaaatttgacctgatttttttatgtgcgatttaaatagacatacattttcgcaaataaattgtccaaggtgaatttttgctgatgtctcttcccaagaatcatgagggagaaagtgccaatttaactggaatggatccaacatgatgttactatcgaaatttgaagtcctttgattttcatttattaaagagtgtttaagtccttgaagtactttgaagttttgtttcaaattgtcaaggagcaaatgcttttttaacaggatctgattatacgttagtaaatagtaagatgaagaaaaattcgatatactaggtgcaatagtacctaagagtcccgaaaaatttcgaaagagcccccaaaattttggaataggaattctaggattcgattcttttaccccattgggattttttgaattcttaaaaaaaccaattcgagaacagttggatgccgacaaaaccatcaaagattggtattctttatttcgattcaacaaggtaccaatagcttcttgatgttggctaagtgattgaatcttcgccttggaataaaaggaattggtattggtgcgatctaacctattatggagaatcagtcctgcacttctgctatcatacctttttcgtgtatacgaaatagtggatttgattaacccaattcttaggaaatcgcgaatcagaccatttgctcttatctcaacaagggaagcacgagcctcctctttttcttcttgttcccaattcaatactaagcaagttcgaacgaattgactattcgtatgataaattctttgagttaacttgctattttcatgagaaataaaattgacaagtcgaagttggagattaccctcttcctgcaagagatcctgtgggaaaagtgttgctaaatttctcccttcgttcatttcatacgcgactgcaggtcgaaccaaaacaaaatacttttccttgctcttgagaatttttttccactgaacatagacccaattttcccttttttttgattccttcgaatcttttttttctctttctagtggtatcaaactgccacctaatatcttatccgcctcttcaggaaaatgaatatctccagaaaagatttttagttccgtatggcttttttttctcttcactcgaaccaatccacccagccgacttcttgtattttttgtgagttgtgtatccactccaataatactattgtcaagtacctttagggatgaggatctcggcaagatatgcagttcttggagaatgaaaaaaaaccgatctacttctttttggtattttagactaaattcttttgttcctcgatgctcaatcaaaacccccttttttaagacggaatcttcctccgggttcccatattcgtcctctgagtcttcctctgagtcttcctctaaagtcccatgttcgtcctctgagtcttcctctaaagtgccatatttatcctctcggggcctatatttgttctctggactcccatattcgtcctcggattcctcctctcgagtcctatattcgtcctctaggattccatattcatcttctagggtttcatattcgttctctgggatcccatattcatcttctagggtttcatactcctcctctcgagtcctatattcgtcttctagggttttacattcttcctctcgggtcctatattcgttttctgggctcccgtattcgttctctgagtctttctctcgagtcctatattcgtcctctagggtcctatatctaaatttaacaattcctgaaccctttttatcttttttgtatcgtgggtcgtcaaaataagcaactatagtatttctacgtaaaacacccataaagggtatttcaatcgaaatcccaaaacaggatattggttctttctcttgttcttgatgatactgtaatggaatggcgaacctatttcttcgctttttcgctaacaaatcaaaattattttgaagaatagaaggatagacaaaattccaatgaccattggacatgattcgatccggcgttgaataatcaagaatttccctatcttttttaccaaaagtatccaacagtctatgtcttacctcatcatcagccatcgagaggccaaagatataccttccgtcaacagaaaaggaataagtattcatttgatcttgatccttgtggagcgaaaaagaagctatactagatctgcacatacttactgacaatatccataaatggcttgtttttggtaatcgacgaagattaccatattgatattcgggcgcatgataaacatcggtactccagtgcatttccccatctgattcggaataaatatgtttttgtaccttttctttaaaatgcaaagcggacgttccggcacgaatctccgcaattacttgttcggattctacatattgatcattttgcactagaatcaagctttttgaaggaatagtcacactatgtagaatatcctgactctgaatagttatatgcaagtctatataacatagaaaagcaggctgcccatgacgggtacgtgtggggtgaaccaaatccccattgaattggatttttccatttgaaggggatcgtacaaggtcggcagtaccccctgtgaataccccaccagtatgaaaagttcttaatgttagttgagtccctggctccccaatagattgacccgcaataacacctacagcttcccccaattcgaccagatcgccatgagtggaactccgaccataacataattgacagatccaagatgtgctccggcaagtaaagggggttctaatatatattggttgtgctcgaaatggctgtgctcgaaaggtggttatgaatcgattgactaacccaattccaatatcttgatttcgagtggcaatgcaccgtgaaccgatatatatatcgtttgctaatacacgaccaattaatgtttgtacaaaaagtttttccgtcatcccattttgaggactcacagaaatagcttggatagtaccacaatctcttctacgcacaataatatgttgaactacttcaacaagtctacgtgtaagatatccagcatccgccgttcgtacagcagtatctacaacccctttgcgggctccgtagcaggaaattatatattctgtcaaagaaagtccctcgcgtaaattgctttgaataggtaaatcaatcatttgtccttgaggatccgccattaatcctcgcatacctactaattggtgtacctgcgatgcatttcctctagctcctgaaaaagacattagatagactggattagaaggatctgttatccgaaaattcgaattcatttcgtgtttcaaatattcacttgtagcataccagatttcaacggattggcgtaatttttctaccgcgtgtacagccccataataatagtgtttttccaaaagaaaactctgttgttccgcatcttggactaaccatcccttagagggtattgttaaaagatcctcgattcctaatgaaatcgatgtagtagtggcttgatggaagcccagcgtttttatttgatccagtatatgggatgtatatcccattccgaaatgatctattaatctgctaataagtcgtttcatagcagttccatctatctctttattctgaaagaccagattggcccgttccgccataaataagtaccccctttttcggctgagtataattcgacaattgctgagtaggattcgacaatgggcctgagtcagtgattcgaaaacttagttaacttcctttcctcaatctcaatctggattcgtgcggcaaaaatgatgatactagcgaaatcggaatgcccctcgaaaggggcatccccgaatctaacttccttgtttagatagtgtatgaataggcctgactaaatccttgtatggcttcctctatttctctataaaaagaaatatgaccaagagtggtgcgaatgtatatagaacggatttccttttttctatttcccactactagatagtgggcataaatctcacgataagtccccaaagattcatattgaacttcaatcggaacttctcttaacccaatgacgcgttgatctagtttccatcggagccacaagggactgtctaaacagatttgtttctgtctataagctcccagtgcatcataggaactagaaaaaagagattctttatctttcgtatacttaggattattattattgtaatttactttttggtttggatagtttccgcaactattatatctatttgcacaaatacctcgacggtttccaatcgttaatacataaagtccgataagcatgtcttgggttggtacgcaaataggatccccaatagcgggagataggagattcatatgagaaaacataagtaaacgagcttccgcctgagcttccaaggataaaggtagatgaacagccatttgatccccatcaaagtctgcattgaaacctttacacactaatgggtgtaaacaaatagtacgcccctctactaaagtgggttggaaagcctgtatgcctaatctatgcagggtaggtgctctattcaacagtacaggatgtcccctcataacttcttgaagtatttcccatacaatgggttccttttcccaaattttccttttagcaatcctaacattagaagtagcacgtttcgtgattaaatcgcgaattacaaatagctgaaaaagctttattgctatctctagaggtaacccacattgatgtaatgaaagtgaaggacccacaacaatgacagaacgccccgagtaatcgacccgtttcccaagcagagtttcgcgaaacctcccctctttaccttcaattacatctgaaagtgatttgtatactttattgtgaccatccctcgttggttgcccgcgggacccactatcaagaagtgtatccacggcttcttgtaccaatttttcctggcacattactaaatctgctggcgctaattcacttctttttaatagataggcaagattgttgttccgacggataactctcttataaagttcattaatatccgaagtcactactttatccccagacctataaacaatgggtcttaattcgggaggaagaactggtaataagcacaaaaccatccattctggttctacatttgtttgaataaaatgtttcgccaattgcatgcgtctaatcaaaaaaacttttcttattcgtctttttctatcttcccattcatctccactatacccctcgtcttctaattccttccattcgaccgaggaattctctaaaataattcgcaaatccaaatctgctaattgttctctaatagcacctgctcctgtcgcaatttcccgatttcgaaatgttgtaaagcctggggtagaaaaaaagggggaaatgctatggttacaggatgaaatttcatcctcgaataaacctcgtaatcgtaagaaagttggttttttagcactgggcctagcaaaagagaaatcgccatatactaggccctccaatttcttaaggggtttatctaaaagattcgcgatataactaggaagaccttttaaataccacacatgagtcacgggacatgcgagtttgatgtatcccatttgatatcttcgtatccgagaatcaacaaattctactccgcatttttggcaaaatctttcgtcttcgttttcagctccgctcgctcgagaatttccacaagcacaaattctgctttttatgggtccaaagattctttcgcaaaacaatccatctttttctggtttatcggttttataatgaaaagtggagggccttgtgacttcgccaacgacttccccattaggtagtgttttgttagcccaagcctttatttgttgaggggaaacgagtccaatttgaagttgttgatgtttatattggtcaatcataaaatagaaataagaaaagaatttatatttattccgatcaaacttcttccctattaacctggaagttcttctgagatacaaggaaatggttcagttctagagccaaagatcgtagttctcgaacaagcactcgaaaagattctggaggatcctcgtgattaggtactcgttttccccagatcgtagcgttaagtatttcttggcgagctataagatgatcagatttataagtaagtatctcttgtaaaatatgagcaacaccaaatccttctaaagcccaaacttccatttctcctattcgttgtcccccttgcttggctcttcctctaacgggttgttgtgtaacaagtgaatagggcccagtagagcgtccgtggattttctcatcaacttgatgaattaattttaagatataggacttccctattagaacaggctgttcgaaggggtctcctgttcttccatcaaatattctgctttttcccgggtactcgggttcaaatacccacggattttttgtttgtttactggcttcatataattctgaaaacacaagttttcttgaagcctcttgctcatatctctcatcaaagggtgctattctataatgtttctttagcagatcccctgctaatccgagcgagctttcaaatatttgtcccacattcattcgggagggtactcctaagggattgaaaaccatatcaacaggcgttccatcttgcaaatagggcatatcttgcctaggcaaaattttggaaatgatccccttattcccgtgtcttccggctactttatccccaactttgatttcgcgtttttgtaaaatatatacacgaaccattatgtcgaggggatccctctggatccatttcacatcgataacgcgtcctcttccacctatcggtagtttgagagaagtttcttttgaagtggatacctcaagaccaaatatggcccgtaataatccagcttccgcgatataggacgattcgctcgctatctgaggcgttaatttacctactaaaatatcgcctgtttctacccaggaccccaacttcacaactccatttctgtccaaattgcggagtaaatgttcttctagatgtggtatttctttagtgattttttcagcggagccttggcttgttgtatccgtctgaatttcatattttcggatgtgaaaagaagtataaatatcctcatataccaaacgttcgctaattaatactgcgtcttcaaaattgtaaccttcccatggcatataagctactaatacgttttttcctaaagcaagttccccaccaaccgtagcagccccctccgctaaaatttgtccttttttaatggatttaccccgcggaacccgaggtttttggtgcatacaagtatttttgttagagcgccgatgggtaactaaaggaatacttatagtcttcccactacttgataaaaggatcttgtgactattagtagaaatgatctttccctcgcgttcggctataacagaaaccctcgaatctagagctgtttggcgttccaatccagttccaacaatgcacttctcggaccgagaaagcggaactgcttggcgctgcatattagaactcattaaagctcgattcgcatcattatgctcaataaaaggaatgagagaacccccaatagaaaaatattggaaaggaaaaatacttctaacatgaatctgttcccatgcaatagtcaggaattcttgacggtatctagctggaacaacctgttcttcctgaataccccgattcaaggacaaagaatttcctgctgctatcatataatactcatctctatttggtgataaataaaccacctgtctctctttttttttctttgctttctcagatatttcataaaaaggactctctacggatccccaccaatgatcaattctcgcatgaatagctaaagatccagtaagtccaacgttgattccttcggacgtgtcaattggacaaatacgcccatagtgactcggatggatatctcggctccgaaaacttgcagttctccccgtcaatcctccaggacccaaacaactcacttttcgcccatgaaccgtttgtgtcaatggattggtttgatcaaaaacttgagataagggatatgtaccaaagaaggtctcgtaagtagttattaataaaatcgaggttgaagttggagttaccaaagtttgtggagtcggttttgattgacgtatgaatactctacggatagttttttgaaccgcatgttgtaaacgaccaagagccagtccgaattgatcttgtaacagatccgcaaccgaacgaatacgtttatttttcaagtgattcatatcgtcatcgtcaagtatacccgtttcaaatttcattccaatcaaatgatccgtagcggccaatacatctcgcggtaacaagaaggtgctgttctgaggtatatcaagattcagtcttcgattcatatttcgtcgaccaatccttcctaattcacatttttgttgaaaaaatttcttttgtaattcctcacataaggattccgaaaataccaggtccccacctacacaagcaaattgttgataaaactccaaaatagctttttcttttgactcaatcctcttcttctccttagcattagggaaagacaagaaaatttcagggtaggaaacattatctagaatttcttttagatttgaacccatagctgatgatagaactagaatagatatcttttgttttctactcacgcgagcccatatcctttcttttttatcaattgctaattccgatcttcctccccaatctgatattatagtcccggtgtagatagaaattcctttatggtctaattccgagcggtagtaaataccaggacttagcaatatttgattgatcacaattcggtatattccatttattataaaggttcctaaggaattcattataggaatgtttccaatagaaatggtttgcttttgcacatcgaaaccaaaaattaatcgcgcggatacgtataattcggaagaataggtgagtgattcatacacagcatccctttcttttatcgaaggttctagcaattgatatcctttcgcaaataattgaaatgaaatttcgtgatctggatctttaattgttggaaacttctcaagttcttctgccaagccttgattaatgaacctacaaaatccctcgaattggatctgactaaatccgggtattgtggacattccctcatttccattccggagcatcttaatcttaagtttcctgtttatcgaagaaaaattccattatcagctcactcttcatcaatccctacagatcgatctagcaattatggaatctatattctgtttactaaatcacatgaaattctcgggaactccacatacgtatttcatatatgtatttcatacatatgaatagagacaatttcaacgaaagttcgaatttcccaggggtccaaatggaatgaaaatgaagtgataaaacattcctagaacctcgaaaaaaattctgccacttacagtttatgatattcttagattggacggcaaagatttctcattttttctcctttctatgaatgggataaaaccaaaatataataatttataagcactagaaagtttgactttagttcgattgagaatagcacgcttagtttaatttcaaaaaagaatttgaaggttcttttttgtttcgtagtagtagaatttctataaaatataagatataagatttcgttgtagaatcctaaaataaagtaagtacttttttaagtacatgccaatctagttctggacctccacatagcaaagtcaattttcttttttttattcaagatatttaatgcaatgaaaaattaaagaacgattctccacagagatatgtacataagggggatccatagataataatgctgttcggacctggagtttacctatatacggattaggcataaatccattgtcttttattatgacattaaatggcaggcgggagagaataccgaaattcaaaataaaaagagaattctagttaatggttccaatttgttcttaattttgtagcttgtgactagaaatccacttttctcctttttcatttcaatagaaagaaaagggaagttttctagtgttagcaatgtgtgttttaagatagaatcctttgaggagaataatcgaaactggatccaaaaaaagcatgaatagattttttgaaaaagattggaaaaaagtaagtagaattagatttaagataaaagaaagttagttttagtaagaaacgtggatgaatacttgctcttttctcgattttagatcgtattttttggcggcatggccaagcggtaaggcaggggactgcaaatcctttatccccagttcaaatctgggtgccgcctgatcaataaaatacttaggcttatagtactgatccaaatcgacaaatttgcaccccgcataagttggggcaagagaataacaaggctcggcgatactggattttgagaacccaccgttctttcctcaaactggggtttgttttagcagtagtggcccaaaccgataccaatagggatgagatagcgtttccttattcttttattaataagaaagggctatgtatcatatttatacttaatgctccccaattctaccagaaatactctaagaatttgttaagagtaaattctttgaactgattcatccatagccttaggtcagaacccctttttgactctgtacccttgattctactatgattattcatcaatagtagaataattccttcatagaaataggagacataatttacatggatatagtaagtctcgcttgggctgctttaatggtagtctttacattttctctttcactagtagtatgggggaggagtggactctagggatactactaattgattgagtagtcgaattgttgtatcaactcttttctttaattgaccgttttgcattaatcattttgccgaactttattctttctctctttctttaattttgtttcactcctgtaagaaactcttgtaagaaagagtctttctattctttctatttctatttctatatagtagaatagaaatagaaagaatagaaaatagaaatagaaagagcggtgagagcaattcataatcgctactagaagcgacccatggttaaaaaagttctatacataagaactttagattttcttccgcggagctattcccaacatatcgcacattttccatttgttttatattcttttcttattcttagttcttaaaataaattttatgctcttttgaaacatttcgcgacatgtttaagcatgaaagattcgctggttttttccttttactttttttcttttactatagtctattctcatattatttttctctccctccatggattttttcattttgacttgattgaaattaagtggatgcagtgaaaaaagaaattgaattagactactatttcaatctagtaatctattctatgtagattcaagataatataatagaaagactctaaagtgtggtagaaaaaactatatgtagttttttctaccacactttatgattccaaccggatcctttcatttaagacttggatttttattttatttaatccctttttcatttcttcaatgattaattgaacttccaattaatcattttggctgactgtttttacataaataataagtaaaaaggcagtaggaactagaatgaacaatgcagtagcaataaatgcgagaatattgacttccataacctcttttttttcgcaataactcgggatgtaatcccatggagagggaaaagggtatcctgtaaattcaaggggaggacttgcattctgataatactgaatcaattcaatattatgaatatcggatctatcaaatcaattcatggttgagagtggaatagtataacataggaggatcccttccacgtatgatatgtatgtctttcgctatcaaccagaagtagtgataannnnnnnnnnnnnnnnnnnnnnnnnnnnnnnnnnnnnnnnnnnnnnnnnn

SEQ ID NO: 37004 - DNA, 1232 bp, Oryza sativa
caataaatgcgagaatattgacttccataacctcttttttttcgcaataactcgggatgtattcccatggagagggaaaagggtatcctgtaaattcaaggggaggacttgcattctgataatactgaatcaattcaatattatgaatatcggatctatcaaatcaattcatggttgagagtggaatagtataacataggaggatcccttccacgtatgatatgtatgtctttcgctatcaaccagaagtagtgataaaaaaattcctatactctcctctctttactgagaaacgcgaactaaaaaaagtgaaataggggtaccccataggtatttgatcttgcttcctgccccccttttttcatggaaaaaggaaagatgaatttctccattcattgaaccctagttcgggactgacggggctcgaacccgcagcttccgccttgacagggcggtgctctgaccaattgaactacaatccccgcggggcgtatggcatacttattcttaaatggaaccataagaataagaatattcgcctgtcctactctaagaaatagacgaatcatatactacatacccccgtatcgtatgggggtatagtgagaatgacataactagtatgtcgcgatttattatcgctaaaaatagataataatccacctttcaataaccaataagaaaaggtcttttgtttgtaagagaggaatgaaagagatatagattagaaagatatttccccttttctttttatcctttatttcttttatttctatggatcaaatattcttttttatggaagaaaaaaaatggatttaactcatattcacgaagccctagatttttgggccgagctggatttgaaccagcgtagacatattgtcaacgaatttacagtccgtccccattaaccgctcgggcatcgacccaggaagaatttattctagggtttttgataatctatgattaacctcctttcataatactccctacccccaggggaagtcgaatccccgctgcctccttgaaagagagatgtcctgaaccactagacgataggggcatcactagacgatagggcggtatacaaccgctcctcattatactataatgatagtatgagcagttttttggaattgtcaatatactcgaagagtataactagatcctaaggcaggagtccttcctacttttccattatgcttttgtaggattttttttagttgatggtt

SEQ ID NO: 37005 - DNA, 735 bp, Oryza sativa
  unsure (1)..(735): unsure at all n locations
gaaacgtctccagattgagtctcaactattggtaaagcagtcatacttccttcccctaaaagagaatttaatttagcggctctttctaaaaggcgtgaatgcaaataaaaaacatcccctgggtaagcttcgcggccggggggtcttcttaatagaagggacatttggcgataagcttgtgcctgtttggagagatcatcataaattattaaagtatgccgttcgcggtacataaaatactcagccagggctgctcccgtataaggagcgaggtattgtaatgtagcaggggaatccgccatttcagctactacaatagtgtattccatggccccctcttcatggaaagtagttactacttgagctacggaggatgctctttgaccgatagctacataaacacatattacatcttgccctttttgattgagaattgtatctgtagctactgctgttttgccggtttgtctgtccccaataattaactctcgctgaccgcgcccaataggaatcatcgaatcgatagcaataagccccgtttgaaggggttcatatacagaacgcctggaaattatacccggagcaggagattcaattaagcgagattccgaagctacaatttcgcctctcccatcaataggtttagacagagcatttataacacgacccaagtaagcctnnnnnnnnnnnnnnnnnnnnnnnnnnnnnnnnnnnnnnnnnnnnnnnnnnnnnnnn

SEQ ID NO: 37006 - DNA, 816 bp, Oryza sativa
  unsure (1)..(816): unsure at all n locations
nnnnnnnnnnnnnnnnnnnnnnnnnnnnnnnnnnnnnnnnnnnnnnnnnnnnnnnnnnnnnnnnnnncttcaccttaattgttatttgaacaaaaagatcacaataaacttttggtaaaagttctgtcttggtcggagtggggatagcatttctcttctgcatatctatggagttttgcaaaacccaaacacctcagagatagatatagaggtaggaatttgtcgaacgaaccacactccttcgtagacgtcaggagtccattgatgaaaaggggctggggaaagcttgaacccaagtcctacagtgatggatataagcgcaattgaaattcctggggagttatacatttgtgtattgataagaccgttcacaatttcttgaagctcgatctcccccccagatgaaccatatagccaagagaaaccatgaaccagaatagaagagcttgccccacccatgagtaaatatttcatagtagcctcattagaccgtagatctctcttggtatatccagacaataggtaggaacataaactgaaacattctggagctacaaagatagttattaaatcgttagcaccacataaaaacattccccctagagtagctgttaatacgaataacagaaactctgttatagccatttctgtacattcaatgtactctacggatagaggaatacataaagttgaacataataaaataagaaattgaaagatttcgttgaaattgttcgtttggaaatttcccgaaaagctaattataggttcttctctccatcggaacaatagggcccgtatgcttattactaaact

SEQ ID NO: 37007 - DNA, 808 bp, Oryza sativa
  unsure (1)..(808): unsure at all n locations
nnnnnnnnnnnnnnnnnnnnnnnnnnnnnnnnnnnnnnnnnnnnnnnnnnnnnnnnnnnnnnnnnnnnnnnntcttgaagctcgatctcccccccagatgaaccatatagccaagagaaaccatgaaccagaatagaagagcttgccccacccatgagtaaatatttcatagtagcctcattagaccgtagatctctcttggtatatccagacaataggtaggaacataaactgaaacattctggagctacaaagatagttattaaatcgttagcaccacataaaaacattccccctagagtagctgttaatacgaataacagaaactctgttatagccatttctgtacattcaatgtactctacggatagaggaatacataaagttgaacataataaaataagaaattgaaagatttcgttgaaattgttcgtttggaaatttcccgaaaagctaattataggttcttctctccatcggaacaatagggccgttatgcttattactaaacttgttgaagagatgaaatagaaccaaggtctatctttttgatcagaggttaaatcgatcatcagaagaagaattaggccaaaaattaggatacattctgggaaaatgaaacttccctggaagagaagcaaatgaaacgctttcataaaaattctcgtagaatcgagaatgaagttttcattctgtacatgccagatcatgaattagtaactgcatccaatctccgaaaagtcccgattgtttcgatttttggaatgggatatttacggaatccccatgaataggatcaaaccttatt

SEQ ID NO: 37008 - DNA, 435 bp, Oryza sativa
cgagctcggtaccctgtgggcacaggcatcccaagtaattcagtcttatggttcttcattatccgcatatggtctttttttcttaggtgctcattttgtctgggccttcagtttaatgtttttattcagcggccgtggttattggcaagaactgattgaatctatcgtttgggctcataacaaattaaaagttgctcctgctactcagcctagagccttgagcattatacaaggacgtgctgtaggagtaacccattaccttctgggtggaattgccacaacatgggcattcttcttagcgagaattattgcagtaggatagtggctaggaggatttgaaaggcattatggaattaagatttcccaggtttagccaaggcttagctcaggaccccactactcgtcgtatttggtttggtattgctaccgcacatg

SEQ ID NO: 37009 - DNA, 473 bp, Oryza sativa
  unsure (1)..(473): unsure at all n locations
nnnnnnnnnnnnnnnnnnnnnnnnnnnnnnnnnnnnnnnnnnnnnnnnnnnnnnnnnnnnnnnnnnnnnnnnnntttctacagcctgttgaataattttgatggattccctcatttcaccgattcgtactaaatagcgtgctaatgaatccccttctttttgccattggactttccaatcgaattgattgtaagactcgtaaagatcaactttacgaagatcccattgtattccagaagctcgtaacatggggcccgataagccccaatttacagcttcttctccgctaataaaaccaactccctcaactcgttccaaaaaaatgggattctgtgtaataagttgttgatattcaataactcctcgtaaaaaataatcacagaaatctaaacatttatcgatccatccataaggcagatcggcagcaactcctccgatgcgaaagtgggtaccgagctcgaattcgccctata

SEQ ID NO: 37010 - DNA, 3241 bp, Oryza sativa
  unsure (1)..(3241): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttactgagtcatttaagttatagaagaattcctgaacccaagaattcaaaataacaagttcctctttacccagaaaaaaagaaccacttagaatagccaaacagattatatttgtcgagaaatgcaaaatgatatggagatgaccctcattatctattttggccaattgtattatttccttgcgtattcctataggggggttttgtacatgtgtattcggtttctcttttatcatttcgtccaagataaaaaggtcttctaattccatgaatctttctagaactcttttctcttgaatagcagttaagagagtttgggattgcctggtattccaccaattcttaatccaaagttccagacatttgttaaaagagaaagagactccccaaggcaaaagtacgataaatacaagatataggaaagaaggcaatgctttcttttttttcatttttgatctgtaaattgagttgttaatgaatccgctttattcgctgactctatatgatatttctttttctttgaaggaaaaattctataacaaggtttgagaccttgtatctattcctcttttttctatactagtagaatttcattgcattgagttctttcttagatctagatggagtggaatagagaaatagaaaaaagtcctttcggatgaaaatggaagaatattacgccatatatcccacttggacaaattagaagcaattttctcttatcctcatttgttccttcctttagataaatactcaaaatccccttacaataatgcaatttcgaagggaccttttccctcgtgttgagaaaacttttcttcttccaattcttcttcattcaattcatttcaaaaaattcaattggtactcaaaatacttccattggtatgcgcaagaaataagccaattcggcagctttttgttcaatttctcgtggagtaaaaagcttctcatcagtacgagtcaagggaatggccccctggccccggatttccatataaaggatacgacgaggaaaaagaccttctttaacctgaattctaattgattggatatcccgcataaggaatcgaaggaagacgcgacgttttattccagggaatccccaacgaaaaatgcacactactccctcttttctatcgaatcggtcataaccactgcctacattccacaaaatagtgcaccacaagtaagcgctaatgaataggcctgcgattccgtagaaagacatcacgaccccctgtggaaaaaaaagaatttgttgagatggaagtacagatataatattcttaccaagataactggaagccccaaccgctaagaatcctagtgaacctagaaaaagaatacaggcccagaaaaaattacctctttttcgagaaccttttagaagttctatccatatgtgttctgatcgccaattcatattagatatactaacagcggtcgattgaaattgagagaataagctaaatgattttgactttactttttttgattctgaaatcgccttcgccaactagatactcctgtaaaataattggttagatacattgactttctattcaaaaagtatttgttgatccacttaaaaaaactcgctatacccggttccgcatatgcatgcatttatgctcgtagcctatatccgcatccataatccccatccatagcgggtttgcatttgtgtgtagaaagagccacataacataccatattatattacttacactacaaaagatccgtattatgatcctgtgtggaaatacattgagaaaattcggtcccgtcggttctagacaatcttatttttctgcacataaagaaataaagaagccattgcaattgccggaaatactaagcctactaaaggcacgaaaatagagggtaagttaaaatccatcatagaataggtgtctccattcaaatttactatttctatctattcgatttgatctattcaaaaaatatcttaagattcttatgatataattaagtatatctattataacgaatattgactattgtatttttgagtttgcaaaaaaagattttttatagaatactttttttttagaatactttagtattctaaaaaaaaagtattctaaaaaaaaagaatcgaatggattatataaataataagaaaatagcaaaaaaggagaagcaattaaaaagatttgatttttcttttccgatcctcgcggcctttctatccttctaatcgaacttgaaattggattcaaagtacgacttagtcgaatgcgcctatttcgaatccaaaatctttttcgtctacttccttccacatgcaatacttattcaaccactctcggaccccacaaatccgctgtaaggattgatacataggacttttagttgattgatattgccgtaaagttgaaacttttttaggcttttttattaaactgtaatttcctctctgcatacgtgctcttctagaagcatatacaataatgcgcggtaaaggagggaaaatagcatactcaatcaagggacaaattcttttacctactacagatctcatactaccccttagactttgtaaggccatataccacccccaaagggtatgaaaataccggatgaccttagcttttcgacgaatcctcgtctcgtgcagcgaagtcctgttagtaagaccccgcgcaaaaatggattatataagaatataattccgaatattcctccgggtgcgtatagtagcattgcgattccgaatcttttttctttgtgaatagaaaaaattcattgtatcgttgggtcggaggtttgctccagaaaaattcggaacaaaacgtctaccgcgttgaagcccatagccccatggagttccgcgaaagtatgattcttatcatcaggagccttttgaacgtctctacgatgggtccagattctatagcagtccaatctgaaatgaaagacttctcgctcttgatcggagtcgtaaactaaaactacctcttcatcaaggttatagaannnnnnnnnnnnnnnnnnnnnnnnnnnnnnnnnnnnnnnnnnnnnnnnnnnnnnnnnnnnnnnnn

SEQ ID NO: 37011 - DNA, 1828 bp, Oryza sativa
ttagaccttttttctatctaattttatccacttagtctagctatctagtttatctaccggctcgaactcgaatttgatcgctttccatatttcacaagctgcggctagttcaggactccatttgcaagctgatcggataatttcattaccttcacgagcaagatcgcgcccttcgttacgagcttgtacacaggcttctaaagccacccgattagctgctgcaccaggtgcattaccccaaggatgtcctaaagttcctccaccaaattgcaatacagaatcatctccaaagatttcggtcagagctggcatatgccaaacatgaataccccctgaagccaccggtataacacctggcatggatacccagtcctgagtgaaaaagataccgcgagcacgatctttttcaataaaatcatcgcgcaataaatcaacaaaacctaaagtcatttcgcgttccccttctaacttacctactactgtaccagcgtggatatgatctcccccagacatacgcaatgctttagctaatacacggaaatgcataccatgatttttctgtctatcaataactgcatgcattgctcggtgaatgtgaagaagtaggccgttgtcgcggcaataatgagccaaactagtatttgcggtgaaccccccggttaagtagtcatgcattacaataggaacccctaattccctcgcaaatacagctcttttaatcatttcttcgcatgtacctgcagtcgcattcaagtaatgccccttaatttcaccggtttcggcctgtgatttataaatagtttcggcacaaaagacaaaacggtccctccaacgcataaatggttgtgagtttacgttttcatcatctttggtaaaatcaagtccaccgcgtagacactcataacatgctctaccataattttttgcagataatcccaattttggtttaatagtacatcccaataaaggacgaccgtatttgttcaacttatccctttcaacttggataccatgaggcggaccttggaaagtttttgaataagtagggggaattcgcagatcctccagacgtagagcgcgtagggctttgaaaccaaatacgttacccacaatggaagtaaacatgttagtaacagaaccctcttcaaataggtctaatggataagctacataagcgatatattgattatcctccccaacaacgggctcgatgtgatagcatcggcctttgtaacgatcaagactggtaagtccatcagtccaaacagttgtccatgtaccagtagaagattcggcagctactgcagcccctgcttcttcgggcggaacccccggctgaggagttactcggaatgctgccaagatatcagtgtccttggtttcgtactccggggtgtagtaagtcaatttataatccttaacaccagctttaaatccaacacttgctttagtttctgtttgtggtgacatacgtccctccctacaactcatgaattaagaattctcacaacgacagggtctactcgatatggattaggcgtaaatgaaacctttgcaaaaatcttaaaaaaaagatattcaattaatatcaactcattaaagaaaatggggggcatgcttaagttaatgaatatgtttcattcatataatatgtttcattcatatataatgggtacaccctgtgtacattctatgctataggaattctactataggaattcgataagaattgagttgttgttatggtaagttaacatgcttcgttattaaaccatggatttgattcaccaaatccatctttattgtatactctttaatagatatagcg

SEQ ID NO: 37012 - DNA, 1587 bp, Oryza sativa
  unsure (1)..(1587): unsure at all n locations
aatagatatagcgcaaccccaaatcaacttctaatccttattagttcttaatagacccccttttcttattttgagtggaaatacctaaatactacgaaaattctctgttgacagcaatctatgcttcacagtagtatatattttgtatatcgaagtcctagataagaaagtagagtaggcacaaatcgtttacaaaaggcaaaatgtatatgaaaaaaagattgattgaactttccgacgggctcattccatgagtaaacgattgaatgggattcgtttgggcaacgaaatcaagtgctggtccccttttctctcttattgaattaactaattcatttccttttgacttttggatttttggatatttttttggtgttgatttggcattattcaacaagaaaaaaatcaaaatttcgataaattccttttttttgaaaattatgtgataattatgagaaccaatcctactacttctcgtcccggggtttctacaattgaagaaaaaagtacagggcgtatcgatcaaattattggacccgtgctggatgtcacttttcccccgggcaagttaccttatatttataatgctttggtagtcaagagtcgagacactgacggtaagcaaattaatgtaacttgtgaggtacaacaattattaggaaataatcgagttagagctgtagctatgagtgctacagatgggttgatgagaggaatggaagtgattgacacgggagctcctctcagtgttcctgtcggtggagctactcttggacgaattttcaacgttcttggggagcctgttgacaatttgggtcctgtagatactagtgcaacattccctattcatagatccgcgcccgcctttatcgagttagatacgaaattatccatctttgaaactggtattaaggtggtcgatcttttagctccttatcggcgtggaggaaaaatcggactatttgggggagctggagtaggtaaaacagtactcatcatggaattaatcaacaatattgctaaagctcacgggggcgtatccgtatttggcggagtaggggaacggactcgtgaaggaaatgatctttatatggaaatgaaggaatctggagtaattaatgaaaaaaatcttgaggaatcaaaggtagctctagtctatggccaaatgaatgaaccgccaggagctcgtatgagagttggtttgactgccctaactatggcagaatatttccgagatgttaataagcaagacgtgcttctattcatcgataatatctttcgttttgttcaagcaggatcggaggtatctgccttattagggagaatgccctctgcagtgggttatcaacctactcttagtacagaaatgggttctttgcaagaaagaattacttctactaaaaagggatctataacttcgatccaagcggtttatgtacctgcggacgatttgaccgaccctgctcctgctacaacatttgcacatttggatgcaactaccgtactttccagaggattagcttccaaagggannnnnnnnnnnnnnnnnnnnnnnnnnnnnnnnnnnnnnnnnnnnnnnnnnnnnnn

SEQ ID NO: 37013 - DNA, 1767 bp, Oryza sativa
gtctcttgcctgctcatggattcagcaggcagttcaaaaggttgacctatttgggaatctccggatctatgcttattttcaactccccgaagcatttcgtcgcttgctacgcccttcctcgtctctgggtacctaggtatccaccgcaagcctttcctcttttgaacctcgccattaacgttaaggctatgccatcctaaggtgctactaaatggaaggatcttatcaacgtccatgaatgcgaaatcatagatcgaactgccgaattggcaaaattcggtgctatcatagtatccgctaagttcacgggctggagataagcggactcgaaccgctgacatccgccacagggtaaaccaccgcctctcaggcctccccgacgggttctaccatagaggccaacgatagacaataactcccccccgaacacagcttacaactttcatcgtactgtgctctccaaagagcaactcttctcaaaatctcaaaacaaaaggtgctgagttggaatcccattctaaggattcttgtggttccggggaatccagctacaggagaaccaggaacggggagctctcccctttttccgcccgactctttgatcttaaacttaagaatgctggttttaagaacgagtgattgcccttctccgacccttactgcccaaccggagagcggacggctaatgtgttccacttattgaacagggtctatggtcggtccgtgacccctggacgccgaaggcgtccttggggtgatctcgtagttcctacggggtggagataatggggtcggtccatggattttccttccttttgccacatttcgctcaaagggttgaagggagatagtgcatcaagctattcgcaagggccaacttgatcctcttccccagggatcccagatgagggaagcctaggagagccgccgactccaactatcgtccatgtacgatccatactagatctgaccaactgcccatcctacctcctctacctttttgacagcccatctttttgtctcagtagagtctttcagtggcatgtttcagtcctcttccccattacttagaaaaagtgagccaccggttcaggtacaagatactaccattaccgcctggacaattagacagccaacccgtaatcgcaacgacccaattgcaagagcggagctctaccagctgagctatatccccccgagccaagtggagtatgcatgaaagagtcagatgcttcttctattcttttccctggcgcagctgggccatcctggacttgaaccagagacctcgcccgtgaagtaaatcatcgcccctacgatccaaccaattgggagagaatcaatagactccttttcgggagcgattcatccttcccgaacgcagcatacaactctccgttgtactgcgctcttcaagtgtgcttcttccccttctcccccttaccatggcaagtccttgggaaataactccgatgggcagaaaaaggaaggcgttaagagaccctcctggcccaaccctagacactctaagatcctttttcaaacctgctctgctcccatttcgagtcaagagatagataaatagccacatcccattgcactgatcgagggcgctcgtagtgacttagggagtcgaagaccaagaagtggcttatttataccaagcattcctcttatggctagatccaacctcctggtccctgcggaaaggaaaaagaatttcacgttcttccttttaggaagggaggatagggaagtcctattgat

SEQ ID NO: 37014 - DNA, 1050 bp, Oryza sativa
taattcgtattttcccattcacctaacagaaatggattaaccctaggattcctttttgttttttgtcctttcctctatgtgtattttacataccatagtaatttggtatagagaatttctattaaataaaggtattgtattattgctggaataaattgtcatttgatttgatacattgtaatcattaacgttgctgaattaagaaaaacggaaagagagggattcgaaccctcggtaaacaaaagtctacatagcagttccaatgctacgccttgaaccgctcggccatctctcctccataatcttattatggaaaaaaaactgagtgaatagcgagttttcctattcctgcagtacaggtacaaccacaaccgcgcgagagttccattgttctattagatagaaaaattccttttcatctaagtggacgggtccaggatttttttactaggaattccgctccctcgaaaagttttagtttgggttttccccaaaccaaagaaaaagagaatggaagaattcttcttattcgataaaaaaggaaccctagaattctgtttgcataaggtatcctaccccatacaatcaaatagaaaatagggtatgggacgattaatgactttgaaaatgcgaaatagttgatgagagaagttgttgttgagaaaagaaataggaaagtggaatgaaatccaatcttagtcaaatattttctatctcttcttgttcaaacagaaggaaaaagagagaatttgggctgagcagaaatacctctcttatccatttggagcatagggatcgatttataagaattgaatggatttgttttttttttatgttattttgtgaaggaatgaaaagaattctatatagaatgatagaatgggttgggaattatgcctagatcccgtataaatggaaatttcattgataagaccttctcaattgtagccaatattttattgcgaataattccgacaacctccggggaaaaaagggcatttacttattatagagatggtgcgatgggtaccgagctcgaattcgcctata

SEQ ID NO: 37015 - DNA, 1036 bp, Oryza sativa
  unsure (1)..(1036): unsure at all n locations
nnnnnnnnnnnnnnnnnnnnnnnnnnnnnnnnnnnnnnnnnnnnnnnnnnnnnnnntcctctagcattaatagaattcattggtgttaagaaaaacctcttgtgggaaggttggctagagatttcttggaaaaataccagcccctttcggtccataatgagatggaactaattctatttttattctctagattttttcgcttagtactatgtacagaagggaggagccgtatgaggtgaaaacctcatgtacggttttggaacggagattttttgaatagaacgaacgaccgtaacggatgttggctcaatccgaaggaaattatgcggaagctttgcaaaattattatgaagctacgcgactagaaattgatccctatgatcgaagttatatactctataacataggccttatacacacaagcaatggagagcatacaaaggctttggaatattatttccgggcactagaacgaaaccccttcttaccacaagcttttaataatatggccgtgatctgtcattacgtgcgactatctccactatagaaagaaaaataagaaaggatcaaattttctagtatttactagaaaagggggctttctacatagggatcgtcaaaacaacgattttgccctatcagctgtaggaagaaaggacacttcacgagaatcaaaataggaagaaagaaagtatggcctatactactctatggatagagttctcaaattgatagagaaagcaccgtaaagatcaattagtgaccgactgggtcgatacaactaaaaaaaactgcttacttatcccatgatatggggcaaaatttaggaatccgcttatgtaatagagccgatccactaagggattaagcagcggtgtagtatcagatcccaaagatagtaagttcttttttcttgcttatggggaaaaagtctttttcaaggattctatagaaatttcatatatgaaaccgagatagttacctttcagaaaattcgaacgaaggatataggtctatctatgcttcatttttctgc

SEQ ID NO: 37016 - DNA, 878 bp, Oryza sativa
  unsure (1)..(878): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttaaaagcttacaagttgaactctaataatctaggaaaaagtgcaacataaaattgagctagataaaatttcattaaatactttgcttatttttctgtttactggatttttctgggaattatttgagcaagggaattatttttaatcaacgaaacatcatttcatgaattattttaattgaaaaggtttttaaatcttcccctaagccgttgggctgattccagaaattgaaagatttcgttgaaattgttcgtttggaaatttcccgaaaagctaattataggttcttctctccatcggaacaatagggccgttatgcttattactaaacttgttgaagagatgaaatagaaccaaggtctatctttttgatcagaggttaaatcgatcatcagaagaagaattaggccaaaaattaggatacattctgggaaaatgaaacttccctggaagagaagcaaatgaaacgctttcataaaaattctcgtagaatcgagaatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 37017 - DNA, 663 bp, Oryza sativa
tattaaagtatccgttcccggtacataaaatactcagccagggctgctcccgtataaggagcgaggtattgtaatgtagcaggggaatccgccatttcagctactacaatagtgtattccatggccccctcttcatggaaagtagttactacttgagctacggaggatgctctttgaccgatagctacataaacacatattacatcttgccctttttgattgagaattgtatctgtagctactgctgttttgccggtttgtctgtccccaataattaactctcgctgaccgcgcccaataggaatcatcgaatcgatagcaataagccccgtttgaaggggttcatatacagaacgcctggaaattatacccggagcaggagattcaattaagcgagattccgaagctacaatttcgcctctcccatcaataggtttagccagagcatttataacacgacccaagtaagcctcgctcacgggtatctgagcaattcttcctgttgcttttacaaaactgccctcttgtatcatcaacccatcgcccattaatacaatcccaacatttttggattccaaattcagagcaatacccctagtcccttctgcaaattcgactaattcggctgacattatttcaccaaggcatataatacgagcaatc

SEQ ID NO: 37018 - DNA, 1140 bp, Oryza sativa
  unsure (1)..(1140): unsure at all n locations
ttcgaataagcatgagtgatcaaatggaataaagcagcttgataagaacctatacctagagctaacatcatataacccaattgagacattgtagaataggctaagcttcttttaatatctctctgagcaagagctaaagtggctcctaagaaaagtgttagtgtacctattaaagaaatgaaactcattatcaaaggtagggatatgaaaagaggaagaagtcgagctataagaaaaatccccgcagcaaccatagttgctgcgtgtataagagctgaaatgggggtgggtccttccatagcatcgggtaaccatacgtgaagagggaattgtgccgatttcgcaaccgcaccaaggaataataaaaaagcacacaaaatagtaagcaaggagttaatctcattattaggaatccagttattagctattttaaacaaatcccgaaactctaaactacctgttatccaaaaaaaacctagaattcctaataacagaccaaaatcccctacacgattagttacaaaagctttttgacaagcactcgctgcaattggccgtgtaaaccaaaagcctatcaataaataggaacacattcccacaagctcccaaaaaaaataaatttgtatcaaattggaactagtaaccaatcccaacatggaagtattgaaaaaacttatataaacaaaaaggctcagatatccctcatcgtgagacatataatcatcactataaataagaaccggcattcctcaagtagtaattagtattagcataatataagtaagcggttcgattaagtatccaaattgtaaggaaaaatcattattgtcggtccgagtccatagatattgatagatagaccttccatttatttgttgaatagacaggtgaactgagaataccatagctatacttaaaagtaaaacactaggaaaagcccatatgcgacgaagattttttgttgctgttggaacaagaaaaagtccaaaccccattgacataataactggaagtgggagaagagggattacccatgcatattgatatgtatgttccataagaaaagaaattgcaatttttacttgnnnnnnnnnnnnnnnnnnnnnnnnnnnnnnnnnnnnnnnnnnnnnnnnnnnnnnn

SEQ ID NO: 37019 - DNA, 1321 bp, Oryza sativa
ttcagggagagctaatgcttatgcttattgggtattttggtttgacactgcttcacgcccaaaaagaaggcagctacgtctgagctaaacttggatatggaagtcttctttcgtttagggtgaagtaagaccaagctcatgagcttattatcctaggtcggaacaaattagttgatagtgataggatcccctttttgacgtccccatgcccccccccgtgtggtgtggcggcatggggatgtcaaaaggaaagggatggagtttttctcgcttttggcgtagcaggcctcccaaagggaggcccgcgcgacgggctattagctcagtggtagagcgcgcccctgataattgcgtcgttgtgcctgggctgtgagggctctcagccacatggatagttcaatgtgctcatcagcgcctgacccgaagatgtggatcatccaaggcacattagcatggcgtactcctcctgtttgaatcggagtttgaaaccaaacaaacttctcctcaggaggatagatggggcgattcaggtgagatcccatgtagatctaactttctattcactcgtgggatccgggcggtccggggggggcactacggctcctctcttctcgagaatccatacatcccttatcagtgtatggagagctatctctcgagcacaggttgaggttcgtcctcaatgggaaaatggagcacctaacaacgcatcttcacagaccaagaactacgagatcaccctttcattctggggtgacggagggatcgtaccattcgagcctttttttcatgcttttcccggcggtctggagaaagcagcaatcaataggacttccctaatcctcccttcctgaaaggaagaacgtgaaattctttttcctttccgcagggaccaggaggttggatctagccataagaggaatgcttggtataaataagccacttcttggtcttcgactccctaagtcactacgagcgccctcgatcagtgcaatgggatgtggctatttatctatctcttgactcgaaatgggagcagagcaggtttgaaaaaggatcttagagtgtctagggttgggccaggagggtctcttaacgccttcctttttctgcccatcggagttatttcccaaggacttgccatggtaagggggagaaggggaagaagcacacttgaagagcgcagtacaacggagagttgtatgctgcgttcgggaaggatgaatcgctcccgaaaaggagtctattgattctctcccaattggttggatcgtaggggcgatgatttacttcacgggcgaggtctctggttcaagtccag

SEQ ID NO: 37020 - DNA, 712 bp, Oryza sativa
  unsure (1)..(712): unsure at all n locations
nnnnnnnnnnnnnnnnnnnnnnnnnnnnnnnatattttgtttttttttgttatttgctaataatttaatgattaatatttcactaaggagaacatagaatcatagcaaatgaaattgctaattctgattagcaaaaaaaaagaatgaatatcaagcgttatagtatgattttgaatactctaaaaaaggaacgcggtaggtgggggagagaaaaaccttgggatatattgattcgcattgaattgcaaatacatcaacgatagaatcaattcaatgctgaattgcaataagcggagtctctcaactagagacgaaccgctagactacatagagtaatgaattcaacgattcaaaaaaaactaacagatggaggaaattgcacaaggaatcctggtctcaaagaaaaagaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 37021 - DNA, 483 bp, Oryza sativa
  unsure (1)..(483): unsure at all n locations
nnnnnnnnnnnnnnnnnnnnnnnnnnnnnnnnnnnnnnnnnnnnnnnnnnnnnnnnnnnnnnnnnnnnnnnacagggactttggtatcgaattttttcatttgagtatctattaaaaatgaattctccagcatttgattccttactaacaaagaatttattggtacacttgaaaagtaccccagaaaatcgaagcaagagttttctaattggtttagatggatcctttgcggttgagtccaaaaagagaaagaatattgccacaaacggacaaggtaacatttccatttcttcttcaaaagaagagttccttttgatgcaagaattgcctttccttgatatcgaacataatgcataaggggatccataacgaaccatatggttttccgaaaaaaagcagggtacattaacccaaaatgttccatcttcctagaaaagatgattcgttccagaaaggttccggaagaagttaatcgcaagcaag

SEQ ID NO: 37022 - DNA, 742 bp, Oryza sativa
  unsure (1)..(742): unsure at all n locations
nnnnnnnnnnnnnnnnnnnnnnnnnnnnnnnnnnnnnnnnnnnnnnnnnnnnnnnnnnnntttccgtgatatgacagaggcaagaaataacgattgcaaaaaatccttcctttttctttcaaaagttcaaaaaaattatattgccaattccattttagttatattcttttttcttaatgttaataaaaaaaagaagaaaattcttcttttttctttctaattctaaaattggatattggctaaaagacaatcagatagattttctcttcagcaggcatttccatataggacttgttataataaaacaagcaggttatagaaaaaaactcttttttttattatttatcaacaaagcaaaaaggggtcttatcaaaccaacccaccccataaaattggaaagaaagataaagtaagtggacctgactccttgaatgaggcctctatccgctattctgatatataaattcgatgtagatgaaattgtataagtggatttttttgtatttccttagacttagaccacgcaaggcaagaatttctcgctatttactatttcatattcttgttactagatgttctataggaataagaagaaatcgcaacccctttccgctacacataaaaatggatttcgaaagtcaatttttcttttcaatatctttactttttttcagaatcctatttttgttcttatacccatgcaatagagagcgagtgggaaaagggagggtactttttttca

SEQ ID NO: 37023 - DNA, 822 bp, Oryza sativa
  unsure (1)..(822): unsure at all n locations
nnnnnnnnnnnnnnnnnnnnnnnnnnnnnnnnnnnnnnnnnnnnnnnnnnnnnnnnatatattatttattcttttccatgtattagattattcgtccgagccatatcaaattaaaaatatctaaaatcaaattcaatatagaaattggaatagattctattagaaaaatagatttgcgaattagagaaaaaagaaagttcaaaaaaatctatctaactttattttatgaagttctagtatttttttctaagtagaacttccaatttcgaactagttaatagctaagattaataattaagatctgacattttacggatttcctatactatacatatttctatttgttacactatttctgttatgtaagcccacttagctcagaggttagagcatcgcatttgtaatgcgagggtcatcggttcaaatccgatagtcggcttttttctctatcaatgttccatgaacaaaaatacctctttttctccgaattaaatggagaagccaggatctattatgtcgttctaccctacaattttgctagatacaaaacaataaaataaataatatatatacaaaaattcagatgttgatgaaattccatttttttgtggtacttttagtagattttactctgtttatcctttactttaattcagttttaatttcgatgtattctgtaatgtaaatacaatgaaattaattgtgtaaaatgaaatttcaataaaaaaaggagtcttcatgtcccgttatcgaggacctcgttttaaaaaaatacgccgtctgggagctttaccaggactcactagaaaaacacctaaatcc

SEQ ID NO: 37024 - DNA, 408 bp, Oryza sativa
  unsure (1)..(408): unsure at all n locations
nnnnnnnnnnnnnnnnnnnnnnnnnnnnnnnnnnnctctttccggacaagacatacaaagagacccgccaactttttagtgaacctttgaaagatagatattatgattagtccttttctttactatctaccgtccttctatttttttttagttattcactggagcaattatatattgaagtcaatctgaggcaagtgttcggatctattatgacataaggattgggtgcctaacggactttttttatcttggatttctccacgtaacaaaaaaacctttttttaatttaaaaagctagtctattttttttaagagtataagtccctatctatatctactttccttgagnnnnnnnnnnnnnnnnnnnnnnnnnnnnnnnnnnnnnnnnnnnnnnnnnnnnnnnnnnnn

SEQ ID NO: 37025 - DNA, 730 bp, Oryza sativa
  unsure (1)..(730): unsure at all n locations
agacccgcataaaaatatgccgctgacgtgagtaaagctaaagcaacagtagtatttatatcattcgtgggcgctgctaattctccatggggtaactgtataattttccaaggtaaaagagcacccgaccagttcgaaacaaaaataaaaaggaacatagttccaataaagggaacccagggaccgtattcttctccaatctgagttttgcttaagtctcgaataaactcaaggacatattcgaagaaattctgaccatcggttgggatggtttgtggattgcgaacagctatgataactgaacctagcaagatagtaattacgacccaagaagtgataagtacttgggcatgaatttggaaacctcctatttgccaatagaagtgttggcctacttctacgcccgatatatcgtataaccccttgagtgttttaatggaacacggtataatattcatattgtcccctgataaaaaatgaacttcaaaaaaagaattcttttgattcaaccatctttttctcaactcagcaacgtgaagtattaatcttatatttaggatatcaagaaatcacatcagatgataatatatatcaataccctctaatatatatcaatattccccgtcttttttctatgcaaaacaaaaaagaatagtaagtgattccataaatctacgcagttgcccaagaatnnnnnnnnnnnnnnnnnnnnnnnnnnnnnnnnnnnnnn

SEQ ID NO: 37026 - DNA, 907 bp, Oryza sativa
  unsure (1)..(907): unsure at all n locations
cgataaaaaaggaaccctagaattctgtttgcataaggtatcctaccccatacaatcaaatagaaaatagggtatgggacgattaatgactttgaaaatgcgaaatagttgatgagagaagttgttgttgagaaaagaaataggaaagtggaatgaaatccaatcttagtcaaatattttctatctcttcttgttcaaacagaaggaaaaagagagaatttgggctgagcagaaatacctctcttatccatttggagcatagggatcgatttataagaattgaatggatttgttttttttttatgttattttgtgaaggaatgaaaagaattctatatagaatgatagaatgggttgggaattatgcctagatcccgtataaatggaaatttcattgataagaccttctcaattgtagccaatattttattgcgaataattccgacaacctccggggaaaaaagggcatttacttattatagagatggtgcgatttgactcttttttttgtttttttagccctacctacaccccggttttacgagaaagagtgggggttcgcggagagaaaaccaaattagtaagggaaacccacgcttagggaaggtgaggtgaactaacaactccttctgtcgtgtatcctcgactgacgcggcctcggatgcttcaattgtagattttagtattgagcgaaaggttacacctacaggataggttctgtattacaggctaatcctactctactagtactaataggtagcataggggataaaagcactacacctagaaataggaatcaacaagagaaaaactttgttagaaattaaccctttcctgattgnnnnnnnnnnnnnnnnnnnnnnnnnnnnnnnnnnnnnnnnnnnnnnnnnnnnnnnnnnnnnnnnnn

SEQ ID NO: 37027 - DNA, 829 bp, Oryza sativa
cgagctcggtaccaaagactacatttttttcttgaacctttatgttcataaacaatgttttagctaatctttattaaggcaaattagaggattgacggggagaactgcaagttttcggagccgagatatccatccgagtcactatgggcgtatttgtccaattgacacgtccgaaggaatcaacgttggacttactggatctttagctattcatgcgagaattgatcattggtggggatccgtagagagtcctttttatgaaatatctgagaaagcaaagaaaaaaaaagagagacaggtggtttatttatcaccaaatagagatgagtattatatgatagcagcaggaaattctttgtccttgaatcggggtattcaggaagaacaggttgttccagctagataccgtcaagaattcctgactattgcatgggaacagattcatgttagaagtatttttcctttccaatatttttctattgggggttctctcattccttttattgagcataatgatgcgaatcgagctttaatgagttctaatatgcagcgccaagcagttccgctttctcggtccgagaagtgcattgttggaactggattggaacgccaaacagctctagattcgagggtttctgttatagccgaacgcgagggaaagatcatttctactaatagtcacaagatccttttatcaagtagtgggaagactatagtattcctttagttacccatcggcgctctaacaaaaatacttgtatgcaccaaaaacctcgggttccgcggggtaaatgcattaaaaaagggaaaaatttagcggagggggctg

SEQ ID NO: 37028 - DNA, 966 bp, Oryza sativa
  unsure (1)..(966): unsure at all n locations
catttccaaaattttgcctaggcaagatatgccctatttgcaagatggaacgcctgttgatatggttttcaatcccttaggagtaccctcccgaatgaatgtgggacaaatatttgaaagctcgctcggattagcaggggatctgctaaagaaacattatagaatagcaccctttgatgagagatatgagcaagaggcttcaagaaaacttgtgttttcagaattatatgaagccagtaaacaaacaaaaaatccgtgggtatttgaacccgagtacccgggaaaaagcagaatatttgatggaagaacaggagaccccttcgaacagcctgttctaatagggaagtcctatatcttaaaattaattcatcaagttgatgagaaaatccacggacgctctactgggccctattcacttgttacacaacaacccgttagaggaagagccaagcaagggggacaacgaataggagaaatggaagtttgggctttagaaggatttggtgttgctcatattttacaagagatacttacttataaatctgatcatcttatagctcgccaagaaatacttaacgctacgatctggggaaaacgagtacctaatcacgaggatcctccagaatcttttcgagtgcttgttcgagaactacgatctttggctctagaactgaaccatttccttgtatctcagaagaacttccaggttaatagggaagaagtttgatcggaataaatataaattcttttcttatttctattttatgattgaccaatataaacatcaacaacttcaaattggactcgtttcccctcaacaaataaaggcttgggctaacaaaacactacctaatggggaagtcgttggcgaagtcacaaggccctccacttttcattataaaaccgatannnnnnnnnnnnnnnnnnnnnnnnnnnnnnnnnnnnnnnnnnnnnnnnnnnnnnnnn

SEQ ID NO: 37029 - DNA, 673 bp, Oryza sativa
  unsure (1)..(673): unsure at all n locations
nnnnnnnnnnnnnnnnnnnnnnnnnnnnnnnnnnnnnnnnnntgatagtggaaaagtcgacagataagtcacccttcctgtccctctacagaaccgtacatgagattttcacctcatacggctcctcgttcaattctttcgaagggatccttttcctcgttcgagagtctccgcccttcttccactccgtcccgaagactaactaagaccaattgagtcacgttttcatgttctaattgaacactttccatttatgattaaaggagaagattgttcttttaccaaacatatgcggatcaaatcacgtcttataataagaagaaatctttctcggtatcaatccccttgcccctcattctttgagaatcagaaggatccttttcgagtttccatttcttcatttggaatctgggctcttctatcttcgacttattttttttttgctttattctttatttatttcatttcgatttttccctcttcctctatccctatcctctaggtacagcgtttgcatcaatagagaaccttttcctctgtatgaatctatattattccattccaatttcttcccgaaacttcccaagaaaaatcccgaattggatccaaaattgacgggttaatgtgagcttatccatgcggttaggcactcttcaaataggaatccattttc

SEQ ID NO: 37030 - DNA, 748 bp, Oryza sativa
  unsure (1)..(748): unsure at all n locations
nnnnnnnnnnnnnnnnnnnnnnnnnnnnnnnnnnnnnnnnnnnnnnnnnnnnnnnnnnnnnnnnnttctatagcatagtacacagggtgtacccattatatatgaatgaaacatattatatgaatgaaacatattcattaacttaagcatgccccccattttctttaatgagttgatattaattgaatatcttttttttaagatttttgcaaaggtttcatttacgcctaatccatatcgagtagaccctgtcgttgtgagaattcttaattcatgagttgtagggagggacgtatgtcaccacaaacagaaactaaagcaagtgttggatttaaagctggtgttaaggattataaattgacttactacaccccggagtacgaaaccaaggacactgatatcttggcagcattccgagtaactcctcagccgggggttccgcccgaagaagcaggggctgcagtagctgccgaatcttctactggtacatggacaactgtttggactgatggacttaccagtcttgatcgttacaaaggccgatgctatcacatcgagcccgttgttggggaggataatcaatatatcgcttatgtagcttatccattagacctatttgaagagggttctggtactaacatgtttactttcattgtgggtaacgtatttggtttcaaagccctacgcgctctacgtctggaggatctgcgaattccccctacttattcaaaaacttttcaaggtccgc

SEQ ID NO: 37031 - DNA, 1488 bp, Oryza sativa
ccatgccaggtgttataccggtggcttcagggggtattcatgtttggcatatgccagctctgaccgaaatctttggagatgattctgtattgcaatttggtggaggaactttaggacatccttggggtaatgcacctggtgcagcagctaatcgggtggctttagaagcctgtgtacaagctcgtaacgaagggcgcgatcttgctcgtgaaggtaatgaaattatccgatcagcttgcaaatggagtcctgaactagccgcagcttgtgaaatatggaaagcgatcaaattcgagttcgagccggtagataaactagatagctagactaagtggataaaattagatagaaaaaaggtctaaataaaaaagaagagaaatagaaagatcaaaaatcagttacgaaaatgcagtaattcttcttttttcttctaattgattgcaattaaactcggctcaatctgaaaaaagattgagccgagtttaaatagattttgatacgatcatgagacttgacaaatcgggattcctctattctatatatttagaagatataaaggtataatacaataaataaatacaaatagagtattatcatatgataatggaatcaaatacgcagtatttacagaaaaagttttcatttattgggaaagaatcaatgacatacaatgcattacagacgtatgatcattaccctttaaccgggttattctattccacttctagatagagaaaaaaactaaaggagaatgaatgaaaaaagacagagtttggaagttagacccctttctaagactctctttcaaaaaagaggacattttgaaacttttaacaggcacaatcgtgagtcaacaagtgactcgaaatgctcgtaagaaaagagaattgattttcaaaatggtagaactagatgacgaagttttctataaccttgatgaagaggtagttttagtttacgactccgatcaagagcgagaagtctttcatttcagattggactgctatagaatctggacccatcgtagagacgttcaaaaggctcctgatgataagaatcatactttcgcggaactccatggggctatgggcttcaacgcggtagacgttttgttccgaatttttctggagcaaacctccgacccaacgatacaatgaattttttctattcacaaagaaaaaagattcggaatcgcaatgctactatacgcacccggaggaatattcggaattatattcttatataatccatttttgcgcggggtcttactaacaggacttcgctgcacgagacgaggattcgtcgaaaagctaaggtcatccggtattttcataccctttgggggtggtatatggccttacaaagtctaaggggtagtatgagatctgtagtaggtaaaagaatttgtccctggattgagtatgctattttccctcctttaccgcgcattattgtatatgcttctagaagagcacgtatgcagagagg

SEQ ID NO: 37032 - DNA, 422 bp, Oryza sativa
  unsure (1)..(422): unsure at all n locations
tggataaataccgattcctattactggtaaaaagatacagattaaaagaaagagtttttgcgggccggaatcctcaaaattttcgtttggaacatgaaatagcttgtatccatagaacatctgtcgtaacatagataataaataaataggagttaatatcattccaattgccattacaaaagtaattagcatttttggcattaacagaaattttggactagtaattagtccaaaaaatactactaattccgcaacaaaaccactcattcctggtaaggcaagagaagccattgaaaagctactaaacatggtaaaaatttttggcattgggatagaaacccctaccagttcttcgagataaacaaggcgcattctatcacaagnnnnnnnnnnnnnnnnnnnnnnnnnnnnnnnnnnnnnnn

SEQ ID NO: 37033 - DNA, 403 bp, Oryza sativa
  unsure (1)..(403): unsure at all n locations
agggcgaattcgagctcggtacccaatctttcaatttcttattttattatgttcaactttatgtattcctctatccgtagagtacattgattgttcagaaatggctataacagagtttctgttattcgtattaacagctactctagggggaatgtttttatgtggtgctaacgatttaataactatctttgtagctccagaatgtttcagtttatgttcctacctattgtctggatataccaagaaagatctacggtctaatgaggctactatgaaatatttactcatgggtggggcaagctcttctattctggttcatggtttctcttggctatatggttcatctggnnnnnnnnnnnnnnnnnnnnnnnnnnnnnnnnnnnnnnnnnnnnnnnnnnnnnnn

SEQ ID NO: 37034 - DNA, 455 bp, Oryza sativa
  unsure (1)..(455): unsure at all n locations
nnnnnnnnnnnnnnnnnnnnnnnnnnnnnnnnnnnnnnnnnnnnnnnnnnnnnnnnncttgtccaaatgattttgtacctcattctaaaattccttgaacttttcaaaggacaaagacttatgcctcattaagtagacataaccatatctactaaagtcatcggtaaaggtaataaagtacccaaaaccacctctggcagttgagctcattggtccacatacatcagtatgtactagtcccaatagttccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 37035 - DNA, 761 bp, Oryza sativa
  unsure (1)..(761): unsure at all n locations
nnnnnnnnnnnnnnnnnnnnnnnnnnnnnnnnnnnnnnnnnnnnnnnnnnnnnnnnnnnnnnnnnnnnnnnnattgaagtaataaaactattccaattcgagtagtagttgagaaagaatcgcaataaatgcaaggatggaacatcttggatccggtattgaaggagttgaagcaagatatccaaatggataggatagggtatttctatatgtgctagataatgtaagtgcaaaaatttgtcttctaaaaaaggaaatattgaatgaatagatcgtaaattctgaaactttggtatttctttttcttccggacaagactgttctcgtagcgagaatgggatttctacaacgatcgcaaacccctcagatagaatctgagaataaaactcagaataaaaaaaattgttgtaatccaataatcgatcttggttaggatgattaaccaaattaatccaaaaattctgctgatacattcgaatcattaaccgtttcacaagtagtgaactaaatttcttgttattagaaccaataatttcgacaagttcggaaccatttaatccataatcatgggcaaacacataaatgtactcctgaaagagtagtgggtagacgaaatattgtctaggaaatttaagtttttctgaataaccctcgaatttttccatttgtatttctacttgaatcagagagagagaaatatttctcggtttatcaaatggtgatacatagtacaatatggtcagaacagggtgttgcatttt

SEQ ID NO: 37036 - DNA, 783 bp, Oryza sativa
agctggctacctgttgggctaatgtaactctttgtgaccgcagtgtttgaagcaaattaaccattgaatttgttaacaaagactacggagaaccaattattgtagaagtagtgcaaaattaatccacctctcgttgtgcatctctcaagagctagccagacctaaccatggccgcagacgatcctatcgtggcatgcgctggtgtgggcccccacgaggggccgcattatggacgccctctaaccttgattagtagccctaaaccacaggtttaaccgcttaaccatggttaattagcaaaaggtcacgatgacacgctagccatcactatcgacatgcatcacatttccgcatcatagttcatcccgctcctcgtctcctctccgaagtctcctcttgtcaccagcacgcttgagctcccgtgaggctgacgcgtgggccctccctcgtgtgcgtgttctgttgggcccacatgtcagtgaggtgatctaggtctcctctgcttagctgtgcaagcatacactagaatttgttctcccttggcacctctccccttattttatgtgttgcacctcctacctctggttggaagaacatctcaagccctcccttttctctcctctttcccctgtgcatgtctctcttcttcttcttcttcttcttcttcttcttcttcttcttcatagcttgcctttctcccttctcctctcctctcccttctccaattagatcaaacagcaatagctctctcttgggggtctctcctccatgcaagctctcttg

SEQ ID NO: 37037 - DNA, 750 bp, Oryza sativa
ccccatccaataaaggtaagagaatatgttatccacgtgcttctcttaaatcaaattgatccaacatgcctctgcctcatgtaaaatatttttagaacttagtatccctattgtttcacctttttagaacgaaatactgatatatcatttccatagcctaaaaagaaaacttgttcggcaaatatatcatttccatagcctaaaaagaaaacttttttgccgggtcggcggaaggacgtcaaccaaatttctttaagataaaaagagggtaatataatatacatgatattacactgtcgagtcgaggggaaacctcgaaaaagaacgtaaaccaaatttctttaagataaaaagagggtaatacaatatacataaaaaaagagggtaatacaatatacatgatattacagagtcgaggggaaacctcgaaaaagaacaggaaaactatttaaggaggccaaaaacatgctgctactcctcgaaagaaaaaattccggccactcttcagatcagaggacctcctgatgtctgccaccaagtgttctaccaccctttctgttataaaaatctttacgtttcttcctttccaaagcttccagcagatcaacatgaacagagaatcgaaatccttacagcttccagcagatcaacatgaacatagaatcgaaaaattcccctttaacccgggtttttcccttttttccttttttttttcccccaaaaaaaaaaagggccttttttttttttccc

SEQ ID NO: 37038 - DNA, 514 bp, Oryza sativa
cgcgcgtcgtgttcctcaacgagcgcccccagccgaggcccggcaagggcgtcaccaacacctgcgaggtctgcgagcgcagcctgctcgacaccttccgcttctgctccctcggctgcaaggtacgttacgtccccccgttggccgccgccgcacgaacacctggtgttgcatcgcattgtgctgacagatgccttcttggacgcgcagatcgtcggcacctccggcgactaccgcggccggaagaggcacgccggcggcggcatcaagaagacgaagaagctgcacaagggcgcggcggcggtgccgtcggactcggacgactcctccacgaccacaagcggcgggagcgacaagagcagcgtggtgcagagcttcaccccgtccacgcctccggcgaccgccaacagctaccgcaccggcaagcgtcgcaagggcgtcccgcaccggtcgccgttcggcagcctcatggtggagttctaaagcagggcagaagcaatgccgccatgccggc

SEQ ID NO: 37039 - DNA, 634 bp, Oryza sativa
  unsure (1)..(634): unsure at all n locations
tggtgcccatccaggacgacgaaccgcccgactacctcgcgccgactcttcgcgacgacgacggcgggcggggctgttactaccagccgcaacacctggagatcagcggcggcgagcagcctgcggctgcctcctgcgtattccggccatgcaaggcggccggcggcggatgcaggggcatgggctgcgtgtacgcgggtagctgctgcaggagggtgctgtgccgggagtgcaacctcccgtgcgtcgagcacaccgacggcttccacaccgcgatactgcccttcctgccgcggcgctccgcgacggcgaccgagatggccgaggatttgctgctgggtttgcctctcgagcacccgtgcgtgccggggcccgagtactgctactactactcggagggggaccaggtggagaaaggcgtggggcggcacgtgttcgtgtcgctcagggatctcgcgcgcaccaggcagccgcgccgtctcatcgagtgtgggtacaggatggatatgatttacattttggtccttttaaaaaacttatttcgcaaatagacccctggaaaaacttatcccaaaaannnnnnnnnnnnnnnnnnnnnnnnnnnnnnnnnnnnnnnnnnnnnnnnnnnnnnnnn

SEQ ID NO: 37040 - DNA, 719 bp, Oryza sativa
  unsure (1)..(719): unsure at all n locations
nnnnnnnnnnnnnnnnnnnnnnnnnnnnnnnnnnnnnnnnnnnnnnnnnnnnnnnnnnnnnntaatttcaaatttctatgaaaatcacgcagaattcatgcgattttagacagcccacacacaaacacagatgcatataccatgctgaatgtcctgctttaatctcctgtattcctacaaaacaatacacatccaatttctcttaatttacaatttacaaatcactttactgatcactctgaaagatgatcagttgagagatttgaggtagtccttgaggtccgtggggaagcaagggtactgcctccagaacgcgccgtgcgctcgcagcatcttcaccgccttgtccttggtcgacggcgagctctccacttgcatcagcgccagcagcttcgccacggcgccgcccaccaccatgtcctccagcaccctctcggcgggggccggggcgcacgccaccagccacagcacgttgacggcgagcctcgtggcgagcccggacacccggagcacggggcgcgccacggcggccaccggcaggccgtgctcggcgaaggccaacccgccctcggggcacttgcacatgcgcttcangaggaagagcgaccgctcggcgacgtggcggtcggcgtcgaggaagagcttcgcgaggacgcgcacggcgcccagcttcacggcttggcgcgccgcgcgccgcgggagtaccgcgccgtgacgtc

SEQ ID NO: 37041 - DNA, 708 bp, Oryza sativa
  unsure (1)..(708): unsure at all n locations
nnnnnnnnnnnnnnnnnnnnnnnnnnnnnnnnnnnnnnnnnnnnnnnnnnnnnnnnnnnnnnnnnnncagtgttctctcgtttgcattgcagggatcatcaaccgcgcgtcacggttggtacgacatcgtttgtggtgtagcgattgcacggcgtcctggacttgttctggttggtagccacgtcgcaaacgtcgcactcgatcaaagcgagagttatccccctcaccagaagatcgggccacgagagagagcgtcatcacttcaagtcttcaacatctgaatgattttctatatatcatgcatgtgcacgagtaaaagctagcatttctgagtaattggtagccaaaaatatggcttggtgcatttctaccatgtactgataatattagctagtaatagtactagaagaatacaaaagctcatatcatgatttttgtaaaattattatgtaacttccggaaataactagaaattcttttgacataaaattaaatacctagaattaatggcatatagatttattggaagaaactagaggtgtgatggtaaagtcgtagatgcatcattacccattagaattcaaatctatatacccagaataatcacatgtacgtgttaagatgtgattttaagaggtaggctgtgtttcgtagtgtgagttcccaactccacatttttcgttttttgtgcgcacgcttctcacgaac

SEQ ID NO: 37042 - DNA, 634 bp, Oryza sativa
acactgaaaattttgatatatgaaaatatcaaattttacattataaaatatggtactatgcacagagaactagagaagtcaagtactttcttaaggatggtaaaatttatctatttagatatgatgcaccatatgcacagagaactagagctttgcagaaatagctcgggacaatgcccgacagtttatatcaaagagttgatgaccgtcattgcgagcagtccggattccataacacgagcattgcgataaactaaaatggagtttttcacgaactaaactagtagtgttcaactctttgaactgtatatcatgaagtaattatgatttctctacacagatctgtcggactgtcaaccatacaacactgtctaggtgaagttcatttcctgtggatggtagcgaagtgaaagcccatgggttctcgaaattcaccggttccatggcaacggtggcagtaatctaacccgctaccaccacatatacggcacctggaaaatggaagtcatgccggagaagcatgtttctcagtaccagcagcataagtatggcagacagcttttgagtatgaggctatgagctcctcaccattgtggccattcgcccttcgggagcatgacaagatcggcatgat

SEQ ID NO: 37043 - DNA, 1317 bp, Oryza sativa
ttctctacgcgcgcgcgacttaggtaaagggcacgtacgcgctatttagccatccccgaaataatatgctatggaaatctgcattctgcgagcactcgaactcgagtactcgacggctcgatgccatcaaattgatatgggctactgggccgtaagcgattcgcacgcgttatcagatactgggctgtatgaggcccaatccacccgcacatcaactcagctggaatcgtgacgacacgactagcgagagcgagttagcgagcagagatccacggcccgcagcggcggcggcggcggcggcggccgaagcccatctggttacgcgagggagatggcagcggcggcgggaggagtcgccggcgagccgtcggggacgaggacgaagcagcttaaggtcgccgtgatccaccccgatctcgggataggtacgcctctactctctctcccccctcctgttgctcctgtcgatgcttgggtgaaccctcatctctcgtgggcagaattttggtagatccggttgagtccccgaaacgattggttgcgtgctactttgtaaattggtcgatatgtagcaattccgagtccacgcggtggaagcatcagtagatttgaggaaccgttgctgcctgagcttgtagctgggatatttgttgggttcctcaattttgctcaaggttcgacgtatgcttagttgcttgctgcaattacggggtagtctgagtgttagggaaagatttttcttcttcttcacttccatactgtgttgatacttctagttaagtagtgagtagtgatgccctagaattggcttattttttggggaagccgttgcacggtttcatttgaatgtaggacttgcggcttgtttattatatgcaggtgagatttttaagaacattttcgagaaaaaaaatgttgtagcagtattgcagcaggttataggacattgaccaatggactaagtgtggcagcatttctagcattgtactagatctcaattgttcaaagaaaacatatgtttttgtgtaggtggtgctgagagattgatagtcgatgcggcttgtcagcttgcggtccatggtcatgatgttcatgttttcacatcacatcatgacaaaaaccgatgctttgaagagactgtttctggtaaggatctaaactctatctgaggtgaatgttgcttataactctcttactatggtagttgcagtacctatttgtgttaaagacttactatgtactatgactgatttgatgtggacttgtagaggatatgcatatattcctatgtgaattgtcgattgattacgtacaaaa

SEQ ID NO: 37044 - DNA, 5413 bp, Oryza sativa
  unsure (1)..(5413): unsure at all n locations
nnnnnnnnnnnnnnnnnnnnnnnnnnnnnnnnnnnnnnnnncaattgacatgattgaagaaacaactactggttttttcttgttcatctagaactgttgcctgctatgttttttaccattccctagtgtttgttctatctgtagtgcttatccctttttgatgtattaaggatggcagatttgattctagtaaacagcaagttcactggaacaacatttgccaggaccttttgcagccttcatgctagagaagtcgagcctgctgttctatatccagctgtctctgttgaacagtttcaggaacctcatgcttataagtaactgcatgcttgtatatctctctgtaactcgcttaggtttcattttatttaaaaaaaaatagtatagtgtgaagtgtaagcatttttctcaccttctgcaccttcaggtctagccaaatttaaccatcatctttctgcgcaggttgaatttcctctcaattaaccggtttgagagaaaaaagaatcttggtcttgccatttcagcattttctctgcttcgctctgttgcttctatgctacctggtgatgctcgacaggaagtaaccttaacagtagcaggtaatttcctttccactacaggttgaatgttgcatcgtcactgcattatgaattaccaactggcaactactgtttacttacaaaagattatgcttaaggtggatatgataagcgtctcagagaaaatgttgaataccttgaggagctcaaaagattggcagcgagtgaaggggtttctgaacatgtcaaatttgtgacatcttgttcaacttctgaaaggaacgaacttctctccaactgcctttgtgtgttatacactccaaaggtaaatatctggcatgtcttttgattctcaacaacatgagaattttcccataataaacctgcgtctgacattttgcaggatgaacatttcggtattgttcctctggaagccatggccgcatataaacctgtaattgcatgcaacagtggtggtccagtggaaacagtcataaatgacgagacagggtttctctgtgagccctctgcccctgaattttcaaaagccatgctgaagctcgtgaacgatcacgatctagcagttaagatgggtaaacaagcaaggggccatgttgtgcagaagttctcaaccaagacatttggtgaccttctgaacagctatgtccttaatgtgtaccatcagaggattgagtgatccccaattcggtgtcggcaatgccgtggaacacttggaatagaccatcattttcatgttttttccttttcttttgttacttctgacttcgatgtacacgcatgcgatagagtattatatacggatgaatagtgaaaacgactttgtaatgttaccatttgtggcaatgacaggaaaaaatatatatttgggccgtctgaaacagagctgaagtttacaatctgattgtctttccctggaaagagatatcaggtacaaaatttgctgaaacaacagttgatgtgatggtcaaagctaaactgtcaggatcaattcccactagcaagatgcaatgtaggaataacaacaatgtttgaaaggaatcatgcaggtacaggtagctgctccaagtggaagcacgattgttaattcggtgaacgttatgaatcatccgaccatcattttttctacaatctgcagtcatacgtttggaaaacgttagcctgctgaaatggatgcaaaaacaagcaactgattaatgtcaaacgctgtgtgcttaaccgaaattaagaaatctgaagtcttcccgagaagaaactcgaagttcgaacaggtaagatctctgtgccaattgtcaatgtagttttgtcaccgcagtggaattattattgcttctgttcacaggaacagaatttaaagttaattactgttggacaaagaaaggataagaacctagtaagagtaacgtgtcggtattaccactagtaattcaactctgagcagttccaaattctgaaaaatattgtaaccccaccagccggtgacagttcttgtcaggacgctcctttgttttcagatcgattagtcaacgaatttatcaatttatggatgatcatcagcagctgcgccgattgcaacgtctgttcaaaagaatatttcgccacagtcaaatcgaacagggagcgtttgttcgacgatatgcctaattttgtcaaagtacaagacttaaaaataaaaactcttaaagtcgtatggcgatggcaagagcaaacgataggatcttaggacgtgtggaacgtcagtgtagcaactagcaagtgggtattaactagtgggtgcttatatatatatatgcaagtattcgtaaacataatttcgtgcaagttttttatttttgttttgaaaattgcatcttccgctaactggcggtgcactaatggacagcttaaggccaaccatttttttttttttttggcttgcgttagcaaaatactatatataaaaaataaagcaacaaagtgatccatcatccatgttcccactacagtacggttgatatagccattttaatcatatagaaaatgttttgctggcagattaaggcatgacaaccacaagatacttattaattatttttgttaaaactacttgctaattaattggagcagaaacagattctctgtgatgaaatagatcttcatagctcagatatgatgaactgaagacagtactcgtttgtcagacagtgatttagtggaactgcacttgtactcgttttctgttccattttagtttcaggagttggcagacggtgcatgacaaagaaagatgtcgtaatgatgccaaactatcacctaaaccacattaagagaaaccataattttgactcccaagtaatctggcacacatgatctttcatttctgaaaaatacattatacatgggagggaagtcagcattaacaagctaaaagcccttgtataggtaaaatataattgggtacagaagatggtgtatagatacaagattacaagaggcaatccaccttgttttttttaccattaattaatcatccgccgtcagtaatatgatgttgagaggtgtgaaacttctaactaaatgacattacaggcaaatttcttatctctataatataatttcatccaaagaaaatatgagaatgcggctggatggatggatgacccaatcacggtcaaatgaaacgctcaaccgctcgcaactaattaatacagacagaggaaaaagaacatgcaagtgaacaaacagaagaagaaatagaaccggacagattaacaattcaagatccaccgtcatcctctgccagctcctccccaatctccatttaacaactccaaagatgcatttgccgttttgaaaaattaaacttcttctgtctccacaaaaaaagaagaagaagaagaagaagaagaaaacagaaaggaataagcaagcaagtgtgttctcttcattacgtttctgacaagtagcatcacaccaagtcttaggttaatacttgtgaaactgtcacctcatcatcgcccatcagattgctccagtcgacgcccatcgaattgctccctgcacgcagcaaaacaaaaggaataaaaaaagtctctagttcttcgtcaaaatctcgaataaattgatccatagaacataagctctaggtaagagacgaagtcttgagtaatacagatcacggccaatccatagacttagtattatttattttgcatgcattgcacagtggcactttaatgtgtagccatcgatcgatcgcttactattctgcccgtctgactcttgactagagtattttacatcaatacagatcgttagaaatcataacagataatgtactaatgctgcaagctgtactttttaagcatttcccctacgggattttaatttggaagaattgttgacttggtttgatagtttctcatatcttcgtatcgttattaagaaaacatttttttttcatatatttaacctgctattgagatgaaaaggagacggatggcatcttcatttttctcgtgcatcatgatttacctttttttcattttgctctgagattttcgagcatcaggtattacaattttctagcactaaattgtctgagattcttcatttttctcaaagattttctagcaccaacaattagtctattagaacatatgtttttggttgatattgttagattcatatcaaaaactttttcttatatataatgaaatgtggtgtggtggtgtagatggcgttgttgtttgtagatacatgcttgaccgtttgtcttattcaaaaattgtatgtaaatatatgagatatttttagtgataagaaaactcacaataaaataaataataattacataatttttttaaaaaactagacgaatggtcaaacgtgtacccaaaagttaacggcgtcatctattacaatgtaatatagagctagtatattagtataacaattgttagtcaaagctttatcctaacgaaacaaaatatacctatatttcgacaagggagtatttcattagttatttgaatttgagccattttgcggctgtactttgggttagcttgactttttaattgcatatgatgacattacaggtataaaaccaacatcccagcttggtctccctcaaccttctcactcaagccaagaaatcgagctgctgctttgtttgatcgcaatggcaatggagcctcctcccctgttcctgtgccccatctcgatggagctaatggaggaccccgtcacggtggccaccggcgtcacctacgaccgccggagcatcgagcggtggttcttcaagtacggcaagacgacgtgcccggccaccatgcagcggcttgcttccttcgacttcactcccaaccacaccctcaagcgcgtcatctcgtcgtggctggaccgcgcctcctcgtcgtcgtcgccgagcacggccggctcgccggcgacgacgtcgtcgtcgtcgtcgtcaaacgcgatggagagggagaggttgccgtcggtgctcgctggcattgaggagacgccgttcaaggcgaccgcgctcaagaacctcaagtcctgcatggccggcgacgaggcggcgcgggaggatttcgtggcgtgcggcggcatccaggtgctcggccgggtcatgacgcaggcgctggaggagagctccgccgggggggacttctcggcgttccggacgtgcgaggaggccgccgccgtcctcgccacgctgccgctctcggacgacgcgtcggtggagctcctgctcaagccggagtgcataaggcccgtgtccgtgctggtccagcgcggcagcgccgaggcgaggctgcacgcaatgtccatgatctccaagatctccagggccagcgtccgcgactgga

SEQ ID NO: 37045 - DNA, 1389 bp, Oryza sativa
gggcgaattcgagctcggtaccctcccgcgcgctcgacgtgctcctcgacgtcacggcgcggtactcccgcggcgcgcggcgcgccaaggccgtggagctgggcgccgtgcgcgtcctcgccgagctcctcctcgacgccgaccgccacgtcgccgagcggtcgctcctcctcctgaagcgcatgtgcaagtgccccgaggggcggctggccttcgccgagcacgggctggcggtggccgccgtggcgcgcgccgtgctccgggtgtccgggctcgccacgaggctcgccgtcaacgtgctgtggctggtggcgtgcgccccggcccccgccgagagggtgctggaggacatggtggtgggcggcgccgtggcgaagctgctggcgctgatgcaagtggagagctcgccgtcgaccaaggacaaggcggtgaagatgctgcgagcgcacggcgcgttctggaggcagtacccttgcttccccacggacctcaaggactacctcaaatctctcaactgatcatctttcagagtgatcagtaaagtgatttgtaaattgtaaattaagagaaattggatgtgtattgttttgtaggaatacaggagattaaagcaggacattcagcatggtatatgcatctgtgtttgtgtgtgggctgtctaaaatcgcatgaattctgcgtgattttcatagaaatttgaaattaaacaattcaagtgcattaggagataggaaaaaaaatctaggtggtgttttttttctaaagatgaagattaagattaagattaagctttttacgcaaaacaatgtggtattaacgtatgattgattgagttttaattattacaaacttaaaaaagtatattaatatgatattttagagcaactttcatatagaaagtttttacacgaaacgtactgtttatttaaacagtttgaaaagcgtgctacaaaaatcttaatcttcgtctaactttttgttttggaaaaaagaacgggaactgtgtaaaagctggggcgtttttcatccactagcaacatgtttgaattcgacatgtacgtgtgttttgtacttttgtttagttgagcaaaactagtaccattgacttggaatcaatacagaaaatcctccttttcaaacaaaaaattctgtatcgaaaccttcagagaggagcaaagcgttgactttcattggagacaactgaacttctctcgagaacaaaagagagttgaacttgaaaatgtgatggtactgtccttgagatgatcaaagtacaggccggacgcatcgttaatcgatccggtcaacattctagatcaggcccatgtgcatgtactcctttcactacaaaatccttatatgggctgcagggccggccatttgagtcta

SEQ ID NO: 37046 - DNA, 5180 bp, Oryza sativa
  unsure (1)..(5180): unsure at all n locations
nnnnnnnnnnnnnnnnnnnnnnnnnnnnnnnnnnnnnnnnnnnnnnnnnnnnnnnnnnnnnnatattttctagtacaacgaatctgaataaagagttatccagattcattgtactacgacatgttacatttttttttttgcggggagacatgttacatatttgcttaggttaaggttttttttagacggagggagtagatgcgttgcgtacctggccatgggaatgcgatgcccgtcaggtcacgagcacggacgacgtacggccggcatctaggcacatggcggctcgacggtgcgccacgcagccacgcgcccaccgaggcccaaaagctccgcgccacctcatgccgtgacgtgcagatcccctcctcccgcatcccccgcatgcgcgccacctagcacgaacacccaacgccgccgctcgatctcatccatgatccatcccatcatcgtcgatggcctatatatactctactccaatcaacccaatcgtccaaaacacgtcgcaagtcgaagcacaaaacgcaagcaacgaatctcaatccacaggctcacactgatacgcaacgcacgtagctactgtactgtaggagcaaaagaaaagaaaagatgcagacggcgaaggtgaaggtgcaggacatggtgagcggtgccaaggagaaggtgaaggaggggacggccaaggcgcacggcaaggccggccaggcgacggcggccacgcacggcgagaaggagatggccaagcaggaggagaaggccggcaaggcacaggccaaggccgacgagcaccaggagagggcggagcaccgcgccaacgccaccacgggccgccacggcacgcgcgtgccgcttacggccggcggcaaccgccaccaccacgctccggtcggcggccccgccgtcgaccctgcatacccggccgccggcaccggcaccggcaccggcacgtacgcggcgtccgacaaatcgtacatctagatttggggtagatggacatgggcgggcttgatcgatctggatcgctagtgtgttttttttcagtgtagcgagtgatctggtcccagcccggccgctgatcgtgttagcttgtgttcgtacgcacgcgtgtatgctgtgtgcacatgcgtgtgctggaataaaaagtgtcagatgtaaaattaacatgcttgatgtagttctgttcaatgaaagggctttcgttttcatgtgtttttgaagtacgcatctacggatctacttatatcgatgaatgtaatcatgtagccgtgtcagtgtatgctgtgctccctagtcgttttgattttttccccatttttttgaagtttgatagaattcagagataaatataatgatatttttaacacaaaatgaatattctattaaaatatatttaatgatatatttaattaaattattttggtatcatatatgttgctattttttttataaatttgatcaaacaaaaaaacataaaggagttttaagagtcaaatatgaaaccgagggagtacaagatattgacatccttagttttgccaatccaataaaggtaagagaatatgttatccacgtgcctctcttaaatcaaattgatccaacatgcctctgcctcatgtaaaatatttttagaacttagtatccctattgtttcacctttttagaacgaaatactgatatatcatttccatagcctaaaaagaaaacttgttcggcaaatatatcatttccatagcctaaaaagaaaacttttttgccgggtcggcggaaggacgtcaaccaaatttctttaagataaaaagagggtaatataatatacatgatattacactgtcgagtcgaggggaaacctcgaaaaagaacgtaaaccaaatttctttaagataaaaagagggtaatacaatatacataaaaaaagagggtaatacaatatacatgatattacagagtcgaggggaaacctcgaaaaagaacaggaaaactatttaaggaggccaaaaacatgctgctactcctcgaaagaaaaaattccggccactcttcagatcagaggacctcctgatgtctgccaccaagtgttctaccaccctttctgttataaaaatctttacgtttcttcctttccaaagcttccagcagatcaacatgaacagagaatcgaaatccttacagcttccagcagatcaacatgaacatagaatcgaaatccttacgtttctttctttccaaagcttccagcagatcaacatacacagagaatcgaaggcggctctgtgcctttgaccgaaaacagagacgcacctgctgccaccattttggaagctgtaggccgagctgacggcaaataccttgtctttaaacacaattattaattcttctctagtgttcctatcccacaagaattattttcttactgtccttacaagttatttccttgcggattctcgatagattttggcactttgccatagacttatacacaccattactggtaccatgtatgaatgcgatcagaattcatgtctatgtgatccctacaccaaaacgcatcagtagtggaatggttttgcagggtgaaacacagcgaagaaaaacgacaatatccaataacatgtcattccaatcttaattaagattcgtacacgccgaatactagcgagaaaagaaaaaggtgtacaaacattcataagaaaaccgtacaactaggctgacaactgacaaagcatgctaaataagctaccgattgagaaaaataaaaattagctacctgacaggccaagccatgcgctggggctacttatttgttcctgatctcttttgttcaggcattgtgatactgattactactagcgcaccggattattggccaacgctgccggtggtgtcggtgcaggaaacactgaatccctgatccctacactctactgggtcaacagctaacagagcttaaaaacacaggattatctagtcggtcatcatcttcaggtcgggatcgtaacggccttgattcccagatagcgaccagctaacaggagcatacgaagaatgcatgggatgacctgaattattgaatgtgctgccattaggtcccatgggactccctgggtcatcggagtggtcgcttgatgatccatcagacggaggactggcagccgtggctgcgccaaagccagctgcgtggttcggcgtcggggcagatgttggctcacgtttcagatgttcttccttgccttttttaccttcagcaatgaaactccccactacaacctggaaaacagaatgtaacagaaggccaaagaaaatgctagtttagggcacaaaccagctgaaaacaaagtgatagcagcaaatagatgaatggggaacctgcacgggcgttgctgccatcagcattccagcaacacaacctccaactatacgtccatcgcttccagcaagtgccacactcaaaccacctgttctgctacgagtgtcgccatcctctgcgagcagaaatgagcccgacagagagagaatatcaaagtggccctgtgaaacatcacagtaagaattcatattcatatattgatttctacaataaaaaaatacaattatattataaacaaagcaactgaatattgttcgaatttgtctgtccacatagaaatggccactaacaaccacatgctgtaaatgaaaatgaccagaagcctttatcatcagatttagatattatgttacttgcacctggtgtgactgttgagaacaaagaagaataaaattttcattctatcccccacccccaatttgtgataacattctaaacatactactatactagtcatttctcctcttatcattggaatacatcagaaaataagttatcatagccagaaagctggacaactgagtgcatcctaccaaagcatacaaagttcaaaaaggggttgctggcaattgtgatgtatatatctggtttgttagtgcaagacagacactggagtttcttgtagttcaggcaaacgtagcaactggtgttgccgaacacaggaagtgcagactgcagagcactgctctactgtggctcgatggcaagcttgggcaactcatcggtgtcaagaggcattggatccaccactgtacagtagcacatatactactaagaaaaatctagccacctattttgtactgcactgtaatgaaacaaagacatcgagaaaactttaattaagcatattcattactatttcacagaaagaacaccagtggagctcaagcattgctctgagcagtaagcacactgcacacagatagtttagcttgaatatacctcatatgttactataccaccagaagttgctggttgacgtagtgttgctgtgcaaagagcgccatttgctgaaattatgcatgtagtgcgagggccttgttgtgaaaatgccattatttttgaagcaacatcctgccaaaaagaagaggtgatgcatgcatgctcatcagcttggacttcaggtagaaacatagaagaggagaataggctaaaaggtgtccaatccgtagtagattggcgctaaaaaaacaaccaagtggcaagtgtatgatgatcaaagccaggaaggacactcattggccaagacagaatcaagtcaacaaataatgacataaatatatgcaatctcctgaattgtaaaattactaattcagaaacaaatgaaaggtttatacggagtattctgtaaatggcattgacaactcaaataaactcaaaaagggaacaagtttaaagatgctgaagaatacattatatgttagtttggtatttattataggaagcttatgctacacatctctcttcttagctctcacttatgtatttggttgtattacttgagatcccaccagcagacagatgtaatatgtaaggcacaaagacttattacaatttacaaaccacaagcaagaaatcaaaaacttaagttctccaaaagtaactttgtcacaacaagacaacataagcagacaaataatgaatttcagctcgtactagatagcagagaggggagcattttcaggtacctcattaggcttcactgttattatgtggggagtaaaagatgtcccggaagatcctgaaaatcagcannnnnnnnnnnnnnnnnnnnnnnnnnnnnnnnnnnnnnnnnnnnnnnnnnnnnnnnnnnnnn

SEQ ID NO: 37047 - DNA, 4443 bp, Oryza sativa
  unsure (1)..(4443): unsure at all n locations
acccagtttaaagatgctgaagaatacattatatgttagtttggtatttattataggaagcttatgctacacatctctcttcttagctctcacttatgtatttggttgtattacttgagatcccaccagcagacagatgtaatatgtaaggcacaaagacttattacaatttacaaaccacaagcaagaaatcaaaaacttaagttctccaaaagtaactttgtcacaacaagacaacataagcagacaaataatgaatttcagctcgtactagatagcagagaggggagcattttcaggtacctcattaggcttcactgttattatgtggggagtaaaagatgtcccggaagatcctgaaaatcagcacataaaagaacatatatatcagatctggcatataattattgatccacacaaagtggtcaagttcagttgaggttaaaagagacccaaaaaaaaactacgaaatctgacaaatggcattatcattatcattctgaccgtgccacatgggtaaggactatggaacagaacaaactactactaatatgtaaaccgagttgacactgccctgttctgcaggggcaagtgtagaagttattgtaattcaaaacatgcaaaaaggacatcagcaaaatattgtccatttgtcagtatatgcacatagattggctcttaatagaaagtaacatatataaaagaaaccaatcaccaatgaatgttcaatattcaaagactaagctcatatttgaataattcctacttttcctgtttagactgtgcccagtgcaacaccaggaaaggataaagagtgcttgtacttttctttattattcaaatctctgcctgcactattctgccatatttttattccttcagaatgatgagggatccttaaaaaaattattccacacatgccctttttaatgcacacaagcaaacacatgaattaattccatttccaacaatcacactccatacccgccacaagcttggaccatatttttccaaagctacaggccaagcaacattgcacttttcagtcatattaagccatatcatttcagagttcagatataaacccaaagcagagaaatgatgcaggcttacccaaagcatctagctgtttttttttcccggatcctgggggtcgccctctgcgcttcccgtcagggttcgagttcgatcctgcaccacctgaaggtccgccggcctccgtccctgctgcagccgcgggcttcagtcccaacccgatgttcccgtcaggaccatacttcctcggcctccccctcttcttcttcacgagctcccctccgccgaccgccgtgccgccaccgccggaaccgggctgctgctgcatgccctgcacgacgggatcggtgcggtacatggtccccgacatatccgcgggcttcataggcgacgaggcggtcggcgacgccatggggttgaacgagagcggcaccccgtgcataacattcgccgaccccggcggcatcgccggcgcggcgccgtaggggtgctgaggcatcatcacgccgccgccggccggcggcggcgagctcacgcgcggctgctgctgctgctcccggccatccatcccggcagcgaaaccctagggcacccacccccacctgaatcgaagccgccgccgccgccgcagcagccgctcctcgcgacctctcctcacctgcgcgtttcgccgaacagttcacatgcaccgttcggcgcggcggttgtacgtgagctctatgcaccggaaaacaaatctcgaaatcgaataaaatacatcggaaatggaggaggaggaggaggggacagaatttctgcggatgcggagaaaaaaattgggaggagaaatggagaaaacagggggggaggtggcgaggcgagaggggttacctcactgtgaggggtcagatcagatcagatctgagtgacgagaaaacgcgagatatcgagtaaaataactcgctgcctcctggctcgccgcggcgtcaggacgagaataggaaacttactactgtactgtatttgaacctttttcgtgatgaaaattgttgttttttctacaaatctatctattttcgtttagattattttttttaagtcaagagagaactttattaatgactaaatagagggttacattcttgatttaacaagtctaggattatgcgggggcggcgcacagcctctactccccacacgacctagtactcattgccatttgtgctaacacatgagcaaccctattagcttctctcttaatcttgtgcacttgcacccgttggatacattgtatcacacctttgatttctgcaaccgtcgtcgcccaggaggatcttgaagctacctgctgtgttagagccttaacaacatcagcattgtctagctccagaataatcggcatatgaatccacttcattgcttctttgagcccttctaaacatgctagcacttctgcttcagccgctgaggtacactgatgcaaagttttatatgcagccaggagtactagcccctgcaatctctgatgataatcccagcgcttgcttcgcctgtttcagttctataagctgcgtccacattgagctttgcacttccatcaggcgggcaactccacttttctttctctgcattcaactgacatgtctgctctttctgacatggatcctgaaacataggtcctttccccttgatgtcttccatgtgttttcgggcgggcaactgtaggttatcataattaatcaaaaaacgcaccgaatctgtaatagggacattacctttaccatgaaccacctcattcctaatatactaggctctccacaacaagtataaaacctgggccttcttttcactgcttagtctgtctagcagaactagaagccaatctggtcctgtcattgaaaacaagctttcatctggcagtgtccaatgttctctcaatgaagctcgcaacgctttggccagcgtacactccactgttgcatggaaccccgtctcctccttctgtccgcaaattgggcaggttccaaacatctcaatcttcctcttttttttattctcccaagtggccaatctgtcctgagctaatttccaggcaaaaaccctcacttttggctgaacattcgctttccacacattatcccagatttttcttccatctgctccccccgagcttgaagaagcttgctctgatgttttcctagcaaggttccaagccaatctataaacacttcttactgaaaatatgccagttttctcataatgccacgctgggaaatcctcttcctcccgttgtggtattcgaattttcagaatttcgtccgcatcctcctctcttataatgtgtctgattaagggctcattccatgttttagtgtcggtgacgattaactcccggacatatataagcctattccaggttttcttctccaaaatctttagattttccccatgtgcaacccagtggttcctccatatctttgtcttacttccatctcctatcctccatatcagccccttctttagcaactctagcccatgcacaattcctttccatgtcggcgatgaaactgacgggaacgctgtatcagttattgtcccatttggatagtactttgccttcagaactcgtgcgcataagctatcaggcgattcgattaatctccacgcttgccgagcaaggagagcctgattaaaacatcggatatcccgaaagcccagtccacccaaaagttttgggcttgtaagtttctcccaggcaatccaatgaaccttcttctcccctttttcatgcccccaccagaaattccggacgagttgttcatattcttcgcaaaaccgctctggcatcttgaacactcccattgtataagtcggcaaggcttgagcaacacttttaatcaaagcttccttcccagctaaagaaaggaatctctcactccaatctgtaagcctcttctcaaacctctctttaattggttggaattgctcagccttcattcttccatctggggttgggagtcccagacacttatcatcaaagcatgttctttcaacttgcaatacagctttgattccatcttgtctctcctgcgggcagagagcactaaacaataacgtacattattttggattaatgagttgccctgtacaccgctcatataaatccagtgcctctttaattctcgtcgcttggatcacttcagccttaaaaaataacaaactgtcatccgcaaataacaggtgcgacacaccaggagcagagcgacagacctttagaggctgaatctgtctttcatccctccttctttgcagaatatttgataggccgtcagcgatacaaagaaataggtatggattgagtgggtctccttcccgcaaaannnnnnnnnnnnnnnnnnnnnnnnnnnnnnnnnnnnnnnnnnnnnnnnn

SEQ ID NO: 37048 - DNA, 1002 bp, Oryza sativa
tacagacgtcacacatgacattatccactttctccagatatttccaaaccccaacttttgcaatgctccatccaagaatccccagtcgactctgtcgtaagcttttgaaagatccagctttaacgcacagaagtcttggctttctcgtgtacacttatgtatggaatgaaagcactcaaaggctactaatgcattgtctgtaatcatacgcccgggcacaaaggcactctgggtctccgatataatctcttgcaacaaaggcctaagccgattgactaagcatttagccaccactttgtaaatcacattacaaaggctgactggtctgaaatccttcatctccaccggtgcattcgtttttggaatcatgacaataacagtatcattcattccttccttccattctccagtttcaaaaaactctcggacaccttcaatcacgtccctctttaggacaccccaattgcgttgaaagaagcgtgccggaaaaccatcgggacccggtgctttgagaggaccaatctggaataaggcgtcactaatctcttcatccgtaaaaggctttgtcaacatgccattcatttcatctgttatttttggttcaaacatattcaacagctcacctggattaaggctttcatccttcgtgtacagatctcggaagaagctgcgtgcgatctctcctaactcctcttctttactgcacatcataccatctgatcttctcagcttcttaatcaggtttttccgtgctctccaagacgctttcaaatgaaagtagcgagtattccgatcgccttctttcagccaggtgatccgggatctctgcttccaccaaatctcttcgcgatggagcagttcctgcaaaaaaattttcagcctgtgaacatccggttctgagtcttcccttcctctcattctcatttcttctagctctcttctgcatctttcaatgctcttctttatatttccaattttatctctgctccaccttttgagatt

SEQ ID NO: 37049 - DNA, 5213 bp, Oryza sativa
  unsure (1)..(5213): unsure at all n locations
aatcaaagcaccgctttccatacgcgcaacgcagtgcatgcatgtacactgctctggtgaattattgtagtcgtactggttcaattcataaggatactcatctcccaagagagggttatcgaataagccagatatctctgcacaaagctctaattcctgaacatagctcggaattgccagtaccctcttcaccttctccctctgctcattgacaccacacttctcttgctttgaaatgctgagctcaagcatcttcaccatggtgctgaaactgtgcccgagcacgacgatcttcccgagcttgtccgggctccagttcaagatgagcaaattctcaaagaagacacggtccgcgtatggcataaagatcagagttggttcttctaccaccaggcatagcgcaggagatgtggtgacaatgcagcccagctcctccatggcccggcgctccactggggccacggtgggatcaaccacctcgatggcgccaaccagctcgggaaacttgtcccgtaggaggagcagcacggcgaggcggaaccgtggcgcccagctgtaccgcaagccgccgagcctatacgccacgacacggagccgctcgtggccacgcccacggacgcgctccaggccctcgaggcacgcggcatcggaggagaagagcgcggagagcttcgcgaaaagcggcgatgacatggcaagctccatggcgaaccacaagaaggacatgagccgcgcgtggtcgcccatcacgaactcctccttgatcaggttcaaagaacgcggaccacctgggcacgccgcgcgcgcggcacaaggaaacaaagatcgcgaaaccacccaagtttctccggaaaaaatgacggcttccaaaaaaatcccaaacacgcaacacatcatgcaccttttttaaaaaaaaacgtgtaaatatataccatggtccattgaaacaaaatataggaataaaaatattagcagaaaaatattggagtacagctggaaaatatctttaagatctagcaattccttctccccactgcggcacacccctatcaccccaagtttctcaaaaaaaaaacacatcttgcgtcttggaaaaaacaggtcaacatatactatggttcattaaaatgattgtatgcatcccaacacatcttacaaaatatcaatattagaaaaatcgagatatctatatatctactactgtaaaagtaaaatcatcctccttctatgccatcctccaccacccgcatgccttccacccacatttctccagagaaaccaatggcttctagaaaaaatcgaacacacaacacatcatgcacctctagaaaaatgtgtcaatatatacattggtccccatgcgtctctagaagaagagccaacattaacagacccaaaaaattaagcaatctatattgcgaaataaaggggttgtttgcatgctatacaacaatcatttgtcatacttttgtgccacactttagctaagttatggccaataaaatgtaagccacactttagctagcaaataaagagtgtgccacacatttttgagttaatgacgtgtgagaccatgagaaatgaaagggaataccacaagtgtggccatgaaccaaacaatgagttaacttggtcaaacttgcctaatatgaggtgtggcaatcttttggcaaagtaatatagacgatttgatcagtactcctctagaaaaactggccaaaaaatggatgatttgtgtttggcaaataatagaatttgatatgagcatagcatgagcaatttaccaggagaactgaaaagaacacgaaatatagacatcttgctgttcaggatgcatgaatccttaaagtagggaacgatcgtttgccatggttggaaagggaaactttcaatatcgtttttgacttgagggaaactttcatttgttttaatttcctttgatcaaaacggttacatagtgaagcttttcttagtaatcataaccactaggcacttctggggaaaaaaaagaaaagtgaatgaatttttacaggatttgaatacttacagtaaaattcctatcaagtcattcataacaaagggttgatgcttaaaagtttatgtggaaatccaattaaggtttcctctcgtggtgttctattcttgtgtccactattattttatctttcctattcctatgtaccatccaaactattattttggaacatttgagtgtgtctaattctttaggaatttgcttggcaagatattctaattatattcttttcaggcttctatgttttcaaaatcctacattccaaagttccctgcaattcctttgaaattcccttgaattgtactaaagactttttttttacattttactggacttgcagtaatggcgatgtgcttgaaaacttacgacatttttctatacgagaggcagcctaacttctcagtaaagaccggcgcatcgcatggtagtgccacactgccactggacgctgctgtcaatggcagcatgatcttgcccgacatagggaggacattgacatgatgacatcctctactagctcgaccagctacaacttcaggggttcgagatggcattccctcatgttggcattccctcatgttgtgaggggaatgtcatcctctactctctgctctctctcctaggcttccttgtgctgcaggggttttatgtacagtaggaccctgggaatgctgaaaaacaacatataggaataaaaaattagtagaaaagagaaaaaatataggagtatgactagaaaacaagtctgctactataaaagcggacctatcatcttgcgattccttcctcctaccgcccacacctaacacccaagtttcttaggaaaaagcggcggctttaaaaaaaaacacgcgacacatcatgcacagtaaaaagtgtaaatatatatcgcggtacactaaaacaaaatataagactaaaatcttagtagaaaaaaaggagtacaactggaaaatatctttagtaacataaaaagaagttgttgtcttgcaattcctcctcccaccactcggcacgcctatcacccccaagtttctcccaaaaagccagcgacttccaaaaaagcaaaacatacagcacatcttgcatcctgagaaaaatagatcaatatatactgcgtttcattaaaatgacggtatgcatcccaacacgtcttaaaaataccaatattaaccgccccagaaaaatcgaactatctatattcctactattgtaaaaccgaaatcatcctccttctatgccctcctcgcaccacccgcacgccttccacccatgtttctccgatgaaaccaatggcttccaaaaaaaaaaccgaacaaacaacacatcatgcacctctagagaaacgtgtcaaatgtcaatatatacatcggtccccacatgtctctagaaaaagagctaatattaacaaaccaaaaaaaataaacaaactatattgcaaaataaaggggctgtttgcatgctatacaacaatcatttaccatacttgtgtgccacactttatcttagttatggccaacaaaatgtaagccacactttagctagaaaaaaagagtgtggcacacattttttagttgatgacacgtgggaccatgagaaatgaaagagaatattaccataagtgtgaccataaaccaaacgatgagttaacttggtcaaatgtgtctaacatgaggtgtgtcaatttttggcaaagtttgagaccgaaccaaacaaccccaaaataatccggatgatttgatcggagcgcctctagaagaatggacaaaaaaaggaatgttttgtgtttgggaaagaaataggatttgtgctaagcatagcatgagcaatttacccggagaactgaaaaaaaaaagaagaaatatagacatgttgcagatcaggatgcaggattctttacaacaggaaactttttatttctttttttttaacttgagggaaactttcatttgttttaatttcctttgatctaaacggttacatggtgaaatttttcttaggaatcaaaacctttaggctcttttggaaaaaaaagtaaagtgaatgaattttagaggatttgaatacttatggcaaaattcctatcaagtcctttagaacaaagggttgatgcttaaaattttatgtggaaatacaattaaggtcttatcccgtggtgttctattattgtgtccactattattttatcattcctattcctatgtaccacccgaatgattattttggagcatttgagtgcatctaattctttaggaatttgcaaggcaagatatattccaatcttgtgcttttcatgctttatgttttcaaaatcctacattccaaagttccttgcaattcctttaaaattcccttcaattccactaaagagtgtattgttgttttcgaatttttatttttaattttatttattaaaatatttaaaacatattctttttaaagttttataaatctacacctatgttgcccttcacaaatctacaatgtcacatggaggaagacaccattttacaagcagtcaccttatcgcctgcaaaggggctcacctataaaatggcagcctaggacatttctaagcatctggagagagttgtagcctctggagagagttgtagcctctaaggggccggttgtaaaatgacattgacggcccttttatagtcttttaggagggtggcaggggttgcctgcaaaatgactggcatccctccacatggccgtgtgccacgtcataaaaaaacattaaggttctgttcttaggtaagggttggacacggaaaacggagcaatggattagtacgtgattaattaattattagcctaaaaaacttcaaaaatagattaatatgattttttaaagcaacttttctatagaaaatttttgcaaaacatacaccgtttagcagtttgggaagtatgcgcgcggtaaacgagagaataaggttgggaacttgaacttaagaacacagccatatatagtggtgtagaaatataaaattttgaatattttatataacttttttataaatagtttaaaaaatcatcaattcatggaataagttcattagagttctcttaacttggcaccaaattcgattttcgtccaaaaactcaaaagccagatacaatacgtcctccaannnnnnnnnnnnnnnnnnnnnnnnnnnnnnnnnnnnnn

SEQ ID NO: 37050 - DNA, 3959 bp, Oryza sativa
tcttttaggagggtggcaggggttgcctgcaaaatgattggcatccctccacatggccgtgtgccacgtcataaaaaaacattaaggttctgttcttaggtaagggttggacacggaaaacggagcaatggattagtacgtgattaattaattattagcctaaaaaacttcaaaaatagattaatatgattttttaaagcaacttttctatagaaaatttttgcaaaacatacaccgtttagcagtttgggaagtatgcgcgcggtaaacgagagaataaggttgggaacttgaacttaagaacacagccatatatagtggtgtagaaatataaaattttgaatattttatataacttttttataaatagtttaaaaaatcatcaattcatggaataagttcattagagttctcttaacttggcaccaaattcgattttcgtccctcaactcaaaaaccagatacaatacgtcctccaacttacaaaaccggtgcaaacgatgtccctcggcagtttggatggcagttttggctgatgtgatgcctacgtggctggtttaacttagtcctcgtcctgcgtggcggtgccatggcgctgacatggcagtttgatttgaaaaaaataaacgaagcaacattaaaaattaaaacaaaatatgtgggacctatatgtcagtcaataaaaatagtgggcctcacatgcatgtcagtgggtcccacctcctccacctaatcctctctacctctatctcctttctccacttctccaccggcgagagcgtgcagagccgcagagggataaggcagggaggtcagcgagacgggtggggaggccagaggcagggaggccgatgttggtagggcaccacaggtaggggctcgacagcgacgggcggatggagaggtgcacagcagcgacgcgaccagtggggagaagggagaaaggtggaagaacttcagtaacggtgcgagcgagcgcctcctccggggatagcggtagagcaggctccgtctcagcctcacttcatcctcattggcggaggggggaaaggaacggcttcttgatgaggtggagctcgccaccttcgccgtcgtcaccgccggaggaggaggaggcacgggcattatcttctttggtccgtcccggcgatccggccgcccatccctttgctctgcccgcggtccgcagccgctccgcccgtccctctgctccgccgctgctccacctatccctctgctccgcccatccacccctctgctctgctcgcggtccacggccactccgcccgtccctctgctccgccgccaccctgttccgccgcccgctccgccggcttgctccgcccacagtccgcggccgctccaccccccctgctctgctgccgcctcgttccgtcgcccgccctgctccaccggccggctagccgctccaccccacccgtcacccatgccatcgcgtctcctcccccaactagaaaacctagagcggcttctttcctctctagctcatttctcctcctcttagcctcccaaaaccctagctcccctcgatctgatgccgtgaggctgtgacctccccagtttcgccatggaagaccccgtggttgccccatcttcctccgtcgcggtggcggcggcggctgtggctagggttgcgccggccgctcctctccgaccccatgcagaggagagagaggatagtgagataaatggagtaatgaggctgacatgtggcctacatggccctcaccatgtttaaataattggtgtgtaactgacatgtgggccctataggctttattttttttggatcgaattgccacgtaaacggcacatcaaatgccacgtgggacgaagacctagtcaaataagccacgtagatgccacgtcagttaaaatcagatgctatactgccgagggacctcgtttgtacggttttgtaagttggggatgcgttttatccagttttgtgatctagggactctgaactcgatagcaaactgagggacctaaagtgaacttattcattgtttcgttagaatagagcccagcccagcctagcccagttaaggagaacccaaagaggcccaatcgtgggcggataacgcagcctgaactgatgaaaacaggtcggtctctctgtgcgaccgtgcctttccagtatccgcccgaccgcccctaccgcaacctgtagccgctgatggcttcgacgccggcggccggccccaacggcgtggcgtcgccggcggggcaggctccttcgagctcgctccccggatttcacgaggcccctcctagcgtgctcatatcgagaccttcatggatcgtccgcagcgaggtgagctcaatccttccctgcacctctccccttttgttctcgtgcctgcgattcgtcgaacacttcgtagacaggaagcgtagttgaatcgaccggtaggtttttcctcggcagcgggacatggagaggaggtgtggggatgggttagggtagcgggtaagattgtgctgcctgcagcagaagctagcgcgatgggaagaatcatgaggaatcggcaattgagtaccaaaaatgaggaaattaggccatggttggtagaaattgtttcggcattacatttacggaattgtttttttctgaccaagtcgccggaggggggcgttccccacctgaatatatttcaaaccatcttacagaatgttaaggtcgtcatgtgtatcagaactttgtagcaattgattccacttcttttttattgaatacctgaagcttagcaccatgcaaatatgcaatccactgaacactttataagcaaaatttacttgccattcacttcatgacttagatcttgttccaacgtttttacagccagcaatgcttactgtgtgtttgctctagcctgtagtgatttcttaactccaaacataccaaggttggccttgcagatttatgtgttttttgatgtagcggtcgggttatccattatctgaaaaaaattgtgatagtacatgagatttatcatagattcattgcgagggaaacatggcaggggaaaaggggaatggggttgagaaagggcatgctattttcctttctgtgccaactgataccctctctgtttgtcactgagttaggagtccttcaacttgccagacagatggaacaagaccatctcagaccatattgtacattaagaattgtcatttgttaacttttgacatgtttatacaccaatcctgatatcttcactgcaagtatgatgcagtcaaatattaggagggagagaccaaaaaggcctgatcctccatgcaccatctgcagaggcacaggcaaaatagattgccgcaactgttttggtcgaggtatctcttgtactccatgttctcttctcttgctagtatcatgatcctacaaaccagttctctcatgaccatggaacctgggatttacagggagaaccaatcatgccgatcttgtcatgctcccgaagggcgaatggccacaatggtgaggagctcatagcctcatactcaaaagctgtctgccatacttatgctgctggtactgagaaacatgcttctccggcatgacttccattttccaggtgccgtatatgtggtggtagcgggttagattactgccaccgttgccatggaaccggtgaatttcgagaacccatgggctttcacttcgctaccatccacaggaaatgaacttcacctagacagtgttgtatggttgacagtccgacagatctgtgtagagaaatcataattacttcatgatatacagttcaaagagttgaacactactagtttagttcgtgaaaaactccattttagtttatcgcaatgctcgtgttatggaatccggactgctcgcaatgacggtcatcaactctttgatataaacttgccggcattggcccgagctatttctgcaaagctctagttctctgtgc

SEQ ID NO: 37051 - DNA, 6063 bp, Oryza sativa
  unsure (1)..(6063): unsure at all n locations
nnnnnnnnnnnnnnnnnnnnnnnnnnnnnnnnnnnnnnnnnnnnnttcgagaacccatgggctttcactttttttttttttacaggaaatgaacttcacctagacagtgttgtatggttgacagtccgacagatctgtgtagagaaatcataattacttcatgatatacagttcaaagagttgaacactactagtttagttcgtgaaaaactccattttagtttatcgcaatgctcgtgttatggaatccggactgctcgcaatgacggtcatcaactctttgatataaactgtcgggcattgtcccgagctatttctgcaaagctctagttctctgtgcatatggtgcatcatatctaaatagataaattttaccatccttaagaaagtacttgacttctctagttctctgtgcatagtaccatattttataatgtaaaatttgatattttcatatatcaaaattttcagtgtaaaatttagatactttctttaaagtaccgtaaaatttctctattaaaagacacagcgcggtatctgcgcacccacgtctccctaataaccttcccgtccatcctgtctagatttttcacattttggtccttttgaaaaacttattttgcaaatagacccctaaaaaaacttatcccagaaatggtcctttttgaggcgccagagtggctggcgccgtcatccaacgggacggcgccggcctctctggcgccgtcctcctgccaccgtggcacacgcgaaccaacgtggcaggaggagggcgccagtatggctggcgccgcccccaggaggagggcgccagcatggctggcgccggcccccggcccttccaaaccctggcctccattcctgcttctctgtatggagttgcaacagtgtcatttttgttttatttctcggatgttttttcactctcaggatcacgatacaaccaaccaaaaaaaaaattaaacttgaactaccacttagtctactttgcaccttcactaatctaccactttgatctaccctttgatcagcatgttaaacataatgcactctaccactttatgaaattacttaatctaattcaaaattccaaattccgcttgcaagattgtgttcggcgatattaaaacctccaaattccgcttgcaagattgtgttttcgatgagagaagtttttcggtagagctttggaaaattccacaggccacatgtttcgtccgtttgagtttattttttatatttttggttcttgtgagttcctaagcgtgaaaaaaatatcaaaaaaataaaaataaaaataaaaaaagttgcacatctctctcctctgcactagttcggagagagaggagaggagaggaaaaattctacatgtcacatattacgtccatttgagttcattttttctatggttggttcttctatgtccctaagcgtgaaaaaaatatcaaaaaaataaaaaaaaattaaaaaaaaattttttggggggggggggcgccagccactctggcgcgctccccctagccacctcagcattgccccgccacgtcggcagggggacggcgccagagaggctgcagttggacgacggcgccagccactctggcgccccaaaaaggaccatttttgggataagtttttccaggggtctatttgcgaaataagttttttaaaaggaccaaaatgtaaatcatatccatcctgtacccacactcgatgagacggcgcggctgcctggtgcgcgcgagatccctgagcgacacgaacacgtgccgccccacgccttcctccacctcgtccccctccgagtagtagtagcagtactcgggccccggcacgcacgggtgctcgagaggcaaacccagcagcaaatcctcggccatctcggtcgccgtcgcggagcgccgcggcaggaagggcagtatcgcggtgtggaagccgtcggtgtgctcgacgcacgggaggctgcactcccggcacagcaccctcctgcagcagctacccgcgtacacgcagcccatgcccctgcagccgccgccggccgcctcgcatggccggaatacgcaggaggcagccgcaggctgctcgccgccgctgatctccacgtgttgcggctggtagtagcagcgccgcccgccgtcgtcgtcgcgaagagtcggcgcgacgtagtcgggcggttcgtcgtcctggatgggcaccaagctatccccgtacagcatggggaatgccatctggcactggggaagctttagctggtcgagcgagtacaaggtgtcgatgcttctcgtctcgagatcgtagtagcccaatgctcgccctgtgtcgagcaagatcctgccgccgccattgctatcggcgacggcgtccagtggcactaccaccacgcccgtttttagtgagaagtccgggtacctctcgtccagtaagatgctgtaacttttgtgccatgtgccgtcagcctcctgcatcgtccatatctgcagattgttctcctccgcgtttgcgacgacgagcgacagcgatccttccagctcgacgagcaacggataatcaccgccgtccctctcgctgcagcatggctggcatggcaagacggagaactcccgggaggagatgtcaaatgccacaatgacacggtctcgggccgtcggctgtggctcgctgatccagtagagcgtcccgtcaacatgtgccggtggcatgtcggtcaccggcctcggcggcttgccagcgcagctccagtaatccacgcagctcgtcttgatcatgcacagctgcaggtcgcctttgaagcggctcatctcaaccactacatgctcttgtgacaaccggtcgaatcctagcccgatgttcctgccaactctcgtgacatggcggcgatcgtcatcaatactgacagttggatcaatctcacgaaactttccacggattccaagacaccggatagaaccagtgcaagggttgcacaggtagtcgtcgctgctggtgcttatcaggttaagtccatggcatggcttagagcagaggatcctgcggttgacaagaacgtccgaacgagctttggcggcaggcccaatccaggtctccaccggcatgaaattaaagaaattctcccgtcgacggccattcgtgactaccatgaccttcttccgttccatgttagcaagcatgtgtgacgtaagaaagcgctcgctctcgatcagtgtgcgccactgtctgcaaacgagcatgcacatggcgattgatttgggcggcaaccgtagtaggatctcagtcatcgccgccgtggcttccctctgtcgacaactctcgccgcctacacgggcaaggctgtcctcgtacagaccaatccgaataccggccaccgcctcctcccggccgccggcgaaatcctctgggacggtgaccaccgtttcgatgctccccgtagctgggtcgtaggcgtgcaccttgtgctgcgaggtagcgatcaggattttcttgatccgctccacactcccgacgtcgtctccgcgcgcgccgccgagacatccaaggacggtgatgaaccggggatcgtgcatgtcgcgtgccacctgcggcgtcatggcgacacggaagtcgagtgaccatacgctggcgctgtaatctctcagcgcccatatctccaggcagctttcaccatgcggaagatggcggagatcgcggaccatgcacaaagagccatggagctccaccaggtggagtggaacagccggggagtggctgtccaaagcgcagtaatccgctatgccgtcgaccgccggcccagcgaccaggctgaaggcctcgtcggcaacagagaagcatagcactggaacgctgctgtttcggttctcaaataccgtcgtgtcagggaagaggtcttgatcaagtatttgtcagggtagagctgccagtgcaagaacccattggcgtataccgggggcaccttggttgccgcgccctcgtagaggagggcgcagatcaccacgccaccgagacgccccggtatgcctccggaggctggcctccacgggcggcttggggtgcagagcgtgtagacctcgcaaccatggtcatggactcactctcgccgccacggctcacatggcagaagagatgcaccaccttgtgctccttggtccgatcgtcgaaggctaggccggcgctggacagatcgtggcagcgccgccgcggcaatggcctgaacacgccggtgctggaattgcacacccagtaggcgaaggatcgagtgtcagccaggagcgtcaggccgtggcacggcctgcttgagacgacgaggaagcccgggcgcaggcggtcgatattgaagagcaagtcggtcgtcgtcgtcgtgatgcgccggactgggccgacgtcgcaggagtagacagccgtggcgcctctgggcgacgccggcgacgccgcaaagaagacgaacttgctcatgctcatgcgacgggcatctgccatggccgcgtagccgtcctggaatccaggagaagagagcatagcggcccatgagcgggagacagcgcggaaacggacgatggaataggccggcaggcgcagaacgatttctgtcatcatttcgtccggcagcggctggccggcggacgaccggcgtgctctcttgcccctcttcgacgacatatgctgcatgcctcgactgccatgaatgatcgatgaggcctgaagttagtgcgcgagagatacgctaacttattataacaaaagtcgggggctctgttgaatccgattcgagtgcgtgtgttctattcattatcggacaaggagggattctgtcgaatgatcaaagagaaaaaaaaaaacacgcgtcatatatcctcatatgtaggtaggcatcgagatcaggcgcttcagttttttttttaaaaaaaaatggtgcaacttgacaatatgaaagttaataggtactctatgtttagggattattaaaaaattcatcatcaggccgggctgcgttttgttccttccagttgggaactaatctcccgcatacaaaaaaaaaccggagtaacttattatcacgaaatttattaaatattagttatattttttaaaaaaaatagattaatatgattttttaaaaacaactatcataaaaaaggctttttattaaaaacacatcgtttaacagttttaaaagcttttgcacggaaaacgaggaagacaaattggaaaactcagctgccaaacaggttgaatctggtataggagatgtggattttcatccctctcgaggacatcctctcgttatttgcatgtcatctaaatagtcaaaaaaaaatatgaaaaaaaccgacaacatagattaatatgaaatatattactccacaaacatacaggtttagactttcagctcatctgatttgcatttcaagtccaaaattccttacttgtatttctacttttccatctggataaccgttcagacatggtcacatactcgcattctatttactcatgaattaaacattactggtcaacaactacgagtaatggcaattcacagcattggctagagaaaacgtcagaactcagaacatagatgagaaaccatcgatgaacattcaacaaatcttcggggtgggttacacatgcacaattaacacgctagcattaatcaatctaaacgtgcaacctcccaacgtgcaagcaaaacgatcgggacaattaacagcttggcaacactctataaatacagtttcccgctactacggccttggtgctccaaagtgaagcacaaaacacaacaggtgcagccaaagagagctgcggttttgcgaggccaaccatgaggacggccttgctgctcgcggcgctcgtggccgcgtgcgtcgcgcacggcggcggcgccgatcagtcgaccccggcgcggcggtcgctcacgttcgacagcatcttcccgggcggcccgcacaccgactcgggcatctgctgggagtctctgctgacgctgggccgctgcaagcacgacctgctcgccgccttcttcacggggtgccccattccgcgagcgtgccgcctcgcggcgtgcgaggc

SEQ ID NO: 37052 - DNA, 1913 bp, Oryza sativa
gtcagtccccgctggtgctcaagccagcccaaggcctcccaccaccaacggtggggcgtgcgcgccatcggttcccagtccaacaccaccgccgcaggcaccaacagctgaaacgagcgtgcgctctcctccaccgtccgatcccagattctcccttggtccaccaaagacatttcccagtccaacaccaccgccgtcggcgccaacggctgaaatgagtgtgcgatctcctccaccgcccgctccgagattctcgcttggtccaccgaagacttttcccagtccaacaccaccaccaccgtcgccaatggctgaaacgagtgtgcaatctcctcctccgcccgctcctagattctcccttggtccaccgaagacctttcccagtccaacaccgccgccgccaacaccaacggctgaaacgagcatccgctcttctccaccgcccgctcctagattctcccttagtccaccaaagacctttcctggtccaacaccaccaccgccagcatcagtggctgaaacgagcgagctctctcctccaccgcccgttcctagattctcccttggtccaccgaagacctttccccgtcgaacacctccgccgctggcgccagtggctgaaacgagcgtgcgctctcctccaccgtctgctccgagattctcccttggtccaccaaagacttttccccgtataacacctccgccgccggcaccaatggctgaaacgagcgagcaccctcctccaccgcccgttcccagattctcccttggtccaccgaagacctttccccgtcgaacacctccgccgccggcagcagtggctgaaacgagcgagctctctcctccaccgcccgttcctagattctcccttggtccaccgaagaccgttccccgtcgaacacctccgccgccggcgccagtggctgaaacgagcgagctctctcctccaccgtccgttccaccgaagacctttccccgtcgaacacctccaccgcagacaccgatgtctgaaacgagcgtgcgctctcctccaccgcctgctcccagattttcccttggttcaccaaagacctttccccgtcgaacaccaccgccgccggcgccagtggttgaaacaagcgtgcgactccctccaccggaacatccgacagcttcttccagtggcacgaacacgccgccgccggacgcatacacaagtgtaagatcgccgccgccacgcacaccaaagatctccggtggcacgcacacgcccccggacgcaaacacgagtgtccgttcgccgccgtcaccacaggacacaccaccgagagtttccgtggcaagcacacaccgccggacgcatacgccagtgtacgtgtgccaccaccttccacgccagagtttccgccggtggaacgcaggcgccgccggaggaagacacgccgagagcttccggtggcaagcacaagagcccagatgaaccaccgtcgccgacggtttccggtaacatgaccggtcgtccaccaccaccaccgccgtcgccgacgttttccggtaacatgactggtcgtccaccaccaccatgttctccgacggccgtgtccagtggctccccggcagtgcctgcgtatgacggtgcagccggccgtgtgggtgggtcgacgggacccaacccgaaggttattcggagtggaggctcaccgcccgtggcagctgcggagtcgccgccgagcagctcgcggacggcgagcccgagcccggattttccgtacggcgctggttctgactagcttcttcctcgccggccgggcggcagcggcagttggcgacgctgcttctctgatcgtgtttttcagttcgcttttcaagtgtaatccatgcttaataaatgaggggaacgtttggttccgttgatacttgctgcatatagatgt

SEQ ID NO: 37053 - DNA, 6211 bp, Oryza sativa
  unsure (1)..(6211): unsure at all n locations
gcggcagcggcagttggcgacgctgcttctctgatcgtgtttttcagttcgcttttcaagtgtaatccatgcttaataaatgaggggaacgtttggttccgttgatacttgctgcatatagatgtgatgtgtgttttttcactttgttcttcttcaagtgtaacgcatatatctaatgagcacaaatgcatcactactatttccagaactatcacattcatacaattcgtattcgagcgataaaatagctgtgcagcttgcaaagaaaagctagctattccaaccaataactgaaactctcaaagccaaactatttcagagttggataacgcgaagaataaataagctgccatgagtttttttttagaaagagaggagatcctcttctatttcattaatgaaatgaaagtagttcgacaactaacaaaatggctgccatgaggttttgcaacagaattacatgtgacacaatgcagttagaagatggttcttaggtttggagcgtaacagtaacaccagcagtttgggccggaacagaatagtgacgaacaaactgggctggatgatagcccgtgtccgctccccttcctattcggtccagcacggcccggccccaccttgctccaggctacagacgtatctgcgggtggggcccgcagctccgagcgcgcctcacctcgccgacttctccagagacacatggcctcgcgattcgtgcagatacgacacctcacgtgcacctctcgaagtgttttacaactcgagctcttgtccgtttcatcacgggcgaggcataatgcccagaacctggtctatggaccgagcctgataccccaccatccaccgagcaaacgagcggtggatgcggcggtagtccacgatggctcaccgaccagctcaacccccgcgcgtcgtgatcaacgtgcacggtcatatactccgtaaagaaaccgaacccacaccctgtcgtccttgtcatcctcggttggcctccttcccccaatcgtctccaactctccatcgcccatagctttctctcatcttcggccctgcaggctgcagcctcatcgctcgtccctgcagcctcccgctgtcctgccagattatctggtaagcgctcgctctgcatctcgtgtatttataagcgcgttagtttctgcaccggattattgctagctggtcaggcgtccctccggttggattgtgtactgacagtatatcgtggttggtttgtgttgcttgaccgctcgtcgcttggttgattacttgattttggttcagtcgcgagtacgtgagtatttaaccatggaagtaattcttgtctaccgttccgtgtggggagatttcatgatttgttgggataaaggtccgttcatttcttcaacaagagttggttgaagataaaaatttttgtggcatgcttttcaaactgttaaatgatgcgttttgtgtaaaaactttctacatgaaaattattgtaaaatatcatattaatttattttttaagttcgtaataattaaaacttaatcaatcatacgttaataccatctcgttttactttaaaaaaacttaatcttcatcttcatatttattttcagaaaaaaagaacaccagcaaagagtcttgtttatggcgatgaacacatcctgactagtttgatttgatctccctcgagatttagttaactgttctttagtagtgtagtggagtacttcttttcaggaggctattacagtattgaaaacattttcttgtcatgcctctagttttcgcggtaatgacggacgtaagattttataaataaggttcaataaattatctcattattatacaatattataaaaaatacaatatgtttatctaaaacaacaatacgattagagaaatatcaacttagtcagaatatcgaatctaattaaaaaagtcatatctaagccgatacgactctaaacagcaatacagttaaagatagaactaatatatcaaataggcaacgttttgcgtcaacctgaatagaatatcggacttaaccacgccaatacaagcgaagttgacggaacatcctcgccggagatcaaaaccgatacatcccaactcaaaactaagaactcgctggaacaaaagatgatggtgtgccaaaaataattgtattgatatatagaaatattttctatagatcctaagtgtatatatttatacccttatagattgatataagtcgtgatcgaaacacgacacaagtttcctaaaagtaaaagtaaaaggaaatatacaagtcatcggacactagatgaaacttaccaaagataaaaaggaaagtttctaaatcttgtctaattaatagataaaattaatttgtcatgtcgtaatatttacgattcctacataaatttgatctctcgattaacttcaatccatcaatcgactcctttccttaagcgaaccaattagagaatcactccaaattttgacatcgacacaattcccagttgaatttgttgcatttttattttctgagtaatgctgatatgtgggccaccaatcatcctaaaaaaagagatataaggtggagtactcatttctcgagtatctctccccttctctttggcgtaaaaggaaaaacacccgtctcgtcgtctcctcagctccgtgcgccatctcgcgtcgcggctgaacaggggaggggaggggatcctggtgagcatccacaccctctttctgattcatctctctcccaccgggagtactgttgtctgggattttgcttgcgttcgtcaatcctagcttctcttctagatctggaagaagctcttctcttaatttcagagccttgaacttactacaagtaaacagtttgtttgtttccccaaaagttttgggggttcagttcatgtcccaagttggatccgcccctgtttcgcggtattcggagcgtcaacgatttagtccacatggctgatactggaactccgaaaagctcgtaatactagtgaaatgcttgtgagttctttggtgcctttcggtttggtaggtgcacctcacgctgaggataaggttacgtaactatagtagcgacgctttgaaatagtaatctgcaatttgaggttgtctttccttatatggagtagtaattcttttctagtaagtagtctattttagctggtcctaccaaaacgaccggttgtatttagtctatatatgagggactgtttgagtgatggcctacctaatttttgcgatctaccactcttttgatgtttaaccttagtactgaaaaacgtactaaatcgtttcaagcagcatgaaaatctcactccagattatgtacccagtctatgcttccagtctaaattcagtagtcacatgatcaaaatgctcttcattcaaaaggcaagtcattttttttagcaagaatacagtgtgattgcttggggcctgtctgcctgatatcctatccacaacagatttatgggtggatcatttgcaacaaaaatagcctctttcatgctaaaacagcgtgtgctaacgggtgcatagctcagcaattatttgtgcgactacacaaactgaacccgttctgcccatgtataccaaatgcgtcacttaaattgaataactctactttctccgaaactcaatcagggcagcacacttcacgcttaagcaaacggtcgaggatggaatcgccctttatgtataacatttttcatatgaaactgacatgcagttactgcagaatattttaggagctttcatgtggaccattacgttgtgttttcaacattactatttttattgctttatattaggagtgttggtagtagtacaattataagctgcctaatttagctcaatgactagcatctacttaattagttattcattccatttatatgccaagccttctaataagctgtatcgtatacttacaccttcctgttatgcttgaattgcagcctttgtttgtttgatggcctcacctgcatcaccgagagagttcactcaggaagctgcccgtcagtctctgattgcgatctcccggtctgttccagcggcaggagaagccgtcaacatcaagtcaccgagcggcgccatggtgaatggccaccaccacgacgatgacggggcagagaagtacagatcaaagctcatctccatctccaacctgtcgcctgatgcccagcctacgccgtgctctcccaaggacaccgctgctgcttaggcttaattaaccgtgtgaccatgttactgcttacacttccaagtgtggatatcgtgtcccagcgtgtgtcgctaaatgctgagactgtgatcaggacccttggccttaataactgccatgactgtatatggtcttgtgatgaactgcccagtgggatactgcccttcttatgtgtgaaagatgcatcatggcctgaaatcttctcgcgtgtaaaatcagtacagcagttacctgaaaactgttttgcaaatgcagtggatcactatcttgttcttcttttgaggccctggtgtagcagtaggacgactgcattatgactctatgagtcgatgagcagtttagatcgaagcagatatgtacagtagctgctgtgaggcaaatttttcatgatatgtgacggttcctcttactttgaagtcttactttgaagtcaagatgaatctgtgaagtgagttgaccgtgaacccacttaaacaaaattacttaaacaaaattagtgtacccacttaaacaaaattagtgggcaacctatgaattaatccacgggttacttactaaccaacttgacgacgggaaccggccgtgggttgcctatttatttaatttaatctataaagcttcgcgggtgatccacttgtatacctacatcttttatcaggatcctggtgcaagaaataatacggatttgctgttgtgtgcgtacgcgccaacgggtcaactcagcgcgcgtttcggacgttcgcaggctcattagtaaagcacgtgcaggtgccaactcatacaattagtgtgtgattaacgccatatctaacgtgattaacatgagtacgtagcgctatgatctcatacttttttttttcttttttccagtaattagctctattattaacatgaacattttcaaatttaagttgaaagtttcgaattttaagataaaagttttaaaatttgagttgaaaaattttaaatcttcagttgaaaattttcaaatcttcagttgaaagttttcaaattttgatttgaaaaattttaaatctaaggtaaaagttttcaactggacttgaaagttttcaaatctgagctgaaaattttttaaatctgaattgaatgttttcaagcttgacttgaaaattttcaaatataaatttaaactttcaaatatagagttgaaagttttcgaatcaaagttgaaaagattcaaatctaagttaaaagtgtttaagagaattaagcactcccgtgacgattttttttccggaaaaaaaaagagagaaacacgaacgggagtttggcttttcttcgtacgtgatgccgaaaacaagtgggcccaccgcttctctacgcgcgcgcgacttaggtaaagggcacgtacgcgctaattagccatccccgaaataatatgctatggaaatctgcattctgcgagcactcgaactcgagtactcgacggctcgatgccatcaaattgatatgggctactgggccgtaagcgattcgcacgcgttatcagatactgggctgtatgaggcccaatccacccgcacatcaactcagctggaatcgtgacgacacgactagcgagagcgagttagcgagcagagatccacggcccgcagcggcggcggcggcggcggcggccgaagcccatctggttacgcgagggagatggcagcggcggcgggaggagtcgccggcgagccgtcggggacgaggacgaagcagcttaaggtcgccgtgatccaccccgatctcgggataggtacgcctctactctctctcccccctctgttgctcctgtcgatgcttgggtgaaccctcatctctcgtgggcagaattttggtagatccggttgagtccccgaaacgattggttgcgtgctactttgtaaattggtcgatatgtagcaattccgagtccacgcggtggaagcatcagtagatttgaggaaaccgtgctgnctgagcttgtaactggatatttgttgggt

SEQ ID NO: 37054 - DNA, 1434 bp, Oryza sativa
  unsure (1)..(1434): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttaagaacattttcgagaaaaaaaatgttgtagcagtattgcagcaggttataggacattgaccaatggactaagtgtggcagcatttctagcattgtactagatctcaattgttcaaagaaaacatatgtttttgtgtaggtggtgctgagagattgatagtcgatgcggcttgtcagcttgcggtccatggtcatgatgttcatgttttcacatcacatcatgacaaaaaccgatgctttgaagagactgtttctggtaaggatctaaactctatctgaggtgaatgttgcttataactctcttactatggtagttgcagtacctatttgtgttaaagacttactatgtactatgactgatttgatgtggacttgtagaggatatgcatatattcctatgtgaattgtcgattgattacgtacaaaatttcacaaaacgtttcctcggataccctactcaaatcgctcaatagtgtgtagggattcttatgccaatggaaactttacttgattttctattgtcctgcaggtccatttgaagttaaagtatatggagatttcttgcctcgccatattttttaccgcttccacgctatctgtgcatatcttcgctgcatttttgttgcaatgtgtgtgctactttggtggccctcatttgacatcatattagtagaccaggtttcggttgtgattccactgcttaaactgaaggcaaaatccaaggtattgatcccttgctttatgtgatcagtatgtttccactgtagatatatgttgataacttctttttcccgtgtattcagatagtattttattgtcactttcctgatatgttgcttgctcaacatactaccatgcttcggaggttgtatcgcaagccaattgacatgattgaagaaacaactactggtatggtcttgttcatctagaactgttgcctgctatgttttttaccattccctagtgtttgttctatctgtagtgcttatcccttttttgtatgtattaggtatggcagatttgattctagtaaacagcaagttcactgcaacaacatttgccaggaccttttgcagccttcatgctagaggagtcgagcctgctgttctatatccagctgtctctgttgaacagtttcaggaacctcatgcttataagtaactgcatgcttgtatatctctctgtaactcgcttaggtttcattttatttaaaaaaaaatagtatagtgtgaagtgtaagcannnnnnnnnnnnnnnnnnnnnnnnnnnnnnnnnnnnnn

SEQ ID NO: 37055 - DNA, 1243 bp, Oryza sativa
cgatcgagtggtacgtggcttgcgcagttgcgtttgctcgttgttaaagctttgtatgcatgtgatcgaaaaataatcacgtacgtccgctaattaattacctccagtacgatacatgcagcttgccatgcacatgtacgtacgcatgaacccatcaacccacccccacttatatatgcaccgtgtcgcacaccgattctttcaggagaaggggagcaaaaccggccaaccggccggacacggtccaaccggggcacggtacgtacgcgcgggtggccgggtgtacgcgtgcgccgacgcctgcagaaggcgccgctcaactggaagcgaatcgtgatgacacggtcggcgacggtgtcagtcgacgcgcgtacggcatctcgatcgatctatcggtccccgcggccgcgcgcgcgcgtggacggcatctcagcgtcaccagttcaccacactgtgcgagtgtgcgactgtgcgagcgtgtatgtgcggtaccggtcgagcagctagtggcagcatgccatgcatgcgtggatgtcgccgttggccccggcctagcacgcgcgcgtacgctccaggtctccagcggtagctgcgtgcgccacgtgcagcgcaggctggtagtaccctcttggccccggtcgatcgagcgccgagagctgcaggctgcacggcccgatcacgaattcacgatacgctgcaaatgcacccgtttggaacaagggatatttgcatttttctgcgaggccagttgaactgagagtagggcgtgggctgtgattttaacgtgaccctgttgtgttttgggcctcaaatgagggaacacgtaggagagctttcatggattgcgtttgggcctttcaggccttctttttaattgttctcgtgatctttttttttaaaaataagtccactttgcctcccttaaaaagtgacccgaatctaatccataaccctaaacgcaaatccagatatctcgatcccccgaactattgaaatcggtgcaatttgacttccttagcggttttggagggcggtttcgctgacgtggcggtgttgacatgtctgtgggttgacatgacgcttagatgtcatttgaattaaaaacgtatatgtgggatccgtttgtcattcacacacataaaaaaggtggggcccactgacatgtgggcccaacatatcatcctctctcttcttcttcctcccctcttcctcccttctctgggtaccgagctcgaattcgccc

SEQ ID NO: 37056 - DNA, 1116 bp, Oryza sativa
ccgccatgccggcctcgcccccgaaacagtggtacactgtagcatacacatatccatatctatctctatagttatagcatacatagccagtgaaaaggaggagcttagtaataacaggatcccccattgcacccctgtgcttctggatgaggaggccggtgcaaatgcaatgtgggacagttacttcatagttacagttactgtgctagtaacaacggtttgggtttgggttctctcttgtggaagaggagaggaggtagtagttactccctgtcataactactaagttttgctgaaaccttataggtctttattactcttttagttactctgtgtttgatatggtagatgtacatatatgtatatcacagatggtggggggaatggtagtaggagatggtgctcccggtgttcatattcgtgcttgcctgtaataaagatgagaatgctgctcctgatggccttcaatgtcagtcagtaatttccttctctgttttgcattgcttggtttctgcttcttcaccccttcttcccttgtactgtagtacagcaattgggagtggctccggtgaacgagatcgtgcaatgcacggagaattgttgagaactagggtaatgcgacttgagattcagagctctgtagtactgtatgtttgcaggtgaaggaatggctgctgtggctataggacggggtcgatcaagttgcgcccgccgtgcggcccccgcctaactccattgacccgccgtttggcctgtggaaagcggccgcccggtgatgccgacgttgtcatcatcatcatcgtccatgttggttgcttcctcccatacgggagaggagccatccgtccaaccgccgtccgggcatttaacgcggcagtggtgggcacactctccctctctctctctctctctctctctctctctctctctctctctcaataaagagggatcgatctagaggcgagatccgtcgtacaatgcccaattatacgtgtatatactggcatgccacgtgcgtgtttgtatatatatatgtagactccagattgagattcccaatcgagggaaaggtgaggtgcacgcgccggacggcccctgccgtagaagtatcccggg

SEQ ID NO: 37057 - DNA, 7845 bp, Oryza sativa
  unsure (1)..(7845): unsure at all n locations
ctgagttcccccatgctcccgtgtcgcgcccgtcgggattggatcgatccgccgctggcgaattcaccgcggcgcgcgcgggcttgagccgagcccatcacgcacgacacggccgttctgcccctgcagccgcgcgcgtggcgtgttgccaccccccgcactcaacggcccccgtatcgcacgcacaaacacacacgcgacgactttttccctcccacgccgccgcggtgatgtcacgggctcacggcccccgcttcctcctgggcgacctaacccctcacgtctcgccgtgtcgcggccggtcgcgggcgccgtccgtgacgcggccgtgtggatcactacgggtgggggggggggagggacgcaaattgcggtggggttaggttttttccgctgatgcgtgatgggccacacgcgggcgctcggccggtccggtggtggatggatcggcgagcccgagcgcgaggaggatttggacgcggacgtggatcggggtagatcgcgcgtaagctttgggatatttccgagtttctattggctttccacaatgaaagcaacgcgggggccgggccaccgtacttgcttcgtttattctatggcaagtgttaggcggcacgggctgccttccacggaatctttgccaacagcggctgacaggtgggcccatcagtgacgctaggcacagtgacaaaatgtggccattcattcaaagttcagttgattataactgtcactgtgaaactgtggtggcttaatgggggttcagctaactgctaaccacgccattgagagggatccgattcaggtgcagtagctagtgtgactgcaagataagcagtcacattagcatcacatgattcaaaatggacgttccagatatatctgagcactgtagcaaaacactgtagcgatttactgtagaaaaggaactgttctgattttactgtgctgaatccttttaggccgttagattttgacatggagggcttggattgtgtgcagtagttaccatgcagtcctagtagctactgcatttgatctcaatcccattgagagcatatttctctccttgcctttttctgctatgcatttgtgagtggtcactggtcagtgggtggatggactgttggagttcatggcttcatggccaccattttgtcatcatatctccacacaaaggaattccccccaagcaaatgtgatagataatcgagagctgtagtggtgtggtgacagtcagtagtatcccactccttcgtgggagcacctcttttcgatcagataagttcagaggtagaacaagaaggttcataaataagagaaaacaaatgaaaagttgtggaggcaatagatcctgagcaatctttgtgacagggagagaggcataggatattagcatgaggaaaaaagtgtatgcacatacaaaatcagtagccttttaatatctcatgagccccctaaactcttactgcgctctatagttctttgtatagtccatcagatcgctttcctcgctgcagaattcacaaggcacgggcagccagtgttttgtttttcctccctcgctttgaagtccaacgaagaaaagttcagagatgtgtgactttggtgaggccaagtggtgtcggtattttcctcacaatatgcatactagttcaaaagggggacgttgaaaggttctgcaccaaaactaggtcccaggaatcaggcgttgtcaggaagctccttccttaagaaaccagcaaagctaaaaataatgcccgggtcctactgaaattaggcctgaatcaaatgacagtcatgataagctcctagcaggtgatcttagaatagaaacgacactagctacgtacattgtttctatgccaccaatggcannnnnnnnnnnnnnnnnnnnnnnnnnnnnnnnnnntgtgtagttgcctccagttcctgaagttactttggtcttattatggagatggacactggatcttgacgtctgctctgtcggtctagcccaatcgtagcggaatgaggagacattgatactctgacagaggatacgatgcagaatgcagtgataagggcagtaccctcgatctactccagtaaaacaaaggcagtagtaggcccgtagtaaaaaaacagtatcgaatactcacccatatttagtggttaatagtaactggatatgcatatgcaccttcggatttggacgaaccaaatgcatttatagcacccagaaatatggttacttgttattcgtcaggcaacaggagcaatcttttttttttttgagaactgcaacaggagcaatcttgttattccttcagtgtaactgtttgtttgacaaggtacacttttgaagatgcgctgaatctggatgttctggtactttatatcctagcatgactgtgagtttggagtatcagtggatggccatgacatgtgtgaaaatatttcaagacattttgtgccatatgatgtttgcaattacagccttgcaggactgcaggttagcctctcactgtctcacaccactaccatagagaagaaagaataatcttcatcaaacagtcgaacccgtgaacaatcgatgatcttgacaggatcaacaagatggacaactaattttttggtccttggtctacgaattcatctattcatgagacatgataggattcaattcttgcacatccctatatggtctacgacgaacacgcagctaaccattattttcctcacttggattgggccccaaacatagggctatccactgggccgacgcaacgggccgaattacgatggcacacggccgtggcgaatcgaaactgggtataagcgtcgccgcgaccaccacatcgccgcctcacgttatccgcgagcgaaccaatggcggcgctctccctcgcgcgaagccccccccaccaccaccacgccgcggcggcgctcgcgctcccggccccgcgcattccccggctcgcgccgctcctccgcacccctcgccgcccccacccgctcatcgacatccgccgcctcccggccgccgcggtcgcggcctcctcgcctcccgaggcgcaggcggtcgaggatggtgaggaggaggaggaggaggggggagagaagcggcggaagctgtacgtggccaacatcccctggtccttccccgcgccggagatcgagaagctcttcgcgcagtgcggcgccgtcaaggacgtcgaggtgagtaaccggtacggcccagttgccatgcttatggaggcgtagctttgagttctgggctatggtgttctgagacacgcgtggcttttttttttttttgggtgaaggtgatcaaggggaaggatgggaagaagaaggggttcgcgttcgtcacgatggcaacggcggaggaggccgccgctgctgtggaaaagctcaactccctcgtgagtttgtttactgttttgatttagcgtatgaaaacttcgcgctagtctatcgattagaatatgataatacacatgcactggatatcggattgatagagcacaaatgcggctaacgccctgtttagattcaaactttttttttaaacttacaacttttccgtcacatctaacttccctacacacacaaatttccaacttctccgtcacatcatttcaatttcttcaaactttcaattttagtgtggaactaaacacaacctaaatgctatttttcgcacgcaaagtggaaaatggttgcaaattgcgatgcatgtttagatgtgtctgttcatcttactttccttcaatccccacaggatgaggactaaacatggagacattgctatttcatgaatacatctggatgaggtctagggttatacttcgatccccacatccccatagacaaagctgaaaaaaaataatgaaaacacacttttatatatgcaaaaatcatattggctacttgtttctattagtggagggatggatgcctataaatggtggaaattcaataatttgattatatagtacaagcttatattatggtagactcaaaatttctcacaatagtatcagtcaggtacagttgaagtattgttcagtgatcttatcatcaacatgctagcagcttgaagtcagatactggcggtcctgacaagaatgatatagacttatatgtatctaagctcctgacaagaatgatatagacttatatgtatctaagctttcgtggtactcagcgatggagatcttattactagtttctgcatcactgatcttttgcaggatgtcatgggaaggaccatcagggtggagttttcaaagagtttcagaaaacctgctcctcctcctcctccgggcacaattttggagaggcacaaactttatgtgtccaatctcccatggaaagcaagggctcccaatatgaaggagtttttctcaaaatttaatccactttctgctaaggtggtctttgatagcccatcaggaaaatcagctggttatggttttgtttcttttgggacaaaagaggaagccgaagctgctctcactgaactcgatgggaaggtgataactacatggactttgccttccaattttacattttataccaagaatgataactgatcatttataaattaacttctgcaatgttgtttaaattatcgattgttgttaaagatttcccattaggcatattaagtaatgtactaacctttagtagtttctgccaccttccccccaattttttgacttcctatgaaataagatgctatatatgtaagattgcaagcacattggacaccatggtattaaagtttacatttctttgtcatgcaggagcttatgggaagacctgttcgtttgagatggcgacaaagtgtagatgattcggatgacagtgtaaaggctgatggtgaaattgaagatgcaaatgttgatggcgaggctgaaggtgtcactgataatggtactaaggatcatggtgaagataaacaggaatagtttaacaatactgtgtttggactcggagaaagttaccagcagcctcattaatagtacatatgtggagcctcattgtacagctacaagttttttacatttcctggtgcgtgactaatataatctaacttagcacctcatggttgatgcttcatagtcacactagatgattgaacttgttttatggtggaaagttccatttcttaacacgccaaaaaaaatcagtaatcttgtttcacctgctttatttagctcaactgcacattttcgcctgcatatatttataaaaaacccaaaacttcatgtttttatcatttgtaccaatcaatctttaatgcactgccacatggacacctaatatgcaatttggcgagcatctctatgtttttatctgccagaattggcagtatattatcatttaccattaaatgtctcttgttcgttaccatgattccataataatgtgagattgaaaaaaaatgcggtgctcaggcgaataatttgttgtttgagataaactgtgtcatgtagacacgccataatgttatgacaccatgttactttacatgcaacaatttaccatacctttggcattgaacagaaattcagatatggctcttttatttgtagattttaaacagaggagatattgtaatcaaatactgcaatatatgtctgtggttgacggcttgacgctgataaggagatgaggaacaaaagggtgccacctctgacctaaggtgaaaaattgttgttgaatggattaatattttaaattttagtgttcattttcagtaatgtatttactctaattatctgtaatttattgtgatcatcaatcttctcctgctgagacaattgttgtctcagcaacttttaggtattccctatagtagtccttaatttgcccaatgaggtactattaaaatacaagttactcttttgtcgtggacatcacctgtggaaaggataaaaagggaaatcatcatgccgtttactgtccccttgagttttatttccaaatagccttcaagatttaactttgactattggtttcacataaaatatattattaacagccgtgaaaccaatgttgtgtgaaaacactttaagtatggatctattggtgttattattacacactcaataaagttgtagtttaattataattgttggtcaaagcctacaaagtttgactcgtaaaattaaatagttcttatcaaaatcaactgagggattgagggagtatgttcctggaacgtttctctcctattgctgcatatgattctctttaaccctggagaaccataacactatttttcatctctcatttttgtagtgattcttgtaatacaaatctgaaaatactaaaagacgggctgaagactcctagaggtctttacagaatattgcttagctttactagtgttttgatcatgcacagtatgcagtacctgaatcatatatgtttttgccaacagatatgcatgtgctagtcactgatggtatgctagtcataatagttgttgatgagaatcaggatacccgttgcatttaagaatagaagcatctagtacccagacactctcattgcttgctaatgatgcatctgcctattgaaatgctttcaaaacttaacgattcatggtaagcccaagaaaggtttccttcctattgcaagatgcctaggctaagaaaaaaatagttgaaattttcttgcaccttaactttagaccttccactaatcaaacactatggagtgtgttgaaaactttaagcacttaagtacttgcaacttattaggttttgatatactactagagcatgtactcgatggttgcatgcatatgttgaggtcttggaagtgtcatccctcgatagcctatggtacacaggatagtgtaactgaagtatttctctgatgaactgaaccaaatagagttgtcttgacaacattcttaatccacaagagtcaacaataggctgtttcgtgaaactgcttgaaacagttcttaaagagttatgatccagtttagtcccctggataagaagttgtaatatgatgatggtctgatgactacaaaagcaagccatgcgcctgactttatgtggcacctctccaaggaggaatcgagtggcaaataggagcatattttacttgttaaactttaaagcagtcgctcctgcaaattttaagaaactaatgtgggcctgattgatccaaactgagatctgattttcgcaaatatgtccaggagatttctttaagtttcttcataggagtgttgagtcaaaaagtcatccctatcagtgagattatacttttggaaaagaaaaggatactcctattcctctattacctggtccaccactttatctgactgcaacaaaacttcaattgatctatttgcatgttctggtaagcatgttcaattcgagggagatgtagaatttaaaaatacccaaaagggttaaaaatatggcttttgtagtgtgaagcaaatgttctttttgagaaatagttaatcatcttagagaaatctaaacataattttctttctcaaggtcatccctcataaggagtgagaatgaacttgatttgatagtcctctgtaaataacccaggaaaatagaccttagtattagaatgaaaccgcacagtttcctttatctacatatgcacttctctttcctatgtgtatcacgcagtgttattcctgctgtagcgtcatacggaagtgatgatttgatcactgaaagaagataattagacatatcaaatctgtctgttcttcacaatggggactatcgtattaaaagttgcttgttccgttcaaaaaaaaagttgcttctaaacttgcatgcctgcaggtcgactctggaggat

SEQ ID NO: 37058 - DNA, 2210 bp, Oryza sativa
  unsure (1)..(2210): unsure at all n locations
nnnnnnnnnnnnnnnnnnnnnnnnnnnnnnnnnnnnnnnnnnnnnnnnnnnnnnnnnaatctgtctgttcttcacaatggggactatcgtattaaaagttgcttgttccgttcaaaaaaaaagttgcttctaaactatttctgcatatccatttccttttgtccgatttcttctgtataaaaccatgtttgttgttctggcttaattatctggaataaaattacattcatgtgattcatgaatgcattttgtcttgaatcttgatttgttcccttttctttagtgtaatgtggatacacggtgaggctaaactgcatttctgtgcatatattctgcttgtcgatccaaattgccgtctgaatctccctaacgctaccctttgacttgaaatagaagtatatggtctctttttaattttacaagttactaatgcaagctatcaaacgctttagtgggcacagcaatagtattagtgctggaaatggataagtatgacgaaagctgtcaaatagtgctagtaatcattgtctccatttacttgaacaaatcagattgtttcgggagatttcaagttgtactgttctacttagtcccaactctgtcattcttacaggataatgatgttttagctgctgggctttgatgaaagttacttctttggcacttaagaaaagctttcaagtatctctttcacaaaagcctacgtcatctttaaattaggaaccagataatgaaattcaggatcatctttaaattttgaactagagtaaactttagctttcagtcaccaaactaatgaaattctgtcacgctagttaaagatgagaatgcacatgaccttatcacgctgggactggtagaatctgatactgatagttgtcatttatcccgtacagtggaaccttgtttggctgcgctgcactgatgcagcaacgccaccttcctcgtgattcgtgaactattctgcccatgttttctattcgtactatagtgtgttttaatcataccaactggacatcctctcttcatcttctgatctgtgttggtgttgcaaaagagacggtggagtttaaagaggaaaggaacagcaacggggcaaaggaaaagagaagaaagaagacctgcagcacccaaaaacaaaagcagaggtcccccaacacaaggcaacaaccgctcaatcctccacccaaattaaaaggagaaaaatctttgctttgcaacaagcaaactcctctcgtcctctcagccagaggcatcatcttgatatctctccccatcctctcacgactcccgacaccaagaaagcaagtataccatggattgaacatatacacggccgtcacacatctgtctccttccctcgtctcctcaccaatgattcggtccagaaacttgcagagatcctctgctagtacttgcacagagcctcagaccgagcactgaggaagcttaacatctgcctatcttctttctagttcttccctttctctctgttgttgcagtcttgcagctgcccgatttcgtgttctacgaggcaatggcatcctctgctcctgcttgggtcccctacgagccaacgagagattgctctcaagggctgtgcagcatgtactgcccccagtggtgctacttcatcttccctccgccgccgcccttcgacgtcgccggcaccagcgccgacgactcctccggccctgtcttctcccctctcgtcattgcaatcatcggcgttctggccagcgccttcctcctcgtcagctattacaccttcatctccaagtactgtggcaccgttagctccctcagggggagggtcttcggctcgagctccggtggcgctgcttatggcggcggtgccggtagcggcggccgccacggccacgggcagtcgaggagccacgagtcatggaacgtctcgccgccgagcgggctggacgagaccctgatcaacaagatcacggtgtgcaagtaccggcgcggtgatgggttcgtccacaccaccgactgctcggtctgcctcggcgagttcagtgacggggagagcctccggctgctacccaggtgcagccatgccttccaccagcaatgcatcgacacttggctcaagtcacactccaattgccccctctgccgcgccaacatcaccttcgtcaccgtcgggttggcgtcgccggagccggagggctgtgctccaggcgagactggaggtg

SEQ ID NO: 37059 - DNA, 1864 bp, Oryza sativa
acggtgccatggcgagaacagcaagggaaggggaggccgcagccgacgtgcattgcagctgcaggacgccatggaggctctgccggggaagagattgccctccggtgggagatcctgcttcagcagcaagagcggcaggggaaaagattcagatcatccaatgtgaggcggtcagttctcattttcttactctaggatactggacaagcaacctttgtttgcatgatgagatgcgaatgggaaaaaattgcaaggacaatcatcataatctggagatgtcgtcttgtgataatgttgatctgctgcctcactccatgtgatgccactgccaaatcgatcctctgcagtgcttggttggtaatgtctcttttgttcatagttgagaaggacctgagagctgatctctctctctctctcttttgctctgccattttatacattacattgacttcccaccgttcaatttttctgtggagtttgttcttctgtgagttcactagttcagtaccaaggctaaaacttttctccaccttgcgttttctttggtttctacgcattggcatttaggtggtgcggaaaagtgaaggatcaaatggaatggtggtgtgaactaggcctatgagtttgacataaaaaagtagcttttgttttcttgcatacaagaatcatttttttcaggtaaaacccaggagaatcagtgtttagaacatcatcatagtactgatggacctattacttattatgggcatggaatttgcaggaacgggttggagtttgctgtgaaccacgaattagtagcttagtactgacaaagttgcaaactgacaccaaattagccacgagttactgcgtgtttctagtcaggtttcagtctggatcaaattggaatttgttttttctctcatctgctttgcccaaatctgttcgttttaggagaccagcggttgcttctctacctagttgcatatgtatagacaaagtagttcggttgaagtttctgtgacagcgatgaagctggcatcttctgactaggtcctattagccctgcataacatgcgtttccgatattccaaatctgtggtcggggattaggttgatgaaatataagtgaattatctttgcacacgttacaaactcactaatcacccctagtctttttatttgaagtgttggcttcccaaaatgaaactggtttgcttgcaactgctgtagctttgaccttcccattagtattccacgaaaatgagcttgaactccctctaggtagacgtctttatcacactcgcaagtgatctgcattattgaggttgatttgtggccattatttttcccactaaggcggcatcatctttgtgcatgcaagcactaaagaaatgttcctaatttatcagcaactaaggcaatggagaaagcatgggcatcctattcctgccttcctgctgcttttgtactttagacgagagcttgatttcgtcggtgactcggtgttgtgttttgccctgaaatgaaatagtttctagtcggcgaaagcactactaaagatgcgtcaagatggtgttttaattccggtgagttttgaacacaatgcaggtggtggacgattgagtgttggtacttttgctctctttgcgcctttgttccgaattcacgtgaggaattcaggattcggcggaagagactagagagcatgaaaaacaaagtcaaaaggggaaaagaggccggtggtggggtttggatggaaaaggagtgtaaattagtgagagcaagaataagaatgtgcacattgtgaacacgtgtgataattattcgaacacattaattcccatgattaaaaggacatgactatctgtatgcattggagaat

SEQ ID NO: 37060 - DNA, 7256 bp, Oryza sativa
  unsure (1)..(7256): unsure at all n locations
nnnnnnnnnnnnnnnnnnnnnnnnnnnnnnnnnnnnnnnnnnnnnnnnnnnnnnnnnttagacgagagcttgatttcgtcggtgactcggtgttgtgttttgccctgaaatgaaatagtttctagtcggcgaaagcactactaaagatgcgtcaagatggtgttttaattccggtgagttttgaacacaatgcaggtggtggacgattgagtgttggtacttttgctctctttgcgcctttgttccgaattcacgtgaggaattcaggattcggcggaagagactagagagcatgaaaaacaaagtcaaaaggggaaaagaggccggtggtggggtttggatggaaaaggagtgtaaattagtgagagcaagaataagaatgtgcacattgtgaacacgtgtgataattattcgaacacattaattcccatgatctaaaaggacatgactatctgtatgcattggagaattagcgaggacatgactagctgtcagtttgttatgactcttcaccatgattctctgatcccacatggacgatgtggattaggcgcgagcatcagccaaatcacggaacaggtgaataagggtgtgtttgtcagtgctccaatttctaattttaacttcataagttgtttctgaagtgaagttgtgaagcagcataaatcctgttccagctctttagtttatttttcttttaaggtaatgctgaaaccgtttacttgaacttaagtctgtcaaacctgccctaagattatgactccaactactcaaagaaaatcctgtgttcaattgggccggaccatgtgctaatctcaagcccataggctgtgtacctagtcggcccaacatggagggacaagcaaggataaaaaaaccctctcttcaccgtctcactcccccggattccacgtcgacttccgccgagaaaaccgcaaaacgcacacactcgacggcaaaaaaaaaaaaaaaccggctaggattacaacgggccgcatgttattgcacttacacgggcttttgccctacgccaccgacccccaaatcacccgactcgcctacgggaggggagagatcgatcgagatccgctacactttacagatttgttacaccggccgccgccgcgcgcctatcttgctaggtggccacgctaaccggaggcctccccggcgagcagcatctgcgacgccgcctcggcgtcgatgatgcagagcacgtggtgcaccgccgctgcgatgtcgtccaccgtcgccatgccgcacccttcctccacctgcaaatgcaaaatccacacacaaaaatcaaaggattgcttgatgccacaaatcacattcacatccggccaacgcaacacaaagtacacaaattaatgcccgcaaggcaaagtgggcgattcgagggaaatcaaacggcgattgataagcaaaggtattacacgggacagacagagaggctaccacgagtcgatcgcctagtcacacagacacagaggctccacaagcacaaagccgaggaggaaaaaagcgaggcacaggcgacgcttttcaatagagcgatcgtttcgtaaaggcagattctctgctgtaaataaaacagcgcaagaaaaggcggcagcagcacacaatgacacacaaaactctgtagccctttttttcttttctgctgagatttcgccttggcaatctactccccagcagaaagattctccgtgacagtgctgtccatcgtcctctctctccctccctctctctctaaacctatctaggagtataaaacatatatatataaaattctgcatctccctttgtgagtatgaagtgccatggcttgatatagtgcagcaccagtcgactggggcacatcaagttcagagctacgtactcttaccactgtagtactgtaccacagatacagagcacagagaaagaacacacccaaggggccaagggaagcaatggcctttccgccatggaatctctggtcaaaagcaatcggccatggcagatatggagcagcatcaacagcagcagcagcgagacgcaattctgatcagtgatcacccatgcaatagcctctactagtatagtaaaatacccccggggatgttggtctacgtacgatgggtaacagaggagaatttatgacacgtttattgttctcgtgtactacactatataggcagcaacagatgcatggagatgattttgcttccctgtgtggctggcgagtatggcctctcatgattgtcaagacgtgtgcagcgccagctgagccgcgtacacgcaagcacggtgtatgaggctcatggcctcacgcatcatcgatctgtacacatgtggagtcgtgttggccatatgctaagggggtgtttgggaactagggactaaatttagtccctctcacaaaaatataagtccctaccatagagacttatacttttgtgagagggactaaagtttagccccactttagtccctccaaccaaacaccacctaagacaatccgtttggtagtttgtatttgggtgtagtagtttgtatatctgagctgatcagaagtatggctgtctctcttgcaaacttggttggtcagtttgtcacatcaggtgctgcacatatgtactacctccgttcaaaaaaaaaaaagtcaaacctaagtttttgtgttcaactttgactgtccgtcttatatgaaatttttttataattcatatttttattgttgttagatgataatacatgattaatattttatgcatgacttgtctttttaatttttttcatatttttttaaataagacggacggttaaacgttggacataaaaactagggtttatctttttttgggacggaggaagtactctactactagtactagcaagtagattatagattattcgtgttattaatctaactcgcggacatctcatgcgtatcttatgtggagtatgtatcttggatgacgaaacttctcagccttttttttctgacggtttatgcttaaaaaggaaacgcaaaagcaacaatgggccatatttcagcaagaaaacggaggaatttttttggcagcagactcctgtgtatacgtaccttgacgctgatggagtagagggcaagcgagccgagggccgtgacgttgaggtggaggacggtgagccggagcgcctgcaggccggcgaccatcttgagcagctgccccggccgccgcgccgccatcacccggatgctggcgtgcgtctccacaaggctcacctcgatgtccgccactccggcgcggttttccgccgccgcgcccccgcccccgccgccgtcttgcgccgggttgtggcaccacacgtactgcgggtacgtgaagaaccgcgcgaacggcggtccatcagccgccgccgccgccgccgccgccgccggagtctcctgatcggccgcgctcgtggagtccgcggcatcacacttgggctcccgctgctgctgcggtggcggcggcggctgcatcagcagcgtgcgcttctgcgcctcgagggattgcagcagctgctcgagctccttcacgaaatcaatggcgccgccgacaatggacgcctggtcgccctacacgccgaccaattaaaagcaagcaagtgagcgacagtgaagtgcagagacgacagatcaaatcaacctagcatacctagcatcatcgcgattctagagcgaagcagttgtgtcagcgagagtaaactagaacagtaataatgttactatgattcaagcaatgataatgacatggagggggcatgcacattaatggcacaaagtggccgaggaacgtatgccccatggaggaattaatgattcattattgggatagcatgaaagagacctggaaattcctcaatattcagttgacgagaaagagcaaaaaaaaaagtgcttaaacatcacaaaagttgaacgaatctttcttaaaaaaaaagttggatgggtacataatggtacgatttttatactagagaaaaatcacagtgcttctcgccgaaacattctcttgccaactccagttcagcacaacccaaaatccaatgtccaaatgagaatcaagctagggagatgaaccctaaggatcagttctcacctcagatcagagttccaagttcagcgtacaggaaatgtagaatgttagtaagtgctagtgtacgtacccggtggacgtaggactccggcatgagcgaccggagcacggcgaggtactcgttcatctggcggcggcggttgcgctcgacggcaatgtgggtcatccgctggctctcggcgtcctcccggctcttgcagctcctcgcccgccgccgccgcttcctcctccccggctgctgagcctgcttcagcagctggtccacctccggcaccgccccggccgccacctgcaccctcgtctccgtccccgccgcgccgccggcattattattcccgaagaggaagctcgccggcggcacaaccgccgccgccgccgcggcggaggcgttgaacgtgtcgtagatgaggacgtcgccgccggcgctgcacagggtgtcaagcgccatgcccgattgaacgaacccgcgcgtggcctctcgtccgtgtcacgacgtgcaaatgcaacctctcctcctcctcccttcttgctgcctgccttggtagctaagctaagcttgttgccttcctcttcctcgaaagaatagataggatgcagcaagctagctagtgagagagcgcgagaccacaagcagctggcggcctggcgctcgcgttggtgctacgcgtgcgtctctagcccaacatgggagggaggagagaagctagctagcgcaagattggccaataatatccatgcgagagcgagagaccagtggacgtcgcaggagctaagctctagctgccgcctgccgctgtgcctccctccctcctctctagcgtgcgtcgcagttgcaggcaggatttnnnnnngnnggggggggggggcagatagaccgtggatatatcgatccctcctgctgcgcagtgcgcaccacgcaatgctccaagagattggcaccaaaagctcgctttctttgggcgtcgtcgcggtgaaatcttcgcgcgcggggagctagctagcagcgaccagcgaagctctctctccacgtgaggagagatgggtggtggatcgacaatgcttctgcttctgctgctgctgcttcggctgaaaaagtgagggagagactgggggtgggaagccgcggaaaggagagtggaggagacgaaagaggtgtggtctcactcactcacttatctttcatcagcgacacatctctctctggcctctgctgtgattttttttcttttttcttagctttgtttgagatatgagtttgtggggaaactattctaatccctcgaggggatgttccctcgtttgctcaaaaaccatctaaatggttatgaaaaattctggaaaaatttgacaacattcatacagcacatatatacaacttcacaaaatcttaagttcaaactcaactcacacgtcgagatataaaaaagacaaattcagcgtatgaatagtagcgtactgtttatatctaaatttgtcttttttgtttctcgatgtgtagatcgaatttgaacatgaattttggtggactggtaggtatcattatactctacattgtcaattttttttagattttttcacaactatttacatcgaatttaaaagaaaaatgtatacgaggggatattcactcgagagataagaatccactcccgagtttgtgtggtgatgtccggttcttggtatggtatgccaagcgaaagtcaccgcggcaggggggggggggggggggatgctgatgctgcggccgagctgaggcaggagagaggggggccccacacggcagcatcttgtgatgaggggtcgtctctgattgggaatgaccgaacatggcggtcgggtcgggtcgggtcgccgagtttctttcacagccatggctcctctatctctctctcctgataattcacctggcttctccatggctccatctagcagtaggctccatgcttcagtttatcatccgattattgtgatgaattatttacatcacgttttcaaaaatatcattttaaaataaaacctcttctatcttatcgctgagctggttacttgtttcaaactatttcttagctttataacacatcatattaattttttaatcaaatatataaactatcggtttttatctgcaaatgatctactctctccagattaaaaataattattgttttggataagatctatgtcaaactttaaaaaattgactatagataagttctaaagtatttacattaattggaaacatgaaagacaatttatatagattaatcttaaaatgtactttaataaaattgtgcatttattaatatttatatatactataatagaaaatagtggtcaaagttaatttaaccatgcaattgtctgagatgacaattactttactagagggagtattcataatgctacgactaattcagcagcgccgtttgctggaagtgatatattttcagtggctgtcaagtgttaagatagtactgagctctgtggcagttgcttatgtgatggtgccacacaatcacatgcgtacgtgaagaagaattgatgtagggtgcacgtacctagccacatggattaacagtgggcacagaatgaggatggtaaggagagtaggagacaagggccacacaccagctatgcgtaccacggtaccagtgtactttcgggtttgagggacgctgtccggtggaccccagccccgcgcataagctctggagcaattttaatctggcaagctctttctatagtgcaatgttaaaaaggaaaatgattatatcgaagccttttggacggatgtagtagaagccggatatttaattaatgtttcttaggctgagcttatagcggctggcggttcggaaaaaggacgaataattcgtgcataattaatttatatctgtatctatatttatatttaatagaaaatagtataaggcttttcatttatcgtagtccattcatttttttcatcgcctttttttttatcaataatcctttacacacatggaagggttcttaatttttggtgcgcacacggtaaggcattcggtttttgattgtctggtcttttttctgttgccgtttttttatctcgtccgatcctatatccacggcacttgcgtgcagcgcacctccagccatcgccgggcc

SEQ ID NO: 37061 - DNA, 6625 bp, Oryza sativa
cggccccaaatttaatctccatttaaccttcgccaatgatggctggccggggagcttccccaaccattgttgtcttgagttttgcagattcgcttcaattttgaaaaaaaaaagaaaagaggatatcgtgtgatcaaaatccctcaactaattttgggagatcgagaaagattcaaccgaatttgatgtgggatcagctcgggtttcatacgggcacgggtctatcttccatgggttgaatacggtagttggttgtgcgagctgggaatgcggttccactcgtgtgctggcccgaagatatgcagaccgagtggagggaggtagtggactgggttggggctgaaaaggaaagaatgaatgggttttcgctcaaaaccaaggaagaatatttagtaactttttcaattataatgtatatcgatactatatttcaatttgcccaactcctaatagctgctgtatcactgaaaaaacatctttacctattgcaacgcacgtgcattttttctagtcaagtataatagctataaatttaaaaatatatttagttgattatttaacaaaaatacttctatatactatagtagatatatactatatatatggacatagaatccgagcattaattgaaaagagatagttatttgaaagagaaatacatgagtgacattaaattatttagatcattcttaaatattgtatattacgagagcaaaggtctaagtagtagtgtaaatatcgataagattagggatggcaatttcccctgcggggccgggtcccctgcggtggcgggggcaggggcgatttcagaccccgcgggtgagtcagggttggggccccgcatttgagcgaggaggggacgggggagatgtttcacccgcgggtgacccgcggagccccgaggatgtatattagacttaatcatagtatgttgtaagcccaaaaggcccatctagtctatcatatatatacatccaaaccctaatttccccacccctccccaccctattctcaatctctccccacccacccaggcagccaccatctccacgactccaccagtgggcaacagcgtcggtggcggcggccaaggcgcgcggcggcagtggcggcggcgacggcagccaaggcgcgcgcggcgtctgcgacgtcgatggccaggcacggggggcggcatcaggcagggcacgtgcggcggcattgacagccatccgcgggcggcggccacggcgcggggcacggcggctcgcctctttgccttccagcttgccgccctcgtcgccatcgtccagctcaccgccctcgtcgccgtcgttagctcgccgtccaccggcccagtcgggtattgcgggggcccgctcacccgtcgggtcccctgcggggacgggggtgggtgacgttttccacccaaccacctctgcggggccgggggcggggggagaagtcggggatcgagcgggggcgggggcattctagcccaatccgccccattgccaaccctagtggagattatatatggacaccacccggtgtcttacatacattagaaactgctcctacagcagcatatttgaatagtgaccacttaccataccgaattggaatctcatgcagtttctatcgagattacaagtttcgagccatctattttattaatgaattagctataatactatatgtaaaagtaataaacaattttagtgccgtgagctacagtatccggacacgtttaaccattacgaagtagatccgaatctaatagtcggtactggactgcataagttacagttacactaccgactacagcggatccaaatcctaccataccaaggctgtgttcgggcactagggatgggaacgtgcacagtatttacggaaaatggagtaatctattagcatgtgattaattaaatattagctatttttttcaaaaattaatcaatatgaatttttaaataactttcgtatagaaacttcttttagaaatacaccgtttaccagtttaaaaaacgtgcgtgtgaaaaacgagatggaagtgttgggaacttgctcttgcaaacacagccccaagtgtgcttacaaaacaagcacagtttgcaagaatccaactgcatcatgcagaaatcatgttcacgcacaaatcgaaacgtgggggtgtggcaactccaaggacaccctctgcgtcgcgtagccttgaatattcttgtggtcgtagacaggcagctacagtcgtcgtcgtaattcagttcttttttttttttactatactcaccatgtgaatgctctctgctagacacccttctctatagaacaaagcacattgtaagctgatggccgccatattttgctgatattctttgtgcctgtagtaccaactatactaccaagtaacttgtgccgagaaagataccccttaagaatgtcttttgggatgcaaccagatgataaacagatcgaggaggcagctagatgacagtactagttcagaacactaagaaaccggatcagattaggatacaacttcgaaagaatctaaccagcttttagggcatatgatatgcatatactcaaggaaaaattggaatcatgccattataattttacaaaatttaagatatgacatcctgactcatatgtcattgatttatgtgggtcctacatatcattgagataccgatggcacatttcaaactttataaaattataatggcatggttcaccgtgagtacttcaattcgaaagagtacttcttatatcacagcacgcaaataaccgtgcaagaccagacctctgatctcttctgcagtggtttcgttctccgttactgccggcagaagcatctcggatcagcatagcaattgatgtatatgctattttagtagctaggcatctcccgaggtagcctatggcacaacagtatcccgttccccatacaaaaatgttgtatatatgatcgctttggcgtcttggttaacataatactccagtagttacatagttaacggaagttgattccacaaaattcacataagacagtagtcaaagttgattcttatggagcttgatggcttaattagctggatctgcatgcccttgagtatgagattgaaggattaattatagcccaaggcatgattatatttttaaagggaaaaacatcgctaatgttatagaagaacgatcttgatcaatatattcctgggagaatcaggaaactctcgtgcgatccactgagacccctcatgctaagggaaaaacatcacccatgttaacacgcgatgttagcacttaatagtacagtgttaaaggtatatgatttcaactccgatgtccgatatttaatttttaacatgttaataatttctttttaagatatgtttggaggaaggtctctcccaccaaatctcgttttttgctatccattgttaacaaaggggaagcttgagctgatcattctcaactctcaaattaaacgagttctgcgccgcgcgtcgtcgtgcgtacgtgtatgtaggcgctcaaaggaaaaaggcaatcctagaaaaggttggtatcactgctgcacggcgcactttccactcgcgagttttgttcgcgtctgtgtttggggagacagatttgcagctatttcactgttcatggcgcggtttccaaggagcaaaggtttcgctgatcacatggatcccgctgacagtttggaccatgcatatgctggtggtcgactaaccagtactagtacagtagtacttggctagctagaaacctatacgtacgcacgtattttctacaggagacaggagctgattaaatcagtttgtgtacccgaactctgtttcgtacgcatcgtaaaggacgtatgcggtatggtacgctacacccgaaactactactaccgaacagtgtttccgccttgtcgtatgcctcgtttgcattagtggtactgtatactcctcaaccctgtacacctgcatgcatgtagctgagggcgatcgatcagtactaccacactatcaccaggctatagctgcattattattcagcacgtacatgcttgctcgacggtaaccctataagccgttatactgaattactgcacgtagttattcctagaagccgttaattagcatgtgagcgaaagtacgtactatcgtgtaccgctagtgagagcatatggatggatgcaggagaaatcgatcacatttaatatgttattgcaatatctcactggagttgtctttctgtcgagctcactcatcaggggccaataaaattaaaccatgggctgatgacagatgacactatgacagatcggacgctagctagcggcctagcgctattaattaacgatttgcagagagagcaggccggccgttttggagtcatatacatgtacagcgtgtgcatgcatgcaacgagggctcgccggccggctggcggccgtccttgatcagagatgtgtgcagtgtgtgtgcgcgcgcgcgcgcgctgccatggtcgatccgggatggatatctggctggctgttacgtgccaaagcgaaatcaattgtgtttttttggtggcacgcgcgcgcgcgggggaggagggtggagcacggggcacgggccgtgtcgatcgatcggatcgctgcccagatcttcccggtgcagtgggggcataccgcgtacgtaagtactgattttgagttcttgcttgtaacgtttgaccactcgtcttattcaaaaaattttgaaattattatttattttatttgtgacttactttattatctacagtactttaagcacaactttttgttttttatatttgcaaaaaaaaatttaataagacgagtggtcaaatgttgcatgcaaaaactcaaaattcattatattgtgtgatggagagagtaggaaagagctcagaggagccgtagtcaatggcagatgcaggggtctgaccgggttttacagccttactgcaggaaaaacccctgcgccagaatattttattttaagatgatagaatgaaatatttcgatctttgctcacgagctacaaccaattattacaaggtttacataaaagcaaactcacacagtgtacatgcgcaggaaaataccctgtgccagatgtacggtcactgagttggtccaaaaggcataataccatttctccaatatatcaaaccactgtatttattgttcactatagtaattataagggtgtgtttaagggaagaagaaaggagaagattgagaaatacataatatgatatgatccattaccatatgattaattaagtactacatctgtttcaggttataagactttctagcattgcccgcattcatataaatgctaatgaatctagacacacacatatgtctagattcatatatgtgtgtgtgtgtttttgtgtgtgtgatgctagaaagtcttataatatggaacggatcggaagtattacttattttaaacttaaaaaatgtagtgatatgattttttttaaaacattttcttttgcaaaagacattgttttggcagttcgatatatatgtaaatgtaattcagtaattgtaaattaatcgttttggcatgattaattgtgcacgtaattcgcacaatactcttctcaatcgaataggcagagctccggccgttttatatttttgttttctaaaaagaagtactctcttcagtgtattcttattgagatttctacgacacttgagatgtacttgcgagtgtacgtagttgccggatatccctatatatagtcctgtgtttgattacaccccacttttgttcgtaattatcatacgcgatatttcttcagtgttacccaactttaggtatattttttctggtagtgctagtgcttgcaagctgtaacatcacccaggaaattaatgttttacgtaggtgctggacagatgaaaacaatattaggttcacgagagtactcgctgtcggatgcatgcacaccacagatcatgtggtctgccactcttccctgcagtgatcgagggatgaagcttgccgtagttggagatgagacatgatagaggagagacgatatccaaatcctcgcaaaagcacatcgtttggtgctatatttggattcaatgcagctatggaagtataactcgagttcaaatcttaatgtccataattacgtctgttttttatgttcgtaaaaactacaattttatcggggagagcggttctaacagttacaacttctttcatcttcaactcctctcaaacaagatatatttttacaccaattctaagatgatgtaagtacaaaatacagtaaataaaatagaagataaaaattgaaaaatccagcttttccggggattatcagaaactagctccctgtacgaggttcgttggatttgtctataacctctatatattaaaggtactcgatcgagtggtacgtggcttgcgcagttgcgtttgctcgttgttaaagctttgtatgcatgtgatcgaaaaataatcacgtacgtccgctaattaattacctccagtacgatacatgcagcttgccatgcacatgtacgtacgcatgaacccatcaacccacccccacttatatatgcaccgtgtcgcacaccgattctttcaggaga

SEQ ID NO: 37062 - DNA, 2952 bp, Oryza sativa
  unsure (1)..(2952): unsure at all n locations
ccccccccccccccccccgcagccagctcgtacccgtacaggcgctcggcgagaacgccgaccaccgttcgtcgacgatgggttccacgacgccatgagcagcgcggccccgtgcttggcgccggtgggtgggtcactaggccactagggagtgcgaggagtaggacggcagcgaacgagctctagccacatcgccgtgaaggagagcgccgacctggggaatgagcccgtgagtcccttcgcctcccttgcgaactcctgtagctcttgccgcaccggcttggcggtggtggtcgtcgacgctgccagcaccgccgccgcgtagttgccannnnnnnnnnnnnnnnnnnnnggagcatatcgccgggatttgcagtgctagcccgacgccgttcaacgccgtcgtgaccgcatctgcatcgcaccatgtacgcaaaagcatgtcaaccatggaggagccgtcgtcggcgcctccagtgagctggtgcaggaagcccaagaactttgccatgatcatttggttggtgttcgtcgccgccgggctgctgctgctgttcatgctcatgaccggcatgctcgactccaccatcccgacgacgagcagcggaagaagtggacggaggtgatcgaccagatggtccagaacctcaacacgctcttcaccatcatgtgcctgcaccagcacgccaagatcttccaccacctcgtgctgctccgccggtggcgccccgacaccggcgacgaccgcgaggagatccacaaggtgtactgcaaggacggcgcaccgcggccgcacgaccacgcgcacatgctcgtcgtggcagtgctgcttcatgtcactgcttggcgctgtacttctgctgcgctctcttctggagctacatatttttaaaattttaatgtcatataagtgccacgtcaacgtcacgtggaagaaagaccaggtcaataccgccacgtatgcatcacgtcagcgaaaccatcctccaaaaccgtcgagggaatgaaattacaccggttttaatagttcggataggcatcctatccggttttgcggttgaagttcaagtgaacttattccttttttttttcttattatatgataggagtaaaatgtatggtatatgtatcatgtatgctactgatatttcaccggcaatcctcagataggaatccttgggccttggcgccgcctcgaaactgtcggaaatcatggggagaagcacatcactcgcgatgcttaggcctacatatttgtccctttcttcttcgctcttcttgcctcaccatttttttctcactgttctttgttaataatggaaataaatttcattttgtctcaccgttactaatgcactccctccgtcctaatataagggattttgacattgaacttacactgtttgaccattcgtcttattaaaaaaaactagctgggtggcccgtacaattacgcagttagcaccgaaacaaaatcatatttttttatgattttacttaaaatttattaaatagctatttcattgtcttaagactttgaaagaccaaaccttatcatccccttgtttctaattatatatttttttaagtcacaccagttgctaccccttatgtcatctccatttttatttgcttgctcgatctaccactatttcttttcattctccttagaatctttaaaaattggaccttataatttttagagtttattgtcacgttgggtttcgtttttataatttctagatgtcccgtcaaacattaccattatactcctctatggcccctccactgtctcttctctttattgccattgagattttaaaaatcgaacataattatcgtttgggttcatttttactttctagaaatcccgccaaaccatcagcggctttaccattgtacttctctacggctcgcccgctgcctctcttctttattgtcattgagattttaaaatcgaacataattatcattgttttttttactttttagaagttccgaacctttaaaaattggacattctagtttttagagtttattgtctcgtcaaatgatgccactatgctcctctacggcctgtccgccgcctactctttattgtcattgtgattctaaaaatcgtacataactatcgttggaattctttttttattttctagaagtcccgtcaaccgtcagcggctctgcaactatactcctatacaccccgcctgctgcttctcctttttattgtcatagagatatttaaaaatcgaatatgattatcaatggggtttattctttttactttctagaagtcccggcaaccgcctcgctcgtttgcttcacggcctgcctgtcgtccctcattttaatcgtcattaggattctattaggtgttttattaacagtttttatatgtcaccactttactcctttataggcctgttacttaatttatctcgtcatgtgttttatatggtattttctttcaatagtctttatttttatcacaaattttagatatttataaattgtattcctaattgaaatcttatttttctttttctaatttcagatttttttttaaattttaattaatatcgtattgtgttcttttaatttttttattttttattttcaatttcagttgtttcgaaattgtactcctacttgaactctcttttaattttttaattttggatattattttatttttttattctgaattttaattaatctcgtattgggttcttatatagattattctttcaatattgcttatttttaattccgaatttcagctaattttaaattgtattcctagttgaactctctttttttgctaatttcagattttatttttatttttattcccaattttaattaatcttgtattgggtttttatatggactcttattttaatatttcttatttttaattccgattttagctattttaaaattgtattt

SEQ ID NO: 37063 - DNA, 35047 bp, Oryza sativa
  unsure (1)..(35047): unsure at all n locations
attattatttatttttttgacttactttattatccaaagtactttaagcacaacttttcgttttttatatttacataaatttttttttgaataagatgagtggtcaaaaaatgtaagcaaaatatcaaaattccttatattatgagacggagggagtatgcagtagcaaaccatgagtttcactcgagttatttgaaaaatgatcaaaatggtggggaaagaaattcacacatcatggcgactgtaaaaaaatgtctccatgtccatggtatatcgatcacggccacccaaggcgcagctccaggtcaatcttcttgtcgttctcgtcgtcacctacatcgatgcaccggtgatcatggccacggcgcgcggccgccagcgcgacgggcgcggagagcagcacgtctccgtgcggtatgcgcaccgccgcgccgcccgcgccggagttcaggatggggtacagcgccacggcgtactccgtcctcgcggcggcggcggcggcaggcgcctccgccgcgccgagctgctgcccggcggcgccgtggagcccgtggccgcgcatcttggcgcggtcgcggcggtgcacgttcatgtgcccgcccagcgcctgcgcggaccggaactcgcggcggcagaacgcgcacgtgtaggaccgcggcggccacgtcccgcccaggccgtccacgtcgtccgccgccagctgctcgtcgggcaccggcggccgcccggcgccgccgccgggcaccaccgacgtcggccatctccacaccacggcggcgggcttgagccggtgctgccgcttcaacaagtggtgaagcgtcaggtgcttcacctcctcagtgctacttgttggcgccattttccggtctgtcggtcagctcccgtgtgcctttttttaaccaagttttggcgcgaacactgacgagaactgcgtgcaatttcttcgccgagtatttatacaaatcttgtgctacgcttgagccgggttcggcgagacaaaatgaggagggggctagcattggtagtctcaccgagttgtgtgcttttgctcatgtttgcaagtgtgaaacacagaatagctgtatgctgcaaactggcatggattgcatcactatcacctggtgaatgctgggagctgagttgattctgctgatggaatcagcaaaaatctgccaaggaaaaagcatatgacacagttgtgttgcattggcttctgtgatgcatccttgaacttgaagtttgggatcaatgaagtcgatctggaatctgggtgaagtacttccaaggagtagctaacagattacactggtaccatagaggacgcagcggcatctctgattctctgaatccatctatgcaagttcgttttagcaggattgacacataattgcaaaaccaactattacagtgtatcaaacctgagaggctacaaatatatgtcgcattgaatttacttgtagtatattcatctatccaaatgctcaaatgcaccttatgttggattcaattttagagtaaacaaaaagacagaattcttatgcactaaccaaattcagtgacaaccatttctcttccctcctatatggctagtactagtagtacttaaatttcagacaggaaactgaagtaagctacaagtctgttagtaaaatgtgtgatgctaatataaaagtaggactttgagctgtcatgaactctttgacagtgagacaaactgagtgaatctcaagtaaaatacaaacaaccaaacaggtaaaaatcgttaagctcctcaactctatatattatccaagctagctgtctgcatcttgtcctatggactcttgtcctcggttccttcgcctccatgtccaagcttgcaacctttcattcttttctgcttctagaacggaagatatgattggccaaatggtcattccaatgaggttacagccatttttcagaatctgttccccgtttttccaacacacacatgacaacagagagtatacgcaattaattatgcatgtgtatacgatatgtaagtacgtcgtccttgcatatagctaacgttgtcatgagtcaaaacatctctgtcgagcctggatgaaaagtccaaccattggtgtcgtcgtgtctgtatatctaaagttcaaatgcattctaatttctgtatagttttagccggcatatgctgcgaaactatgccgctgggttgtctgggagactacactactaagggcatttcttgtgtcctaatcactagggagagtccgtacgtcctgcaagcatcgttcttaactaaacatgcaagagcttgtgcttttcatctagagttagttctagatggtaatgtgacagactgacagttatggttgtaacagtgttgatgttttcattgaaatatattgttgagagaggtgtaaattttgtacagtgcttatcttatgaaatataaaaccagctaagctggctaaggtttaaaaaaagagagaggtgtaaaaacagaagcaaatttgtcgttgcgtactaaaaaataataatcaatgcaagcatgtacgtcacaaatgacagcttgaaatatctttgtgacaatcccaggtatgaaagtagtatcgatggaattgagagttacaactgctagcctgctaactagagaagatatcactgattaaagattattgggcacagatatcccaatgtttcggacggctaagcagtatacggccagtaccctagtccacatttccacactaatcaaatccccagataatgtaaaaaagagtggaaaacaaagaaacattaacatttgctctctagagtcagaaattagcatgttaaaaaatcagtaggaaataaaatatttataatacattattgatatggcaaaggtcagtggcataaaaaatatagttatagtaaagtttttaccagtgtattagtactttggtgtctgggttggaaatcagctattcaaagcctagtgaatgtattgcaaatccaagcgtttttatgcagaaaggcctccacctgaggcagggcctagatatagttcggcccagaagttggatacaaagataacaatcagggcctaatcgttttggaggaattttaaaggatttggatttctagggattaattcttatgaatatcatacggttcataggaatttagatataagaaaaccaaaataaattttcctttctaattgtggagagaaaacaagggaaaattttcatccacacaaacctcatgaaaaaaatcctatgaattgaagtgtgcatgcattcctattactccacacacacatgctcccagctaatctgccacccaaagtaaaatcaagttgcgcgttttccggcaatgcgcgcggctagctagctttctcctgtccgctccgctgcatgattcgtgctccagtaacgcagcgatggtgcggggggttgtggacttgtggatgaacaccggaaaggcagcgtgcaatggatcaatatactgctctttctttggatctctagggcctctcatcaaatttgacgatttgggatcagtgagagtgtgagacgcttatgtttctcaatgcaaacattaattgtcagaagaaaaaacagtctgggcccgctccgtgctcatgttgtacagaagaaaaatatgttgaggcgccacttgaattcagaagcattgcactgaacaatacattagcacattatgagcaagttgggcttttgtttttgggtggataaattgtgctgttcttttggttcattgaactagttgcaagttggttacatccacgctgtactactacatatcaagttgcagataaaccatttcgttatttatatcaccaattcaccatgtaggctttaaccctttgcccaggctggaccatgtgaacagtacatgcatgatgtgtaattgtgttttcaaagtacagttttgagccccacaggtcacacacgcttagagagaagtatatccttttctgtcagatactcatccaaagtatactctagcccagtcaaaatccaatatcttctattgcccagaaataggtcaaaattcattgaaataggaatcagacataactaatggagtggtacctccacagaagaaatcagctgagttagtcatatttacagtttgctagtttggttcccatgctgaaagagcaaagatgatacgccccttccaaccttgcagcatccatttgttatcttcgtcaactaggaaatccctgtggtaggatttcttcaccttgtatcttgccttcttcaccgtctcttggttcagtggtagctgcttgaagcctgccctgatgttcctcacctgccattgcttgtacgtctctggtctttctactctctcagtgccctcacaagcaaccacattaagagcttcccggccgaagagatctctttctatcagcagcctgttttcgtcgacccgtgaagcagttgtttcaagcatatcaaaaagtgaagagtagtagaacaaagcctccttgaatcgtgtcacgaagaagggcgcattgtaggtgccattgacaacgccatggatgaacaaatttggattcatctttcttattgtcttcagaacctgcattcttgggctgtcatctgtcaccatttcgtccatcatgtttctcatccggaaaaggcagttaacaacaagaagttcatccttgtctttgtctatcttaagatcttcgacacggatagtgtcccacttggcagcaatagcatggtattcaaatggaacattgaacatacgggcatagtcatgcaaccgacggcccgtcgcctcaatgagttgtgcagggcggaatcccggctgtggtaagtcaacaccggtgattcgaacacttggagggccaccaggtctcttcgagatccgctggaagaagattggccactggaatccatactgtataccatagtcaacaatgtgcaaccttgtcatacccttggatgcgttcaagatggcttcgatcgagaagaagttcgatattttcttgaacgggcatgctgtaacatacagcttgaatgcattcaatatgtcataaacagaagttcgcttggcagcaagtgaacggtaaatgttgctgccagtgccagctagccgagcctccaacgcattagcaaaacaatgtgctaacctctgaccggcatctccatatgcagaagaacgctgcctaatttgtttcagcaactcattggagttccggtgatcatcgattgcagcggcctgggcacaatgaatgagtagggtagtgagatcaaccgcatcatcctctgcagatgctccagattttcctttctttcggcctctcttatttccagatcctttcacgtacaccccgcagttccgtgcttcagctggcagtggtgcccggagctcgcattcgccattacacagaagcaccttgtcaaacatctctctgacagtctcctcctcagacactgccaactgcttgctcctcctgctctcttcctcgaacaataggcaatcatcatgcgggttcttccggcctttatgaacagcacactcccccttctccttctcaaattcacaaggcgctggctggcaagcggcatgtgtggttgtgaacgtatcaagcaatcctccattccccgtgaaatcacaacaagaatctatccaagaattctcttgacaggcctcttggctagcagtgaggatgtcaacgaatggcttctcgacggcgaggagggcagagtcctccaccgatgtgatggtgccaggacaagattcatcttcctcatcttcaagaagaaactgattgatgtatgctaggaccgcatcgtcggcggattcagacagatcctctgaattttccaactcggttgtggttgatgtggggcttggggtcgagccaaacataccagctggtgatctatgggaatcatcagcagaactgatgaatccgttggaagggaagaactggagggggaaattgagcaagtgaggcgcaggtggattggggatggagaacaaatccccatagtcaacatcatcataagaaccagaatccaacatgactcttgaatcttcgaacaagatccacccttttacttactgactaacaatacccttttctctgcaaattaaacacaaggatctcactaaagagaactgaacaaataccataaaaatctgttcttttttaccataaaaatctgacggtgctatggtatagaaattttacaagcatgccatggtaccttattgtttcaagtatatactcctactcatattccagaatgtaaaaaacacatgttacctcacaaagcgaaagccatggaagaacaggctcttcaccaagatctgcgaaaaaaaaaaagctgcttgcttgctagctagccgcagcttgcgactccaagaacagaacacttgctaagcactgcagtctttttcatccaaaatcaatcttggatttttgcctttatgacgcagaacttcaggaagaaactagaaagcagatggtgatttgtggtcgttgcggtggagaggagaggcacagggagtcccaactcccaactcccaagagcctcggttggcttggtgctggaggcgaattgattaatgtgtgatgtgtttgctgttaaaagcgtgacagcctgtcttctcgctcgtaaaagcgtgcttaacgttaactaatcgccccccctcataagagcaaggataataatgggctataagcaaactatatactttatgtggaagagagataaggaaaagtgggtagtattggctctcatgcaagagttagctccacacaacctccaaaaaatatgcattaaatttatggagtgagaaagagagagaatggaaaaaataaagttaaccttatagaaaaaataaagttaaccttacaactaacttattatataagttaactctaaatttatagtaagcagtgagctttactattaaatttgctcttcgccattctaggaagagtatggtcaattggttaagtatactagtactactttcattagtacacctgcagcttttaagcgattaatcaaacaaggtggtcaagtgggaaagaaagggggatgcaccactgcaagggtacctcaggtctcaacaggacaggatgcgaaggtggaggattttctgcaacagataattgtgcttttaggttgagccttgttgatgcaaccaacgacgataacagtcctccgtcatgttatccgaattgaattaatacaaccattccaaaataagctgatataaaataaatatattttaatataatgttccaatcttatactagattagtttaatttgacgaagagagtacgaattttttgagtccgacaaaagctgtacgtatatgtttcgttattcatcgttcatgcgcatgtacgacagtagaatatgttggagagtcgggtgtgtttagttcctgaaaaaagttgaaagtttgaaaaaagttaggagtttgaaaaaaaagttaaaagtttatatgtgtagaaaaaattttgatgtgatatgatgtgatggaaagttgggaatagagggaaactaaacacggcctcgaatactcacttgatccacaccgatgcatttatcacgattgtcatcctgtttggtcgaggtatccgttgtttgtcgtacagacatatgtatgatagtagaatccgttgaagagttgaatactcagtcaatccatgccgatacatctatcacatttgctagttaccgtatcttttcctttcatttcttaaagcatttccgattggtatcattttgtccgactttagctcttttcatgtgtctttaattacaccacacgtgatctatatgccgaggagatccatgtaacacttgttgatgacgttgtcataggcctgacacccatagcggtggtagtgggcgagaaggataggcaaagcgaaaggatcgcagtggtgatggcatgcatgtcgaccgttcagagtacagtataagctctatgacgagtttaaatacgtgttaaatatatagggtgatgtgtttctagtaatacagatgtataaagtatttatagaatttccaaaccatccgacagggtacaacctggtgaaaaattagcacatgtgatttaaaaattttggaaatggtaaaattagaaacgcctgctacgtgtcgcatgattacgctatgaaccacttgaggatgttttgggccgcatggactctcatggaattgctggcacatgcgatcggagggaagatgcagaactccacctgtgcagtgtgaacgctgcgagatgccgcagcaccagatcagtagaccaggcggctgaccacacagcgaattagcgatcaggtcagccaataacgctgacaatattgtactcatgccaatatttgcctcttaaaaggataattctagagaacatttttgtttactctttaggtggtgtttggttcggatgtggtaacgtaaacgctaatggtattgcctccagccgtaacggataccaatttatccgattacatgattagtttggttgcaggcggtaacgtcatttatttacattactgcgtttggttgcggattgcggatggcagccaaggaacgggaggctgatcaataggacacaattcgaaatttgaaacagaagcctttgggaagatcatttgctccgattacactaatcaaagaactgcttgcttccagacaaccattgatcaaataactgattatacaagtatgcttatacaagtacgcaattaagcatatgacataagctatgaaacattcgcaccagacacactccagtactatatcaacagcagctgacatcaaaagctacataaagaagctcaataaattttgacatgcaaatgtttgaaagataactcgagagttaattcctatacatgcaacgagcagagttttggcagatagttcataatattccaaacactgtcacctcatgtttggatacaaattttgacagtgagaactcaagacaaaaagacattttgcagattagtaaacaataagctaggggcaatacttctgtctgaaaaacaggacagtactttgatcacagaatatatagattgtcatggttcaagcaaataaagctgaagtactgaaactaaacatccttaggacataggtagtctccaatccccaaggcctatgcttatatggaattctaataattcaaaaacagataatgaacatcttgtagatcatgcttgacagccagcacatcagtacatcaatttttctttgcctcatctgataacaaaaaaaaaattcagaaattagtgaaagaaacattaggtgaaagaaaatatatagtgctcagcatcataccaaattaagaatattcttgcacagacaagccatatatgatattcagaaaaaaggtagcattttttaactttaggagtacaaaaactcccagttaggtgtaagcaagtaagcaagagaccaagcacatactccagttagaagtgaatataatattactatggcattgagatggacagctgggtccattgatgcattatactagtgcaaggcaaataatatgaatgcatatatgaaatgctaagtggtaaagagcaatatgcttacaattaatgatcacaaaataaagtgatatgtttcctgttgcatttgcaacactacaagattgatcaagtgaattaccagcaagtattttcagtacgtactccctcctgagagactctggaagagcgagaagcatactcatttgagccggcacttttacaaaagcagctgcagcattgacaacttcagtaccagtcaatccaatcttttgacactcaagaatagcttcgttctgaattttttgtagtgggtcctcctcagccattgccttctcttggatctcagcttcacgttgcatagatgccaccattgctcccacatgctttgtaacatccctcagatcaccttgaacattggcaaagacatccataaaagggtcacttgacaaggtatttttcagtttgttgctgtctttcttcctcttcttagagcttgaagcagttgaatcaatgctccgtcgaggtgtggctgaatcgatgctccgtcgagctgcagctgaatcgatgctccgtcgagctgcagctgaatcgatgctccgccgaggcgtttctctagacactctctcttcatcctcctcatcttcttcatcttgaatatcttgaacaatttctttctccatattagcaacagcctcaccaagaccctctgcaccttctccagtagcaatgtctttaccataaattgcagctagtgtatcatagtgagggaatgctacaccatatagaccctttgcctcattgtttttctgtaaaatacaaagaatgacacaaaattaaggtcatggtttagcaagcaaaagagagacctatgcagctacaattgcatgaaaaacacaagagaacatatgtatgagaaagcatactactagaaaaccataatgttgtctttgcaaacatttcagaggaattttacatagccgcttatttggaacaaaatttcataaaatatcttacagtagtttcacatatttcaattcaatgcactcatgaatcaataaataaattttctactccatagttagtttgatgacttaccctgcaatgatcatcgtattgttgtttctcacattgtatcatctttctattgtcatcccaagaaaagccacttttggttagcatcacttcaattgcgccaaacttggtcctaaagtgtcttactctcgactctatgtgcggaacagcagtaaggccagaacttggcaacttcttagcaagcacgttctctagaacttggcagtatccatttttgaaacccccttctgatttccagcttggatccaaagcaatctcgaacaatgccttgatcagctcctcatcctcaaagtacgtccaaatcctcttgttcttgcctctcccacgcacaatgcttgagcttccaagatgctccataactgcaatattagaaattcaacagaaaactaacatcagtaagcatccataattgtaccaacattttttttatttttgatttgcaaacaattagaaattccatttaaaacacaaacctcaatgagccctatagctattatacatcccctgagcaagagtgttgcgaaaatttgtccaatcatcagatgtcgaaatagctgagataaactcaggttcggcgagttctccctcaagtatatccaatggtatctcgtcctcatcctcatcctcgtcctcatcctcaaatggatcactagacatcttttgcaaaattaagttgtgcaataaagcacatgccattataattcgacactgagttttgataggaaaatatgatggggacctcaaaatcgcccaacgaccctttagtcttccaaaagacctctctacaatatttctagcacttgcatgcctcatgttaaagtactcctctgcactatgtggtgggttacgtgctgtgaaacggcctaaatgatatctttggcctcggtaaggggctaaaaaaccatctgcttttgtataaccagcatccacaaggtaatagcaacctttaaaattttaaaaaagaaatatcagtacaattcaggctgtggagtgtcaaacttcaaaataaattgattggaaaaagactcgccttgagggacacgaagcccgtccggcctgtgaattgcatcacgaccatcatgtgcagaaccctcccaaccaggtagtaagtaaatgaactgcatatcgggtgcacaaacacctaatacatttgtaacaatgtctccttttcttgacatatatcttccttttatcctagttgggacagttacttttatgtgtgtaccatccaatgcacctaggcaattctacaatccagaacaccacatcaataaaatatggtacaattaatagtgctgagatgtgattttttttaaaggaaatgtgatttattttttagaatgggttaccttgaaatatttccatctatcgtcggtggtgtcctcaggtataggttctggcttcttaagtagaagttgatgaagcctcagaacagcaagtaggcataaattgaaatgcctactcacagtctctccacttcggtaaaaaaactttcctattgttctattctttaaatggtgagatagtatatataagaatgaagctactgattcctccaacggcatatttcttgtatcctcaatacctccgacgtctctaagcatgtcacatagaatgtgaaatgtcctcctgtccattcggagctcgcttatacaagcaatatcactctcacgaataagctggaatagtctttcactcctaagttctctagttctgatcctcctctctattttccaatattttctcttatatgaaattaaaaacagtacaacaacatgataatacataagtatgacagcaatcatcatatttctaagccctaaatttcttctccgcgttttggtacttaagggaaggcgagccatagcactctacaaatatataaaacaaaagcattaaccatgtccagaatatatcctgctagcacgcataatacatcaagctaccactaaaataaacacagtacatattttttttattgctaaacctaagtgatttgctagaacacaatatcaagcatccattcagggatatttacatgtatctgttgttttacacaaaactttttttccaatcttacattgtggaaaatgatatatcacctggcagtaaaagaaatcaaaattctcaaaatctagatagtaaaaatgagttggtcaaacttccctacactcaaaaaaaatattcactaatattcaactttcctgcaatctgggaaaatatattctacataaccatgtgaacttatgaagaaaacatgtatgaggcaggattaatacatgagattcactagtataagctacttcatgatttgttaatgaaaagattatcacaggatcatcactcatcagcattcacaatttataaagagaggtggtttcagtagggggagggttctcaccggcgaggtgattgatagatgacagcaacgacggaagtccgatgtggttgatggcaccagccccctgcttcacagcctcgcccttgttcccggagttcttccggtcaagatccacatcgaaagacggcggtggtggaggagcgcaagacggcggcgtcggcgatgcgcggggggtgaggggacggcgccggcgacacgcgggacgatgggaaggcgcggggacacgcgcggggcgagggggctgcgccggcgatgcgcacagggtgaggagaaggcgccggcgacgcgcacagggagagggggcggcgatggcgacgcgcgcgatgtggaggagaagctgcggcggcgctcgatctggacgaggcgcgtgaggagagttaggttacgctccgtatcggtatcgttttccgcccgcctatgagtgtaatcagctttgtattgggccggaattcgtttgcgggctatccgattacgatccatctgaaacaaacatgtgtaatgcaatctattcacggtgggatctgatacgggccaaaaacggcccaaccaaacagctccttagtagtgtccaacacgccgcatggtctttctcaggtcagaacaccgtacacgaaaaaaaacaaacaaaatccaaaacacaagtagaaaaaaataaaataaaaattgtcccagcaaatgtttcttcacgtagaacttgttgggctcgccaaactgggccagagagcagaggccggttattgctttttcgccagaaaaaggccagtaaggccttattttggtccgtgtcaaaaaagtcctcgtctcggtgggccgaaatctaatccgtcgcatacaataggcctccattccagcccatccatgtaactccaggaaaaaaatggaacaagttcacttaagatccctcgacttgatgttgagttcaaattgcgtcctcaaccgcaataccagatataagtatataacacatctctcaacttgtaaaatcgatacaaataagcggttttaactagcatgacgctgccgtggtaccacaatttttttatttaaaggtgaagaaacatatgtgtgtgaccaggcaatcccataggagagactgcgatgtgcgccgcccccggtggtgctgattttgtgatgggttcgttctcttgttgggtgcgcagggggtggaagtggttgtccctgttcaggttcaagatctggtggatgatcccgatggtgggcgaggacgtaatcgcctcggctgagctgggcatgtagcaccagaactctggtccatgtgattttttatttttcatattttttctttttttgtgacatgtcatccaaaaacatatttaatacttcctccgtttctaaatatttgacaccattgttcttttagtacatgtttaactgtttgtcttattcaaaaacttttgtgaaatatataaaactatatgtatacataaaagtatatttaacaataaatcaaatgataggaaaaaaaataattattatttaatttttttaataagacaaacggtcaaacaagtgctaaaaaagtcaacggcgtcaaatatttagaaacggagggagtactatcttagactatatttgcaccagtttaataaaatgagggacacgttatatccagttttgcggtttaggatggaacaaactcgacatcaagttgaaggacctcgagtgaacttagtcccgaaaaaacatgagccgatcacagcaaaagcaacgcggcctaagacctcattgtgatgggcctcattctagcccttctaatcggatgggcctcaattccatcccatccatataacgctagaatatacagggcgggtcaaagcccaagccccacactacgccgtttcacgcccgcaagtccgcaacacagatcaacacaaacgccatagaggcgtttctcccggccttgtgcagcatgcgtgcgcggcgccgcggtgccacctcccggacaggtcgggcgaccgccccgactctatcgttaccgtcttcactgtccatatccgtcaatactaacaaaaattaatctatcaccgaaaaacactaccggcttgacggccattgtgccggctccgccactagcggcggccgctcgaccgcttttcgatcgatcggcagggattcacgacgccgtacgagaggtgaaattcttcgccaatcgccgccagtacccgaaggaattcagttagctgcatctctctccccactctctcgatccgctgcacacacgcatatggcgctcatgcgatcgatcgatcgatcggaggcgtgtgcgaagcaattaatgcggcgagagggtcgcgcaagcgtgggagcacatgcggccgcctcggcgggcgcgcccgctgcctgccgcacgtgcgacagcgctcctagctcgctctctcatggcgctagcctcgcgcgtggatgtgctcttttggatattgctagcttccgtggtggatgcatctgcgtgcgcgcgcgcgtactgcggagtacgtacgccgncgcgcgcgctgcactacacacagtctcaatctctctcgaatatctcgagagcagcggccgggcgcgcgggcacgcagccggcagccatggacgtacttacgtacgccgccatgcgcgcttagctagctagctcgctccggccggctcgatcggccggatgggacgcgctcacgtgaacgcatgtacatactctatccatccaataaaaaactaacctggtgttggatatgacacatcctaatactacaaatcttaatataactctgtgtctagattcgttgtactagaatatgttacgtccagtcttagattcgtttttttacgggacggagtgagtacgagaacgccatacatggtgggtagctagctagcttagagctgcatcacgtgtaccacccatcacaccgtacccccagcactgtatatgcatcatgctcatagctcatttgctcaactgacggccgcagggttaatttcatgtcgcgcatcgaccaacgcttgctaatgctagctccgtttgatgatttgattaactgaggctaatctatgaccgattaaaacgtgcatataccgacccccatgtggccttcagatccggccgagatcgagctagctatccgcagttctgcacccgccaagagtcaaatcggtggtaattaacagcgtatgtttcagcataattaattaatcaagtaagcgaacactgcaaataaataaataagtaaataaagatatgcgcgtgtacttgagagcgttgagacgatggagagctagatagaatgtcaaatgattgctagcatagctagactaattattattctccgaaagagtttacatatactaattgaccttattgtctatggacagaatcaagcacccatgcatccacacacaccaaagccatacttttcaatgaatcagtaaataaactatgcacgaaacaccacatttgcggccatgtataaactatagcgaggataaatctagcaggatatagctagctagatttgacatgacaaaataaccatttaattaaggcactaaattaaggggttgaaagggtgacaaatcaatcattatcaatcacagggcgctgtgtatatgcacaagcaaactctttgttggtcggttaatattttttctctcgtccttgaaaaatactcctatgcacacgcattttcctttaggtcaacacccctttattgcaagcttccgtcccctcacatttgcgccccatttgccgtctgatgtcgtcacttttatcaggggcccatatgctacttagcataaaatattggccttaataggtgtagtgcttatctttatatggccattaggttaaaggtttccactctggcaagatgccgttgagccctaaaatattagggtgagcaagctaatcgctcattggctcgtgaaaatagtgggtgtgagagagggggtgtctctggctagcttcaacttggcgacatgattaggtgaggcgcctcccagcaaacaaagtctatgccgaattaatctttatttttcttttcgttgccgcgcgccataataaactatactgctctctctctctctctctctctcaagatctctcgtcactttaggatgcttatgcaggtttgattggtgagacgttttgtcgtcgtcttcttagtttcatctccaatttacttcatgaacatttaatttgtagcatgcgtgattcatctcaacttgtgttccacggtttcacattgaatatttaatactccatctgtttcaggttataagatgttttgactttagtcaaagtcaaacttctttaagtttgatcaagtttataaaaaaatagtaacattttcaaccaagacaaatttattgtgaaaatatattcaattattgatttgatgaaactaatttagtattataaatattactatatttgtctataaacttagctaaatttgaaacagtttgactttaactaaagtcaaaacgtcttataacctgaaacatatggagtacattcgatcgtgtgtttacatgcatgcatgcatgggaagtgtgtgttcatgtaaaatggcatccatgtgaatgtccttgaatcataatatacatagatatatgtcctgcgcatgcaggatccttattcaaaactaacaaagatgtctatataaacaaagacctttcatatatagcaatgaaaattagctccaacgaaggctagcgataagtatgttagtctcactgaggctgtgttcggcagcttgagatgatagctaatccctagcgcaggtgaaatggaacgactcattagctcaagattaattaagtattagctaaatttctttgaaaaatagattaatatgattttttaaagcaactttcgtatagaaattttttcttcaaaaaaataacgttcaacagttcgtgaggagcgtgcgcacaaaaaacgaaaaatgtgggagttgggaactcacactaccgaacacagcctaacctcttaaaatcacatcttaacacctacatgtgattattctgggtatatagatttgaattctaatgggtaatgatgcatctacgactttaccatcacacctctagtttcttccaataaatctatatgccattaattctaggtatttaattttatgtcaaaagaatttctagttattttcggaagttacataataattttacaaaaatcatgatatgagcttttgtattcttctagtactattactagctaatattatcagtacatggtagaaatgcaccaagccatatttttggctaccaattactcagaaatgctagcttttactcgtgcacatgcatgatatatagaaaatcattcagatgttgaagacttgaagtgatgacgctctctctcgtggcccgatcttctggtgagggggataactctcgctttgatcgagtgcgacgtttgcgacgtggctaccaaccagaacaagtccaggacgccgtgcaatcgctacaccacaaacgatgtcgtaccaaccgtgacgcgcggttgatgatccctgcaatgcaaacgagagaacactgcaagaacaagataagatgcaatctaaatattgcgaatagggaattaagcacaaaggaatagttgcgattgaagtggtagatctaatcgacccggcaaatcaacacaccaactattgggggctctgaatctatagtcgccgactaatcgagcgaggactagagacaaggtgaatggcacctagcaaaattcaactaaacaaaacccaaatgtttttgaggatgtataaagctatttatagaggaaaataaagctagggttcagtgctaattcgtggaggtggagggtgacacttccgagatgggcctagtctattacaaggcccaaggcccaagttcggtttcagcaacagcactgtcttgttttggcgattcccgttgactcgagatgaatttggacatgagaccagatgcgtttgaaaggtagcgagataatctttccacgaagtccaagatcacccaaatcggagttggcatgaaggcgctaggtccgtttgaagtcagtgctgtctccggaggccgaactggacttggatttggaattatcattggagtgtgtgaagttatgagcgtatccgacgaagtgatgtcctcatcatgaattcatgctttgtacgcgcttattagaaaccaagttgctctcgcccacagtttatccatggcgtggtaataaaaaaatggccagtacagtgactataaaagatttgatgcaacaaatgatgttgatgttgtcctgcgatcaagtacttacgattcttatattagtagtaacctacaaaatgaactttttgtgttctcgatcgatattttaattacgtaatcaacagtagtactatccattgcaagtgactaaatataacgaactttccgtgtttccatagctaggaagaaaatttatttagacttttgtgcatacacaataaagaaatccaaggtgctcgcctactcattacacttataatactgaccctcaaagcaaaacatatggctgtaattatatgtagtttactcctgtgaggtaaccatcacacatatgttaacattatcccattgtaaactttgcagaagtaatctaatatttgacttgaattggagctatatatattgcgtgatgttagtttataaattaacacatggctctagctgctaattcgaggaatggacataaaatatatgaggccgtgctcgaattgtttgggctagtttctttttttatcttctttcctagggcaactaattacttgtaaaagcaaccaaagcaagtagaaagaacctgcaggagaataaactagaattagaagttacttttagtaccaacatgtgagttagtgtacatttatctaagcatgcgttaattaacttctaactttcttgcattaagtagtagctagtgtctcatcattgagtgattgaacagcagaatcttccaacccttccgggatttacatgcatttatatactgaccgagtaatatataatcaccaggcaaaggacgatcgagcgtcataaaattaagaaggctgagagcccaagacaacacacgcatatatttcagccaaatttatataattgtgcatgctcccatgatacttaccgcatctatatatgttagattaggttgactaaaacatttccatcagcagatcgacacgccagtttttttccctagagattcaataataataatgcatgtatatcaaacactcaggtgcactttgatgaagacctacaattaatagataattaatatgcatgcgtgtggaacatatatatacatatagactgaaacatgaaacaaatatagtagtatcctatgctccgggacgggcgctcatgcaagctcagttgctcgatctttattctaaattattcaaattcactggttggtcctcggatttttgttggaacatctcatcccttttatctagcttgtatcttatcgccaagttggaatcgaggaaaatatcaggtggaaagcactaattcatctctctgaaagtctgatgaacaaattgaagctgatctcgatgaccctatgcattcatgcatgtgaggacttaactgtacatgcacagtaagccaaaagtgcatatgatgcccattagccgcgaataacactgtgcaaccctagccaggactgaaaggaccagacgggaggacaaagggttgcaacaaaacaaataacggggttactacgattctgctagccgacagcatttctcggtgacatatcccaaatcacgaacgaccatgggctacatgccatcccggaagttggactttcccgctgttgctttcagttttttttgtgtggccaagaacagcgacaggccaaccaaccagctagctgatcgatcgatcgatcgaatgatcaccatatttagatcgacgcgcacataatattggcagcgaaaccgatcgaataatatgacctagctagcagctgctgttacggacgaacaaattgcctggccctgatctcttcttcttcctccgatcctctcctagctagcttagctagctcctcaatcgatcgatcgccttcgctttgctatagctttagctcactttcggactcgacgagggggattaggctaggtttaatcactccattagccattagctagcgccggtctcgagcttatccaaccattggcccaaaggcaacgtgcttgtcgggattagggaccatgacacgcacaataatgtattcgattagcgattaacttaatcccgcctagccttggctttcttaaagctaaagttgccaccgagggttagaatattgcggctggtacgggtcaccgtccttggaaccaccaccggtcgcgcgcacgcagctgcccaagatctagggcctcgacctctccatcgtgatcggcccggctacggcgccgacggaccgaccggtcaaaggatgcatgaagccatggctagctagctagctacgtactactagatgcgtatggcgaagataacgataattgatcgatcagctagctcgtcgccggccggcaagccggagatctccggctcaccgccggcagtacgctgcgctctggccggcatgtgcacccatcctattaatcaacgatgtagctaggttggaattggataaactggaaatttcatgcagaaaataaataaatactggtcgatatttttttatttgatatgaaatttaagggatcaattgaggggggggggggtgtgcaagaacacgtacggaagataatagacacatcatcacttcagagaccaagttgggatcaagaattaagtttgacaaacagaaacttcagaatttgctcagggtaaaagcgtagtggattcggttaaagaaataagccgattggtagatacaagtttatctagaggaatcgtgaagaccatgcagtttcatatttttaagtatatatattttaaatcggcataattagttattttccttaaatttcttgttaagagtcttgtgtccgatcaaaacttgtatcaacccgattatataaatatgtacacataaagtctttgtaaactatcttcatatatcaatacaattacttttgacgtatcgctaccttttattttggcaagtccttagtttcaagttgggtgcatcggtttcgatctccggcgaggaagtaaattccgtcaacttcacttgtatcagcgtggctaaaactttctcgttcaagtccgatattctatctaggtcgatgcaaggtgttgcctatctgatatgttcgttatatctttaattgcattgttgtttagagttgtattggcctagttaggattttgtcggttaggtacgatattcttactaagttgatgtttttctaattatattgttgttttagattgatcgatatatctatcatgcttatatagatctatcgggcaacagaaattttaagccatggtcgtcgtcttcttcttcttttcttatttttcaatagtaattataggttgtgtgcatcctaactatatatatgcagaggctagaaggaagacttagagtaattatatcatattgacgtacttgtctaatatcaataaagcttaatttctttatcgaaaaataaacgtctgaatctacataacacacacaaaaaaaaatataaaaatgtttttgagacagatcgatcgagatgactgaaaaattcgttgagggaaactatcagatcacaagacttagcatcaatatacaggtcaacaaaacagcgcaatgttaaatcatagaacttcagcatatatatctattatgcgaactttaaccaagaactaaatagggtaggggtatcatatgatggcatgatgcacccacttggccggacaaaccaatggttggcaatgtatatgcgaagtacacgcagagctacatatattactccctccatttcaaaatgtttgacaccgttgactttttagcacatgtttgaccattcgtcttattaaaaaatttgtgaaatatgtaaaactatatgtgtacataaaagtatatttaacaatgaatcaaataatatgaaaagaataaataattacttaaattttttgaataagactaatggtcaaacacgtactaaaaagttaactgtgtcaaacattttgaaacggagaaagtaatatttaaacaaatcgataaacttctgcttcaaaatacatgaggagcaactaactagactgcattattgttactaactaccctcaactaatagtataaggtatccaaagttgagcgagattggtgtattttggcgggacatgggacatggttaaattaatgattaacaagatggcaaatttattaatttacaagcgcacgcaccttcaaagtaagagacctgccaggaacagcatgaaacctaaatctttttaatccctcaccggaccaagctatgattaacaccctgtattattttatgacaggcttagaaaagtggtagttgcgacctactaattaataagatacctgaaagtagtgagaagagggaaggcagaattaagctgacacgtaccgtgaattgtacttacaaattaaacttatccgaatccctttcgatgaatctatatacgtctttccgatcgacctcgaacgtcttaacttgtcgataataaacaaaaacacaccaaatcgatcatcatatttttattatcaccagagagttagcagaagtacgaggcactgtttacagatctctccacctccaaaatatatattgctagctactttccgatcgaagagatagcttatatccactaacccccggcccagacaaaaataatctacgataccataataatgcaagtagcatagctctaggagtatatgttattttcataaactaacagatcgacgtacaaccatggacagcataatttatgatcgatccatggcagcattattaactgccttaactatcttcagacttcagattgatcgacgtgtgtgttagctactagtactagtatatgtttgctcgtgtgcgcaagtaaattaactattttctggaaagcagtttaactttatcttgtcactgaaactttctagctagcgcagaaggtaattaattaactaaacagatatagaagaaattaattaaaacgagcacaatagttgcagctgttcattcagaacgaactgatactacaaagcatatcctgcagtattcgtctttccttctctcttgtctcactgcaacaacttttggggagtccttagggttagggttcttgcgccatgctttggggctgtggtggtggggcccacgtgcagtgggacgcatgggctggggttggaggtagcgaggcagagcgtggtttccgaggaaagcgagctcgtctctctcatcttctctctcttttctctctctccggtgttgctcggccatggccgacagccacgccgagttaccgcctaggggcagccgcgcacttgaccgcacgtgaccgggcacgtgggggggcgagccgtagcgtcggctcgcggctgcacagtcggctcgatcgatcggctccctggatggggatacttgtcgagaactgattagccaggcacaacttgccgtttttaagtttgggatcgagaggtacgtattgctagtagcatacaagtactgaaatactaccagccagcgcttcaccatacattagccaaaaattatcactatttacttctcattgttttccttctggcatgtgggtctgcaagttaatgtgccgtgcatgagatttctgctaaggaattactccctccgttttaaaataaaactgcacactaattttaggacggagtataaacatatctttcactaaatgtagttctaactgttaggaaatcatatcttactagttataacccactaaattctaaaacataacatgcgaagatgttacatcatcatccactaacaattattacatttaaacatcatacaaacatgctatgttatctacaattttataatttactaagttttagagcttttaaaatgcaagcatgctaaatcaccatcctacataattcacataatatttcaatatatcttttcatcattttttaataatatcgcatatatccatataattcatactcggttaatattatttctcttttctctcatcaagccatatcacatcaattgattttagtccttagatgattaatatatgatccaaactatctccctcatttttttctctcataaagccacatcactttacttttacatttgaatcattattctatatactctctccgtttcatattacaagtcgctttgacttttttcctagtcaaaattttttgtatttgaccaaatttatagaaaaatttagcaacatctacaacaccgatttagtttcgttaaataaaatattgaatatgttttaaaattatgcttgttttgtgttgaaaatgttgctttcaatagaatttgagtgaggctaatgcactcacgcgctaatgcactttcaatatgattttagcgaggctaggaatttatgtactgttgacctttcgatgcatctctttgagcatgtcttatggaacacattcactggtgtatgagtgtggtgcgcgcgtatatgtctccatgtaattgaaaagagcaaattaaattgaccgcattcattttcaaatataagcattcacatgattcaaattatatgtacaccacaaacatttctacaacattggttccaatctacgagaatctaaacattttcagtcaacagatgctcacttttttgggattttttttaaggggggggggggggggtgtttattgctagtagccctcggactgtctttgtagtgtgtgcatttgtgtgatgtgtctacatgtaagtgtagagattttcaacaaagaaatataaggaggctgcttataagaacatctatttgtagagaagcttatgtacgtgctggaatattcttattgcacacaataaaaaattggttttgcattcggagtttattgacacaaaaattgaggaacatgcatacatgcaccactaggagaaggcacgagtgagtgtttgaggatatatatagctggatttgatgcatataaaagtggtaagtagttgtactttcagttaatttaactaagactagctagcttgttaattatatgtattgtcattacactaatgtaatgttttgttatcttgagacctacttttcgtcatatagttaatcttttgatccagttgccatatagtatatagtatcaagatacaattatgtgtttattatattaaattgaatatatataattgtgtgcatgtatatatatactccatcatatccacacgttcttaagaacagaggttatatttgctcatagatttgtgatgtcaacaataataataataataataataataataataataataataataataataataataataataataataataataataataataataataataataataagagatgtgcttctatactttaaaaaaaaaggttgcacgaaaatcaaagcacataagtggatgagattaaaagagagattaacactctaatcctcattagcgaggggtatttttgtccatggaattttgagccccggtccaactctgcagcgataccaaattaccaatggcgacgccgattcctccacgactacgaccgctagtccgggatgctctctccttgggtagcgccgctcctcagcctcgcaagcaccgcccgcgcttcccttgcctcgccacctcccctccctcttcctcccctcgttgcccggcttcctcttgcaaacagcgccgccgctccgccctcttcttcctctcgacgcgcggtgcagcacgacgctccattttgtccatctcacagccagtagtcataaaacaagtatctgcataccattgtctaccccgttcatttacagctcaccaccatcacaagtcacatcgaacttgccgttgcagattgcagacaaacaaatatcaaacaagccaaagcacgaagggcacaagcttattttgtgttatttcttctgtttaaactttggttcaatcgaattgcgacttggccttaaatgaggtgtagatcatggcaccgaagaagctgctgcagctgtcgctggggtggcctgactactgccggcacggcggcgtgctcaatgtggcagtggcgacggcgcgaggtggtggcccttgatgaggacgtcgacgttgctatatatagtcctcgtgctcgaggctgatcatgttgagcatggcggcgacgatcttcattgtggagcagcatattattcactggagctcccgctcatcgtgttgcgagcgaactaccaactcaaatcaccgcaaatccatcgatccatcgatgggatctagttagggtggtctagcagggcagggaggtgaagcgggtggcgcttacgttgcagaggaaaccagcgggcagtggcgctgcctgacgaggagagaacgatatcgttgtgggctgaaatttctatggacgaaaatacccctcactaatgaggattaaactgttaacccacttttaatcacagccattgatgtgcttcgattttcgtgcaacttttttttaaagaagtgtagaagcacatctctaataataataataataataataataataataataataataataataataataataataataataataataataataataataataataataataataataataataataccaggcatggatccacgacgtctgtccttattctcttaaaagttaacgacatatgatttatagacggttatgttctactataataaattacataacaacgaaacctgctaatacgtacaccttcagagaaaaacatatggcatatgttttttttgggatatcttatttctctttgatttgttattgtctggatatatatatatatatattaaatttgtttggtgctccatggtgcccgggcaccattgttgaaattgagtatatacccaattcaaatgagcatgaaacttttttaattatttaggtattaatattaactactttactaactagttgaaagcaagtttgaactgaatttgaacttgtttttgttagattttgattctaggtatatagcatccatacatataattagttaggtatgtaatcatggattgtgaaataaagttaaatttgagttgttttgttgataggtataggtatgaatcgaattcttataactaggtatatactcacaatttgaaaattttgaaaaatttgagtgattttgtgcatttgaaaccatggtgcccgggcaccatggtgccccatatgagtgtcctatatatatatatatatatatatatatatatatatatattgatgtgcaattcttttacgcgttaaaataatgtaggatcgaaacacaagaactaagccaaccagaggggagggtgaatgggtggtatacccaaaaacccaaactttttgcggaattaaaagttacccttaaattcgacggatcgcggtctgaccaaaggtgttgcgccgatctgaccgcctggaagtcgtcggtccgaagtagaatgtccagtcgaaccaccaagatcagcagattcctcttgtagccaccgccggtctgaccgcagatatgacaccggtctgatcgccggtgtgtcgccggttagaccgctgaacccgatgaaacacaaatcgaagaactctcaaagtagatgccaactttattacttctctctgtgtttacaaagtgcaacaacaacacttcttacaaaaatctcgactaaactcgaaatcctaactaaactatcaactcagttgttctcaaaagcgataccggaaagcctcatgctccctctctatttatacatgaggtaggcagcctaaagccacgaatcaaactcatattagaagtcctaaaccacctaggaaaccttctcgcacaagaaacaaactttacaaactccaatcataccaaatttggactccttccaaattcgactccgcatcccatacgcacacaatacctccatcgtatgccatatggaatcttcaccaaccacgtgcattgaactctagcctaagtatcccgcatgatatctgatcgtcaaggacatcgccttatccccaagtcgactcccgatctatcaccggcaatactctcctgaggcatcaagtcacctacacatgaagcaaacaaaaaaaccatattccgagaccaagctatctccaacttgactcattattagcaaacaacagtattacatacgtatagtatccatctagaagccataaatatgaaacaatcacagatatccaaacaaacaacccgaaaccgaaaccgacacagagtcggccggtcagaccgcgggcttgccgccagtctgatcggcagcacatgcctggtctgaccggaccacatcacaacagttcctgtagaccaccagtaaaattccaatcatctccgtaaccacttcacaaataaattccaaatatcaaaaccaataatctcatatgccaattgttcatcacaaaataaggaatcaaaaacactttgattttacaaaaaatagatatattttattttggttccttaaaaagttatgcattattccatgcgtctcggtgtacagaattgaaatctaccgtgttcatgtgcatgcatggtcgtgtttcttccaaggcgaaacacatttaaaaagctgtaaattaatattcggaaacagttgcgctcgaggttactcatgtgttaattggtctctcgtgaaaagatggtaaaaagtagtctagtgtccaaagttttgtggtcatcgatcagacgtagtgaaagtacggcatgcaggttacgcttacaagaactgatcataagatattgcatataaaattcagtttgagcgcgagcatgatgtgggtcattcatttgacttgacatttgtaatatattgaaagtaaactataaacgcacgatcaattataaatcttgttgtctaaaaatatgttgtaaaggacaaaggccaattaaagaaatgcatcaatcaattcgcgggcatttttttttgttaattattagagggtgttgcacatctctcatgtatacatgtacacatgtcaaacagatgaattaatgaatgaatcgtgtattgtctccatgagcatatacatatgggtatagctacctagataagctaaattaatgttggaatatatttatagtcgtgatcaatataattcgtaaaccaaattaattaggtaaaaagtgtcaactgaaactgctacaaagttatgtatagattttaccaaaggcaagccctcactactaattatattgtgtcatgaaaacagtttattacaaaattaatctattggcagaattttatacaccatgtgtaattattaatttggcaagattttgataagacctttaaaattaaaatacgccctataactataattatcaaaattcaaatcggagtaacaaataccaaaggcagctggctacctgttgggcgtatgtaactctttgtgaccgcagtgtttggagcaaattaaccattgaatttgttaacaaagactacggagaaccaattattgtagaagtagtgcaaaattaatccacctctcgttgtgcatctctcaagagctagccagacctaaccatggccgcagacgatcctatcgtggcatgcgctggtgtgggcccccacgaggggccgcattatggacgccctctaaccttgattagtagccctaaaccacaggtttaaccgcttaaccatggttaattagcaaaaggtcacgatgacacgctagccatcactatcgacatgcatcacatttccgcatcatagttcatcccgctcctcgtctcctctccgaagtctcctcttgtcaccagcacgcttgagctcccgtgaggctgacgcgtgggccctccctcgtgtgcgtgttctgttgggcccacatgtcagtgaggtgatctaggtctcctctgcttagctgtgcaagcatacactagaatttgttctcccttggcacctctccccttattttatgtgttgcacctcctacctctggttggaagaacatctcaagccctcccttttctctcctctttcccctgtgcatgtctctcttcttcttcttcttcttcttcttcttcttcttcttcttcatagcttgcctttctcccttctcctctcctctcccttctccaattcagatcaaacagcaatagctctctcttggtgttctctcctccatgcaagctctcttgtgcttctttttttaatttctctctctgtttgcttctctgtgcatccaaaaattttaaaaacaaggaggagtataaacaactcccccactttaaaaatcattgcttccttttccaacaccgccttttaaccctaaaaacaaaacaccacccctgttccaattcggtttttttcctctcttttttctccactttttttttagattttaaattttttttgctagagctagagaggcgctctgctgctgctacatcagtacatgagctagtggagaagcatggcaggtctcgacctcggcaccgccgcgacgcgctacgtccaccagctccaccacctccaccccgacctccagctgcagcacagctacgccaagcagcacgagccgtccgacgacgaccccaacggcagcggcggcggcggcaacagcaacggcgggccgtacggggaccatgacggcgggtcctcgtcgtcaggtcctgccaccgacggcgcggtcggcgggcccggcgacgtggtggcgcgccggccgcgggggcgcccgcctggctccaagaacaagccgaagccgccggtgatcatcacgcgggagagcgccaacacgctgcgcgcccacatcctggaggtcgggagcggctgcgacgtgttcgagtgcgtctccacgtacgcgcgccggcggcagcgcggcgtgtgcgtgctgagcggcagcggcgtggtcaccaacgtgacgctgcgtcagcagtcggcgcccgcgggcgccgtcgtgtcgctgcacgggaggttcgagatcctgtcgctctagggctccttcctccagcggccggctcccccaggcgccaccagcctcaccatcttcctcgccgggggccaggtacaggtcgtcgccggaaacgtcgtcggcgcgctatacgccgcgggcccggtcatcgtcatcgcggcgtccttcgccaacgtcgcctacgagcgcctcccactggaggaggaggaggcgccgccgccgcaggccggcctgcagatgcagcagcccggcggcggcgccgatgctggtggcatgggtggcgcgttcccgccggacccgtctgccgccggcctcccgttcttcaacctgccgctcaacaacatgcccggtggcggcggctcacagctccctcccggcgccgacggccatggctgggccggcgcacggccaccgttctgacatgcgcatacatgggtgtagctccggcgaaaggagaggagatgagaggagagatcacaagaagcaaaggaaaggacatcgcaagggttcatggccgcagcttgcaaaaggttagcgaacgcacgcatgaaccacgtattcagggttaccaccgatcgatctatatctactgctctatttctatctctatgtacaattatttcgtagtgtttgctcgatctctgattatgtgttttcgttattgttctttttttcccctttttcttttattgtttcttttgaaccttaatttgtggtgtaacctttcttaattgtcaatctggctttaataattaagtagcctttaaattgttcgaggatgcatgggcgttctatttgttttgctgttgatgttcaatttgttactggtatgtggatgagagattcgcctcaaactgataattataagaaaaaggttttatgtgttcgtgtggcgtaagctgtcaattcttactttatcatgcacatatagatgtgctggtgcgtgcttttggagttttagctaattgtttttgtgtgatacgaaggtgttagatgtctttgtgtgatgatatataacaatcagtgatgtatgtatattatagtatttgtagatagttcagctggggaaacataattatatgcatgtcatcagttcttctggttcaaaatttatgtggaagctaggggaatgcaacacgagttacaactccttgctcccacgtgtgcatacttgccttagtttaaagatcaaaagcaattagcaactgcatcctctcaaaacaggctagctagtgttcatggggaatcctcaccaactgtctgcctatcatcttaccactacttacagtgtgtgtcccctcatgttctttcttgtcctatatgcatagattgcaagatgctcgtaagagtaaatggaagaacagagaactagttcctaagttattgggacttgaaccttcaaagaattgagattcctaaagtttctattgacgacatgtgttctatttctatgggctctgtctttgcatcagcgctgctttcatgttttatcaatactgtgtttatggcttaactcaccgcgccgcttgatcgcgcaattaattcaatgtgctcagctttggaaaacattggaatttcttgcaacaaaatgttcaggtcttgcaaattgtaacctttttcatctgtaacaataattgagctttaaatactttcttgtatcaaaacctgtaaagcccctgaaaatacatcagaacggagccccggcctaaaaatacatcatctgctgttatgtattagtattaattttcatgggcttcagaggatgaaaaaaaaaatcacctccttgcttcaacctacaaactataagcccctgaaaaataagaaagttcagcaactatatatagaagaaggaaaaactgcagcctgctaatttcagttaccctgttcagctacaagttacatgaaaccgaactaagtagtctgtgtgttaggtcgtagagaccagcatgatttttagcttcactgactagttgtcaatggattcaattcagtatctatatgccgcacgcatgcgcatactgcagtatccatttaagtatatatttgattgcctacagtatccatttcagtaagttttttagatccaaagggcatgtgtttgttgtattgtagttccgttatctaaaaaaatgtgtttgttgctactctatgttacatgcatgaaccatacttttttaacaggatgaaaattatagagaactaaccacttagtacttgttttgacaaagttcaggttcatgtatttctttatattgtgtttgcctctttttcattattatacctcaaatagattcctaggtacatcatgctttgatgtcgaaatgtttcctagttacatatatatattaagtaattacaaaatgttgaattgagtgaatcatttagtattagcacatgtgcctgaattggagagggagacaaatgttttcttccaaaatatattgaaatcctgtaagatcactatgcatgcaagctgggttaagttgcagcgctacgctcacgtacgtacactgatagtagtaactagcttttcatgatttgaagatcttaacttgatctgaagaaataacatgaagtgtgtgtatatctattgattaattgattgtcagatcgtgtgaagagatcgatcttcaatttcgtgtgttcatgtatttgctgatctaatatatgcttccaactaaatgtcctgtgttcttcacacgaatgacacactttgattttatggtgacaaaatgataactatcgcttatattcagtaacattggttgcctgatagcatttctcgtagtctcagcattaaggcacatgaaaaactagcctgattcctgaaacaagatatgcagcccgggaatgtcaagctacatactgttcatatatgactatgagagctgttctctgtaacttagttcagaacttcagattcttgcctgtatacacaga

SEQ ID NO: 37064 - DNA, 1260 bp, Oryza sativa
cattggttgcctgatagcatttctcgtagtctcagcattaaggcacatgaaaaactagcctgattcctgaaacaagatatgcagcccgggaatgtcaagctacatactgttcatatatgactatgagagctgttctctgtaacttagttcagaacttcagattcttgcctgtatacacagatacggaattcccacagatacatataggacatgcagcgcaacctttcttttctgaactgaagcaaatttattctggatgtatgcgaagttttgttagtattaaatactatacctcgacgcacgttttccataaatattggatctatctgaaattactctacatcacagagcaggcttccgggttttcgttactgaggaactgattagagtgtgagcaatgcaagaaaaccgtgtccttgaatccatggagttcagggtgtgagtaatcgatgaagtgagggtgcgtgcaggggatgaagtagggagcaacgacctccttgaccttctccttcaccttgacctcctccttcttctcgccttccttcttcttctcagcttccttcttcttcacctcaaccttctcttccacaatgatctccttcttctcaaccttttcgatgaagccgtacttgcgcgttctatggtagatgtattcaaagagtttcttctcctcaatcaccccctcgacgacacacaagttcttcccaaggtcaatcttagccgcgtaaatgcctgaattatttattcattttgcatgcatatggttactacattagtatctgcagtttcattctgttggattgagataaaactgtccgaggtacagaaattaattacttttgtgctcaagtagaacctctttgaccctggctgcgcactctgcgcaatgcaagggaacccttacagtgatgatcttcagttcctgtattatatatccagaaaaccaaaatccaatttttcaggcaagtgaaactccaaaaataacttaatcaaggacatagattaattacctccttcttgctcttgacctcagtgactatgtccttgggaggaggcaccagctcaactctcctccggcatcccttctcgaccttcttcctgagcttctcggcgtcgaagccgatgcccttcactgtcacctttcctccatccaatttcacctctctgactcctgttcatgttattactacgcaattaatcagaatgtaaatcgtgcgcaggcgccaaattcagacggcaaaaaaaatttttttgcagcgg

SEQ ID NO: 37065 - DNA, 5269 bp, Oryza sativa
  unsure (1)..(5269): unsure at all n locations
nnnnnnnnnnnnnnnnnnnnnnnnnnnnnnnnnnnnnnnnnnnnnnnnnnnnnnnnnnnnnnnnnnctgcagtttcattctgttggattgagataaaactgtccgaggtacagaaattaattacttttgtgctcaagtagaacctctttgaccctggctgcgcactctgcgcaatgcaagggaacccttacagtgatgatcttcagttcctgtattatatatccagaaaaccaaaatccaatttttcaggcaagtgaaactccaaaaataacttaatcaaggacatagattaattacctccttcttgctcttgacctcagtgactatgtccttgggaggaggcaccagctcaactctcctccggcatcccttctcgaccttcttcctgagcttctcggcgtcgaagccgatgcccttcactgtcacctttcctccatccaatttcacctctctgactcctgttcatgttattactacgcaattaatcagaatgtaaatcgtgcgcaggcgccaaattcagacggcaaaaaaaatttttttgcagcggcctgcggggtactgaagcaggcacacacctgggaactgcgtgaactgtgtcacgatggtgttcgcgcactgcttgcagtggacgtgcaccttgtacacggccgtcaccagctgttcggctttggtttctcccattgctacgtcgttaccctcatttgtgctgttgctgcactgcagctgctgtggagttgggtgctggggctagctgtgatatgcatatgctcgttgcttgtgggcacggcttgagcgggacgctttcgatcaggatctgggatttgttggagatttgttggaggtggttcactagcttgatggatgagacaacagtgagaaaacgtattcggtttggggagctcactggtgcgctgtagttttgtgactttgtcaatccaaactgacgtggcttattaacctgtcaaacccaagccaatcgataccgatgtcacccgaagtggttgtgttgttcttattgaccaacgaacaccgggtcaacttgtagaaacagagagtaatgtgaattctcgtcgtgttgtcgtggttctcgtcgtcttcagatcgaaggagctggcgatttcccggtcaaccttttttttactgcttccaaaagagagaaatgtgaaatcaggaataagttcactggaggtcctccaacttaagagcgagattttttgacgtcccttaactgcaaaaacagaaatcttcaccctaaactatacaaaaccgtccaatttatatctcatagaagtatagatatctggtttcgctaacatagcatcctagtaaacaaaatataaaaaaatatgtgaagcccacgtatcagcccatcaacatctctctcttcttcccaggcagccggcgggaggggggttggcaacacgccggtggaagaggaggaccggcgagagaggcagccggccgcaccggcgagagaggggggaggagaggaggtggcaccggctatgtggtggtggcggcgaccactgcaaccatgacggcgaggaggtagcgtgggggtgtgacccgctgcaacgacgagattggggcggcgatgacaagacgccgactagggatggcgaggaggaggcagcgacttagcaccggttgtcggggggacgcgctggtgccctcggcggggcccaccccgggcggctccctctcgctatcctccatcgacaacgacgacaaaggccaccaccgtctgcatctccatcgacttcatccaggtattcccctccgtctccaccgaagccgtcgaggactaggccgcatcggtcgtccactaccaccctatcgccggccgcatcacgaatctggtcgtcgggaagcctgagatcgacagcaccggcggaggggtgtggttcatcgaggccaaggcgagctacactgcctgcgcggactctgtgcttaccgccgacggcaccgtcgagatggagggtgagcgcctccccttctctcctccaaccccctctccacttccccctcccctcgccccggctcgacctcaccagccacaacatcctcaactttcggctggtcgagccgccgccaccactctgccggcctactccactcctcctctagccacctccgctgtcgtggtagtggggtgctcccagatccggtcgaggcggcggcactgctggtcctcaaggaatgtccctaggactgcctcttcgccgttgggagcgggggcaaaggggacaggggaagcgacgacgcagggggtagaggaagcgatagcgagcgagcgcgtgtgcgtcagtgcggcgacggcggcggagctcggccaggctcgcctcgcccccatttgccatcggtggcagcctccctgggagaggatctgaagagaagaaaaaaagagaaaagagagaagaagagaagtggtccccacattttctatctcatttcacttaatgtgggatctatatatatatatatattaattttgctgactcgaatgccacgtcagcgaaactaggcatctgtactgtcatgggacctaaattggacggttttgtatagtttaggggtgaagacttctggttttttttttgttaagggacgttaaaaaatcttgctgttaagttgagggacctctgatgaacttattccgagatgtaaacgtagagcccaatcaaccggccgaactttcccacacggcccagtcagtcggtagatagccccataacagatgggcctcagaatctcccatgcttcggcctgcacgcacattgcccgatcggagcccaaggtcttctgtcggaaagtctcctgagaagcatggctcaacaccgagatgatacgcgcggcagggtcacatggcgacgcgccccgtccccgtccgtccgtccgtccccacgaagcaaccgtgctactgctaacctgacctgctgaccaacgcagcgtgagcccgtgaaccaactcacggtttcgctcccgcgcgcaccgtgcaccctcgtacccccgtactacacgcgagcgcgcgcggttgggtggtcgtctcgtcgtctgtcgctgttgctggacggacgcggacagggagcggcggggtgggttggttggttggatgactggatcgcggatcccggttgatttgccagcgtaattgcccgatttgccgagccgcgggccgcgggcatgcaagttttggacagataagtttggggaggaggggccacatccctcccgcgaacccgtggtgtttatcgtcctttgagcatgccccaccaggtactcccagtactactctcgtgcacgatgtgatgggccccgggggcgcttttaacgtcctgtataaacgcacggtggctcggcggtgtccggcagatcctgatgggttacacctttttttttttgaaactaaatgggttacaccttttgcacgtacaactttatagctgacatctggaaagacatatgacacggaccatacgaacaacatggtgacaaggagcatgtcaatgtcgtccgatttgtgtctaacggctcggatcaaagaacctaccgtacaaaatctctcggctacaaataagtaaatccctcttagtctgtaaaatcttgggtcagctcagtgcaaaatttgatctgttcccaagaaaaatcttgggtcaagtcctttttgacattttttttctcagagacatgttgtctctttcacgtagaagttataatatttggcaaatttttctacttgacattgttaagcaatttttttcccaaaacaaggttgattatatcaattatgataactaacttataaccatgttctcacaataataagagaataagtgactggttattttaatatggttgcatggggtttgtgctaacgggtaacaaccatcaaacatgacaagaatagccgcattgttggaataagtctcctgtcgtttggcataaagtaagaaccaaaagataacttgaaactaaaaacttttatatctatgttctaagtcataagtcaatgctgcaaagtaaattatgataaaatatctctaaaagcaacttttttttaaaaaaatcaaattataaaattcaaatcttaacaacggcttataaatgggaggcttagtatgtcactcaaatattggtaaaaaaggtactccctccgttccaaaatataagaaattttagaggtggacacgattattaaaaaagtaggttgaagtgagtggcggagggttgtgattggatgagtaatggaggtaggtggaaaaagtgaatggtgaagggttgtgattggttgggaagagaatgttggtggaaaagttgttatattttgggacaaattctgagagctaaaagttgttatattttggggcggaggtaatcctccattttaatcctaaggaaggtacgtgatcaaattttaccatcaaagaaaactgtcgttattttaagtcctaatacttctgtggacgtaaatcgtagtggaacattagtagttgtcacgtcctttttcttacttgaattggaagatatcattcttgccgaagaaaaatgagaactgttttccccacgtaacagctatagattagcaagattgttttatcagctacctaatctaaacgaaaatagttaactccataccctgaaaactagggtttctatcctcctggcggcggcgacaaggagtctctcggcgatttacgttatcgactcggtttcttcccagatctcgagtagaattcaacgtgcttgcttatagcactacaggataaggaaggggaacacaacagccatggcgagcgaaggttcaacgtcggagaaacaggctgcgacgggcagcaaggtgcctgcggcggatcgggggaaggaaaaggaggaaatcgaagttatgctggaggggcttgacctaagggcagatgaggaggaggatgtggaattggaggaagatctagaggagcttgaagcagatgcaagatggctagccctagccacagttcatacgaagtgatcgtttagtcatggggctttctttgggagtatgcgctcagcatggaactacgcgaaagaagtagatttcagagcaataaaagacaatctgttctcgatccaattcaattgtttgggggattgggaacgagttatgaatgaaggtccatggacctttcgaggatgtccggtgctcctcgcagaatatgatggctggtctaagattgaatctnnnnnnnnnnnnnnnnnnnnnnnnnnnnnnnnnnnnnnnnnnnnnnnnnnnnnnnnn

SEQ ID NO: 37066 - DNA, 696 bp, Oryza sativa
gaagcaagcagttctttgattagtgtaatcggagcaaatgatcttcccaaaggcttctgtttcaaatttcgaattgtgtcctattgatcagcctcccgttccttggctgccatccgcaatccgcaaccaaacgcagtaatgtaaataaatgacgttaccgcctgcaaccaaactaatcatgtaatcggataaattggtatccgttacggctggaggcaataccattagcgtttacgttaccacatccgaaccaaacaccacctaaagagtaaacaaaaatgttctctagaattatccttttaagaggcaaatattggcatgagtacaatattgtcagcgttattggctgacctgatcgctaattcgctgtgtggtcagccgcctggtctactgatctggtgctgcggcatctcgcagcgttcacactgcacaggtggagttctgcatcttccctccgatcgcatgtgccagcaattccatgagagtccatgcggcccaaaacatcctcaagtggttcatagcgtaatcatgcgacacgtagcaggcgtttctaattttaccatttccaaaatttttaaatcacatgtgctaatttttcaccaggttgtaccctgtcggatggtttggaaattctataaatactttatacatctgtattactagaaacacatcaccctatataattaacacgtattt

SEQ ID NO: 37067 - DNA, 424 bp, Oryza sativa
taatacctaaataattaaaaaagtttcatgctcatttgaattgggtatatactcaatttcaacaatggtgcccgggcaccatggagcaccaaacaaatttaatatatatatatatatatccagacaataacaaatcaaagagaaataagatatcccaaaaaaaacatatgccatatgtttttctctgaaggtgtacgtattagcaggtttcgttgttatgtaatttattatagtagaacataaccgtctataaatcatatgtcgttaacttttaagagaataaggacagacgtcgtggatccatgcctggtattattattattattattattattattattattattattattattattattattattattattattattattattattattattattattattattattattattaatagaga

SEQ ID NO: 37068 - DNA, 573 bp, Oryza sativa
cctattctcgtcctgacgccgcggcgagccaggaggcagcgagttattttactcgatatctcgcgttttctcgtcactcagatctgatctgatctgacccctcacagtgaggtaacccctctcgcctcgccacctccccccctgttttctccatttctcctcccaatttttttctccgcatccgcagaaattctgtcccctcctcctcctcctccatttccgatgtattttattcgatttcgagatttgttttccggtgcatagagctcacgtacaaccgccgcgccgaacggtgcatgtgaactgttcggcgaaacgcgcaagtgaggagaggtcgcgaggagcggctgctgcggcggcggcggcggcttcgattcaggtgggggtgggtgccctagggtttcgctgccgggatggatggccgggagcagcagcagcagccgcgcgtgagctcgccgccgccggccggcggcggcgtgatgatgcctcatcacccctactgcgccgcgccggcgatgcccgccgggtcggcgaatgttatgcacggggtgccgctctcgttcaaccccatgg

SEQ ID NO: 37069 - DNA, 441 bp, Oryza sativa
aattggcagcgaatgcctctgctctgttccatctccagcagcttatctctgacgaagacgatgctttctctttttggtgttgtgcgcagataccgaggtccttctaccacgacgtgatccgggtgtcggagatacagaaagtgctggacatcaccggcgtgcagacgtacatcatcaacagcgcgcgcgtcgtgttccttaacgagcgcccccagccgaggcccggcaagggcgtcaccaacacctgcgaggtctgcgagcgcagcctgctcgacaccttacgcttttgcttcctcggctgcaaggtacgttacgtccccccgttgggcgaccccgacgaacacctggtgttgcatcgcattgtgctgacagatgccttcttggacgcgcagatcgttggcaccttcagtgactacccgcgaccgaaaggcacgccggcgg

SEQ ID NO: 37070 - DNA, 886 bp, Oryza sativa
  unsure (1)..(886): unsure at all n locations
ggtacagctgggcgccacggttccgcctcgccgtgctgctcctcctacgggacaagtttcccgagctggttggcgccatcgaggtggttgatcccaccgtggccccagtggagcgccgggccatgaaggagctgggctgcattgtcaccacatctcctgcgctatgcctggtggtagaagaaccaactctgatctttatgccatacgcggaccgtgtcttctttgagaatttgctcatcttgaactggagcccggacaagctcgggaagatcgtcgtgctcgggcacagtttcagcaccatggtgaagatgcttgagctcagcatttcaaagcaagagaagtgtggtgtcaatgaccagagggagaaggtgaagagggtactggcaattccgagctatgttcaggaattagagctttgtgcagagatatctggcttattcgataaccctctcttgggagatgagtatccttatgaattgaaccagtacgactacaataattcaccagagcagtgtacatgcatgcactgcgttgcgcgtatggaaagcggtgctttgatttgtgctcttcccagcaccttttcaattcatttctttcacctcgatgctgaaatcgatatggaatatttgataccaggttcttttgcagctcatttccttttttttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 37071 - DNA, 1109 bp, Oryza sativa
cgtatcagtgtgagcctgtggattgagattcgttgcttgcgttttgtgcttcgacttgcgacgtgttttggacgattgggttgattggagtagagtatatataggccatcgacgatgatgggatggatcatggatgagatcgagcggcggcgttgggtgttcgtgctaggtggcgcgcatgcgggggatgcgggaggaggggatctgcacgtcacggcatgaggtggcgcggagcttttgggcctcggtgggcgcgtggctgcgtggcgcaccgtcgagccgccatgtgcctagatgccggccgtacgtcgtccgtgctcgtgacctgacgggcatcgcattcccatggccaggtacgcaacgcatctactccctccgtctaaaaaaaaccttaacctaagcaaatatgtaacatgtctccccgcaaaaaaaaaaatgtaacatgtcgtagtacaatgaatctggataactctttattcagattcgttgtactagaaaatatcacatttccttttaaatttatttttttttctgaaacggaaggtgtggagggagtatgtgttcagcttttattttttcccttcctcttaatgacacgttggagtctcccggcctattatcgctagactcaaatggccggccctgcagcccatataaggattttgtagtgaaaggagtacatgcacatgggcctgatctagaatgttgaccggatcgattaacgatgcgtccggcctgtactttgatcatctcaaggacagtaccatcacattttcaagttcaactctcttttgttctcgagagaagttcagttgtctccaatgaaagtcaacgctttgctcctctctgaaggtttcgatacagaattttttgtttgaaaaggaggattttctgtattgattccaagtcaatggtactagttttgctcaactaaacaaaagtacaaaacacacgtacatgtcgaattcaaacatgttgctagtggatgaaaaacgccccagcttttacacagttcccgttttttttttcaaaacaaaaagttagacgaaagataaagatttttgtagcacgcttttcaaactgtttaaattaacagtacgtttcgtgta

SEQ ID NO: 37072 - DNA, 743 bp, Oryza sativa
  unsure (1)..(743): unsure at all n locations
nnnnnnnnnnnnnnnnnnnnnnnnnnnnnnnnnnnnnnnnnnnnnnnnnnnnnnncctggctaatcagttctcgacaagtatccccatccagggagccgatcgatcgagccgactgtgcagccgcgagccgacgctacggctcgcccccccacgtgcccggtcacgtgcggtcaagtgcgcggctgcccctaggcggtaactcggcgtggctgtcggccatggccgagcaacaccggagagagagaaaagagagagaagatgagagagacgagctcgctttcctcggaaaccacgctctgcctcgctacctccaaccccagcccatgcgtcccactgcacgtgggccccaccaccacagccccaaagcatggcgcaagaaccctaaccctaaggactccccaaaagttgttgcagtgagacaagagagaaggaaagacgaatactgcaggatatgctttgtagtatcagttcgttctgaatgaacagctgcaactattgtgctcgttttaattaatttcttctatatctggttagttaattaattaccttctgcgctagctagaaagtttcagtgacaagataaagttaaactgctttccagaaaatagttaatttacttgcgcacacgagcaaacatatactagtactagtagctaacacacacgtcgatcaatctgaagtctgaagatagttaaggcagttaataatgctgccatggatcgaacataaaatatgctgtcca

SEQ ID NO: 37073 - DNA, 555 bp, Oryza sativa
  unsure (1)..(555): unsure at all n locations
atattgaggaatttccaggtctctttcatgctatcccaataatgaatcattaattcctccatggggcatacgttcctcggccactttgtgccattaatgtgcatgccccctccatgtcattatcattgcttgaatcatagtaacattattactgttctagtttactctcgctgacacaactgcttcgctctagaatcgcgatgatgctaggtatgctaggttgatttgatctgtcgtctctgcacttcactgtcgctcacttgcttgcttttaattggtcggcgtgtagggcgaccaggcgtccattgtcggcggcgccattgatttcgtgaaggagctcgagcagctgctgcaatccctcgaggcgcaaaagcgcacgctgctgatgcagccgccgccgccaccgcagcagcagcgggagcccaagtgtgatgccgcggactccacgagcgcggccgatcaggaaacttcngcngcngccgccgccgcggcggcggctgatggaccgccgttcgcgcggttcttcacgtacccgcagtacgtgtggtgccacaa

SEQ ID NO: 37074 - DNA, 753 bp, Oryza sativa
  unsure (1)..(753): unsure at all n locations
nnnnnnnnnnnnnnnnnnnnnnnnnnnnnnnnnnnnnnnnnnnnnnnnnnnnnnntgcgcaagtaaattaactattttctggaaagcagtttaactttatcttgtcactgaaactttctagctagcgcagaaggtaattaattaactaaacagatatagaagaaattaattaaaacgagcacaatagttgcagctgttcattcagaacgaactgatactacaaagcatatcctgcagtattcgtctttccttctctcttgtctcactgcaacaacttttggggagtccttagggttagggttcttgcgccatgctttggggctgtggtggtggggcccacgtgcagtgggacgcatgggctggggttggaggtagcgaggcagagcgtggtttccgaggaaagcgagctcgtctctctcatcttctctctcttttctctctctccggtgttgctcggccatggccgacagccacgccgagttaccgcctaggggcagccgcgcacttgaccgcacgtgaccgggcacgtgggggggcgagccgtagcgtcggctcgcggctgcacagtcggctcgatcgatcggctccctggatggggatacttgtcgagaactgattagccaggcacaacttgccgtttttaagtttgggatcgagaggtacgtattgctagtagcatacaagtactgaaatactaccagccagcgcttcaccatacattagccaaaaattatcactatttacttctcattg

SEQ ID NO: 37075 - DNA, 721 bp, Oryza sativa
  unsure (1)..(721): unsure at all n locations
nnnnnnnnnnnnnnnnnnnnnnnnnnnnnnnnnnnnnnnnnnnnnnnnnnnnnttgggataagtttttccaggggtctatttgcgaaataagttttttaaaaggaccaaaatgtaaatcatatccatcctgtacccacactcgatgagacggcgcggctgcctggtgcgcgcgagatccctgagcgacacgaacacgtgccgccccacgccttcctccacctcgtccccctccgagtagtagtagcagtactcgggccccggcacgcacgggtgctcgagaggcaaacccagcagcaaatcctcggccatcttggtcgccgtcgcggagcgccgcggcaggaagggcagtatcgcggtgtggaagccgtcggtgtgctcgacgcacgggaggctgcactcccggcacagcaccctcctgcagcagctacccgcgtacacgcagcccatgcccctgcagccgtcgccggccgactcgcatgtgcggaatacgcaggaagcagccgcaggctgctcgccgacggtgatcttcacgtgttgcggctggtagtagcagggccatccgccgtcgtcgtcgcgaagagtcggggcgacgtaatctggcggttcgtcgttctggatgggcaccaagctattcccgtacagcatggggaatgccatcttgcactggggaagctttaacttgtccagcgagtccaggtgtcgatgcttctcgtctcgaga

SEQ ID NO: 37076 - DNA, 595 bp, Oryza sativa
gtgcgttctgcgcctcgagggattgcagcagctgctcgagctccttcacgaaatcaatggcgccgccgacaatggacgcctggtcgccatacacgccgaccaattaaaagcaagcaagtgagcgacagtaaagtgcagagacgacagatcaaatcaacctagcatacctagcatcatcgcgattctagagcgaagcagttgtgtcagcgagagtaaactagaacagtaataatgttactatgattcaagcaatgataatgacatggagggggcatgcacattaatggcacaaagtggccgaggaacgtatgccccatggaggaattaatgattcattattgggatagcatgaaagagacctggaaattcctcaatattcagttgacgagaaagagcaaaaaaaaaagtgcttaaacatcacaaaagttgaacgaatctttcttaaaaaaaaagttggatgggtacataatggtacgatttttatactagagaaaaatcacagtgcttctcgccgaaacattctcttgccaactccagttcagcacaacccaaaatccaatgtccaaatgagaatcaagctagggagatgaaccct

SEQ ID NO: 37077 - DNA, 527 bp, Oryza sativa
ccctacaccaaaacgcatcagtagtggaatggttttgcagggtgaaacacagcgaagaaaaacgacaatatccaataacatgtcattccaatcttaattaagattcgtacacgccgaatactagcgagaaaagaaaaaggtgtacaaacattcataagaaaaccgtacaactaggctgacaactgacaaagcatgctaaataagctaccgattgagaaaaataaaaattagctacctgacaggccaagccatgcgctggggctacttatttgttcctgatctcttttgttcaggcattgtgatactgattactactagcgcaccggattattggccaacgctgccggtggtgtcggtgcaggaaacactgaatccctgatccctacactctactgggtcaacagctaacagagcttaaaaacacaggattatctagtcggtcatcatcttcaggtcgggatcgtaacggccttgatttccagatagcgaccagctaacaggagcatacgaagaatgcatgggatgac

SEQ ID NO: 37078 - DNA, 506 bp, Oryza sativa
  unsure (1)..(506): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgataatgtcagaaacaaccatgcttacatgcaagggaaaggcggaagaacccttaagcgtattgtcagggactttgcagaaagccatcggaatgcccccatgccctgcccttcataacgtgtttgatgaaactcctcatgcgggaaatggaactgccgcgattaatagtgttgattttggagctgtcaatgatcccggagagctcactgaaaaaaaaaggatctaaagagagaccgtgtggagcttctgtnnnnnnnnnnnnnnnnnnnnnnnnnnnnnnnnnnnnnnn

SEQ ID NO: 37079 - DNA, 658 bp, Oryza sativa
  unsure (1)..(658): unsure at all n locations
nnnnnnnnnnnnnnnnnnnnnnnnnnnnnnnnnnnnnnnnnnnnnnnnnnnnnnnnncaatttgcaaccattttccactttgcggcgaaaaatagcatttaggttgtgtttagttccacactaaaattgaaagtttgaagaaattgaaatgatgtgacggagaagttggaaatttgtgtgtgtagggaagttagatgtgacggaaaagttgtaagtttaaaaaaaaagtttgaatctaaacagggcgttagccgcatttgtgctctatcaatccgatatccagtgcatgtgtattatcatattctaatcgatagactagcgcgaagttttcatacgctaaatcaaaacagtaaacaaactcacgagggagttgagcttctccacagcagcggcggcctcctccgccgttgccatcgtgacgaacgcgaaccccttcttcttcccatccttccccttgatcaccttcacccaaaaaaaaaaaaaagccacgcgtgtctcagaacaccatagcccagaactcaagctacgcctccataagcatggcaactgggccgtaccggttactcacctcgacgtccttgacggcgccgcactgcgcgaagagcttctcgatctccggcgcggtgaaggaccaggggatgttggccacgtacagctt

SEQ ID NO: 37080 - DNA, 513 bp, Oryza sativa
ccatcacatcaactgttgtttcagcaaattttgtacctgatatctctttccagggaaagacaatcagattgtaaacttcagctctgtttcagacggcccaaatatatattttttcctgtcattgccacaaatggtaacattacaaagtcgttttcactattcatccgtatataatactctatcgcatgcgtgtacatcgaagtcagaagtaacaaaagaaaaggaaaaaacatgaaaatgatggtctattccaagtgttccacggcattgccgacaccgaattggggatcactcaatcctctgatggtacacattaaggacatagctgttcagaaggtcaccaaatgtcttggttgagaacttctgcacaacatggccccttgcttgtttacccatcttaactgctagatcgtgatcgttcacgagcttcagcatggcttttgaaaattcaaaagcagagggctcacagagaaaccctgtctcgtcatttatgactgtttccactggcccacc

SEQ ID NO: 37081 - DNA, 381 bp, Oryza sativa
tatatatatatatatatatatatatatatatatatatatatatatatatatatatatatatatatatatatattgatgtgcaattcttttacgcgttaaaataatgtaggatcgaaacacaagaactaagccaaccagaggggagggtgaatggttggtatacccaaaaacccaaactttttgcggaattaaaagttacccttaaattcgacggatcgcggtctgaccaaaggtgttgcgccgatctgaccgcctggaagtcgtcggtccgaagtagaatgtccagtcgaaccaccaagatcagcagattcctcttgtagccaccgccggtctgaccgcagatatgacaccggtctgatcgccggtgtgtcgccggttaga

SEQ ID NO: 37082 - DNA, 1027 bp, Oryza sativa
  unsure (1)..(1027): unsure at all n locations
nnnnnnnnnnnnnnnnnnnnnnnnnnnnnnnnnnnnnnatcgaagccttttggacggatgtagtagaagccggatatttaattaatgtttcttaggctgagcttatagcggctggcggttcggaaaaaggacgaataattcgtgcataattaatttatatctgtatctatatttatatttaatagaaaatagtataaggcttttcatttatcgtagtccattcatttttttcatcgcctttttttttatcaataatcctttacacacatggaagggttcttaatttttggtgcgcacacggtaaggcattcggtttttgattgtctggtcttttttctgttgccgtttttttatctcgtccgatcctatatccacggcacttgcgtgcagcgcacctccagccatcgccgggccgagccctagtatatcgttgttgcttcaatctatctctcgtgtgtttcatcctccaattaattaaaaaatcgaattcccgctccttatcatttttctcatgatgtcctctattaattcggccccaaatttaatctccatttaaccttcgccaatgatggctggccggggagcttccccaaccattgttgtcttgagttttgcagattcgcttcaattttgaaaaaaaaaagaaaagaggatatcgtgtgatcaaaatccctcaactaattttgggagatcgagaaagattcaaccgaatttgatgtgggatcagctcgggtttcatacgggcacgggtctatcttccatgggttgaatacggtagttggttgtgcgagctgggaatgcggttccactcgtgtgctggcccgaagatatgcagaccgagtggagggaggtagtggactgggttggggctgaaaaggaaagaatgaatgggttttcgctcaaaaccaaggaagaatatttagtaactttttcaattataatgtatatcgatactatatttcaatttgcccaactcctaatagctgctgtatcactgaaaaaacatctttacctattgcaacgcacg

SEQ ID NO: 37083 - DNA, 1479 bp, Oryza sativa
atgttgatctagagcttaaataatgaaagattttaataaagctccatgtcaactttgtattagagtaactggaaagtagatcagtgtaggttcttggtcagtgctagatacatcaaaaataaattggctagtagatgagaggataacaaaagtgtccagcttgggctatagatagcaaaagtaggctgtcttgattggagaagttatcaggtagaacgcttctttttgccctttgtctgaatgaagccatagtcagtgctttcttcttcatcattttcctaaaaaagaaaaacagaatccttatcaaagtatattactaaggaaccagcaattctttctcatgcaatacttagcacaatgcaggcagtaggtttggcaagtatgagacccctagtgtcagccatatatgtgaatagtacatgtaaatagagaatagttgttgaccacagggtatacacttgcttgaatatttcattccattatctaaaaaaatacacttgattgaaatggtgccaagcttgtgcacagtacagttagtaggttaattgtatgattgaagaatgaaaaacaaatgaatttaaatatgatcagttgtttacctgatctgtactgtttggatcttcataagctctttttcctgacaaagtgcttgtttctaaattatatggttcaacttccatgctttgaatatcttggggtggttctatctgggatgatgagcagtaaataagaaagaaaagaaaggaaatagtaagagattatgtagcaccgacaaaaatgaataaaagaaagagtactactcttttacctcatgttgtattttcttggatagtataggcaccagtggaggtaaattatgtagttgttgagatgaacttgaactgatgggaagattcttagttgccttaaagccttggctggaatgttgccttccaaatctttctttaattgtcagcacctcaaatgaaggttcatcagcgttgatagttatgttcggcaaaaccttcactatgaatgtgaatttatgtcctatccatgcttttatttctggaggtgtttgattgatatcatattgccttttcatagtttcagcagtcctaccaataagttctgtacctttcttttcaaatagcacaagttcaaggctagctgtgccatcatttgcaatgaatggtattttgtacctgttcaagtgcagagttatttgaaaattatagttatatatattcacacttaatagtatgattggaaaaagaaatactcacttgtactcatactgcctacatgggcagttctctttcttgcattttaatatagaaccatcccatatcatcttgcaattgcacaatttacaggcttgataacaccaagtttttctttcctgaattccaatgatagtagcagtgcactggtatttttcatcctatgtaaatgtataaatgaaaggtttaagttgtagttcaatgaaagaatttaata

SEQ ID NO: 37084 - DNA, 1077 bp, Oryza sativa
gttgcttaccatgcactttgcattgcagagctctatttcacccacttcacgtctttgatgcttgttaggctgtaaaactggtttagcttacatatcaacggcatttaatagtactagatagaaggatcatgtcttaacagtactggttaatagtactggtttagctttgtaatcctaaataaatgttctgatattcaaaatttcaaaagttaacttcagatttgcatcaagatactattgtttacgttgtttaggatcaacatcagaaggagagtagaaaagtcgttttgaaggcacaggcagatttggtattcaagcagaagaattacgccgctgcagcaaaaatatatgatctggtaatttcttgcaccttatttctgattgttaacgctaatcaattattgttgttataaagtttttgtatgttattcttaagcttgggaatgatttgtttatctgatgcttgagcataggcaatagctcatggaccgactgcagttttgtacgcaaacaggagcatctgtagattgctcatgggtgatggtgaaggtgctctttctgatgcttacagatgccgaatgatgcggcctaactgggcaaaagcttgctaccgtcagggtgcagctcacatgctactcaaggtaagactcactgcagttaacgttttgtgatcctggtattatggtcggtgtcctgaactcctgatttactctaaaaccaggagtacaaacatgcgtgtgatgctctcatggatgcacaaaaattagattctgggaatgtcgagattgagagggaactaaggtaatcttctgtttcgctcgagtatgccttccaaataaaaatgtggttgcgcagggaacatgaccattagtactggcattccgttgtgattatgcccacatttactgcaactgaagcaactcaacactcaactgttcttttcggttttatatgccattcttccatctttgggtcaattttacgctttgggttgttataactgacatttttttggtccaaatcttttgtaggaaagctagggaattaatggcgaaacctccagatgagcagtgaggc

SEQ ID NO: 37085 - DNA, 1241 bp, Oryza sativa
tttttccacgtttaatactatatgtatgtgtctaaacatttgatgtgatagatgaaaaagtttttgttttgggaactaaacagggcccaagtcgtgtgcagtgcaccggtccgcttccgtgcgtgtgtgagatgggcgttccagatcagctccaagtttgcttgaaagcgtcgcttctcgttgcgttgccacttgccaagcagcagcacgtgaattcgttgctgttatcttatctatcctggaaagcgacatcgccccctgtggcttggagttgcacgtattccattccatctctctctcacacacacggatcgacgatccacgatccactgtaccaaccgcggcatatgcttaccttaccggctcctacccccaccagcatataccacggttctaccgtagttgtacggttcagacagcgtgtgatcggcccacccacatgcatgaaccagaagcattcaatcaatcaaacaaacaaacaaacaagatcttccgcgcaggtgcaccagttttggctccaaacggggacgacgacgcgacccacttgagcctcgccctccagcccatcgatcgatccccctttagctgagcgaattattccacaagttccacgacgacgacgacacggccgggcgaggcaggcgtacatatgaacagcgcgacgcggccggaaacggtcgcgtacgtggaaacggccggtgcgtgccgatcgatccgtgagccaccttccaggcgcgcgggagcagaagtgtactatgccattggcagcgacggcgagcgaagaccgcgagcgagctagtggacacgggaggttgctctcgcggcgcgcgggaggggaggagaggagagggagaccggtggcgcgggtgcgctggaccggttcacgccccgcgtgcgcgccggggaccgaaatatctgtccgcgtcgtcgatggccggtgtcgccgtcgagcgagctacggaccaaaacgccgggatctcgaaggggcgcggcgctgcttacttggttgcttgattagttaagtttatccgccctccgttttacgcttttctgtttcccccggttatttaagccagactcaagtttctcgaaatagaatttaaggaagggtgtgtttcacgtcaaaattgaaagtttggttgaaattgaaacgattcgacagaaaagttgaaagtttgagtgtgtagaaaagttttgatgtaatggaatactttggatctaaactcggccatgggatgcat

SEQ ID NO: 37086 - DNA, 602 bp, Oryza sativa
  unsure (1)..(602): unsure at all n locations
gggaagaggttcggcgtgctgacggaggagaaggcgcggcagctgcgcgcacggatgatggagacggagagcttccacgnctgcatgtaccactccgccatggcctccngcntngcntcgcccgcccccccccgacgacggcaagcactgagccgccgccgccatccatggctccccgcctctgcccataccgcgccgccatccaacgccgatgatgatgatgatgttgttgtgtcgttttggtatcaataacgtcgccgccgccgacgccgtcaatggccggagaagtattagtatgaggcctcgacggcggcgtgcttgtcggattgattccatggagatgggatgatttcatcctaatatctccatttctgtaactcatagtatagcagctaatgcatctaaacgttgttgtaacaagaaatttaatctggtttcttcaaccatggcttcttctgtactatacatcacaatcactctgaaattttcagaaatttcagtgttcattttttatctctgaaagtttcgagaattcaatgtttttttattcctttttcttctccaagatatgtgcagcatctaagatcgaagaacttgatcat

SEQ ID NO: 37087 - DNA, 1403 bp, Oryza sativa
tcactacaaattcaaaattaacatttctaacaaacactagcattccagtttcttgtgtgatttgcatcagctcaaaagatttgtagtagctaaagaattcattaaaatgaaatgaaattaataatggcagcactgcaagcaatactaacttacaaagtgcatatgctttttgcaagaatttgaaatggtaagccaaaaaaaacaagagttaaggtttattagacaatattattgtaggacattaagattgttatttacatcaagatctctaaaatcaatgtaggacatcagtaaagggaaaaaaaactcctagctagcagcacacacaatgcttcatctgcttcacgaatgtgcttacctacatatttaacttctagaactcataattgtatggaactcttaagccacaaggagaaagacggaagctacaatcagtataaaatttgcaaatatttggaatgttcattgattcttatggataagattaaatatgacctaataattgataagctcacgaatttttttccttaataggaacataaactgtagcataactgccaaagatgtgtttttaaaatattttgaagtatccgatagttcttaaaagaagtaagttctcgctggttcatgaggaatggatgtactcataaggagtggctgtggaacaagacacgtacatgaaaaaggatagaaaacgccatacatcatattatgtatttatatgtacaaagggcttatacatatgatacaacgatatgcacatactctatcaagtacatgatggcagaggcgggcattctagaatacagctgctaactagtgttgagctaacaagagggaaaccagtaaaaaaaaaaacagaacagtagcataaaaagaagaaagctgacagcaactgcaactatatgacttactacttacatctatacatgatggacctgactacaaagccacaaagaaaaaagaaactgatagctctgcacagatagttgagaagagcacaaaaggctagaaccttcttggtttagatggctctgaaagtaccggcttcctaaaaattccacagaagatgcatccgggaaccttgggtgaaggaggatcctgtgctgggggcacacggcgagtatggaacgcctggctgttgttgcacctggtgtgccctgcaccatcgccatgcctacgctgcagcccaatcaacccaacactacgggagtgtctcagctctaaggctccatcttcttgatctctctcgctatgaccatctaacataagcctctcatcccagaccaagccagatgaaccggaccttctaaatgtctgcgaagatctttgtagcgcggccatgttcctcacggtggttctctatctaggaatgttctatggtatgcaatgaggactaaggg

SEQ ID NO: 37088 - DNA, 2301 bp, Oryza sativa
cccaaaccctagcacgcaacaagccaaaacgagcggccttcttctctcctcgctttccacacgaatcccatcccagaagagggaagaggaagccaaagcctctcctagatgctaccacatggttccagttccaaatcccaccaccccgccgacggcgacatccactacgccaccgacgacgacgatcccgagttccccctcggcaccacgaccacgcagccgcaggagcaaccagtggccgggccattttgcggcggcagagcaccatgggtgcgcgcggatccgtgtggcgggcatggggttcgcatcgcacgcgtaccttggcgggaagcggccgcgcatgacggtccagccggagacgcgcccctccctctccgtccgtctccccgctccgccgcggcgaggaagaagagatgggtgtcgcggcgtggccgtggccgtgtgggagaggaagcggcgacgaaacgaggctgaaaaataatttgcaaataaaattttgatatagtacgtgtttttaacaatcttaaagtaaatggtgaaaaataaatttcgctgaaaaaaaacctaaaatcaaatttggttgaaaataaataatttagctgataagtataagtaaaaagatgatgaagctggataactgttttgcttttagagttcttttagccgtttgtttggtttaaattttaaaaacaaaccctctaaaacttggttttcaaaactaaacctttctaatcgtcgtgctactgtggttctgcggcaactaaaattccaaacacatgtttaattttcacctctccagctctccttgtatgaatttgctgtttcgtcaggtaaaaactcgaaatgcagtgcacaaggtagtctcaaatctgtgaatggatctatctctataagatcatccacggcaattccagaccatctcataaacggctgaagcaatgcatatccaggtgcatgggccgcaagaacatatcgcagaagcaaaccacgcaaaaagatgtgattctcaatgaacattattgagaaatgtcaaaactttctcaagtctggaacccaactgctgtggcataataaaagaagtgttcagctgtggtttatttgatcattgccatggcgccattgcagcaagcatgtcagcattctaacgtcttgaagacgcactcagaacttgtataccatctctgcagtgtatcctaactctttcagaatgccggtgagctgcagagtaaccaaattgatgatcagtaaaacattaacatggccaagcaaaagagggcaataaagtgataaaacgaatgtcatgttgtagtggttaatgcaaatctaggaactaggatacaactgggatatttagatcactggaatgctccctggctagctttgacaggtctgttagctggaacttggcaagcgaaaattgtcgcttttagctaggaattatcttagtatgttcatccagatatcattctactgttttcatccaattaagaaggataagaaatatggcactaactacaatcacaaaaggtagatagtgacttcacattacctcgccctgcgatctatcctttgccttgtcaccggatatatgattcatcatacctggaggaccacaaacctgaccaagcaaaaaccattgaatgactgatgctttcttacattccaacattaataatcatgtttatgctacacatgaatgaagataatgttgatggagattataagcgagctttaaaattgtacaaactcttgtcaaaagcttaaagaatatcagcagaactataagcagaaatgacaaagactactcacaaggatcagagaatcctcccctggccgtggcaaacctttcaaggcaatgtccttggatatgtagccaacaccacccctccaatcatttgatggtttgtccaccgtgtagaatacctagagaaaaattaccagggcgtgttacactaacaaaaaaatcccatgtaatcagatcaaaatgaattaaaccctgtagtaataccaaccttgaaattaggatagctactggcaagtctatctaattcccttttcagcaagatatcatctggtgacacattggcataaattaaggaaacctagaaataccaagaaccataaatcagattagaacaaaacattagtcaaacattatatagctaataatgttatttctggtagcagtatgaaagtggatacattgatctgttctgtcatgtcagcatgcataacaaagttacgtggtatagcaatatcgttcacataaaatgatagttgctcaaagggataggctgcagg

SEQ ID NO: 37089 - DNA, 870 bp, Oryza sativa
aaaaattgtgatggcaacagacctgagtgttgtcatcagggttttttaggatagccctgacaacctgcagcattggtgttatgccagtcccaccagcgatctgaaagcatatacatacattttgttaaaattttttaaaaaaaaagaccagcttgataacttcagaatttttctagctttgggcttgctaaattgaattggcaaacatagacacttggctaaggttgaagtcatgtcttaccatgccaatttgtttcttcatatttgggctatatctgagcttttcaatgggcctggaaaaaaaaaagagaaagacatcaattacagatagccaataacatgcatagaaaactcaacggattttcatttcacattaccctttgacctcaacaacatctcctggtttcagacttgcgaaatactgactcattttcccatcaggataaacctgcaacatacatatagcacaaaaataactctcctttcagtactaccttacactggactacaagaactgctgatctaaaagcaactagcatgttctgaacttcagacattaaactttgtgttaccttgattagcaggtcaaaatatcctttagaatctggatcagagataggtgtgtacctgcagaaaacatgttagattccaataaaaatctaatcgaacagtcgtactaacatatgttatgtatgcaataatggataactgtttttgtctctgcttacgggcgaatgacaaattttcttcctccctccacttcctctcctattggagccctgagatgaattaatggttttagagtctccaaggtaagaaataaatataaaaaatactagctcatactatcagaaaagtagatgcaaaatg

SEQ ID NO: 37090 - DNA, 13538 bp, Oryza sativa
  unsure (1)..(13538): unsure at all n locations
gggagagcgcgcgcgagagagagagagagagagagagagagagcgcccggggagagagggggccggggaagaggggaagatgggccgagcgagattcggcccatcgacctcgggggaggcaaaatagacttttgcggaggaatttgattggaaggatttggattcggaattgaactcgacgatagatcgggtattgagatcttgagatggcacggacactagacaacaagcaaagaaacaaatttcgcaattagggtttttaagagatgattttcccgctaggcgccatgacggaacgggcgctacagaccaacccccctaacaagaatctcgaccccgagattcagcacctaagggagcaggtccgggaactcggcgcggagaagatcttctcgctcccaggttgcctcgtcttcggaatgattgctccattggactttgtagaacttgatggtcttccttcgagtctgacgttctgcctcttcaagaaccttgatcggtctttccttgtaggtcagattcttttctagctcgatattacccaggggaacttgctcttctggaactcgaagacatttctttaactgggatacgtggaacacgttgtgcacgtctgcgagaccttcaggtagctcaagctgataagccacttcgccacgtctggcggttatgaggtaggggccgatgtagcggggtgctaacttgccggacatcccaaaccttctcataccacggaggggtgatacccgcaggtacacatgatctcctttttcgaactcaaggtcacgcctccgattgtcagcgtaattcttctgacggttctgtgctgtcttcaaacgttctcgtatcagcttaacttgttcttctgctgacttgagtatgtcaggaccgaataccagtgctttgcccacctcattccagcacaagggggtgcggcactttcttccgaacattgcctcattcggcgacatctgaatgctggcctgataactgttgttgtatgagaactcggcatacggcaaacaacgatcccaagtgccttcgaaatccaaggcatacgcacgtagcatgtcttctaggatttggtttaccctttcggtctgaccatcggtctgcggatggtaggctgtactaaaattcagatcagttccgagggcttcatgcaactgcttccagaaccttgaggtgaactgagtgcctcggtctgacacaattttcttgggacagccaaatctacatacgacatgggtcatgtagagttctgctagtttctttccatcataggtggttttcactggcacgaaatgagctgatttcgtgagtcggtccacgattacccaaatggagtcgtacccgttgggggttcttggcaaaccggtgatgaaatccattccgatctcttcccatttccactcgggaatcggtaggggttgcagcagaccagctggcctctgatgttccgccttgactctttggcaaatgtcagacagggctacgtattctgcgacgtctcgcttcattccagcccaccagaagtatgccttgatatcttggtacatcttcgtacttcctgggtgaatggagtaggcggactcatgagcttcctttaggatgagatctcttaactccttcttggccggtacacagatgcgtggtccgcaccaaactgtgccttgatcgtctatggagaaatttgtgtctttcttctcctgtattctttttattaattcttttatcccttcgtcgtctttctgagcctcccggattcgcgactctagggtaggctgtactgtcaagctggcagggacacctgactgtaccacggtcagtcttaacttctccaattctccgcacaggtgatcttggtcaggccgtatttgagctacattgcaataggccttgcgacttagcgcatcagcgaccacgttggctttaccaggatgatagtggattccaagatcgtaatccttgattagttccaaccatcttctctgtctcatatttaactcggtctgagtgaagatatacttaagacttttgtgatcggtgtatacttcacatctgttcccgattaaatagtgcctccagatcttaagagcatgaaccacggctgccaactcgagatcatgggtgggataattggcttcatgaggcctgagctgcctggatgcataggccacaaccttttgttcttgcattaggacacatcctaagccttgtcttgatgcgtcacagaagatctcgaaatctttttggatatctagcaaggtgagaactggggcagtggtcaaccttttcttcaattcttggaagctgtcttcacaggctgcagaccattgaaatttcttttccttctttaacagctcggtcataggtctggctagcttagagaatccttcaatgaatcttcgataatatccagctaagccaaggaagctgcggatctctgacacgttcttgggcgggttccaagcaagtacagcttcaaccttgctgggatctacttcgacaccgttggaggaaatcacgtgtccaagaaatgctactctgtccaaccagaattcgcatttcgagaatttagcgaatagttgatgatctctgagcttttccattatcagcctcaggtgttcagcatgttcttcctcgttcttggagtatatcaggatgtcatcgatgaacaccacgacaaactggtctaggtattccatgaagattttgttcattaagttcatgaagaatgctggagcattggtgagtccgaaggacataactgtgaactcatatagaccataacgcgttgagaaagcggtcttcgggatatcttcagatctgattttcagttggtggtaacctgacctcaagtcaatttttgagaaaactcttgctcctttaagttgatcgaataaatcgtcaatccgtggcaacgggtacttgttctttatagttacttcattcagggctctatagtcgattaccattctctccgagccatcctttttcttaaccagaagcactggggctccccaaggggatgagctaggtcgcacataacctttactttccagttcttcgatttgtcttttaacttctgctaactcattagctgccattcggtagggtctttttgcaattggagctgtgcctggtgccagttctatggcgaactcgatctctcggtctggtggcattcttgttaattcttccggaaatacgtcgggatattcacagactatgggcaccgactccaaggaggtgacttgtaaacaggttaggatagaccgacttgcggtaggggtgttaggggtaaagcggacttgctttcctctaggtccttgcaaggtgatggacttttcggcacattctatctgtcctttgtgcttagccaaccaatccatccctagaatgatgtccaagctttgcgagtctaggactatcggtttggctaggaagtcaacttcctcaattctaaggttaacttccgggcatatttgagttgcccttatattccttccaggggaatgtactatcattggtacacgcaaattttgggttttccaaccatttcttttcacaaaagcttgcgatatgaaagaatgggaagctcccgaatcgaacagaactattgcgggtacggagttgacagagaacatacccatcacaacgtctggagcatcctgagcggtttcagcttgaatgtgattcacacggcctcgaccaaagttgttggaagcacgtgaaccttgtccacttgcctgagagctaggacgagactgagttgccgctggagtaggagttctggcagtgctgccattagcatgccctgagttggtgttggtaggattctgaggacactgtctagcatagtgacccatctggttgcaccggaaacactgaactgctgacggtccctacggtgacttgaaagaggtaacgctgttaggcgcagtattgccactaggggcacgctgctgtggctgaggtgccggacggtttatctgaggacgaggggcgtagcctggctggcggttagcctgagtgaccgactggtggtattgcatgggttgaccgtagcgagggcgaggtgcgcctcgggaagaatttccctgatggttagacttgcgtttcttgtattcttcggtagcctcttttctggcatcctcaagtagaagtgcgttgttgatcatatgttgaaaagtggggaagtcatgagcaagcaactggagtctcattccaactgcgattcctttcaagaatttcctgatcttcttcttgtctgtgtccacttcctcaggggcgtaccgagccaacttgttgaactgacttaggtactcattgatactgctgttgccttgcttaagtctgttgaattcttctttcttcatgtcaatagtgctttcaggcacatgagctgcacggaaagccgtagcgaactcatcccaagcaatgttagtgggttcagggtgtgcattgcagtaattctcccaccaatctgcggcaggtcctcttagttggtgagaggcgtagagcgtcttctcaacaggagtacactgcactaagttgagttttctatcaacatctttcaaccaatcgtcagcctcgacgggctcgacggtctgagagaactctggcggacgagacctcaaaaagtctgtcagcttggatctgttgttgcccatgtgagggtggccatttccatgcgcattatgctgaaaactggctatggctgtggttagtccttgcaagatttgtgtctgaactgccattaagtgttgcatgttggtttccacatgaggtggggaagggaggcgttcttctccagaattgtgactggcagtgcggtgagagcggtgagactgttccatctctgcatcacgggaaactgtgcgatgcgagcggctgctgcggcggggttgctcaacctctgcgttgcgggaaacagtacgatgcgaacggttgctgtggtgagactgctcattagctgattcatgattttcttctggctcaactctaccatcctcaacaccaaagcgggctggtgcacgagctgcacggcggggacggctagccatctaaactcccagaagagggcggggtaagagtcagataagcacttaggagggcaaggagcaaagcaaatagcaactcagatagcacacactaggcataaactggatttttcaaatcataaaaacacctgatacaacgggtgtggacaagtcacagagctacgccgagcttgactgtgcgcacaccacctaggagaatcagactaccaaacaacacccacaacaaacacacgcacgcactacctcgccacgactccaaaagagttggcggcggaacaaaagggcctatcacacggacggctgctgaagactgcctcctctactcctcgtcggcctggctgcctcctgtagttggctcctcagtcgaagaaacgtcgatcggctgacgcgaagggaccggcggaacctgtcgagggccggcagcagcacgggccgctggcggtgggggagctgggtagtggaaacggaacacggtggcagaaccaacaacacgcttccgcgcagtgcggataaagcgtgggccacggcgggaggaagcaactggggtgtgtcctggggtgtaggaagggctaactgggtgtgggtagggcgagtacactggtgagtacggcgcacgcgagctgggggagcgcgggccactgggagtgcgggcagagccgcgggagctgtgggaggacaggtggctggcgtggcagaggcggcctgagtcccaagagatagtgtcaactgaggtgacaccctcctcggccagacgggcctccaaagcggcgtagcggcgggcaagggagcggtaagcctcaaggagtaggtcgtgctgagtggcctgagcctccgaaagctcgaccatgcgagtcagcactggctgagactcgctgtacggacaagggtacctggcgtctgagtggccagagggaaggcgtggaagctgccggaaggcggaacctccgagacggtggctgtagtcgtgggccaggcgacgaagcgcagtccaggagaggtcctggtacgcgatctggagagtgggcctggccacagtgaagtggtgggggcgaaggccagctccgtgtatacctccacgggggtaaaggtacaccgagagctcacagtgagggggaacacggtccacggagtaccccgtgtactcgggacacgagaagccaaggaaacgggagaggtcacgaagctgagcgacgtggtgaccctcaccaaaaccgtgggaactgaagctggcgttcactgccatctacaattttgaaagagggagaaagatcagtaaccgttttagaaacaaactattgaaaataaagaaaacaaaagaaaccttagcttttcgcaagtagttttgaacttagtatccttagggtcgtcctaagcgtcgggtttcgccctagggccaagcctgtgctctgataccacctcttgtcacgccccgaactagtcccgaccggatctagcccgtgacgctccaaattaacctgttaatcgataccagtcccaggaaatagtgctggtatcacaaggagacagagtatcacagcaacagaggtctctttattatagagtagaagtacagtcatgttgggctgcggacagatcccgagctcacaactgcattacaaaaggaaagcggaagccagtacttggaccaatcatcacaggcgcgacttgggaactaggccgaaaccctaaaactcatcgtagccgacttgctcctggaagaactcctcgtcagcaggatccacttcatcttcttcagcaactaggggggattatttatatagagcaagggtgagtacgggagtactcagcaagccaggggaaataagtgtttaatgcaggcttcaaggaaaggctgttgttttcgtaattgattttgtttgaactcttttctaaaaagtctaagtgagtgcttctcaaacgacacggatgagacagtgcgtctcgtccggtcggagtatgtgcaatgtatcagtctttagatcttgaaacagggttggcacccggccaacagcttttcaaacggccacccgggccaacaacttttcaaacggccacccgggcctagctgatcccgtcagctgctgatttttcaaacatcgaacccagtttcacaacagcaatttcacaagcagtagtcaaacaaaactacgctaggaatcacctcacatccgcccatgaccgtgggcacggctgttcgagcagtttgttaacctctgtagagggggtacactttacccacacgacattactaacccggatcacccagcccgtggggatcagccacgtcgggagacctccaagctttcatgacaaggcatttcgaaagccgatacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcgagagcgggaaaccgtacacccggtacgttccccggtccgcggttttggaaattcatttagttcgcaagcaccgacccaggtgtcgggttttccaagtcttttgtaaaactccagttttacccaagttgttactcagattttaagtttgaaggcgaccgtcgatactcgcacagagtgcacgaatatcgaggtgcaactgggtggttacaaggggacatggtataacaattaacaaaggaaggatcaaatgcaacaaattaggtaggtctgccaacctgccttgcagacgggacaacagattaagtgtgatcctatcaatgcataatatttcgcaagcaatataattaaatttcaaatataggctcaagatgttcaaaggtggcttgccttgctcgagatccggagcttgatcctcgaaatcctcgcactgcgggtcttcgggctccgaaactacacgcgaaacgggacaactcaacaaacggcgaaaataaagccctattaatgacctctaagcgtgccattagatagatctcgagatttgaggaattttggaagttgaacggagtcaatcggatttacggttgggaagatattgaatttctaagattattggatttttggtctaaaggaaaaaggatttatttaaatcctttttggaaaagaaaaagaaaagaagggagggagggaatatagacttttctcggacggctagggcgcggcccaagagaaatggagcggtctggccgagctaaatgggccggccggcccaaggtggcccaaactcgcgcgcgcgcgggagggaggagagagagagccggtggaccaggctcaacacgcgcggtcccgggtgggacccgcttgtcagcggctcggctcaccgtgcggagggagcacgcgacgcacgcacgcgggcggggaagggacgcggtgcacgcgcgcggttcgcggtggacgcggatgcggcgggcccacgcgcagcctcacggctcgcggtggaacgcgcgcacggggagggactgaccggggtcggctcgacccggtctaggctgagctggcgccgacgtggcacctacgtggctgccacgcgggccggcgggaggtagacgacgacccggccgcgaatggacggcgggcggcggcggcgagcggcggagcgaaccacggcgatacgggcaacagcgagcacaccgggcggttgcacgtgacaagggggggcgagccaacggctcggattcgccggaggttgctcgacggcggcggattgcggcggcgacaaccggcggcgggagaagagggaaacggcgacgaggtcacgagaggtcgattcccggcggtgagagcatctacgcggcgtcgggaactcgacgctagcgtcggattggacggaactacgccgagcgaggccggcgacgagcgggtgctacggagctcgggcggcgacggcggcgagcacacggcgagcgacggcaacggtcggggcggcgccggctagctacggggaggctactcgtgctaccaccgaaaactaaggggggggagatggagcgaggaggaagaacggagagaggcactaccgtgcgggtcggggcgctgtgacgagaggccgacggcgcgggagtaatctctccggcctcgggccggggaagaggaaggagagggcgcggccggagtcctcttccgcgtccttgctcgtgccggctcctccgacacatgcaacgacgatcggcgacggcgaaacagagggcggcaatggcgcggaggcgaaaatgagggagtttggagggggagggcttgggcttaaatggacggcaatgtcggtttgggagaggggaaccgacattggacggttaaggcgcgagctggcgctcggcgcttgtagccaaagcggcggcaggaggatgacgccggcgaggaggaaaaaggggaaaaggagggggagaaaggggcttgcccctttgccgattcgggaaaaagagggggaggggaacgggagcatcgcggcagagggaggaggggcgcggctccgtcccttggcggcttgcgcgcggaggggcgggggccgggcgatgacgacggcgatgacggcggggcgatttggagcggagcggcgacactggcgacaggcgcgtgcagaggctgacggcggcggcgaccgggcggtcggccaccacggcacgcgcgcgcgggaagcaacgggcggcgtccgcgcgggcgcgcacacgctggctcgcgaggacgagcggctgcgcggctgcaggcgcggcagagcgaggggaaagggagggggcgctcggcgcggcggcttacgcgcacgcgcgcgcggcgtgcgggcgaggctgagcgggggaggagagatgggagagcgcgcgagagagagagagagagagagagagagagagagcgcccggggagagagggggccggggaagaggggaagatgggtcgagcgagattcggcccatcgacctcgggggaggcaaaatagacttttgcggaggaatttgattggaaggatttggattcggaattgaactcgatgatagatcggggattgagatcttgagatggcacggacactagacaacaagcaaagaaacaaatttcgcaattagggtttttaagagatgattttcccgctaggcgccacgacggaacgggcgctacaatacacctctccgtgggtggttgatcttgacggtggagatcaaccttattcctgcaagcaaatcgaagaaacaagtaagaacaagataaaagcaatttgaattacagataggaattgaatacaaatgataagttggggctccgtaacgagtaaaccggcaatctaaccgatcacgggattacacggcaaagtagcaaagctaaactttaatctaaacaaaacccaagaaaccctgaaggggtacctaactatttaaagaggtgggaggacgaccaaggggaccctagggtcgtgctccatctggttgggtcgcaccccacataggccccacttgggccggggtcccaaacgaagttacaagcccataggcccattacaggtgacgcaacaccttgtttcttcaattgcggatgattgggatggaatttgacgatgaggctggatccgttggaaagaggactccgagagctttctatcaagtactaggatgtgtcagatccctccgaaatcccgtatattatgggataaatggaatagtatctaagtcacatcttactactcacttggtgaatatatattgtgaatggcctaatgcggctatactggtgtcattgtgtatgtagatccctttctcctactaaggccattcacagtgctccgacatgctgttaggccaaccctcgacgcgtcagagatttgcggctagctaggtgtcgcgcgtgaccaaatgaggtccacggagtctagattgggcattcgttcttctgacaacccaaaggagcacggtgtgggggagaatggcgtggccgcgttgtggaggtcatggccttgccgcttcgagcctccgtgcgtgtgttcccctccccatccctcgagccggcggcagaagaaaaggaagacacaacggtggaggaagaggaggcggtagatcttgtgcctaccttgttgatatcccccctcccaccgtgccgccgctcgtcgtcgtgcctcgctctaagccgccgagcttgtcgtcatcctctgatgtgcgccgctgctcgttgtcgtcgtccactccaagcatggcagcctcctcgacccctccgtagcctcggtggcctccatgacccgtccagatcgaggcgccaccgaggagagtgtaaaggtcgtgccaccactcgttattgttgctctaaactacgggcaccggcgaggagaggggagaagggatttggcgccggcgaggagagtagagaagggagatccggcgagccccgggttggatttggccacgccactactctgcctggtgccgtcgctgcttgggtcatcgctccccgtcgcggcgcggtggactgaggagagcacaagcaacaagcaaggcaacaagcaaccaagaagtcacacatggagaaaatatgaggaaaagtcacaaaagcttgctgcaagcaaccaagaagtcacacccacgtggagaatatcaggtactaccgcacagtagcgtgctacatattaccaacctaaaaaaaatacatcaaaaaagtcaaaaacaatatgaaaaaaaattcgagatgtgaaacactatgacatttgccatcacacaaaacatcaactcaaaatacaatgtgcacaatgagaaaaagaaacaattttgttctccaatagtatttaaacaaatcagttttctattccactgagatttgtcattttttctatgtgtatatgttgtattttgagctgatttttttacatgtcataggtggtgtttggatacagggactgatcctgtcatatcagatgtttgaatactaatttaaaagattaaatataaactaataataaaactaattgcataaataagagctaattcgtgagataatttttttaagcctaattaattcataattagcacatgtttactgtggtatcacatggactaatcatggataaattatgctcaatatattcgtctcgcgaattagttcaggttatggattgtgttttttcattaatctacattttctacttctaatgaatcaaacatccgacggtaactaaaatttagtcctcccatcaaacagccttgcgcttgcacctctcaaaatttttctattctttttttttttgactttttcggtgtatttttcgataaggggactcatctctcaagtgcactgcttctcttcgtctcttcccccatctccggcgagccgtactggtccaactccggcggccaacgacccctcaactaccagctgccccaaaactggatccgtcactgagttagttaccaaggtatatctccccctcattcatatcggcggccggcgacggcgagggtgagaaactgaatctgtacaccctgttcttgcccagcggcggcggtgaagagaaggggcagatggacggagcagcagtgagcgtcgccactggggtgatgggatccctccttgccaagctctctgcattgctgggagaagaacgcgggcttctgaaaggtgtcaagggtgacatcaggttcttgagagatgagctgagcaccatgaacgtctttctgatgaatatggccagtgtggaggagaacatggatgtgcaggtgaaggactggaggaacaaggtccgggaactgagctatgatatcgaggattgcatcgatttattcatgcacaaattgaatcgcggggatgataaggtcaacattgttctcaagatggcaaagaagattagaatgttatggtcaaggcatcagattgctaaccagatccaagaacttaaggctcgtgtcaaggaagagagtgatcgccgtttgaggtactacttcagcgagtgcaatgcacatgtcgacgggactaaaattgatccccgcctaccggcgctttatgttgaagaagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 37091 - DNA, 722 bp, Oryza sativa
ggttgatattaaatcgagtagtgcagttgtgcaatcctaggatccaacaaaattccgtaacaccagaccccgcatagacccatgactccgcacgtatattttgtgaccgttggatctttcgatctaacgtcccatccctgacctccccactcggctctgcctatcacgcttctccctccctgattcctctcggaaaccgcatctcctccccgagtctccaggcaggcaggctcccagcaaccgcatgcgtcggcacttcatcgccaccgctctgccatcgccgcccaccctagcacccagccaacgtcgtcgccgcctaacgcgcccaatgtcgtcgcagccatcgtgcacgctataagagcaaggttaatagtatagccaactactagctctaattcatctatagctaatctaatagccaatttatacaatagttgtttactatactaatagtatatggtcccactgtcatacatacattgcatcttggagtccgtgctgcagctagctacagatctgtatcccgctgctcttctctctcatcttttatctcattaaaatatatttgtagctggctaatattctgctattgtacctgctctaattgtcgcctcccccgcttctgcttgcctcgccgccaacctcgcccgtcgcacctcttttctcctcaccttcacatacaatcgtgtgaagatttgtcttttagttaacattttgagggt

SEQ ID NO: 37092 - DNA, 1158 bp, Oryza sativa
acgctaactcatggttatttatgtgtattaggaattacacatgatttaaacacgatggaggagtcttacacgtacgactacacaaagaatacagtaatactccaatacataaaaatatatgatgtcaccatttcaccatagagctatacaacttacggaaacggaataaaactaaaatattttggccattagaagtagaacctcatctaaataaccataaataaattatatatttttttattacacacaacacgtatgtgcacacataccactcactcactcacctgccagtttgctccaaaacacacgttttgaagagataaaaaccgccgcatagcccaagccctactatacatatgataaaatttcttgctaatgttgcttctatgaaactagtgcatgcaacaaacatgagctccaatataatgttttaatggcccaatcgttaatcatgcaaggcaggatcataacaagattttatcaattttatcatacatatagttattttcagcatagccctgactctgaatacccgtaaatttttattaaaaacggactcacacatacataatatttatagatacagggaatctactgacccactattgtccccctttaataagtttcattttaaccgatcatctgttagagtacgacatcttttacattaatgtaaacgtctcaaaactaaattacacctttcgctataaaactaaatcacaacttactgtttctcatcaatacagcgtggcaaatgtgtcagcatctcaacaaaaagctcctgcaatttactcctccacaacttcttttcattttggcatcgtaggctcgttagtagcagctgttcgttgcgcttagcttgttggttggacgagaaacccacatcggccgtgcctgctgctgctgctggtggtggtgatggccgtgccttcggccgcgcggcgtacgtggcggtgccctgcagcagtggatgcctgggtggcagggggaagctgacgatgacgcaacgatcggtacacgtcaccatcaccccggccttaaaattaatttttaggtttggttatcacatcgaatatatacaagcacatatttaaagtattaaacgtaatataatataaaataaaatatatgttccgctaggaaactgctagacgaatt

SEQ ID NO: 37093 - DNA, 1009 bp, Oryza sativa
tttgctgttatgactgaaccccacgcatgacggcatgagaggagaggaagtgttggacacttgccgcggttacctgacgacaattttttagtgcttttatttttgaaagaacccagcaagctggttttattttagtgcttttatgcatgatgtttagctcagcaagtgaccaagtaatttgtatagtataaacttcctagaaattgtatgcagaaatgcaaatttgtctcctcgtcatgcagaagttcgaattacaaattacaaatgctaattatggtacaccaaatatgttgcaatgcagtaagcgcaaattaattacgtatactgcaaactttgcatacgtattagcaccaagcgtgcattttgtgatgattgcaagtttggtccgtggtttctctccatttgactcatctgggtagcttgacaccttaacctgagtttgtaaattttgtaacatgggggcttctaggatgtgtgtatgccaatatgtgtgtcttcaaaatactacgtatgtaatatatatgtaccatttctgaattgtaagtactgttgcagcttctggttagtattgagtggaattcagctgatggaactactaaagattccctttaagggtgtcgtcgctgatatcgaaggccgagcagcttggtacaagcatgattggcttgagggattccactctggcttcaggttaattttgtttcgaacaattaattttgcagtagatcactgtgtgtgttttcactcctcttgttgctgtcagtttcattccttaattattcatgttgcctctggatgtatcgtcaggatattggcacctactatgtatatattttttgcctctgccctcccagtcatagccttcggaacgcaactgagcagagaaacaagtaaatacctaccctcttgccactatgagccatactacagttgtgctctttttggaattgctgtccttaggctttaattacatctctaacaaagggaaagtggttcatttcagatggta

SEQ ID NO: 37094 - DNA, 2412 bp, Oryza sativa
tttcgggatgttgatcactgttctgttcctgcaacaagctattaaagtatgctatttctagcgagctcagtgctttgtatcttggaagaaaatatttagaacggtgcctacttattgcagggaattatagaagaattcaaggtacctggaggtgtcgaccatagttcacctatatatcgattccagtggttgtatgtcaacggcctacttggtgtaatcttttcaattgggctgttatacactgcattaaggtcaagaagggcaaggtcatgggtgtatggtcaaggttggtcacgttttcatcttacttttatctcattgtgtccaatttagggggcaagttgagctctgggtcatcaaattagcaatagctgttccattagtcatccatccaaccgttagatttatgccaaacatttcttttgctgttttgaagtttggactgggcctactttagatcaggcgttggttgggctgggctgcaagcttgtgttgtgtcagcctgtcagctttggggcaaaccatatggactccttttttttccttattgagtggatggcttggcttgagatggtgtttagtagcccatatcgacagattcttattctgcacagtgtttttccctctttgaaatttttaacatttagaaacaaaaacaagaaattactactatcttctctattaaatacgcaaagcttttgccatctttcaagtaaaaagagaagaaattactactatgtatgctacatcagcatgcaaatgactccatgatgacattttataaccattgagaagcacatgtacatgaactgatcattgtgcgtttgagttgacacttgcagggtggctcagaggcttcatttctgattatggtgtcccacttatggtgattgtttggacagcattatcgtacgcattaccaaaggatgttccttcaggagttcctaggaggctgttcagtccacttccctgggagtcaagttcactgcatcactggaccatagcaaaggtaataaatcaaacttgcttgggatactggagatgtgaatatttatggtcttcaggtttagaattttggtatagcttattttgcatggcatcattgataatatctttgggttttttttttatttccaggacctgttttctgttcccccagcatacatatttgctgccattctgccagctttgatgattgcaggactttacttctttgatcatagcgtggcttcacaattggcgcaacaaaaggagtttaacttgaagaagccctctgcttaccattatgacattttggtcctcggattcatggtgtgtgccatggttctatgataaatttatctgcttatacccgtctaaaaaaattatctgcttatggcggcccttcttaagtttttttttctcggctaactaggaacctaacatcttttggtcctcagtgaacatttcatttctctatcacttctagcctaaaactagccaaaatcttttagtatagtcttatgaatatgaaatatttccgttcaaaaaaaatgaataagaaatattctcatatattttaaagtagagttggtatttgttacaacaattgaatgggtatgattgaaaatccaacatccataatatcttatattcttttttgcgtgattataacctggcactactgcaatctacaaggtgatggttgataggagtattggacactgattctgctttgtggtgtaatagaccaaagctgtgacatgctcctcttctcatatagtagtataaaaatgatgcaggtcctgctttgtggtttgattggcatccctccatctaatggagtacttcctcagtccccgatgcatacaagaagccttgctgtccttaaggggcaggttggtgaacttcagaccgaagtgttttgtttgctacaatatccatatttgctcatcagctcacccatcttcttcctctgtttgcttagctgctacgcaaaaagatggttcaaactgccaacgaaggcctgatgaatcgtgctagcagtttggaaatctatggcaagatgcaaggggttttcattgagatggactgtgaaaaaaatgtgagtatgtactcttcattactgatgtatgttaccatataatttcctcttccatttatttgttgcattttacttctattgtcaatgccagttcctgtcaaaattactacatcagttgtcaagaaaattagtcctaagctcatgtaattgcctgaacaccttacttttcaccttacgaggagtccccatacttttggttttctttcagtaactattcaaaatgtagatgccactgttagtcttgtatggaaaatgttcaagtaaatcaacttataggtcaaaaattgtcctgcagactgattctgttgacaaggagttaaagagcttga

SEQ ID NO: 37095 - DNA, 2959 bp, Oryza sativa
ttttctttcagcaactattcgaaatgttgatgccactgttagtcttgtatggaaaatgttcaagtaaatcaacttataggtcaaaaattgtcctgcagactgattctgttgacaaggagttaaagagcttgaaggatgctattctgcaagaaggtgataaagaagggacattggctgaagaatttgaccctataaaacatattgaagcacatttgcctgttcgagtgaatgagcagagactaagtaacttgctgcaatccttattagttggtgcttgtgttggagctatgccagtcatcaagatgataccgacatcggtcctctggggttactttgcttatatggccattgacagtctacctggcaaccagttttgggaaagaataagacttatattcatcccatcaagccgacgctacaagtaatatctctatctgcatctgtttaccccatttgaacaatgaaattgcatgcttgactacttgcggtgcagcctatgtgcctccttttggattaatcgtaagataatccattttttgtcaaaacagtgattaacagctcacactatgcttcaacatttgcagggttttggagggtccccatgcgtctttcatggagtcagtgccttcaaaaacaattactgtcttcacgatcttccagttggtttacctcttgatatgcttcggcataacatggataccaatagcagggatcctgttcccgttgccattcttccttatgattcttatcaggcagcatgtcctcccaaagttttttgagccaaatgaccttcgggaattggatgcagctgagtatgaagagcttgaaggtgtccaccacgatcacacgctggtataaatttatctcccattcttggattatttacttgtcagtgatgattgtgtttcactctttaattctccgatgccccacgtctgttgttaatctgaatcttttgttccacacaggaggatggtgcatctgattcagaaagctgtggcagccgtgacgatgccgagatattagatgagctgacaactaaccgtggagagctaaagcacagaactttcaaccaccgtgaagaaaggcacccgcaggtaaactattggcatgaacaatattgcgccgaatgtgcacgggattagagatgagatgatacaatgcgtggccttacaatttgctctctaactcttctatcagcgtcactactagccaggcttgttgaaatatcgagctctttcttttttacggaagatcaaataccacgcacgatttgttgtactttctgcctgaaaaatggcagagttcacgtgcaaattcaaaattctcttgcgttaagcgcatttcatggcatccctttatcttttttatatatttgagtttgacaaatgttgatctccatcatgcaggcgcatacaaaagccgttcagcccaggtgtggagatacagaaaactggtccgagtgctaaagaatttcggcttactgtcggatgggtatacgataggcatatatagcacttcctcatacattcctactttcctatacatcgcactgtagcaggagatcggcggccgtatgatatgatatgcttgtcagttgtcacattgtgcatggagtaaacagaagcaactggattttacgatgttctctagcctgtgaaatgttgctccttgattgttctgttcgattgtaaaattgcatggcaaatcagatgtggggagtagcacttcatgtttcgtttgctatggcataaacttttagcctttttattattgacaaaattggttatatagcatcgaaccaattttgcctataacttactgtagcacgcagacgcaggagctcacatcctagggaaggatgggaacatgcacagtgcgcacggaaaacggagtaatctattagcgtgtgattaattaagtattttagctatttttttccaaaaatagatcaatatgatttttttaaaaaacaactttcgtatagaaacttttttttaaaaaaacatattgtttagcagtttaaaaagcgtgcgcgtggaaaacgagaggggagtgttgggaacttgctcttgcaaacacagtgtttgatggatccaatcttcaaactggtaagacaattcctcgatctccagttatattcctagtttatcaacttcctgcttgaaattaagattcagaaatggttcagtgatatttttagaaaaagtgtcgagaagacgaaataaaaacatgcaaacaaacatcgattttgtataaactataggatgagttatagagggattcaggaccaagtaattaaagggagcaagaaacgttggtgctgctaaatagctaaatcctagccacaattatattcatctaaaatcatgctcttgactgatcaagctaccacaacgtcaatgctgtctaaacataaatgggcagaacaattcacttcaaactaggaaaattctgtacaacatgcaaccaaaagaacagtatggcatgcatttggcaaactagacatgaaattattaccttttcatggtttgtccagacaggtaatatggcatttcactggagataaaggagagtctctcagacatccttctggcagtcatgtaggtggtgttctgatgagacaagcttccatttttagaataactagtacaacctagtagaatcttcttcttcatgtggaccttgatcatccatgttgtggcttcagggacaatgtagttgccctcgttcaacaagaagcaaacggtgtaagggttttccatgtcaacaatagggaattctggttggacatttggaaggcggttttcacaatcgaggtcccaaagttgggcagcatccagtgtcgcatcttctctccatgttccgtcctcgcaccacgaccacagggttatgctaaaactgccaccacattggttgatgatattgacgaacttgatgccatggtgggtggcacaca

SEQ ID NO: 37096 - DNA, 2176 bp, Oryza sativa
tattatggagttcttgatagctatttagattgaaggatctgatttctttctctctctgatatgctgcatttgggatcaaatgtatgcaagcaaagagatggggtaaaaggggacaagtttcagtgcgtgacaggggaggggctacagaactccaatccaccgtaggtttgtttacaagattagtcatagcgagggatgcacataaataagatctgtactggtatactccatcccttctaaacaaaaagagactaacctaagagagtccgacatagacaacccgcttctctctcttatgttactgtcaggggagtccgtctttcccgaaactaaggccctatttagttgggaaaagtttttgggtttggttatcacattggatatatggacacacatctgaagtattaaacgtagtataatgacaaaataaattacagattccgtcagaaaaactgcgggatgaatttattaagcctaattaatccgtcatcagcaaatgtttattgtagcaccacttatcaaatcatggcgcaattaggcttaaaagattcgtctcgcaatttacatgtaatatgtgtaattgattttttttttgcctacatttaatgttttatacatatgtccaaacattcaatgtaacagcgcgattttttttccagaaactaaacagggcctagacccctgcatgggccacccatgtcatactcatagaccatctatctgcgagacagcgagaggtagtgtagcaaaacggctccgtgcaccttgtcccgaggtcccacgagtgcaccgggtccagtgcaccaaaaccaaaccaaaaccccccacccccacccactccgctcctcgtcctcctcctcctgcaagcttcctccctcctcgcggccatggcggcgccgttcgtctactgccgccccaccgacgacggcaccagttcgtccagcctccccccacctctccgcatctcctcctagctcgatcggcttgctagctcctcggccatgtggtctaatggcgatttctcggtttgttcgcaggtgagagcgctctcctgagggcggccttcgacgggaacctcggacgcctcaaaggtaggtttgcttcctctcctcctcctcctcctcctcctctccttcttctccgccgcgtcgatcccccccgatcgatgcgtgtatgcattgccccccctttgcatgcgcctgtgttgcgtgcttttcctcccttaggtttgggtgatgcatgtgtgtccttgtgtggagcgcttggcgatggctgtactgttaattgatttggccatggaattttggaatgcaaattctgtatctagcactcgttgcctttgggaatttcccacaatttattttcggtaatgtttatatgttgcatggatttttgaccctgcgtgaaggaattaacagccaggtctatggattactggagatgcatgccatcttatctagaaattgcaagatctgaggcttttatcgtagcaagtccttgcgttggataaatgcgacaacgttgtgatcatctttctattacagttacctctccaagtgctaatgtgtgatgagtagcaggtagtactctacaaaaatgtttttcaagtcgcaagtatgaagtataggttcacatgactcagtgaggttcttgcacgttgcacgtattcgtcgctttttcgagttctacctagttaatctgttcattcgcagattatcttcctcactgtgatgacttctttttgttcttatttgcgagaaggtattttaaagagccttgggatcgagaaaggaaagacccagtatgcagtcttagctcttaacaagcatgggattgggatgctgcacgccgtggcatgccagggccatctgaatgtttgcaagttcttggtggaggaattggggggtgacgtgaatattgctggaaaagaaggttattatctaactctaccatcctttcatgaaattggcggctgccatgtctatgttttggcagtataatgtgccaagtgtactgatgtgctgtttattacagatataacaccgtttatggccgctgctgagtctggtgatgttcctacggtgcagtattttcttgatcatggtggtgatgtaacaaaagcagatgttagaggatgcacagttctccaccatgctgctggcacaggtctcccttg

SEQ ID NO: 37097 - DNA, 931 bp, Oryza sativa
aactgcttgtctctaaattacatggctcagcttccatgctctgaatatcttggggtggttctcactaaattaagtgtgtcaatttttcactatagtggcagaacagagaaatttaaccaccagataatcacaggaataaatattcgaggaattaaattaagttaaccaactgaaagtctgaaacttcttatgcatgggtagtctcctagtcaatacaagccccaaagctggagctaagcaaagacttaacaaataaaattcaaatgttataattaatcattggcgaaattgtcaaacaaaaacagaaaacctcatgatattggaacttggtagagtaggagtagtaccagcatcactaaacaaaatatattctacaagggttctatcttcttaatgaagatggtcctcattatgcgtttacaataacaaagggacagtaaaacttctttccgaatgcttccattcccaataacttatactataacaaatagtctaatatatatcagtgaagtaacagatctagctggtttttttttaagaatgaaaaatctgcaatatttatatcactaatacatgtgattgccattcactgaactcgcgaacgtcgtcctcgcggtgcaggacgtgctcgccgtagagataccggccgaaggccaccgcctcctcctcgtggtgttgtctctgtgcaggacatgcttgccgcagaggtaccggccggaggtcgctacctctttctcccggtggatcagacaagatggagaatgaatgtgaaacaatgacaagagaaaagaggaacgattatagaagatgaagagtgaatcaagattatagaagaccaagagtcgtgacccttccggaaatatcaggtggctttgcactttttgattttactccaacgtaagattgttttttatattttagtccttctcaa

SEQ ID NO: 37098 - DNA, 1134 bp, Oryza sativa
ttaatctagtactagatgtaacatattttagtactataaatttgaatatatctatttaaattcgttgtgttagaatatatcacattcagtgtttaatttattttttatgagacgggaagagtatgttgctaagagcaggtacaatagtaggctataagccagctgcaaacataatttaagaagataaataaggagagagaagagcagcggactacagatttatagccagctgtagcacagactccaagatgcagtgtatgtatgacaggtggaaccaagtattaatagtgtagtatataactattgtatagataagctatcatattagttatagataaattagagctagtagttggctatactattaaacttgctctaacgctagctactcagctccacgagggaaacgtgcactagctagctgccatgatgtactaggtacgttgtactagtgtaccacagattcagtcataggtaaggagtagtaggagcactattgagcagaggcaattaaagaggtactagaggaacgtactagaacgaacgtgtggctgactagttgaactgatcctgatcgaggcacccactcggccactcggcccctcctcacgtggacatgcactactttgctatttttaagcactccctgcgggatatttaacactgttattaactttaaaaatatttaaccatacatcttatttttgaaaataatatgaatatataaaaaaatataaattataacaaaataaaattacgtaattttctgaataagacgaatggttgaatttcactctgtttgttacttcgggtgcgtccgaatcggcttccctaagataatttttagcgagacgtaaaatgagataagctattagcacgtagttaattgattattaattactataaacttgaaatttgagtttatttttttaaatctatataaaatgtattaaaaataccgtttagtaatttaggaaacgttctcatggtttaatgaaggagtagtttttttaacttacgaaggagtagtttagctgagttgtagaatcaaatgaaggtgagtccatttcatatttagaatattgtagatgtaacctaagttaatttcttaaagtttgactaaatctattaaaa

SEQ ID NO: 37099 - DNA, 846 bp, Oryza sativa
caaaaggtgagccatatgaaccaacatcatctattcccatgaatttcaaagaaagtatgaatttttaattaacattggaaaatgtaatgaaatattttttttatttttttgcaacgcgtgagcatttagctaatagtagtagtatagatacagagtattcaaaactaatctcaaaagaaaatcaagttcaatgtggcatttcgttcattgttctgcgagctttacagccaggccatggaactgcctgccatttccgtggaatctggccatctgggcctatctatgtgggctgatgacagttcgtgagccaggccagaacggactccataggctaaatgggctgggctttgcaaaggccgcgcgaggcagcccacatcaaacagggccgtctttgatgcacacagtacgaatctgggccgcagaggctaatcgaacggctggtagcgacccaccagagggggtcatctttccagtgatgacggcagcagcaaccttgatgctggttgctcatctttccagtgatgatatatatacagattttccagtaaaatcaaagcacgcaattagtgatcatgatcgaaaaatcgattgcatgcaagccatcagcagcctgaaaataaaggatgtagattcagttatgcaatcgatcggcctaatcatgcagtagtttcgcctgaaaaaggatattagattcagttatgcatgcagcttcgaaaataaaggcagtgtaacgtactcccacttcagataaacttgttcaagatacaggtcagcttgaacatacagggatagcagatagctagctgggtttcagaatttcgttcagctggttaataggcaaaaacc

SEQ ID NO: 37100 - DNA, 679 bp, Oryza sativa
cctttatctctaacattgtcctatcacattgactattgcagtcaaacttggtgttggtggctttagcatgggcgcagctaccgccctttactctgcaacctgctatgctcatggaaaatacggaaatggcaatccatatcctgtgaacttaagtgtgtctgttggtctcagtggctggcttccttgtgccaggtttgtcctagtatgttcacgtgtttaggtatcactgaaatttcagccctgtaaatgatattgactgatatacttgttggttatcacaggtctttgaagaacaaaattgaaagctcacaggaggctgcacaaaaggcttcatccatacctcttttgctttgtcatggaaaaggtgcataaactgttctgtgaccttcattagtatactaagtttctgttacatgttacatttacatgtaatggcattaccaaatcagttggcattgttctaacattcaacttgaggtagtttggggtttatacttgtttcgttgctttatgctagctgaaggcataacctaatataccaggttctgagttttgacaatagcatggcactattcctaggaaagaaaggctacatgagtcttataatccacagcccaaatttgaatttggaaagttaattttaaattaatataggtgtttttttaactttttctattat

SEQ ID NO: 37101 - DNA, 681 bp, Oryza sativa
tatttactgcaggaagttgcccgtcacaactatctgctccctgacattgcaagttcgcaggataggcagtgctgttttgtggtttactattgggtatggttgagataaagattttattgccttttgataagtcaacaggaactgcattgataaaaagatttgcatctattagtagggcacactaagaggttagtatccatatccaaatatgtaaattcataatgtctgagcaccttgtgtgttattgtgattttccattgctgcaagcttcacacgggtaagttgaagctcatatttgagcttacatgctgatgcttctgcttcaacccacaaatttttgtagatcgacaattgcgagacatcaatatcatcaagcgtcttatcctctgggagcttagcaacagcctgaagggaagataaggataaggtacacaatagaggataaaaagatgtaatcaattcaaattaaacggcagcatgatgctcctaatcatgattgaagctacctgtgaaatagaggtcttcaattctgaatcgttctctactaatgagtgttcaggcattgccatccataagttattccttgaacaactcatattttgaaccttgtatgagacaaaaaaaaaagaaatgagtaaaagctaatgaaacaagcttcgcctttcctacatttagtctatg

SEQ ID NO: 37102 - DNA, 1186 bp, Oryza sativa
ggaaggggaagggtttccagtagttgagaccagctgcaaatatatccattatttatatcagtatctcccaaattttaacttgcaatgatgcagtagagtttttttttttttcgaacgcacaaaagctttgcatgtcgcaatcagagttattgttatctacgcgtggtttcatacaatctacctctttcgccaatactaataaattgtgtgcgtgttaaaaagttcattgtacagtggtggtggaatttgggaagaaaccatcagaaaaatcactacaacataaacagagcaggatatttgtgtacacggtacactacaccaatcagattacttgagcaatcagcttgcaataacccggggctataagaaaggaaattgacaatgagaaactgccatcgttggcatttggcagtaagctaaccggatgcccggatgtcaataaattgacagttatttgttgacagttgggaaaaaaaagtgcattggcgctattgttcatctacgcatccggtaagcacatcaatcacaacgagaggatcgatcgcgacgagagagagaggatggacggcggcggaattggggaggagagggtgggcgtacctggctccgttgtccccgaggccgtggagccagacgatggtggccttgtgcgcgcccttgggcctcacgacatgcgtccgcccgtactcgagcctcttcccacctgcatccaaccatccaatcccacccccattttacgattcgatcccaaatcccccaacgcattcgaatcaaaatcaggagcatcacgaacgcaatcaaatcacagcatcaatcccatcccatttcacgaatcaatccccccctcctcaacgcattcaacaccgatcaatggaacgaaacgtaccaccggaggcgacggagctggtgccgccgaagctgctcatcccgcgaacaatcgccgccgccgccgcccctccgcgtcccctcgcggccacgctcgctccaccacccaactctgcaaacaaaaaaaaaatccaatccaaaccaaggtaaacaacccaaacatcaccaccaccaccaccagataaaggagaggcgcgcgcgcccgtgggtaaaggggggagaagtgaaagtggaagtggcagtggcgacccaacccgacccgacgggacgcgacgcaatacaaagggaaagggcgatttgg

SEQ ID NO: 37103 - DNA, 797 bp, Oryza sativa
attcctgcagctcctatgagaaaaggagcatgccacaattttggactgataatgaagtcagaacacaggatagatgcagggtgtacattagaccagaaagcagaatctgtatcctatctgccattgccttgtagattgcagtagtgccataatcacgcaaaaaaaattcagatattacggatgttggaatttaattttctaagaaatgcaggtgtattttcaatcatacccattcaattggtgtaacaaatacaaactctactttaaaatatataagaacatttcttattcaaaagactatactaagagaaacttaagaagggtcgccataagcagataaattgtatcataaaaacatgccacacaccatgaatccgaggaccaaaatgtcataatggtaggcagagggtttcttcaagttaaactctttttgttgcgccaattgtgaagccacgctatgatcaaagaagtaaagtcctgcaaccatcaaagccggcagaatggcagcaaatatgtatgctggaggaactgaaaacagatcctgaaaataaaaaaagagaagatattattaatgatgccatgcaaaataagctgtgcgaaacttctaaaattgaagaccataaatattcacatctccagtatcacaagcaagtttgactaattacttttgctaccgtccaatgttgcagtgaactcgactcccagggaagtggactgaacagcctcctaggaactcctgaaggaacatcctttggtaacgtgtacgagaatgctgtccaaacaatcaccataagtgg

SEQ ID NO: 37104 - DNA, 299 bp, Oryza sativa
gccccctcgagctttgcttcaccattctcaatctctcatggcgatttctcctctactctcctatagatactcaagaacacgacggcgcacgccggcaagaggggcggcggcggcggaggcaagggcggcgatggcggcggcggcgggaagaagcaccatttcaccaagagctaggaggagagggactgcggtgacggcggcggcggaggcagggttgtggtaggaattgaattgttcatctgatctgaccattgttaggaaacatcatcgatgttgttgttgttgttgttgacgttttt

SEQ ID NO: 37105 - DNA, 948 bp, Oryza sativa
cgatctcatcgtgtattccgctacgagcttggagaagagagacgacttgtcctccagtagcctggtcggcgtgtcgcgctccacggccacacctgcaaaagcattggcacggtgtttcggtcgtcagacagacgcgacaaacccatacaatatgtaagataaattgggattggttagttggaactgtggttattgtcgttataaaatcggagattgattagtggcatctgtgattggtttgggacttggaaggcgaactaaactcaccgttgtcaaggagcaagaccatgtcgctgtcaaggacggaggtgatccggtgcgcgattgtgatgaccgtcgcgtcggaaaactgctgcctgagagttttctggatgaggttgtccgtggcggtgtcgacggaggccgtggcctcgtcgagcaccaggatcttgctccgtttcaggatcaccctcccaaggcacaccagctgacgctgacccacgctccagttctcgccgttctctatcactgcaaccaagccaagccaagccaaatcgggagaatattcaccaagaattaccaagtgtaaaagtagactttgaactgcatgattctgaacaggaaaaagaaatgagtccagatgcagagaaccgaacggacctggtgaatcaagtcgcagctccttcctcctaacttcatctcctagctgacagcgatccaaggcctgaaaaggaagggcaagatattcataaatcataatagaacttcactgcaagtccacaaatagtatgtggcagctgacaatggtgaagcatgtgaagactggaactacctcccagatttggctatcagtgtactctccaataggatcaaggttggttctcacggtaccctcgaacatggttggctcttgcgggatgatgcttagcctggatctcagatcatgaagtccgatggtgcagatgtcga

SEQ ID NO: 37106 - DNA, 173 bp, Oryza sativa
aagagacaccttggtctgaatcaacattgagatcgtgtcgggaagattgtatatcggttcttgcagcacgcggaatgtggccagtgcagatagcaccttccctgactccaatggtatccccatgagcatgcaagctatgaaggtcaccactgccacaaatgttggggctcccc

SEQ ID NO: 37107 - DNA, 3469 bp, Oryza sativa
  unsure (1)..(3469): unsure at all n locations
ctctacattgtcaatttttttcagattttttcacaactatttgcatcgaatttagaagaaaaaggtatacgaggggatatccctcgagggattagaatccactcccccaccatgccatccattctctcaaggtcacaacagctgcttatatagcaaagaagagagctggaagagctagtagctagcaagcctccttatttttgcacttgcaaactgcattgtttcacttgtctgcagctagtttcaatggctgccatcaaagaggaatccgactacgacagtagccggtcttcgctgacggcgccggactcccgccggagctggatcagtgacattggtagctccagctcggtctcggcgcgctccttcggcggcgacacaccggcgtcgtcatgccggtacaagccccacaaggcgaaccaggccgagtgggaggccatccggcgcctccgtgccggcgccggccgcgtcgggctggagcacttccggctcgtccgccgcctcggcagcggcgacctcggcaacgtctacctgtgccggctgcgcgagccgtggtcatcgtcgtcgatgacgacgacggcgggcggttgcctctacgccatgaaggtggtggacaaggacgcgctggcgttcaggaagaagctccggcgcgcggaggtggagcgcgacatcctccgcaccctcgaccaccccttcctgcctacattgtacgccgacttcgaggcgtcgcactacgcctgcctcgtcatggagttctgccccggcggcgacctccacgtcgcccgccagcgccagcccggccgccgcttcaccgtctcctccaccaggttcgtactcgtacacctccacacccacgtcgaacgtgtgaatgcatgcgtgcccccacccatgacccattcatgtttagttactgctccactagcctttttctttgttttaccactactactactgtggtctgaatgaatgtatctgatgatctgaagagtgggggagaaatgctctgttccagggtcaagctttgtttcagtgtcacttttgcaaaagcttagacctcagctttaggttagtgatcgtctttccatgttgcattggggctttcatccaaatcctttttgtcttgctgtgccaatctaaacagatttgttggcaccacttggggttcatactaagctaatgatttagtaagatttaaacccaaaccattgtgcagcttaagcttttgatactcacaagagggggaaaaaagagagaagagaatcttggggttattagcattcctagtctcttactgtggatggattatctttgtcggacagtgaactgatgttgctgaaaacgaattaacattgtgttgtgtatggcaggttctatgtggcggagactgtgctggcgctggagtacctgcacatgatgggtgtggtgtacagggacctcaagccggagaacgtcctggtccgcggcgacggccacatcatgctctccgacttcgacctctccctcaagtgcgacgtcgtcccgaagctgctccgccccgccaggagcgccgccgccggtggcaagccgccgctgccgccgccgtcgtcgtgcgtgccgccgacgatccagccggtgctgtcgtgcatcttccgcggcgtgcacaagtgccatcacgccaaggagtgcgccggtgncggcgcgccggcgggtaacaatggcgacggcgacggcaacgacgaggaggcggagaccgagacggcggagcccnaggtggtggtggtggagccggtgncggcgcggtccaagtcgttcgtgggcacgcacgagtacctggcgccggaggtgatctccggccagggccacggcagcgcggtggactggtggacgctcggcgtgttcatgtacgagatgctgtacggccggacgccgttcaagggcgagagcaacgagaagaccctcatcaacatcatcaagcagccggtcaccttccctcgcctcgccggcgccgccgccgccggcgaatgggaggagatgaagacggcgcaggacctgatgttgcagctcctggcaaagaaccccaagaagcggctggggagcaccatgggctccgccgaggtgaagcggcaccccttcttcaagggcgtcaactgggcgctcgtcaggacagtccggccgccggaggttcctgcgccgccggcgccggcgccgaagaaggtgatgacgatgagcaagaaggagcggcaagagccgtacaactaccgaccggaaaaccacttcgattacttctgatcaagtagctgccatgcatgagcatgatgcatgatgcatcttggttaattaattaattaatcacttgtaagaggggagattagtagtgtacatagagtgctaatcaatgagtaaccagtgttagtttctcagtgagtgagtgagtggcaggcggccatgggtggtgggggtctgcatgcttgctctcatggcgcggttgcgcacgcgcggttcgtcactgggttgggctagtcggctacccgtgcgcggcagacacgagcccccaccagttccgtcggtcgatcgatcgatcggtgaagcagcagctttgtttgcgtggccccggacaccgtgcgcgcatctcccagccgatctcgctgctgcgcctgcgcgcaatttcttgtgccgcctttcgcggaaataaagccagccccctccccgcgaagtgtctaagtaacttatcctaaaatataacaactttttctaaaatataataacttttgacttatcttgtcctaaaatataacaacttttagctaagtgtccaaatttataggtaaaaatgcttatattttgggacagaacgagtatactctatactcatcatggaaaatgtcaagcatgtctgttcttaggccgcccaggctagtcgacgaaaactccgttaaattttaatactgacgagtaaatcgataataaaatttaaatttttatagtaaatactagttatattgaaatttgctcatgcttaaaaaattttcgggtaggcttttttcccctaaaaccaagtgcaaacgttgctcatttgttcacatttatctctataaatatacactcactatctatataattgtacacatgcaatgcacatcttatctctctggcctccgtaaaagattagactgaacggcttattattaataggtatatagcatgtcgctaaaaagaatcattaaccataaatataactactcggaacataaccagctgagtgtcagctagccatacaatttatgttcaacggtgccaatgatggcaatgctaaattttgctataaaattgaaaatgcgaacttgaatttcgatctatggaagcaattttgccaatagtttaagaggtcactaatggccaaagttgtaaacagttctgatgacaagtaaataggtaaggagagtagctaaaaataatagtgatgttcaaagtattaaaaagaatcaactcg

SEQ ID NO: 37108 - DNA, 1157 bp, Oryza sativa
acatcggatatcacatcggatgtttggatactaattataaatattaaatatagattattaataaaactcatccataatcttggattaattcaagagacgaatctttttagcctaattaatccatgattagcctatgtgatgctacactaaacattctctaattatggattaattaggcttaaaaaatttgtctcgcgaattagctttcatttatgtaattagttttgtaagtagtctatatttaatactctaaattagtgtctaaatatagggactaaagttaagtccctggatccaaacaccaccttaatctcaagttggagtgttccactagcctttgcttgatgtcggtttcagtgtctctttgcttaattgagtgagttgagccatagcttgacaagtaataaatgattagttaaatggagtagtataccactatgatgtgtgacgtgtcttaggcttcgtttagattcaaaatttttttacaaaaacgtcacatcaaatatttagacatatgtatcgagcattaaatatggagaaaaaaatcaattgcatagtttacatgtaaattgcgagacgaatattttgagcctaattacaccatgattttaacaatatgatgctacagtaaatatttgctaatgatagattaattagacttaatagattcgtcttgcagtttacaggcggaatctgtgatttgttttgttattaatctacgtttaatacttcaaatgtgtatccgtatatcttaaaaaaattgaaaattgaaaaggaactaaacacggcctatgacgtgtgcgtccggtgataaatttttaattgtaactagttaaatatatctcttgattttaccgtggagataaaattaaaaaaatatataattagtgcgggagacgacgtggggtgggttctcgatcgaaggtttagtaaatgtaaatctgggggttctgattgtgtttatgcacgtcgttcggagaagaccgagacgtagatgcgagattagttagataaattcaggttttgttttgtttgttcctagtatgtttttgattttattattattattattattattattattattattattattattattattattattacaaaaggaagggcaactttcggtttgtgcgcgacttaaaaatgca

SEQ ID NO: 37109 - DNA, 754 bp, Oryza sativa
gctgacattcctgctggtcttcagaaaatggagagagcattcaggtcttgaagtatggagtgaacagaagtggcagtatcaaggaggaacctaaatcaagcagtggtgcccataggcttgcgaccattttgatgtatctttctgatgtcaagcaaggtggtgaaactgttttccccagatctgaggtaattatatcctcaccaggcctactttttcagaacaccttatcagaataactatgcactgcttatagtctaggcacatgtaatttcttcagtgatttgattcagttgagcagaagatcttatactaaactatgattttagatgaaggatgctcaagctaaggagggggcaccatctcaatgttctggttatgcagtgcgaccagccaagggcaatgcaatactgctgttcaatttaaggcctgatggagaaacagataaggatagccaatatgaagaatgtcctgtcctcgaaggagagaaatggctagccataaaacatataaatttgagaaaatttgattatccaaaatcatcacttgcatccgaggatgagtgcacagatgaagatgataggtgtgtgagttgggctgctagtggtgagtgtgacaggaatccggtgtttatgataggaagctcagactactatggctcttgccgaaagagctgtcgagtgtgctgattattttgcaattttttgctagtagaaatattgatgtcataggcagagaatggtgtaacaaactgtat

SEQ ID NO: 37110 - DNA, 1557 bp, Oryza sativa
aataatatgaaggaaagtggattacctctcacggcggtggattgacatagatccacccatgatagcatcaaagacaaggaaggtggcgacgaccggtagagatagatggcggcggataatcaactaaaggattaggttagatctgtgttcctctccgtttcaattggtagcatggcacgaggcgtacgacccatggcggcggtgggcggaaggatggagatggagatgtgagagaggaggggcggcggtagtcggatggagcgtagatggagatgtgatagacgagtggcagcggcgatcttggggggggggagatggagatggagagaggattggcgacggcaatagatggaggggatcgagggacgaagagataatgacacgagaatagaaaagtggtggtacaatggctattgaaaggggaaagatggagatgcaagagaggagcggtggtgccgtggcggcggtaggtggaggggaggggataataacaagaggaaaagtagcctattagggttaggttgacacatcatgaatttcatacgctaggggataatctgacggttgaaaaaacaacccgctttttgaataaataatttattaattgtggcatcatttcttccttgaaaatgtatttaacatttcaccgttgtattgtaatgattatggtttctaaaaaatatgctaatatgaaaagagtttatcccttatcagacattgtcataccgattcatagttgatcgacttgcccttcctataccgcggatgtagcagttactttcatttttctgaagaagtgttctaatgacttataactctcgactagaaacttgaaacttgaaattccaactgatttaaactcccaattgaaagatcttaaaacttccatattatatgaaaaaaaatcataactttatctactccctccgtcccacaaaggaagtcgctttgctcagtagaaaatgccccaaaatactcgacgctgaactttcccatcagctagtagtagcgcataaaagtgacagtagctaatgaagttttttaaatgatgggaccggttggattactataatccataaagttggtaccaatgtgtaccgctgctgcaagcaccaactattaattttatcatgatttaaatgttcttttttaagtagatgtggcagtataactgattattgcagtgttgtagcgtgctactctcaagcctccgcatgattagctgcaatcctataaaacatgagcaatatgtcattttcacctaactctaatttggctgacaatacctagaacgacatacttcgtgggacagagtaagtagttggtttgaaagtttgaatcaaaccttggactttcaaccaacagatttgatataatctgaagatacattatttggaataatgaaaaagagaatatgaaattccactctcaagtctcaagttgtgatttttcaaccatcacttgcggtaataacggcggaggcagtgaagagtgaagaccgaagaacaggactagaggagtcgcttttgttgcgagatcactgcgccgtgggcccac

SEQ ID NO: 37111 - DNA, 567 bp, Oryza sativa
cttaggatctcaattcataactcctctatagttccggttttctaaccgggactacgaatttaggactaaaaatcgctatctttagtcccagttcaaataagcgggattaaaaatggatctttggtcccggttggtgttatcctctttttagtcccagttggtaaccgggagtaaagagagaatagcggtagttccagatggtctccttttctttttttttattttctccctaatcttatcaagtgggaagcatatccccaaatcaaagtaacatcccaaatccacatcacaaataaagtaaaatcacaaatcttaaagttacatatatacacaaatcaaatacatcacaaatcctaaaaaattacacacaaatcaaatacatcacaggtcatctcagatccatccaataaatcacaaaattatacatgtaaatcacaaactaaaaaaaagagagaaaacaacgccgttgccgccgccgccgcccggcgcggccccgccgccccggcccaccgccgcctgccacgggcgccggcccgccaccgggcatggccccgccggccgccggct

SEQ ID NO: 37112 - DNA, 725 bp, Oryza sativa
cacgacgctggcccgtcgccttccccttctctcgtgtctcagcagccacgttgtcgctgccgcatcgcccgccggccgacggacctctcacccgggcaaccccctccccaccgccgaccggcctgccgatgacgttgcatcctaattcctaaccagacgagacgaaaggaggggagaggaaaggaagggagaggctggccgacgtggcatcctgacatgtggggcccacatgggtcccacactgagtcagccatcatgtcagctaaaaccggggtcaaaaccaccaagggatctaaggggatgcgttgtatccggttttgcgattgggggacgattttgtaactcgatgacaagttgagggaccttcggtgtactttttcctttaaatatccgaatccccggttgcaggaacggcccgttctttggtgggccgcacggaaaaaaaatagaatgggccacacgtgagcttcattcccttttcggcccaaacaatatggcccacactatcccacaaactcattctagcccaaaatcaatagcccgcacggtgcgtcggtgccacataaaaaaaccgagatttggagtgagagacatccctccaaatatatttttaagggaaaattaagagtttgctagtgattgaacatgtgacctcgaggctgaaatcatacaccctttgacactgcagtatcaagtataactcatgcgtcggtgccacattaccg

SEQ ID NO: 37113 - DNA, 3811 bp, Oryza sativa
cacattattattccaaactcagtaggtgcagttggctagttgttaattaatttctgcatcaagattatatatatttcagctcccagtcagtttagcagattatatatattccagctcccagtcagtttagcacaactaacaattgatgttcatataataccacaacattgcaattaccgctaccatgactcgtggatacattctttaatttggagatatgaattgaaatcggtcgaaatgatatataacgtgtaatcgtctatactcctttaaaagataccagtggtaataacagtgaatatgttactaccacagtgccaccccaccactccttaagcagtttttataaatcatctcttggtattttctgatattatggaatagtccatttgattcaaatgagtgaataccatatattttaataaaaaaacaagtaaaaaaatatattttgtgtaaaacatatcataatatattttcttttacacctagcaaaacacgagcatttttactagtacgcataaaaatatgaatgtgtggcatggcagtgcgagagcatggaggcggtgcagcggcggctgaaggagatgggcgtccggtacgtgcagcggcgggtggaggaaggcggcgtgtacgtggaccagatcttcttccacgaccccgacggcttcatgatcgagatctgcacctgcgacaagctccccgtcgtccccctcgacgccgccgccgcccactccatcttcgccggccgctcgccgccgccgcccgtcgcctgcaagatcaggcccgtcaagcagccgtcggcgacgaagctgggcagcgtcgccgccggcggctgtgttggggaggtcatcgtcgtcgacgcgatcaacggcgccgccgccgccggcggcggcggcgcgatgagctgaggagacttgtggcattgctgatccaacgaggaatcattgatttgatgaattgttgttcaactttaattttggtcgtgatgatgattaaggtgtatgtaattcgatccggtgattaatttgtctctcgctgcccaataatatttgcgtaaattaattaattacctgtggtcgtcactagctaattcatcaacgtacgttgagtgaccagagattagcaggacaaactgaaactagcgcgcgtacgtaatatttgattccctccgttcaaaaatatatgacgtattttttaccagtctaaaaacacaaaactttgaccgtaaatttcttttgtactatttcgtctatggttacaaatcatgaatccaccaatatttttttaggtaaaaatctaaatattattaaattaatagcttgtcaaagcttaaaattgggcggtcgaaatacatgcatcttatataaggacggagagagtatacgagtacgcagcagctctgctagcaattactgtctttgaattcattcacgagatgtaatgtttcctttgctgctttgcacacgtagtaggccgcactgagtgagcaagataagataagataagaaaattcctcatttttgcgtgcgcttcgcgaggtgcaaagctatgtgttttctaagaaaaaattgtagaaaagttacataaaaaatatattaatctattttttaaatttaaagtaattaatatttaattaatcatgtgctagtggctcatcttactttgcatgcatatacatatcttcttcaatttcctatcctcaagtacagctgtagtatgtgttatatgcgtggtatttatacattgttcttgtaataatcagtgctgtcagcacattgtattacgttgttgaattcacagacaagtagcacctggagatcagttgcgttcaaaatgtgtaaatccagtaatatattgtgcaatgaagttagcagaaatgacatgcatgcacgcatcactaacatgccacagaactgataaaatttactattgggatggaggcatgtgacaagctaatataataggaacagtaccacgcatgatccacactgctcatgctccaccattcttaatttcaggttgacgatatattggtatgcatgtgatcggatgacagcttgtacgtagtattagtcatgttgcttcaggcagataacaaatgtattttaattcgattggtcaaagccgaatttaaaatttcccagcccaaccagcctgaccgaggtttttaattttgggcttcccaaaaaagaagtgaagattggagccgacgcgctgtacactttacacgagggaaaagtgcaatttgcatttcttaattattaatggtggagctataaatttacgtccctcaaccgtaaacgggatatatatagcctcctccaattcttttttttttcttttttttacgaacggccggtcagaattgactggcgttatattgatagaaggagaaaaagtacagatagccaaagggctaagaaagagaaaaactgtacatgacaacatgcaaacaagcttgcacgtagccttcctagctcctcatggcaacattctcccaatgtgtttagcgctggtcatacttcaccaacctaattcctcttggatgcgactaatcatctggtgtgctgtcgcctcctttgctctgaagattcttgcatttcgttccttccagatttcccgagcaatgagcaagaagagagttctgagtcctttctattttgttgcttccgggtcgcttgttccttgtgtccaccaatttaagaggtttctacttatgttccatttcgggatgatgtgcccttggtgtagccatgtgagaatcccaaaccagatttgctttgagaccggcattcaaacagaagatggtcgattgtttcgagatttcgaaagcatagctggcagaaataattatttggccatcccttatctgtaaccggtcagatgtccacacccggttttgaagaaccaaccaaaaaaagattttgcactttgccggagcccatgcctcccaagacaactttgttgatggcgagagtaccattccattgaattggaattggtacgtggattttgcactgtattccccattagttgtccattgccaaacaatcgagtcttgtaccccctctgttagttgtggggtgtcacgggctaaaatttcccaaacatggaaagaattcatcaagaaggggaatggtgaggctgtggcggatgtcgttaatccatcttccttgttgcagggcgtcctggacggtgcggggttcctctttgaatgcctataaagattcggtgcttgactttttaggctttggccaccgatccaatttgattcccaaaagctcgccttttgtccgtcaccaatttggactctcgttgatgccgcgaaaagatccttatccaattcatcacagggtgtttcagtccctatccaaggcttctctggcgtcctccattcgaaccataaccatctcagtcgaagagctctggcaaacttttctaagttcggaacccccaaaccaccgtaccggacatgtgagcaaactttaagccaattgaccttgcattttccgccatgcatattctcgttacctgcccacaggaaccgccttcttgctttgtcaatttcttgaagagattgtttcgacggtttcagcaccttgagggtgtaagttgggatggcacttagaactgagttcaccataattcggcgcccccccccaatgtacaacaatgatggtttccatcccgagagccgacctttgatcttatcctggagaggctggaaatgcaccttacgtaggcggccaggagtgagtggtagccctaggtaagtcagtgggaagctggctcttgcccccgaaaaactacg

SEQ ID NO: 37114 - DNA, 39512 bp, Oryza sativa
  unsure (1)..(39512): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagatttggcaggataacgatcaaacaataagaagtccagcagtaaagccgtttgggaagacgtcaaagcatgtcaagtgggataagttggttcggttgagaaacataattcaaaggcaaagttatcgaccctcgcatggaatagcagaagtagctagcacccggagagcaggaaagctaatatgatgcagttagtgacaagttgtcaaacatggtatgctggataagcgtgatatcatagtccaaagcattcagtggtaagttagaagtaaatgacaagcatgatattctcatgatgacaagcatggtatcctagtaatgacgagctgatctcgacgcatgacatgaagtgggtaacttgtatgaggttgactccgaagatatgaatcatgagaagttctggaacggaagcatcattaaactaccgcaacctagtctgagtcagctaaaaggtgcaccctggttcaagtcaggtgaagagaagattccatccgcaacaggaggtcaagccaagcagttccgagtcgtgaagttttgctgaaagtttgtgaagacggagcggaagaagtcaaacaagaagagaagaccacccaacctatcttcttgctagcctcctcgaatctcggggacgagattcttgtaaggggggtggatttgtcacgtcctgataaattcatcccgaattaaaaatcattttccaaaaggaataatagaattaattaaaattcgaaaagaaattggcaaacactaaaatacgtacaagaaaaattcaaatgtggcccggagaatttttgttaaattctccttagtctaaaaagagccctcaaattttagtggaattttcagagcacaaataataattattaagaaataaacaaagttaaaaaggttttataaaaagaaaagccctaaaaagtcttttttccccccccctccccctcttgggccggctcggcccagcttcctctctctcctctcccccgcggcccatccggccttcccccgcgcgcgcgccgctgacgggcgggcccgcccgccaccctcgctgacgggtggggcccacccgtcatcccctacctcgcgccgcacccgccgcccgcccgtgccctagcgccgccgccgccgcggattccgccgcatcccgccgtccccgcgcgcattaaagagggggaaatcactccccgtgattccctccctctttccccccacttttccctctctctctccctcggattcgttcggatttactcccgcgaacttcgccggcgcatcaatggaaaagagatagccgcgccggtttccttcctctccggccgccctctctcactcccaacactatataatcgctccccgtgcctccctcctccgtttccgccgttcgccgctcgctctccccgtcggaatcgagctcgcgccgtcgtcctctctctccgccgtcgccgccgagcttcggttcgccgccgtcgtcgccctggtacctcctgccgcttcggcatcgcctccttcggcttcgccgcgtccccgtcgacctcgtccacccctccgtttcgcccgccgcccgccggaacgccgccgtcctcgtcgacccgaaccgcgccgccgcctctctccgcttcggccgccgtttccgtcgtcgccgtcgacccggggtgagccttggaccgccatttcgcttcccccttccctcccctctctcgggcgccgctccgtcgcgccggaggtcgccgccggcgaccatcggggcgcgggcgcgccgcctcccgtcggccgtgccggcgaggccgccttcgggcgcgccccgcggctgccatgtggggcccggccgtcagccgcccgcgccctcgggtgcggctgacgcgtgggacccacggcatcggccagcgcaagccgcgtgcgcccggtccaccgtggaccgagaggctgccgcgtgggccccactcccgtggacccggtccgcgcgcccctcccctcggctgacgcaataaatccgattttaaattaaaatttaaatgaagaaattcgtaaatatccatttaaagagcatataaacttcaaatggccatatcttggccatttgaactcgggattggaccgttcaagtctctaatttttccttaagaagtcaagaacccatttttgtgctttgtttctgcttgttatatggggtttagtagagtaaaagccttttcttttccgtcggtcgtgtagacgctgcagcttcggaagatccgctcttcgtggaagttgaagccgacgtttaggaaagcgagcaaggcaagtcacatcatccttgaacatattgaatcccagtttataaaattatgttgatttaaattattgcattatcgctttatttaaattcccgcgttatcactgttttatctagccatgcctatttacctttgttatgaccttattattgctattgttattattaccttgttcaccctagaataaacaaaaccccaactagtgggtactctattcgtggttccactagtataaatttaggtagatgcttcgctgactaattaggcaacattaggtggttttataactttagactttgggaattctcatatcatttggacactatggaatagttggcttatgttggaattggacacacacctcccccctctattcaaaaacccccaaaatggttttaggctgggctcgaggtgcgtggttgggttttgctagtcgtacctcgggtactataaggattaagctcgggcctctgttgcaaagcactaccgtacttccacatgtctagtgggtaaggcttagtttgtggctcagtctggttataaacaaaagtacacggattggagatggatgaagtcgggggtcgatggacattctccatggaaaatgaaggctacacgagctgcggcccggtagtcgagatgtcatggcacagggctggtgtcctgctgctagggggctcaattctgcctgcctgtcccgggggttccggccgtaggtgggattgggtcggtactcttgtggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatattgtgtagctctaggatcgtctttataaaatagctttgggcaactaagtgacttttaaatgctgtttactgcaaaacttaacccctatattattatccccttgtaccccccttgcattaattatgcatctccgttgtggcttgctgagtactgtggttgtactcattcttgctctatctttctccccccttcagtaagagaagctttggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgttccccggcttttcctgggacgggggttaatacactagcgttcgggaaaaggcaattttcccggtcgcgacaggaggccaattcatgagcacttaccttcaccaaacaaaagccgattttatggtaaaaatcgggttaatgaagaaaaaagggaaggaaagcgcaccaaggtggaggaaaggacttcggaggtgattactatcaaaataggatctcatgatgtgcctataccttctggagatggagttggaaagtccccaagcaaaaaatccgaagccggtaccagctcctcgcagtcggccagtctgaccaggccctctggccggtctgaccgcagccatgttgccggtctgaccgggccatcaggccggtctgaccgccgacctgacgacggtctgaccgacgcctcaggccggtctggccggtctgaccggtggcctacagccggtctgaccgggctccggtgtcggtttgatgagagggctgcaaagggcgatgtgggggcttcatcgtcttcaagcaaagttaatagaggacattatttgcctcctagaacagagccgaatcctaggtggatgcctaaggatttgacggctacacaaaagagaaggttgcaatgtcttcgggcccaagaattaagggagaaaaaggccgaagaacaaagagataaaaggttcaatgagttacgaccaccaccggtatggaggcctaaatccatagagaaggcaaaaccgattgatgtagaggagaaggaagaacaatcggttgacaaagataaatcgtctccaaaggaggacatggatatcaacatggtgtgtatgttgcctatggagttttgtgctatggatgaagccgaggttgcccaattctcattaggtcctaaagatgcggtttttgagaagcccgatgagtcaaaccgtcacatgaagcctctctatctcaaaggccatgttgatgggaaaccggtctctaggatgctagtggatggaggtgccgccgtgaatttgatgccgtattcgctattcaagaagttggggcatgaggatgatgagttgaagaagaccaacatgatcctcaatggcttcaatggtgaaccaatggaggcgaggggtatcttttcggcggagctcaccgtgggaaacaagacgctaccaaccgctttcttcatcgtcgatgtgcaaggtaactataatgttattttgggtcgttgttggattcatgcaaattgttgtgtgccttctaccttgcatcaatgtttaatccaatgggacggcgatgatgttgaaattgttcaagcggatacatcggccgaggttgcaatggccgatgctacttttgagtggcgttatgggaatatccaatgcttatcggggagggatctttctagctatgattttattagtatctccgatggcaaatttgtacctatctctgtaaagctggctagtgtagcacggctaagccatataaacttgtataatgaataaagaggctagtttagagtggttacaaaaaagggtgcaagaatatcggtctacaaagaacgatattggagagaccgttgaagattttgatgaagtagagaagcttgggcaagggtttacatcggccgatccattagaagaagtagacataggtgatggaattaaaccaaggccgacttttgtaaacaaaaacatgagagccgattataaggttaagataatcgagctacttaaagaatatgttgattgctttgcatgggagtaccatgagatgccgggtcttagccgtgagcttgttgagcatcggcttccaattaaaccgggttttaggccttataagcaaccacctcgtcgttttaatcctttattatatgaccgagtcaaagaggagattgatcggttgttgaaggcggggtttattaggccatgtcgttatgcggagtgggtttctagcatagtcccggtggagaagaaggggagtggtaagattagagtttgcttagattttagagatttaaataaagctactcctaaagatgagtatcctatgcctatagccgacatgatgattaatgatgccttgggtcataaggtgattagcttcttagatggtaatgccggctacaatcaaatttttatgacagaagaggatatgtacaagacggcttttaggtgtccggggtttgttggtttatttgagtgggttgtcatgacctttggtttaaagagtgccggcgcaacgtatcaaagggcaatgaatttgattttccatgatttgctaggtattatcttagagatctacattgatgatattgttgtcaaatcggatggtatggaaggacatatagccgatttgatattagcttttgagaggatgcgccggtatggtttgaagatgaacctacttaaatgtgcttttggtgtgtcggcggggaagttcttaggattcatggtgcatgagagaggagttgagattgatcctaagaagatagaaaaaattcgtgatttcaaagcgccgacatgcaagaaagaggtccaaaagttgctaggtaaggtgaattatttgaggaggtttatttctaacctagcgggtaaaatcgatgcttttgttcctattcttcgcttgaagaaagaagccgattttacttggggggcaaaacaacaagaggcgtttgaagagttgaagaggtatttatctactccacccgttgtgcgagcgcctaaagccgaaaagccttttcggttatatattgcctccgaggacaaagtcattggtgccgttttgacgcaagaggaagatggcaaggaatatatcattacatatttgagccgccgtcttttagatgccgaatcgaggtatgttcttatagagagactttgtctatgcttatactatgcttgtaccaaattgaggcattatttgttatctagtacatgcatagttacttgtcaagccgatgttattaaacacatgttgcaaaggccaattctaagtgggagaattggcaagtgggcatatgctttgatagaatatgatttggcttatgaaccattgaaaactataaaaggccaaattgtatgtgattttatagtagaccatcatatagatgttgcttatgagggagagatttgcttagttgaagttataccttggaaaatttattttgatggttcttcttgcaaagaaggtcaaggcataggggtagttttgttttcacctaatggcatgtgttatgaggcatcggttcgctaagaatattattgcacaaataatcaagccgaatacaatgctttattgttcggcttacaagttatggagatggttggagctaaatatgtggaggcctttggtgattcggaattggtggtgcaacaagtcgccggagtctacacatgcttggatggatcactaaataggtacctcgattcatgtttagatattattgccaattttgataattttgctattagacatattgctaggcatgataattctagagcaaatgacttagcacaacaagcatctggttataatgtgaagaagggattatttctgatattagaagaaccggtgcttgattttaaatctttgtgcgaaattagcaaaattggagaccagggcggtctgaccggcgttgcacggccggtctgaccggtgaccaggggcggtctgaccggccacatgccgccggtctgatcagcgaccccgagcggtctgaccggccctgtgtggccggtctgaccggttttgggcaggatgctgggggcacacttcaatcaatttggaggccggattaattgaaaattcggacatttgtgcccaggatacagaagaggattggagaattcctttgattcaatatctaaaagatcccacacttaaggttgatcgaaaaattcggcggcaagcattcaaatatacattgcttgatgaagatttatatcgccgaaacgtagacggtgtcttgttgaagtgcttggatgaagatcaatctaaagtggctattggagaagtgcatgaaggaatttgtggaactcatcaatcggcccataagatgaattggttgcttagaagagcgggattctattagccgaggatgattgatgattgcttcaaatattataggggatgtgaggcttgtcaatggttcggcaatgttcaattggcacccgccgccgtgttgaaccctataatcaaaccatggccgttccggggatgggctttggatttcattggtcaaatttatccttcgtcatcaaaggggcataggttcgtgctagttgctacggactacttcaccaagtgggccgaagccgtgccttcgaggaatatgactcatacggaggtaattgattttattttgaagcatattattcatagattcggtgttcggcaaacattgactacggaccaaggtgcttcttttatgtctaaagaagtgaatagttttaccgaatcttatggtattaaattgttgagttcttctccttactacgctcaggctaatggtcaagccgagtcgagtaataagacattgctaaaactagtgaaaaagaagattgaggagcacccaaagaggtggcatgaggtgctttccgaagcattgtgggcgcataggatatctaaacatggtgccactaaagtcactccttttgagttggtttatggtcaagaagccattttaccggtagaggtaaatcttggttctcttcgttatatcaagcaagatgatttgtcaagtgaagattacaagacgttgatgggagacaaccttgatgaagtcgtcgacaagcgcttgaaggcattggaagagatagagaaagagaagaagagggtggccaaggcatacaacaagagggtgaaagcaaaattgtttcaagttggagacttggtttggaagacaattttgcctttgggtactcgatccaaggagttcggtaagtgatctcctagttgggaaggtccttatcgaatatgcggcattgttcgggggaacgcatactttttggagacactttaaggggagcgttttcagcgagcaatcaacgggaaatacttgaagaaatacttcccgagtgtttggcaagatgcttaggaggtactatggccggtaattggattatcgtcctaaggccaaaaacatgctctatgcttttagattcacgttgttcaccaaaaaggtaggggggcatgtgtttacacccaaatttggcacctaggattaaaataggaaagattaccaaaatttggaaatctaccggtttcctccgagtgggccggtctgaccgccatgtgttgggcggtcagaccgccgattgtaggccggtcagaccgacggtatgtggccggtctgaccggcaggtccgagttcgaccctgtttcgtcgggtttcgaggtttccttgctcgggaaggcatgtttcggatttcctttggattctaccccaagttggacgtggaggatggcctgtagagggcaagaccaacccctatataagggacaaggccggttcattgtaaaaatcaatctactatcaatcaatcgaatcgctcttttcatattgcttttagttttctcttagtttgtccatctttgtcggtttgcgccgtaaaccgtccaccgccgctgcgagagtgcgacatctctttgtaggtttgtcctgaaaaccttctgtttgcccacgagacgggtagttatctaaaaatcggctccgctagccggtttagttatcgaaacccatctaggtttagctcttcgctagatcgaggtggttggcgactctaggatcaccgcaaggcttgaggtgctgcgatcatgcttgtcaacttgtcacaaaaagttaccaacaataaccagaggaaaaaaatacttctcctttaggtatatttttactcttacatataccatatatttttaaaaactttttccttttgttttttattttcctatgatacatgtaagggtaaattggacaaatcatatagattttgcataggaaggtgacatggcatgtcaatgtggcaattttggtgggaccaaggactatatcagcccacatgacaaatttaaagaacttttttggacaatatgaaagattaaggactaaaataatccaggagcgaaactttagggaccatattggctgttctccctaaaatctttgtcagctcacaatttccaaatgtcataccaaatttaaaatccgtttgaatttatggcctcctctcaagatgtaaaacaaaactattccaatattgattttattcggacatcgtgtgatattggaaatttcgggacccacccattatagggacattcctaatgtatttagtaaatctaggctgcaaataatattctcatataaattaacacccaataatatattatttccacaactatttttcaaaaagctacagccccgtggaggtacgctgtcctaccgtcaaggcgtactggagttttatgtaaacattttaaaccagtggtgtctacatgtgagagagatgaactcctctaatctttcagccaagcactaaagttttcagaaattacgtatagatcctagtgctccttgtcagtgattgatcttgtttttgtaacatactaacatgtacctcagcttttccactaattactgtttgaggcggcgtggcgacgggctaccgaggcggcagagagcggtgccggcggcggcagcgctccggcgagggtggccctgaaattggttgagggaatgagtttgggggcttctaggagctcgctggcgcgagggctaggtccgggactcaccgaggcggcgactcgatgttgaggatatggcggccgcgtcctggccgacgcgggcggcggtgatggcgcggcgttccacggcaaaccacaggtgttcggacttcggatttgggtatggaggtcgagtgggttgtggggagttagctggcgcgaaggctcgattcataggcgagggaggagcgaaaggcgggcgcgtcgagcacctgtcgcgacacgttcggcaggagcacggcggcagcggggaatcacgtcagctttgtaggcgtgctctcagcgtgggacacggtatcagcagggcagcgagaaggctggcgcggggagctgcaggtggcaggcatggtcgggcggagcggtgtcgtgttcgtgtccagccgcggggcggcttcgattggctgaggccggcgcccggcgccgcggcgacgttagccttgcagtttcagcgtcagctttgcagagcggagacagaggcggtcgggctagtcgcgtctcgtcgtttcgggtagaggggcagtgttggttcgccacggcgaacggcgaggtcagcggcgatctcgacagggcatcgggcacggcggcgtcggctttacaggcgcgggtcagtggctttgcaggattggcgcgcagcgggggacaaggcttttggccgcgacgcgtcgtcaatggttcgttgtgctcatcgcgcagtttgcacgccaagtgcttgttaaaatgcctgcaaggagggagagagaaaggaaggtgggggagggatggggcactggtgcggctggcatgtggggtccagggctcctgggctcaccgctcagagaggaggagaagaaagagaggagaggcgattttcctgaaaattttggtgaaaactgagagtgtgatcgaattttcaggatatgctacagtgtagcaaacacctgtgcatagataactgggaataaatgcgatcatgaacttcttttggtgaatttttgagacttttgtcatgtgtacttctgtgaaaattcagagaagttcactgtttcatttcaatttgaactggtttcgattgttttgacatatttaattgacgtgcaaaactaaggtacaaagttgtcaaacttttccagaacattattgaaggtgtctactgtttataaaaaacccatatttttactcctcttagatttaatactttcacttttctgtttttcaatgcaagttcattttctgcagccgtaacaggatgcccagcttgctggcgctgcagcagccagcagaaacgatcaagcccatggagcacagagaaaacgctttggaaataaaagtagtgcatataatacttgcagagaagcagccgtagaataactgatggcattagatgaagcacccgatattcttatacggatcaggtgaccgattacgagcaatctccaaaactaatcctacctggatgggacaaccagcgtttcactactctgcagaggccacaaaccacatccagtccaatgaaccaagaacatcttcagggatacaaaactaacagccagcctaatagcagaggcaagaaacaaattatagacctgatgtcgactggtctcagactctcggtcgttcgagaacccttttgctccatgtatccaggcacctcctctcatcagcaatttgctccatctctgcaggaaagaaaccttattagttggtgatattatttggtaccacttaaattttggtgacaggaatgtagttttctgacaaagtcaattactgaatataaaaaatatttgcacagctctgcatcaacagttgtccaagggatgcctcaaaaatctgtgcagattatcagtcgtcacgcagaagcagaacatcgtggtgtgctaggtctgcttcttgcactgggccatgaatccggtgggttgttaggtggtgtttaggaaggagggactaaactttagtcccttttacaaaagcaagtctttatgggagggactaaaatctctcctctcttagggcatcagcaatttatgctatcgacatgggtattagcgtgggcccagatgacaggtggtaatagagggagacgcgctccacattgcttatttccgtgagttggcggtaaggtggggttcatggggtaaaaaaatcgcagcaaggacagagcatgcatgcgacggttgggagaagcaatggtagcctgttttttttttttcttttgctatcagaaaacactgtatacatacatattctatttccttgcttccggcggtaggggtatgacccggttgtagttatgtactactcccacaatgcttaataccacgtagtaattaagaatgtatttattgcttactatccggtttgtgagcgtattgctgatgcccttattctcttattaagatgcacaactcttttgtattccaaaaaaaatcctgttgatagtagccacggtgccattaggtaccgttgaacctaacagatatttatgcatgtgtatatatattgctatatagataaaattggtgccgattatagacccaaaagcaagaggtgtataatataatacagaccacacgaccaaactaagaatcgatcaaatagacaaggcatgtctccaaattgtcttatactatttccgtaggttcagccgttcaggagtcgaatcagcctctgccggcgttttctttgcacgtacgacggacacacatgggcataccatatagctggtccatgacattaggagagagaacgtacgtgttgacctgtagctgagatataacaaggttgattataatatcaccaaacatgaaatcatccaaggatgacccataactatcactactatagtactgcatctggtaatagaaattgtatagactctatttcgagcactaccacataacgcctgcaatgtgacaccctacctgttcactaatgtgcctcttcccacacgctttccacccgtactgctcacagctttaagaaccagaacaaatgagtaatattagtgtcggttcatggctaaaaccagcactgatgtacatgaccacatatgtcaaatgctgcttctaggcatgacccgctcttactaatacctactcatcgctagaagaattttcggctgataaattttcaatttaagcaagagttatccgcattggttcataactcaaactgatggccccaaccatattagtgcaaatttcacatatgatcataaccttttcatatgaaatcgggtcgaggtgaactttatataaaaactgtagctgtagatgatacctacaattttatagttcacaacctttttatttcaagtcatttaaatgcccaaataggtgtttcaaatatcagatagaaatgttcaaaagtaaaaaaggtccatattatagcataattaatatgtaagtgagttggaaaaaagataagtacgctgagagaggtcggggatcgaattctggtgtaaaaataaaaaatgtatgtatttcactcataaaaattggtagcagctagtagttgggactctgtatataccggtaaggatgggatggtagtagaataattccttttttgtttttagttttttctggtcccaaatttaaaatttggatcccttacttgtaccaactaatattaatgagtgttgagggtagtagagatgcaactttaccatactccctttgtttcagattataatatgttttgactttggttaatatcaaactactttaaatttgactgagtttaagcgcaaatatagtaatatttataataccaaattagttttattaaataaataattgaatatattttcataataaatttgtgttgtgttgaaaatattattaactttttctacaaacttggttaaacttgaagcagtttgactttgaccaaagtcaaaacgtcttataacctcaaacggagggagtactttttttgtgggaacaagtttacaatgtttaataaaagcacaatccatcttaatgttttcaagctgaatattgtaaaattcatggataaaccagcttctaaatgtttaattgggaaaatgtcgaatgacaaattaatatttttaagtggagggaagtattaatatttcaatatcgtactaaactgtgggatttattttctaaaattttataccctgccaattcacgtgttgtagatctttttttttcactaaccgacaccaggtatatcaattttattgaatatagcagcaaaaagaatgtgttgcacttgtaaacaaaaagcaaactgtacataaaaaaatgtactaatgaagttcataaagatgctttgcttaatgagggcccaaagttttgatgaccttttgcttgatctcgaaattaaaattcaagtactgttaagggaggtcacaccaccatcaattttcagcctgaagaaacagttaaacaacgaccccgatgaccagtctactgctctccacatactagcagcattattgatcacaaaagaaaccaaaataaaaatcagcaccgagtgtgcagagggagacaaaggtgatctggcagtggatatctccccatccatcctcacccgcgctgcccatcactcgccgccgcatactacatcatgtggagagaggaagacgaggaccacagccagagcccgggtcgagatgccaccacggccacaatccacgagcccggcgcgacaccaccgcgcgcgcgtgagccagccacaaacgcccgcggataggcgcgcgcacgccggccaatcctaccacatccccggcctccgcggctcgcgagcgccgctgccatccgatccgctgagttttggctatttatacgtaccgcgggagcctgtgtgcagagcagtgcatctcaagaagtactcgagcaaagaaggagagagcttggtgagctgcagagatggccccctccgtgatggcgtcgtcggccaccaccgtcgctcccttccaggggctcaagtccaccgccggcatgcccgtcgcccgccgctccggcaactccagcttcggcaacgtcagcaatggcggcaggatcaggtgcatgcaggtaataacctactgacccaacacacattattcttcttcttcttcttcttcttcttcttcttcttcttcaacattaaccaataattcaattatcgtttatttaggtgtggccgattgagggcatcaagaagttcgagaccctctcctacctgccaccgctcaccgtggaggacctcctgaagcagatcgagtacctgctccgttccaagtgggtgccctgcctcgagttcagcaaggtcggattcgtctaccgtgagaaccacagatcccccggatactacgatggcaggtactggaccatgtggaagctgcccatgttcgggtgcactgacgccacccaggtgctcaaggagctcgaggaggccaagaaggcgtaccctgatgcattcgtccgtatcatcggcttcgacaacgtcaggcaggtgcagctcatcagcttcatcgcctacaagcccccgggctgcgaggagtctggtggcaactaagccgtcatcgtcatatatagccttgtttaattgttcatctctgattcgatgatgtctcccaccttgtttcgtgtgttcccagtttgttcatcgtcttttgattttaccggccgtgctctgcttttgtttttgtttcacctgatctctctctgacttgatgtaagagtggtatctgctacgactatatgttgttgggtgaggcatatgtgaatgaaatatatggaagctccggctatatatatttatacaaagggtacgagatggatgtgaatcctagagcatatgtgtccaacaatcaattcgtcgacaatgaaaatttgatcatggaattaaaaaatcatgcttctgttgttcatcggaaatgcctttctatactgattagtggatttccaaactgaattcacaagaaaacatatataattgttgtgttcatcaatctacttcttttgatcaaataaaagataatttgacttggcaaaaaacaaaaaatacagtttttcaggtatggagggagtactttttttttttcaagattgtcacatgcaaataggcaataatacactctttttataacttgtaagtgtttttttaccttttttttgctacatattaaataccaaaacagtgtatcgaaaagcaaatctgtacgacgaccaaatggctaagtggtgtaattgtgtgtcagtccagtccaagtccaacagaaaggttggcagatgataccccaacggtgttgcgctttctttttgtccataatttctatttctagtttttttttaaaaaaaaacaagcggtcagttaataaaatacggttggaccaactgctttctaattttatcccaaaagattgctctccaatggcaaaaacgtaaaagcaattctaaggcccttcacaatgcggggacgtggaccggtgctccaccgcgctagctaggattcgcgcttgcgtggcgtaaggttgcgcgtcccaccagaggcgctcgctcccgcggagggaagcgcgcttcctcgctcgcgctggagcagagtaacggctggagcctacactgtggagagcgtgcctccgactcgccgtcacctcgcgccctcccgctccgcgtcgccgacctcatcgtcgtcctgggctccgcttcgcgctgccgcctccgaaacctcatcgccggccggaagtggagacaaagcgaggaggacgacgaccatgagcagctccgtctcctcgtcgtcggccgagagaggaggagcccagatccgctctgccaccatctccagaatcgcgccaccgccgccgtcctcccgccggcgcttcttcaaggacgctaccgccactgctcggcccggaggacgctgctgctgccgccgcacggcatggaggacgccgttgctcggcccggaggagaggagagccggcgccggctgagggaagaggggagccggagccggcggagggagcaggggagagctagcatggtgagtgacggaggaggagacgggcgtgatgactgagggagttggggatttggtaaagcagtatatgtgggtcccactagcggtgcttgcactgtgaagaaagtgtctttgaagctctctatcctaggtgccaccttgtggtacctcacaatgtaagtcattctagcatttcccacgttcatatttcccacaatatgaatgtggctagaatgacttgaattgtgaaatggagggagtacccattaaagttggataaaaataaacattgtgatgatatgatgcatgaaggagcaagttggtcgttaaattgaagttgtactgaaatgtgaaaaaatatatatgccaaatgcaaggtaattcattaattaatcatgcttggagcacaacgctcttacaaaaagataagcagcaaaatgctaagtgctaaccaatgttgagaagccacttcagtaatcttggcaaaaagaaagaaggaaagaaattaaagaaaaactcacttcagcttgtatatatctttcttttacaaccatgagtccatgatcgataaacttatcagtagcaattaaatcactgcaactgatcagatctctttggctggaaataaaggagcaacgggcatattacttcgtaatcatctctgaaacttgtcaagacgagcagctcgacgactcgaacgtggagacctttcggcgtttgctgcccagcagcgacgcactgggtgcgaagtcgaagcctgagctgaccttgccgagcacggactggagcgcgtggcggaccgaggctatggcggcggcggcgtcgcgagacccgcacgatacaaggaaggcgagcctgacctggccgcccagcgtggtgacctccgagccgaccacctccagcccgagcctgagtcgcgctctccactgccgttcggtttcgatggatgaggaagcggcaactctgctttgcgacggagaggagcgagtgagcgagcgacgctgaccgtgggacccacgaggagaaaaattagtgtcaaatttaccctaatcaatcttaatactttactaatctacccttaaaaataaataaaccgttccgattagttctactggcctggcagcataatactatcggtagagagcatcgccctagaagaaaaatccagagatctcctatcttgtactgcaccacattcgtctaccctttacattttctcatccagccatctgaaagaccttggtgtcatagatggcacggttcgtagtctcgcggatggcagcatggtgtcatgaagtcctggaaggaagtggaatgttgcaaagaagtcaaatgtagcgacatggcattcgaagaattcttgaagagttgaggaggaccaaatgaggaggtaggcagtgtgtggtcgatacttccagattcattgataccaatcatacccctcttaaatcaatggctagatgtgattggtacctcgtctcgtggttcctgatacctcgtggtacctcacggtatctcctcaagagtggtaaaatatcttccaaggaaaacttcggaatacgactcacaagcatctggattgcgctgaaatgatgtaactgatataagaaaaaagaagtaatatatcaagtcttaaaaaataaaagtccatcagtagcaggccggtataacccaagttctctgctgttgttctccaatgtttcctctactagtaacctagcttttgtgctagttaccttgttagtagaccatggtaagaaattgtgacctacaactaaataacctataaacatcctttttttttttacttgttgtcatgggcattgggctgtagacctgtaggtaacccatatcaattaattagagataagattggattgaatcctttcttaggctgtgtttgtttccctgtgttcccaacctctctcactcgtgttctgcgcgcacgttttttaaactgctaaacggtttgatttttgagaaaagtttctatacgaaagttgctttaataaaatcatattgatccattttttgaaaaaatagctaatatttaattaatcacatgttaatagactgctctatttttcgtgcggagggaatgagttcccatctcagagaaacgaacttagccttagggggtcaagctataccaactatataaggatgggattgtgtatattatctgcaagcaaatagtctaatctatctgtcccaataatatgtttctcccttatttaaatctatatcccttcttcggaagccgacgtcgcccatgtatcttttcaacagtgtttatctcatcattgcctcaggtcatgagacttgttgacatacatacctcggactttagtaaaaatcggtgcttgctctgtttgttaagctctgtttttgttcctacgcgctatctgccgccgagtaatttgtttgctgttcttttttccagacaaaaccttattctactgccggttagtacttacttcctccgtttcacaatgtaagtcattctagcatttttaatattcatattgatgttagtgaatctagatagatatatatgtctagatttattagcatcaatataaatgtgggaaatactagaatgatttacattgtaaaacggaggaagtagtaatcattaatgtaggaccagtccatgtaaccgttgatccattatgagtccaacccttccgtggcctccataccccatacaacgatcgaaggaaataaaaaagatgggacagtgtaattaaaagcacgggacgcagttcgatcttgtcaaaccatatgtcggccacatttggatctctaccataccaattcatttgttggtagtgttaaaatctaaataattagttatgtggcttatgttagaaatgagtttaatacaaagtccgtggcggagctaaaaaaaattactgaagtttttactggcgagcccatgtatgaagtcaaaatttgatattgtattgaagtctgtgaagaaacttctaagatttagccaaattaaacataggcactattaattagttgagcttaatcccacatttactatttggatcgttgaaaaaataggcaagacacatttttgacatcaatccaaaatgtcccatcatcgaagcagaccaattagcaacagggttcactatatcagtttagggtttttgatcgggggtcactgaaatcccgaaatttcagaaattttagaaattttggtacaaaattttgaacaaaatttagttgaatttgaacaaatattacccaaattcatgaaaaaattgaaaatttcaaaaatttcggccgaattaatatcgtatcggaggaatttcggtctgaaatttccaaccctgattagcagtgagcgaggacgctcgatggattgacgtgagtggcccctgatcagtgatcactgacgacggcgagatgcgccgagtacgttcaaccaagaagagaaatccagtgcagactatactggatttctttggcggattcatgcaatgcacggatcagctccgacctacatcaccgttgagtgaggtttgtgagaagactctgtcggggtcacctagcctgggtacatattacaaactgtgtggagcgggactgagctattcgttagaaacacgggtagtaaattacaaatatagacgcccatattgctcgtaaattttgtatttttatgtaacacatatattctacctctattaatatcttcaaaatattgaaacgtcataatttaagtttggcaaagtcatcacatgaatctcgttatcaatgggtatgtgtcagggttacgggtctggcataccctctacccttcgatatacgttacgtatcgacatggcatacccacgcgtacgtggatatttccttcataatctaagaaaacttctcacgaaatcaatagacgggaagagtccttctcggacaagaactgggttacctacgtattgtgctaggtctagtgtgttcgagtcctactcggagagcatcagacctatggtataaaagggacccccggggagggcatagatcatcgaatctcagagccaacacaacccacacagcctacgaagccggagcctgcgaggagccaaatcgacgagagctagtcggatcaactcgactacgatctcgttggatccgacaagttccatcttttcctttgtaacctgtgttttctaccatataatcccatatcaactggattagggctattacctatcaaggggcctgaatcagtataattcttgtcttttgattgctcgatgtcgtactacttagatccttgtaccagcgtaccccaataccctctatatccggtctacgggtatcacccgtcgacagtatgttacttatcatcgaaaaataattagccgtaaatacgagactcgtaccaaatctagcaacgacttgtacctgaatatactcatttcaccttgtttacttccccgggctggctattttaatttgcacagctacattttggcaaagtcatcaaaatttaaaactttcaactcactttttaaaactatatattttttaaaatctatccaaaagtttcttcaataaattagaaaccaaaattattttttggggtttaaatattggtgaaaatatcgtttgaatttcatcaaatttgattcaacgttttttattttaaatttatgatcaaataatttaatcccctttgattttacaaatgaatcttgtttgcatttttttattttacactagcacaaataagtatgagaaaggagcaatattgtcattttgaaagaaatggaataatgtaccaacagaatatagagaagatccaaatggaaactcaagtacatataaagaattggtacataaacatttttctactataattaatggtatggaacagaggagcaaataattttttttaaaacaagtgtttctagaaaaaaaatggttaaatgaaatggggcatcaatgaaataaaaaaatagagtaatttttttaaaaaaaactacaaatagtaaagatacagatttaaaatgttatatcacaaaactacaaatttaatactcactccgttccaaaatataagcatttttagttatgaatttggacattgtatgtctagattcatagctaaaaacaatgtctagattcatagctaaaaatggctatattttgggacggaggtagtattacatttataacaaaacaatagatttaagttcaagtatcataaaattatagatttaataaaaatatcttatcacaaaactactggcttcaaatccatttaatcacaaaactataacacttatagccctatatgacatcaatactagagatctgatctataaaatctatagttttatcataacttcgatatatatcaaatcttgtgataaatttagtgttatatgtgatacaatgttttaaatctgtagtttttttatagttcgataaaacgtatatacagttttgtaaaatttactaaaaggaatatatttgcatgatggtttactaaaaagaatatatttgcatgattgtttaaatggtacggaacggtggagcaacgaaatttttttaaaaatatttggataaaattgcaaggtgcatttggtaaaaattggaacggtggagcaacgaaattttaaaaatatttggttaaaattgcaaggtgcctttggtaaataatggtcccggcggggctcgaacccgcgaccttcggctcataagatcaacnnnnnnnnnnnnnnnnnnnnnngaccaaactgggcttaactgaacattacagtttttataaattttgaacaatgtgaccaaatctgaccacttataccgtaggtcttatacagttcttttcccacgtatattttggttttctcgccttgcatactaaatggaattggcacactataaagattcattaacaaaaacaggattttttaaaaaattttactataggacattttaaatttgtagttttcactctagaacaccacatcaaataactcttaggagaacacactttgtcattatgattatttgtcagcagacatcgtacctattaaattagtgtttttgtgcggactagtgagaggggcccattaaatcgccatgcgtgttttgcttaggctaattgcatgtggctcctgttctctttctcctcgtcctcttcatctctcctcctctcttgcttctccagacaaatcaaacaaacaacattgttgaatctcgactaaaaatattatacataattgatgagttgataaaattatatataattgttggttctggagtaataaaaatacattaaaaagggaaaaaagcaatagaaggatgatgatgagggaggcgccgtccaacaccaccggttcgccagccacccaccgacgacagcgtgagcatatgtaactgtggtggcgacgagcaggagcagccgatcggaagtcagggatgataggtgcgagtagctcactccggatcgggtgttagggatggccatcatgattcgccgatgtcaggtcggtcagggcatgagtagatctgatgatagcgtcgtgcggactagccgagccagcggcattgactagtgaggcaaatggattgggggatggtgacttggggaaggccaactggcagagatacttacgatttcgtcccgctcctctgcctaggaccttgagagaggaagaggaagacggggattaaaacgaaaaactttttttagaggcggatgtctttttttattctaaatgcaggatcaatatggccatgccgtgtaaaaaagtagctaggctctctctcgccttgtcaacacgaaagcactaatttaatggatgcagtatagcttgataaataaaccatgaagtcacaaactcgcaatgtcatgtagcaaaaattaacctttttatttatttttaaagtaaaaccggaagttgtcgccgctatgttgatcgcaacgcctttttcggctgaggcaccccgagtcatttactttaacctccaccagtcaccggcccagccacacaacacaatacagtctgcttgcgttttcccgtgatcagtcagaaatttcacgagccggcatgcatgtgcatgcatccacgacggatcgatcatcttccaaccaaccatattatattacctctatatctatatatacacacacacccacactcctccattcacaaagaccaatataaataatccatcgacgccacagcgcagctagcgcccccacaatgcacactaaagctagatcacctgtagcactcgtgcttctcgtcgtcgccatggcggcgtcgccggcgttggtggcggcggcggcgcagcagcagcagctggtgccgtgcatgtacatcttcggcgactcgctggtggacagcggcaacaacaacaacatcctgagcctggcgcgcgccaactaccagccctacgggatcgacttctccggcgcggcgccgccggggcgcttcaccaacggcctcaccgtggtggacatgctcgccgacatgctcggcctccgcccgccgctcatcccggcgtacgccatggcgcagcccggcgacttcgcccgcggcctcaacttcgcctccggggccgccgggatcaggcccgagaccggcaacaacctggtaagggagtagtacgtactgtacagtacggacgtgccaacgttaattcagacatgttgatcatgtagctagtaataattaatgaccacggttcaatattacggaaaccaccaatattttgaggagtaatacaatcggttttggagatgttggaaatttccggacaaaattaattttaaaatttcagcaaaatttgtctgaatttaattaaactaattttgctgaatccaaacttttcaaccgaagagaatgtgctctcggtgtaccgatagacccgaaattcagtctgaattttggccaaaatttaaattttggataaatttgcactatatttttgacaaaaaatgaaatttgagtgaatttaagcaaaatttgaacatattattctgacttgtttcagaaaaaaaattggcaggattttaacagatttgacttgttttaggaaaaaaaagggatattttggcgcaaaaaaaacctacaatgggactagctgatagaaccaaaatttgtttaaattcagccaaaattactcattttcagtttcttcagaaatttcagttctatgggtcaccaaaatatttatgatttccgcgacattaaaccatcttcctcaaagtacatgtggacacgcaccacacgcatgcatgcagggtcggcactacccattctcggagcaggtggagcacttccgggcggcggtgcggcagatggggccgaacgccggctcgccggagcggctcgggcggtgcatcttctacgtcgggatgggcagcaacgactacctcaacaactacttcatgcccaactactacaccaccgcgcagtcctacgacccggccgcctacgccgccgacctcctccaggagtactcccgccagctcgccgccctccacgccctcggcgcccgcaagttcgtcctcgccgccgtcggcgacatcggctgcatcccctacgagctcgcccgcatcagcaacaaccaagacgacgatgacgctgctcctagtagcgattccggcaccggcattagcatctctctcggcggcgtcggtctgaccgtcggcggcggcggcggcggagggagtacgcgagcggcgaacgcgagcaggagcggcggcaatggcggcggcggggcgtgcaacgaggagatcaacagcgcgatcgccatctacaacagggggttgttgtccatggtgaagcggctcaacggcggcggcggcggggggaggatggcgggggcgacggtggtgtacctggacacggtgaggacggggagggcggtggcggcgagcgcggcggcgcacgggttcgaggtgctcgaccgcgggtgctgcggcgtggggcggaacaacgggcagatcacgtgcctgccgatgcagcagccgtgcggcgaccggagcaagtacgtgttctgggacgccttccacccgacggaggcggccaaccggatctacgccgccagggcgttcaactcctccgccgccgccggcgacgcttaccccatcaacgtcagccagctcgccgccatatgaatccaatgattaatctcgctgacatatgatcgatcattgatcaatgcatgcacttacttacggcaagagcagtgtatctcggttggaaagaattaatgttgtacccctcattctctaaatgtttgacgttgtcgacttttttaaatatgtttgacaatacgtcttattcaaaaacttctgtgaaatgtgtaaaactatacctcattccctaaatgtttgacgctattgacttttttaaacatgtttgaccattcgtcttattcaaaaacttttatgaaatatgtaaaactatatgtatacataaaaatatatttaacaatatatcattttcaaatgatatgaaaataattaataattacttaattttttttaataagacgaacggtcaaacatttttaaaaagtcaactgcgtcaaacattttgggatgaagggagtattgtagtagtatataggtattattatcagctattcccatcgttccataatataagggattttggtcggatgtgacacattctagtaatatgaatctgggcggcccagattcgtagtactagaatatgtcacatcccaccaaaatctcttatattatgggacggaggtgctaaagggtttgcgggcgtgaaagcatatatgaactaaatacacaaaataaaataaatgtagacaaacgcactttattaatgacatttttccctgtttacatggaacacgtacatacatcacgctcacgcgcaaaaaaaaaaaacgtctccttaagacggaggtcaacggcaattcaatgatatcactacaatcctattaaaagtatatagtgctacaaataaacccctaatagagactggctaataagcgtcagcttatttaaaaccgatacctattaaccgttttctaactccataggatgtaaaagctggtacgtagtatagtaatggttttttaaaaaactgacacctataaactttatatatatatatattgattaattaaaaaatcggtacttataatatattataggtgccaactcttttaaaaacctgcacctataaaaaccaagccaagttgatcaagccgagctttatcctctccctcctaccacttctccttttcttcgtccccctcccgtctgccactcgccaaatctccccattcctcctctgccgcaacgccacctcccctgccatcgtgctacacctcttccgctcttcctccacctcacctctgccgcctccccgttgtggccgcactccacctccttcctctcctgcatctgtcttcctcacacgtcgccctcttcctgagcctcctccaccatgagcaggagcaacatcgtccaggctcatcgatggagctcggcatggagatggagaagaaggacgcagtcacctcggccatgccggtgcaggtggcgcaggccgggcagcatttgccatcgttcctagcatcatccaggcttaccgattgcctctcttccaccgtcacttcacctctcttccaccactgcctcaccttcacggcctctccgctcacttccgccacctccacacaaccatgagcaggagcaacgccgacaagcttcggtagtgatgagctcaagggcgaccaaagccgccacgagctcaggggagttgacaatgagcaggagcagcgacgatgatgacgaaggtcactgccattggtctccctctccccttctccatggtggccctgctgacggatctgatgatggattggctacaggtgcatgtacaacttagggcattattgatggttcatgtgggatattgttcttgttcatgttggatgtgttgttcatctgttgatatgagatccggagattatttgttgtttatgagttgaactgttgatatgaggaattgggaatcgatatgtgttgatatgtggaaattgggatgtgtttatttcttgatacattgttattaggtggatttaggctagggttggggttgctcgaagtatcggatcgagccgacttcttttcttttggctagtggattccacgtggttgccggttgttaatcgactatctctgtttttttaatacactatgccggaccatgctagctgtgacgggcctaaaccatcacctctgacggattcagcctctcgtcagagattagtggtcagtgatgactctcttcacctttgacaggcgaaggaccgtcagtggtgaccagcccctatgacgggccacgtgtagaacccgtcacaggtaactattatctcaaatggcccattagtttgtgagccgtcagtgatgtctataatccagaaaaaaaagaaaaatagattgcaacccgtcacacgtgtgaaaaaaccctagcaagaaaattggcacacgctgccatggtggtgcttgctgtcattaaactgaccacatcacaaaaacttcaaactgaccaatagttcattgtcctccatcaccgcatcaccatcttatatagcaatcatttacaaaaggggatggcaaaaatttatcatacaacaatatcatatcattcacaaaaggggcacaatggccgatagttcgtcgtcctccatgacgaaccagctacgagagacacaggtggagacgccgcgctcgcagccgccggggaggcggcggaggatctcgaagaggcactccactgctgttgcactaccaaacaaaaatcaagaaacaagaaaccaccattagagcccacattctcaaaccaaacacctcaaatcatcatcatcatcaacaacaacaacaacaacaacaacaacaacaacaacaacaaggagaagatttaagtaaaaaaaaacaacaagaagaagaaacctcaccgaggtggccggtgggtgggcatggaggaggcggtacctggcgttcagatctgcgcatccccggcctcgtggaggtcggatctggcggctagcgcggtcggtggcggagctaagggaggcgttggtggcattggtggccgggaggcggggggaggcgctggcggaggtggaggcgtaggtggcggccggctagcgcgggaggaggcgaaggcgcggctggaggcgtcgccggcagcggcggcggaggtggagaccgctgccgccgtcaggcctcggccgcctcccctccccccctcggcaaaaaccgcgccacggctccagatccgtcgtccgccaccccgcttcccctcgcccctgccggatcgggcggccgagccgccgccgcgcctcccctcccgcccctgtcggatctggcggtcgggccggcgccgccgcgcctcccctcccgcccttgcacaaagaaagagaggggagatagagaagaagtggaagagatagaggagaagtggagaagagggtgccggccgaccttatctcctcctatgggccccgctgggagaggagatatatatatatatatatatagtggcagaagtcatctcaaacgggctaagacttaaagccgtttgaggtgagtaaaccttacctctgacgggccgtccggctgcgatccgtcacaggtaaacccgtcacaagtgactagttacctgtgacgggtcgcagccggatgactcaccgatgacggcatcccgtatgacccgtcaaaggtgacggtcatcagtgaccatttcgtttgcctatcacagttatcccgtcagaggtgtgaggatctggtgtagtgatagtttacaccgttaactttttgttacacgttttaccattcgtcttataaaaaaatttacgtaattataatttattttgttgtgatgccatctattaggaaatggagggagtataacgcatatctatcgcaccatggcccccatcctagtcggaaactaggaagaaattaaaatttactcctcctacgactcctattcggaaactggtaatttgggcatcgaatcaaaccagagcggatagatcgcagagggtttgctcctcgtaacggattgcattgctcgatccctccccggcccctaccaaattcacctccctggccgatagcgccgcaccgcagttatccacctcctccggccggccgccggccagtcgaccagtcgagtcggaggcggagtgcatcgatagatcgatcggtttccatcggaaataatcggagaaggtttcgtttccttcattaacccggatcgatcgggaggaatgcgaggagcgtgcgttgggtacgtgaggctggaggagaggaagaaaacgccgccgccgccgccgcagccggagatgatccccgggcagcatacggtggagataaggaggatgatatacctgacgatcaagctggccacaagcttgctgaaatcaagctcgagcctgcccaagaggtagcaactgcactttggttcactcgtttcttctttaattattagaattgtctttcagtttttattatggtaactagcagattgcgcggcaaacatcattatattttctctcatataatagtatatatgttttctcaatatattattcaaattttttataatgacatcaaaattttaaattttgcaataactttacgaaactacaaatacgtaatattcatattgtattttatatacgtgttagttattaattatttttaatatcaaattttagttatttgtaaattatatatattcctatatgtactctagacttgtcttttttttttaattctgaattttctataaattgtatttctatatagactctaggctcttcttctaatattatttatttttatttctgattttttattatttctaattatatttctacgtggactctaaactcatctctcaatattctttaatttttaattttgaatttcagttacttctaaattgtattcctatattgactttaaactcttcttcccatgtttttcttaattttgaattttagttatttgtaaattgtatttttatatggactcaaaactctacttttaattttgttatgtttattccgaagtttagttagttttaaattcctatatggactctatactctacttctaatattccttatttttaattctgaatttcagttatttcctaattgtatttctatatggactctagtgtcctcttctaatattccttattttttaattccgaatttcaactatttctaaattgtatttctatatggactctagtctcctcttttaatatttcttattttttaattccgaatttcagctatttctaaattgtatttcaatatggactatgatttttctttttcttcgattaatgtgagaatttctaagccatgagagcgaacgtggagactcctttttctattcctttaataatataatagattttgttaatttccttattagaaaaacaatagccttgagccaattaacaaagacaattctaataattaaagtctagctcaaggcctagcacaaagagaagcttagggtagctaggccttgagctagatttgtctactaaactagatagaaccccgcgcgttgtcgtgggattttgtgtacagtaatatattataatcaaataaaaatatactccaaagagaagtctgaaattatagttaaaaactttataaactctgttgtctagtagtactaaattatgaagatgtatatattttcttttctaagaaacatgttcctagatgtgtgtgtctatatatttcaaccgatggtaaggcaaaagaagatatcaaactccaagggtcggtgagtaatgatgggacggtggtactcataacaatagaacggatatgtactttgtcaactaaagctcaatcgttgtcattaaggaggccaggctcttcaatcgccttagttgatttgtggatggcattaaggagggttgttcaatcctacttcatgcatgcatgttgatgaaacgcccggctagcaaaattgtggcatcgaatgcattgagtgcatgatggaaggaataactaaatgcaagctacaaaacgtatcacactcaaaagtaaatctgagctgtccaagataatccaatggtgaatagtgaaatggctttgagataatctggaatgttggatttcaatctaatggctaaaaagaattaaggtgatgtagaagcaccacaagtgagaaaaatactaataactatacttagtggggatcaactatatatattatatagatatagattactattagattctctcaaaactcagtgaaaattttgaaaaagaaattaaaacaaaagatataaacaagttcaaccccccccctatggagatggattcgaatcactccggtggacgtccacagttcccctctactcttgaagatttctttctctgtgcctgatagcctagtttctcaaaattgatactgtactactacctccgttttaggttataagactttctaacattgcccatattcatatagatgttaatgaatctaggcacacatatatgtctagattcattatcatatatatgaatacgggcaatgctagaaagccttataatatgaaacagaggaattactagttagttagtacttggtcattaaaacactattgatatttcagtgcgtggatacatatcagaacaattttgtggtgatactaatgcatgatttcacgaaccatttgggaagccagctcctgaaccccagatgataatttgtcaatggaaaaaatagtgaaccaagttgttagtaataattgttaagtaacaatactaaatactagtactaactacgtgggcattaggcatttcaggttcaattgacttatttaaattatcaggtagctgattgatttctttggtccttcagtgctgaaatttgcatgatatggtttttcccctatgcatgctaactgttgcatgtttcatttctcagatggaattatgcattatgctcctcgagtgttgctctcaagagagaacctaccttccatattacggattactagcacaaagattgtgcctaatcaacaaagtttaccaaaaaaacttcgagaaatgttttgcgaaacaatattcgatgatcgatcgtctcgacacaaataagctggggaatgttgccaactttttcgcgcatttgttggccaccgacgcgcttccatggcatgttttggcctacatccgtttgacagaggaggataccacgtcgtcttcaagaattttcataaaaatactgttccatgagttatcagatcaccttggaattcgccaactcaataagagactgagcgatcctaaaatgaaagattattttgattcaatctttctaatggatcatccgaagaacacaagattctggatcaatttcttcacctccatcggtcttggtggtatcactgagacgctgagagagtaccaatgcctgcaatgcaacaacagaagtcagaatcaagttctgatgagagtggcagaaacccaagtaagagaaggaagatgtaaagagacggatggaagaagagctccatgaaaattcaactgtgcttatgggggatgcaactgtcgtcacaatcggcatcgtcagatttgttcagtgcgattgttttgttggatcaatcttcctctatctgtatccatgtgtaatatcagatgatgtttgttgcttatcgaattcaggaaaccagccatagcagatgttttctgcagtgcaagttttgtgccttcataaacggtttattattgtttataggtttgacaacagtgatgaagaaataattttaaggataaaatgctataacaggcagcagctaagcaggattaaaaatgatgtaccttttttatgtgaaatatgatttacctttttgtagatgaaatattatgatatacattggaaacacacgtaggtttcacttaaggtataaacttttgcaccctcttgttatatttctcgtctacatagataagtggtggaaatgaatggtaagaaaattaaatccagcaggaaaataacatcaaacatgtgtacaaaataacagacaagatttcacagaattcaactttggttgatctagaatcccctttcaggccactcagttgctgctccctgtcagacatggcatcatatgtggcaagtcatggtaaaagcgtggaaacccatctacagccgttgtgcttggcgtctgaccaggaacagccacagaaaatatgccccaatttgcaagcacaaatcacaccgtcttcagtagggcagactatcagtagctcctgctgactttcacactggaaatgagcagcagatcacccacatctgagttcttacaataccaggcgtgaggtcgaaatgcaagcaaaaacttgttgcttttgttgactagtaagatttcattgccgtatgaccgggtgcaggggaattccatgaagaggacgcaaatatcacattcaaatcaactggaccagacacttcatcatgactcgaatgacagagataacataatactactgccaaaaagaaaaaaggaaaagaggatcagtattttcttctaacagtagtcactatataacatgatccgaagtgtcattcatgagcaaatatatatttttgcatattacatttgcatccattcattcacacagaaaaagaagaaaaacagaatggctgagcccaggtttcctcctcctgaaactctgaagatagcattgctgtgccttctcctccccttgttctcaccagccacagcatccatcccttctgctgcatcgacgtcgtcggaccggagctgcatcgccgatgagagggccgcacttctcgccataaaggcaaccttcttcgacccgaacagccgcctcgcatcatggcagggcgaggattgttgcagctggtggggtgtcaggtgcagcaacagaaccggccatgtcatcaagctgagactccgtgggaacacagacgactgtctcagcttctatggagacaaactcagaggtgagatgagctactctttggtcagtttgcagaaattgaggtatctagacttgagttgcaacaacttcaattggtcacagataccggtatttcttggttctcttccaagccttagatatctcaacctttcatatggtttcttctatggaagtgtacccccccagcttggcaacctctccaaacttgcctaccttgatctgacctcttattcatacaaccagctatactcggttgccctttcatggctgtcacacctatcctcactgaagcatctggtcatgaaccatgtgaaccttaccactgcagtagattgggttgatgaaatcaacatgcttcctgctctgaaagtactctacctgaaacagtgtgggctgaggaaaacagttcctttccttcgtcggtccaatatcacggggctcgaagtgcttgacatctcgggaaatagatttcacaccaagattgctcctaactggttttggaatataactagtctctctgctcttgatatccgatcgtgtggtttctttggctcaattccagacgaaataggcaggatggcctctcttgaagaagtctatttccaagggaacaatctcatgtcaaccatgataccctcaagtttcaaaaatctatgcaacctgaaggtgctggatctacgaagtaccaatactacaggggatatcagagaattgatagaaaagttgccaaactgtcactggaacaagctgcaacagttgggtttatcttataataatattggtggaaccctgccaaattggtcagaacctctggccaacttaactgtcttgcttctctccaatactaacatctcaggagctatgccatcgtcgatatgggctctcacaaaactgaacattttggatctttgttccaataagctcaatggcacagtcagggaagatcaattaggaaaccttacaaatctagtgtacttagggttgggcaatacacatctacagattaaagccagctcagattggattcctccattcaaactgcaggtagttctcttctattctttgcagctagggtcagaagtcccaccatggcttagatcacaaacaagcattcaacaccttcaaattgcaaacacaagcattactacaatcccagattggttttggattgtgttttcaagagcagattttttggatgtggcatataatcagataacgggaacgctaccagcaacgttggagtttatggcagcaaaaaccatggatctgtccaacaacagatttactggtatggttccaaaatttccaataaatgtaacatacatgtacttgcaacggaactcattatcaggaccactgccatcagatttcggagccccgttgttacagtcacttactctctatggcaatttaatatcaggcaccattccatcttcactgttctcactggaacacttggaaatattagatctatctggaaataaacttagtggcgaagttccaacttatcaagaagattcaaatccacgcacacgacaactcattgtcgtaaacttaaatagtaacaacctctctggagaattcccattgattttcagaagttgcccgcgcctagtttttcttgatctatcctataatcagttttctggaaatttaccactgtggatgggaaagaagtttctgccaattttatcattgttgcgtctacggtcaaatatgttttcgggacacattcccacagaacttacaaggattgatcaattacagttcttagacctcgctgaaaactacttctctggaagcatacctgactctttggttaacttgagtgcaatggctcgcacatctggatacagtgttcttctagatgaagtcatcgcaactggtcaaggtgcaatgtaagatataaattatttctatgaactggtatcagttcaaacaaaagggcagcaacttgaattttcaagaggaatttcacgtgtggtgaacctcgacttgtcgaagaacaagtttactggagcaatcccttgaggcattggtgctcttgttgcactaaaaagtttgaacttttcttggaacctcataaatggggaaatcccggagactattggtcagctcaaacaactggaatctcttgacctatctcacaatgagctttctggtgaaatcccttcgagcatgcaggatcttaacgctttgggcaccatgaacctctcatacaacaatctatctggaagaattccaagaggaaacactatgggatcatatgacgcgtcttcctacattggaaacattggtctatgtggtcctcctttaactagaaactgttctggaaatgcgacaagcaaagacttacctagaaatcatgttgatttggaacatatatccctttatcttggcatggctattggatttgtcctcagcctctgggtggttctttgtttgctgctgttcaaaactagttggagaaaatcctatttcatgtttgttgatagacagcagaagaagatttatgttagtgtaaaaattagaagtgccgtcttaaagaggaagttaggtgcaaataatcattgatgtatctctagtctctaatatatacaagaatgtagtggttattgtgcggtgttgagtttgcttattaaccaccatgccttgtgttggtggcatcttctatgtataattaatcatttgcatgtatggcttgtaataagataattgtgtgatacacatatgcaatattgttaagttcacaaacttatggtattttatctaagttttggttctcttctatttctataacatgggagtagctatatttatggcgctatatttttcaccaaaaaatagttgtcatgtatttagattgtaagtccctaaattacatgtgtaattttaatgtatttacaatgtaagtcccaaaattacatatataagtccaaaatttacatggtaattatatatttaagtggtgtgtaagtggggtgtaactattgtgtaaatttcatttgatgtatttttatctaaaaatttgtcaccatatttttatagctgctaacgtcttaaaggaaatcaaatgatctagagatcgactgtaaacaagacaaaaatgtggcgacagtggtttagcaaaaccgtaacataatgtggtagcatcttccttgtcatatactcgtaagtcataagtagcaaattattcagtgattaattcagttgattccatgacgccaatctataccttctattttttattactattatttttccccaatttcaagccctacaattgattcagtttgaaattaaaaagatggaaaatgtgtttgtgagacttgtgaaagggggttcgtttcagaaatcttaccggccggcgccgatgcggcagtgctccgcggatgggaggggtttcaggggctagccggcggcgagggggctggccaccttcgggctcggggctccagcctccgccgctcttgctgccgcgagaccgcgagagctttggcatgagcgatggtgtgcgtgtcgtggcgtccgggtcggccgtccgggcggcaggcaaggcgccgtcgcggttttggggggacggcgaccggcggcggctgccggctggagcagtgaagcccgaaccgaaggcatcggctgctgccttgttgggccttttttctgggcttgcggctgtcaatttgggctgactaggggtgtgggctgctaaaagcagagtccgcccctcctcctctcccttcgtagttcccgcatataaagaaactgcattaataatttaacgcgcagattgcgcggtatcgttagcatttttttgtcatataatagcttaaatattttcatattttattattaaattaataacataattntaaattgagtaaaa

SEQ ID NO: 37115 - DNA, 20270 bp, Oryza sativa
ttctcccttcttccttctcttttctcttttatgaaaagacgatgacatggacgatgacgtgtataaggcattttcatcttttcgacaaggaagaaagagaaaaaaaagaaggaagaagggagaaaaaaataaaaatccatgtcatcgtccacgtggcgtgccacgtaggcaagaccacggtcaaacgcggctttggaccggaatgatacaataaaccaagtttagggatctcgatgtgcgcttggcaagttcgtggacctaagtgaaacctgctgacaagtttaaggaccgctagtgcattttactcttttaaattcttggttgaactaaaaatgtgtgatatttttattatattgtatatacatgatagttatttataaattatatctctatatggactcaagaatcatcttttaatattccttactttttaaatttcgaatttcctttatcataaattatattcctatatggattctagactacccttccaatattcatttttcttaactctgaattttagttatttataaattatatctatatatggactctaaactcttctttcaatattttttattttttaatttttaatttcagttattggtaaattgtattcctgtattgactctagacttcttttttccaatatttcttttttttagtttcagtgtatggacgctagacatttttttcccaatattctttatttgttaatttcgaatttcagttatttataaattgtatttctatacggacgctagactcttctcccaatcttttttatttttaattttgattttttgtaattataaattgtatttctatatgaactccaaactctacttttagttttcttattttttagttctaactttcagttagttctaaattcctgtgtgtggatcgtagactcatcttccaatatttctacttttctaattcccaatctgttatttctaattatatttctatatgaactctaaatttatttttcaatattgtgtttttttattttgaatttaagttatttataaattatattcttatatagactctagactctttttttctcatttttttatttcaaattttagttatttataaatcgtattgatatatggactctaggctcttctcctaatcttgattttttaaaattttgaatattagttaattgtaaattgtatttctatatagactctaacttgtacttttaattttcctttttttaattccgaattttaattaattctaaattgtatacttctatggattccagtctactctgtcaatattctttatttttaatttcgaatttcatctatttttaaattatattcctatatgaactctactttttctttttttctgattaatgtaggaatttctaggttgtgagcgcaaacgtggtggcttttttttctattactttaataagataatagattattaatgcagttctaaaaaaaagaaaaaaagcaaccacctaaaatcagtgttctcacatgaaaatcaaccagaaaaccctttagtttcaatctagttgaaaagaattgtttagtccattgaaaatgattcgatttactccctaataggatttcttttccccgccctatagtagtcaattttattttgatccacctgatgttcctcttaatttacactaggtaacttatcttttttttattgttccgttagcaactctccattaaaagtgttataggatgaataatacatttaacgacgtgtgatagacaaaccctaacggtgatggtatttctggaacaaaatcgcttgtaaaataatattccatgaaactcgcgcttatcgataacatttttttgaaattggatgcttgtcaatggtatttcttggattttctctaaaattaattcccaatctttaatcccatatccaatatatttacatacactcttgtaactgaacaaataacccacattggaacatgcattacaagacaatatatatggatgtgtatacaattattcaacaccttgctaagctactcagtagggtaggaaggctgcatggcaaggccacacatacccctcttgtcatcaatgtccttctccatcctcaggtacccggcctcgccccacgtcgtgccccacgagttcttcaccagccaatacttggtgccatcgctcgccgcgccatagccgatcacggtgacgccgtggtctaggctggtgccgcattcgccggccatcacgccgccgccgtagaactggaacttggacgcgtcgacggccaccgacaccggctggccggcgacggccttcatgaggctgggctcgtcgttggccggcacgtcctcgtagcccctgatggacgcggcgacgtccgccgccgccgtggtcttgcaccggccgtcctccgccgtgtacgggtagtttgcctcggctgtgaggccgccgttgctgaggatgaactggaacgcgccgtcaatctcgccgccctcgcagccctggtcgttgccgtcgacgtcgcagtcgaccagctcctgctccgacagcgagatgagcttgccggtgctcagcttgacgaagccctccatcgctgccacggccgagaacgcccagcagcaacctgcacttgtgattaattatggtagataacattatcttcttttaataatcaaagtgagcaacttccggattctgcatcaatcaattaagagtgaattgcaccagcaacgacttcagctctaccaccatgcacttcatctcagcttgagcacctgtaccggtgctgaacctgtgatgatttgctactcttccctccagattggatagggtgactggagtttgggaaactgtcatacttctacctcctcctgatcggtgatagaataacgagaacaggttgggagagaggataatagggctgcctgacttggagaagatgaggtgtggtgtaaagtgaaacaaatggtaaggttatgtggtgcaaagcgaaaatcatggctaagaccctgtccaagctgcaacaaaggtaaaaatacatgacccaaactgcaatttactcatcaattaacgatgaaaaacagccgacgtgccatcatattgttcacaaattaagatgaaagatggattattttttcatgctttgaccttggttatttgtgtactaaaatgaggacaaccaaggaggttatttgtgtacttaaaatgaggggaaatataatgataaccaaggagaaacttgattatcaaataattagaaggaattgtgaccgttttaagaattaaacacgggatgttaatgttcaaaccacataccttaccactacactaccaagtgcatctcggttattttctacttaccacattggccttggtccttgatgcgagtgacggcacctttggtcctccagtccacggacgcaggcaaagcatcggcactaacattctcatacttgaacccagttgataccctaacaccattattaggagtactgaaccccttgctgttggtcatggtcgccttgaactcctcgctggtgagatcggcgaactggttgacgccgagccagtacctgttcttgccaccggcgttgaacgactcgatgaacgcgacgttggccttgaacacctcgagccgccgcgccttctccgcggcgtccttgtacacacggccgtgctgcgccatccacctctcgtgcctcgccgccatggctgcgtcgccgccgagctcacgcgccgccgcgacaatggcgccgccgctgctgctgtagaggcagacgatgcagcagaggatggcaaggagcaatggcttggagatggcgcccatggtgagatcaaccagatcaggatttgtgagttgcttgctgcttaattacagctactactatgtgttttgtactgtgtttggtttgtccaaatggattggatggtatgtggtttatatagtgctgctcctgcaggtgttgagagggacactccagcgtagccgtgaagctaattgatcacaggattattactagtaattaaaaacctgcaattagaacgtacgctagcttctccagtgacttatgaattaaataagaggtttaaaaaaagccggcaaaagagaaaggaattaataatgatcagccgggcgggcagtgcaggtaggctgctgatgaggaattaaaaaacgaaacagacaacatacgacgttatgggttctgcacattagaaatttagaaaatgaacatcataggatactcggattacatgtttaccatccccaaaaagggttgtttgaacatgttacatgtgctcgtactattgagataaaaaaaaatcactgctcaacaacacctctgctttattttccaagctagaaaatgatagtcccaattacaatcagcaagcctaactcgagaattagatgcgtagagaaaggcatcctctaatacagattggaagggcaaacataactaacaacattaatacagattggaagtactacaaaggcaacacagcgaagataagaatcaaacgaataagctattatttactaagccctaaaatcgccggagaaaaataaaagagaccatataatctaacccagccttctgagtggaaagcaacatatttgtttgtctttggatgcttctttgtttgttgggtgtgcatgactgttgttgacatcttgtgaactctgcatttaaatttttgttgtcagaggttgagatctcagaactttgacacaaatgtatagagccaattgcaagcggagaaaatgcatatacagattggtgattctccttttacatctgatttctatagacaattcacaactgataaatacacaaataaaacatcaaggtgaggtgcagtcatgaattagtcatacaaaaggatagtgtttgcaagaaatgggaaactccaaaacagagaagtttttctttgttatttatcatccatttccattacaatatagaccaaatgctgttacaatgtaaacatgagctctaattccttcttagcataaatgcggatgaaagactaaataattggatttcaaaatcagtaattccatgtccgaagttacaggtcaaacatgaagtgagattgggtaactttcaattacattctctatttctgctgcttagtttgccccttctgaataatatgcacatattattcttttttgaacaattatgatttgcaatgatagatgagtcgttcagcaaggctcctttgctcaatgatgcaaagttctgaacttgttccctattgacttcaccaatagttattaaaagaaacatatgaaattggcacaccacttatggtgttctctcatggatggatcaaattgatcttgacatctccaaaatgttcatcagaagtgtgatgcaggaatacacaggaagaaatgtgcagcgtgggtataccataatctccagtaactgctaccatcattatgaaggcataacgatgattatctatatagtgatgttgatctatctctggttctttctatgttagggacggtagaggtgccctttacctatcatatacaaattaatttacacatcatttagatgaataccaaactaacatgaacttatgttgccaaaaaaatcttacatgacaaagtggaggaaacatcacacgattaatgaatataagaggaactatgatattcaccagatatgtgaagtaaaccactatgttacttgccagatgcacatatttgatattggaaagttttgacttgaaaatgtttgtgctcgttactatgcattgttcctcagaaatgttcagacacaagcctccatatttcttaaggaataataacatatcggtttatggttcatttggaagtatgtgattcaattagcataaaatgatttcgatgccacactctcaattagcataacaaattggaatagacttgtacctggtgaattgaatcctttgcttgcttatttctacgataaaaatttggtagtggccgagccttgaagctttcattttgggtttttccctgcacaagagtagcatgtaaggttatacctgatctataataccttttcaatcattatccgttatgatttattatggtctttgagaaggcatcacaatttttacattaatttatggcacctcaacatttggatggtatgtgaaatataacaacaaattaacattgtaaagtatggtatctcgtggtacctcttcaaggatcataaaaatctcgtcttgaaaacatgtagtttataaaagtattatttactagacaacgatggaacttctatttggtatgtccttgatattattttgatgtgattagctggtattttagtatctggcaattcctaccaaaatattaacagcatggaactccctaaaacatatgaaaacagagcagtgcggcagctatatttatcatattgcattcactcagtcaggtactttagtaatttaccttctctttacgtggtgtattggctttctgatgtgccgattgtgaggtaaaaccaaataacttttctttcaccctcgttacatgtgaggacctggtgatgatagaagatgatgcaatcaagtcattcagggaaaccaaaaactccagtatctctttcaagtaaaaaaaagatgaattggcgtactgtatacattgtaatgtcaaaaatgttcatttacatcacacaaggacgtaaattctttcagtataaaagcctaatgttcagatcaatccctagacaactttggtatattcaggctctcacaactctgctgtcgaacgtacctttgttcttccagttgggatgttctcgaggtaatttctggcacatctttgggaaatgcctgaaatgccgtcaaacaaaattagtgcaacgataaaaattaattgaaaacagttatgttcattccatgaattaggcagcttcaaacctctattggtggcttgacttggctcagtgcagaatcagtgtgtttcacaggcccagttgcagattccagctgactaatccttgcagcaattgtggtgccaagattttttgagctcgaggcagcattgcctgtttcgcacctaccaaagttctttgacttctgaaacgcttccaagatggaccgattttgagggaccgaacttgttgcctgctggtcgctttcgttgttaggaggtgagctgttctcctttgcagaatgcaggcgtgaccgtcttttcgccgatgaggtaggccctttgctaccagaggaaggagagctgaatttggccggtttctgaagcagagatggaagccgtcttctctttacagactcggcacttccctgattaacaatggaactctcctgaaaagaacacaacattacagtacagggtggtatgtaaaatgcccaaacatttgattccgctgcacattacgaacaaaatccccacataatttgatgaacagaaatgtcaccttcaatggttgcttgtcgtctgcatcagcaggcacggaattgtcagcacaaggatcgggagtagcagcctcctgcttctccatcgcttgcaacacctctctcgattcaccagcatggacaccatcctgcttgtgatgcgcggctccatccgcatccactccgcaagaggagccaaccccaccatcggcgatgacatccagctcctccatctcttccaccggcccagcagcgacaacgcccgaaccaacgacgcagctcgtcgtctcctccgcggcgggctcgtccgtcatacacgaagaggaggaggagcgcgccgaggagacagcggcggcggcgtcctcgtcagggtcgacgtcactgccggtggcgtcggcgtcggcgtcggtcttgcgcttccgggcgtagtgcgcctcgaagaaggccttcttctgggcgacggagcccgggcgcgactggtgcgccgcctcctcgaggtagcggttgtgggcgaacgccgaccacttcccccactccagcggctcggcgaggaaccgcccgaacgacaccgactcccccagcgccgacatcatctccgccttccagctctaaccccaccattagaaacccaattaatctcaccaaatcgatcgattcgatctctccgacaattcgacgaacaggaggaaggcggggggcggcggcggcgctcacctggtggtcgggggcgaggatctccggctccggcgacagcgcgggctccggcggcggcggcggcggcgagaagtccaggtcggctcccatggcggcgaggctggattggatctgggcttctggggtggtgaaaaaagcttcgctggattggattgccttttcgaaatgtggaaggaggaggggagtatgattgctttggggaagggggggtggtggtcacagcctcacaggcgcagagcgtggtggtgggatttgaattggggggaggaggagaggggtcaggtgtacgttgggaggagctggggttgggtctcgggggcctacgggtgaccgttacacagtgtttgaccctgagacacactgactgcgtagggtcagagggagaaatgtttgtagcggctatagtagattacctttttatttttctttttcggcacatatcataagaccaagtttaactccatcctgtttttttaaaaagataatttgctgtgacaattttttttggcaaaagatttggcattcaagttctgctagctggcgtttaggtggtgtttggatccagggacttaactttagtccctgtctttagacactaatttagagtattaaatatagactacttacaaaactaattacataaatgaaagctaattcgcgagacaaattttttaagcctaattaatccataattagagaatgtttactgtagcatcacataggctaatcatgtattaattaggctcaatagattcgtctcgcgaattagtccaagattatgtatgggttttattaatagtctacgtttaatatttataattagtatccaaacatccgatgtgatagggaaaattttagtcccatctaaacagagccttagatgtagggtaaagttttgccactttactagtaaagaaagagagaacgactcccaacgttttttttttcaaaatttgctaccctaaactcccaaatgacaaatgacaaattgcgctactagtgcttatccatgtagcaaaaagtgcttcaaaacatcaaaacttttgtcattttagaggaactaaacagggctatactccctctgtttttaggttataagacgttttgactttggtccaagttaaattgcttcaagttttaccaagtttgtagaaaaaaataataataatttcaactcaacacaaatttattatgaaaatatattcaattattgatttaatgaaactaatttggtatttataaatattactatatttgtgcataaacttagtcaaatttaaagtattttgactttcaccaaaatcaaaacgttttataatctaaaacggatggagtagtagattttatctttggttttaattagtacgtttttaaacgattaaacattgtaattgttaaaggaaatttaatatatcaaataaatttatttttcaagttgtaactcaattaattattcgctaatgattttcttgttttacgtgcactaacttctttctaatcttaatttgtattaatctatcttaattactacctccatccatgttattcaagctaccttttctaaaatgaaactattttatcacctgtctccttgtctcaaccaatcacaatcattctccttcactaactttctcttctcatccaatcatacactttctccaattatttccacgtactttcttagtacctgtgtcaacctttaaaatacgtacattttttgatggagctagtaattaagatggattaatataaattaagataaagatgaagtcaacacacgtaaaatgagaaaaccattaacgtatgattaattgagctttaattattacaaacttgaaaaatagatgtatttgatattttaaatcaacttctgcattgaatttattttaacactgtccaaagtacattactacactcaactttggtaccctctttaaatactacactacagtactacactgcaatccggagcggctacggctgcgttcgcttctacgactcggatgaagataaagggtacgtttgagaacttctctcctgcatacgcaaaacggagtggctattggcggcagttatatgccaattttatgccgccaatacctgcataaaacataggaaataaaacatctaacatagtggtagtgcttaattctaacatattccacgagtgtgtatatttggatgcaggtaataaaccaccaaaattggaaggaaattcagactatttcatgcaagtgttgggctccaaaagtctatttcaacattggaaaatgggcccaactctcgaagaaatggataaggcaagttgcaaaggagatacaaaccaatttatgggcctgttgggctagaccagggttcggctgaaccaggcctggttcagctgaaccacaatctcagccgttcaggctaaggttcggcgtggtcgctccagatgcactcctgatgacggttacgggcatttcaaacatttcgcgttctgtaaccatcattacctgtctatataaggacatcacttcactcaatttcacacacacttcaagcttgagctgaattataagagactttattgtattttattgtatactagaattagagagagagtagagtagaggaagtcggaggaattataagaggaagtcggaaattctcttcttatttcttttactctgttaattactctgctttaatagaaatactattctgagtaattatgatttattcagtgagatttatctcttggttagttcctaattagcgtgcgggatcattgaccactatgatccagtaaagtatagtggttactttagtgtttagctaacgctgaagtagttattaattgtgtagacatggtgttagagagttaatttctgatggtggtctcgtatcccacaataggtctgagatgggtgtagaggtggtgacagccctcaattacactgaatccctccctgtccaggtatgcactagagcgacatctgggagcagctggctggccagtggctgaagtaccgcgttacgatcaaattgagctatctttgcctatctttgctttgtatcattggacgaatctggtgaagagctgacacacacattccctgtagaaatcgataccttggaatactctcaggtgaactgctacatcggtattttccgtgcgcttgcgtattctatatgtgatgttaagaaataccaaccgtggctcattagcacatgatgagttaagtattagtaaaaaaacttgaaaatagattaatatgattttttaaagtaactatagaatttttttaaaaaacaaagttcgataaatgtgcccgtgaaatacgagagagtagaagtttgtgtaaatgttttatattgaaaaagtttttcaaaaagtcaaataaatatatttttgagctggtaattattaatactcaattaatcttatgcctcgctctcttcagtctattggtacttagattattgcatatatgcttttcaagtcttttttttacataaagctaaaaacagtactttttaagtttataatagttaatactaattaatcatgcgttaattgactttcttatcttgtaagctaaccggctaattgctccaacctcacgaaatccgaatagggccttagctaatttgtgaaaagtttacttttacgtatgagcaaacttcacatacatggtaaagaaggaagggatcttgttaaagtttggcatgaaccgaacttaaaacaacttcttcatttaagcaaatggcccaatagaataatgctaagatataaaaagttcccaatagaaaatttaaaactactgttccaaaatactccaaacttctagaattttgtttctagcacaattcatactactacttgttacaccaatcaccccccatttgaatttcttcctatcttatcccacccatctttccaactccacttatccttatttattgagaggtgctaaagtcttttcttctcaaccttagtctctaataaggagaaaaatttttagaacggatgtagtaaatgctaccctcacatccggagacaacttcaataaggagaaaaattaactaaagtgctcctcgttatagaaaagtagtatgggtggtgatgtacctaaaggtaatgaaatgatagaacttcttgatttatggactgaggttacataagggtatagaaatcaacttattttgaaatttgaactttagaaattaacttgttttgatacgaaaagactaacttcttaaatttgttaatgctttgatgtccgaacgttggatatattccctccatttgaaaaatataagacatcattgtttttcgcatagtcaatattaaaaaaatgtctaataattaaactaaaaacaaaatgcttagtgtcatgcaagtagtatacctagatttgtatttaatactattttcatgcaatattaatattgtagttgttgatacattataaaagaaattaatgatcaaaggccatataaaaaattaatactgcttatattttcaaactgaggagttgctaagtacttagcaaagaaaataaaatactactctcctctcataatataagaattttttagagttaaatggttattaagaaagtaggtaaaattaaatggtggaaggttgtgattggttgagaagggaagatagatggagaaattaaatggtagagacttatgattggttgataagagagtgttggtggaaaaattgttatgttatgggataaattcaaaaggctaaaactcttgttagacttactattacaagtgtagcggtttactagtattccacgtgcaatcgcacccactagttccaatccgattcatcccacgctccccaccgactcaatgcaatccgtaaatcatctacttgttggttgattttgtcgacttgtgtccataagggttagaagaggatctaaaccaccagtttccttatcctaacaagaaacaaactaacagataaattcgttttttgtgtggtcggtacaaaaaacagaatcctaaactaattgagataacccctgagccccactagtgtcgcatatataaagaaagagaaggaaggaggcagacgaccgaactctctctctctctaatctcaaaccctaaattaatcgcccgatcgatctaggcactggaaggggttcgtgaggcatctttagaagaagaagaaagaagaacggcaatggcttcaaacacaggtcagtagatcaattaatttccgcataagcaagaggtgattgttttgtagactaaagcctaagatcctgtaattagaactccaacattgtggtatcagagctgatctttagtccactcaatccctcataatcacatcatccctgtgattagaagccatccttaaaaaggttcaagattgattcggcatgaacaattttgaattagattagattaatttctttaagtcttggttgcatattaagccatgttatactgttggtctcggccaacagtagaagaagcaaagttattgaagaatttaatttcgttgcttagcagtagaatttaagagaagaatgaggattgggataaacgagattgaaattcccaaactctcacactaagaattcccagaccgaagctatggcttcggccagatattagaggggaggattggtcaagtcagatcgaaaatcaccaattaacttttttttaatctactcggcctattgcaaggtctattaatctactgttcttacatgattaagtttttcatcatgaatgagcttcggctagcagtggattaagaagaaaattggggaagacgggataaactagattgaaattcccaaacttttccccaactatttagctcagaaaagaggagtttgggataaacaagattgaaattcccaaaatccacaccttagaaaccctaattcgaagaactctaatttcggttctaagaaccctaagaccaaagcccgaattaaatccaatatagagtcaatttagggtttgatttcgaatgacttaccggaattgaaccccaccggagcctcccgggaagcggcaccgccgcaccttagctcctcgcggtcgtgtcgggttccccgtgcgcagccgtcttggagcttgtctctccacaccatccctcgccagggacgggaagcgtcagcttggcggatgctttcgagctccgccccccccccccgacgagctccggccgcatcgacgctcgccgtcgcttgcgcgccgcctcgccggaccgtcgatgccgtggcacacggcttggcgccaccctacgggtgcgccccccagccggccgagatgaagccgctgcagcgctcgccgccgcacgcgtgcgccgcctcgccggaccgctgctcgctcgctcgccagggtgagagagccgtcgaagagagggaagagaaggggagaagaatgagctagggttagggctcacacccatttccccctggcatgcgatttgttcggcgcgggcaaaatctaagccgtccgtttgatcggacggccgtcctcgcttccgcgtcgggccgtcgccgtaatgggccacgccgatctcggccgcatccgcctgagagtgggccgatcgtgcacataaataggccggtccattttgggctggccttttcaataagagtgggccttttattttaatttattattaagcccgtgaatttaattttctcaaaatgtatttagcctgtttttatgggccggcttaggaagtgatgggccgcattattattttaagcccgccatttatgtcttatttatttccagaaatttatttatgagttttcttagccatttaaattgctggaaaattatggtcaattatttgatcacttagaaaattatttctagttaaatggaaccaacgggatgtttagctagaaagaaattaatggtatgatataatatttgaccaacgttaatataatttcatgtcaatatttattaagaatattatttccttaagccacttaatttatttttagttgaatggaaatttaactagaaagtatttatgatttcatgtcaacatcattatgatggtcatttccttagtatattaattatttatagttgaatggaaccaacgaaaatatcgtctagaaagcattaagatgtgaagttatatttaacccacgttattataattgcatgtcaattataatttttattccttagttattttctaccaaatggtgatataattaaggaattaattttaagattacataatcatttatgaccaatggtgctttgactatgaaattgtaagtttattttgcatatgattgattaagccatggtaaactaattatatgcaattagcaatgcttattatttaagattagttgcaatactgagtaaattatttctagattaatggaaccaacgggaagtttatctagaaagaaagatgatttaattaagattgttatttccttaattatttatgcccaacggtgatgtaattaaggaaacatctaagtattgtcaatcattattttcattttctttgtcattttggccttaacggtgatatgacttagaattttacttatgccattagtgcattatttcctttatcacttttaccttacagtgatgtgatcaaggatctctaattcgtcactaagcttaattcctttaccatttctgcccaacggtgatatggctaaggatcttaatttcatgtcatttactaatggcattatgccctatatgatatctacctacttttggtaatttgatttaggattttaatttccgtaattcattattctttgccatttcataatcttttctaccctatggtgtttgattatgaaaattaagattcatttgtatgtgattaattaagccaatggaaattaattgcatgcattactaatgtttaattaataattaatttttcagcattaggacagcttaaggctattcagcttcttgatggatcaaattacgttgaatggagaaataatgtgcttattaacttagccatgttggattatgacttagccataagagaggatcctcccgaggaacctcaaccagccgaagaactcaatataattggggaagaatatgataatctcatgtgggcctacaataagaagttagccaactgggagaagtccaacagaatgtgcttaatttatgtcaaggatgccatctctccagaagttattggaggaatcattgactctaatgacattaagacgtatctggcaaacattgaagaaagttttgaatttgcacctgaggctcatgccaatacgcttgtaaatgagatgatcactagtcattacgatggcgaaagtggtataaggaagcacatccttgaaatgactcatatggcaaatcaactcagatccatggatatgaaaatatctgatggatttttagtgcacatcatcatgagatctcttggtcctaactatgatccattaaaaaaatatataacactcagaaagaggagtggaccatacaagaattgatcttacactccgtggaagaggaagagcgccagaaagctgaaaagcagaagattaaagaccggctcaacctcactaatgcctttgataaaggcaaaaaggtctatcaaggggaatcctctaataagaatagcgagccagagggtgagcagaatcaagaagggatcaaggcctccacttcagctgttccttttaagtacaagtccctactgccacttctgtgcgtcagatggacattggcagagaaattgcacacgcttcacagcgtggttagtcaagaaaggtataaatgaaattaaataaatcccttatgatgaattttcccttaatacttagtgagtttaactcaatgccattgtgcatgtttctaactcattacaggaaactcgcaccatccaaacggtagcaaagaggggagtgaacactcagagtaactgatggagtgaagatgaaagtgaagggttgttggagacctcacacttagtttctccagcagttgcaataatgtctcatttgttcactctattaagagaaactctactagtttaattatttaaagtcatgtgagaaacgggtcatgtccgttatttttttccaaatagaacatgatatattaagtgtgataataaagtgattggtcttgtccttgtgcacgacagtcatatttgttcttttggatgatcatgtgactattataataattgcctgtaatgacaaaagatgagacgtcattgaaattgtgacattgtaattgatgtcacatttctagggggaggttagaacgtctcataagttggagatattctttcccttggattgattttagtgatgttatttaagctttaagggaagattcactaagttaagaatttagccaataaattacttttggcgatgtttacccataaggctatgtttactcataagcaacctctaatttcctttaagaaatttaagatttaagatactaatgctaaaatcaaatgaagttatgagatcggattatggtggtaaacactaaataaagcgtgttcacccgatgaagacattaaaaataagcgttcatccaaatggtttccgaaccatgtaagaataaattgagattgatgaacaaaataagacattgaagtgttcatctaaatggttttcgaaccatgtaataaagaatttagtagaagtttctaaatgagtcaaaaataggctatttaagtgggttaataaaattaagcctgactctaatggaaatttcgaacaattcaagtgaggtggacagctgcatgaaaattaaaggtgggaatttcattcaccggtactctgtactaatgacattttattgtcaagcaatccatattgctgttagaaactaaggaaatttttccatgaattattttggtctaaaggagtactgggcttatatcagtaagtcatacattgacataaattaaagaaataatttgagagaattcagttaaagttagtaaagctgagattaaattctaaagttagactcagctgacagaagcttgagattagctcaaatctggatgcatacagatttgacatacattttgctgggaatcttggcagtattaattaaatccagactagttcactggtattaagaatgttttgtattatttgcaaggcaatatcaagtaacatgctcatatttctaaagtccaatgaccttagaagttcagagacatttggacactttattttgtgagatgtgtggatatttataaagattattaagttaactaagattaagctatgtccacacataggggagcaataaccatggaaaagctccaaaataatctcttactgcatagtcgatgatgtagttagattttaaagcatgttatgattaatcataagaatatttcctagaactaagagtggtaaatagtgctcataaaccactcaaaaggtgtaaaccacccaaaatatactgtgttataagttgtgcactaattaaacacagttttctattctagtagcaatgtgttgtgtgttttctgcctaacacattgatatggttgtgaaagacatgtcccaggatcgaattattaagctaagaatttgctaatggatccataatctaaaggctcataaaattaagattaattaagattatgttctggccagtacatatgtaaattagagccttactcagatcctggatgagggggactaaattttcaatcaacatccactaaattaagcttgagtttatttgagtactatagtgagctataggtcttgttgtttcagtgacgcataatgttgttgaagacacattgccttggggagctattttatttaatagactcgtaagtaagtctcaaaatctaggggagaatgttggttgattttgtcgacttgtgtcgataagggttaggagaggatctaaaccaccggtttccttatcctaacaagaaacaaactaagagataaattcgttttttgtgtgattggtacaaaaaaatagaatcctaaactaattgagatgaagaaagagaaggaaggaggcagacgaccgaactctctctctttgatctcaaaccctaaattaatcgcccgaccgatctaggcactggaaggggttcgtgaggcatctctagaagaataagaaagaagaacggcaatgacttcaaacacaggtcagtagatcaattaatttccgcataagcaagaggtgattgttttgtagagtaaagcctaagatcctgtaattagaactccaacattattatctatagaaccagctattctagaaatgaaccgcccactctcaccattattcatctctctccccgtgtttttttggatcttaccaaatcgagcggctccaagagttggccaaatctatgccatctgttatttcctatggttgagatcatgatgaaccctaagctcctctggagatactcaaagctgttattggcccaatctttcggtgagttgatgataactacgatttgggagaaacgttgacgacccaactacaaccgtactagatgttgttgtgttgcaccttagcgatcgatacatgtcacgccccgaactagtcccgaccggatctagcccgtgacgctccaaattaacctgttaatcgataccagtcccaggaaacagtgctggtatcacaaggagacagagtatcacagcaacagaggtctctttattatagagtagaagtacagtcatgttgggctgcggacagatcccgagctcacaactgcattacaaaaggaaagcggaagccaggacttggaccaatcatcacaggcgcgacttgggaactaggccgaaaccctaaaactcatcgtagccgacttgctcctggaagaactcctcgtcagcaggatccacttcatcttcttcagcaactagggggggattatttatatagagcaagggtgagtacgggagtactcagcaagccaggggaaataagtgtttaatgcaggcttcaaggaaaggctgttgttttcgtaattgattttgtttgaactcttttctaaaaagtctaagtgagtgcttctcaaacgacacggatgagacagtgcgtctcgtccggtcggagtatgtgcaatgtatcagtctttagatcttgaaacagggttggcacccggccaacagc

SEQ ID NO: 37116 - DNA, 325 bp, Oryza sativa
aaatgatttagaagagcaagctaacaaattgtacttacagctaaacgatgaccaaaagaaagcatttcatcttatagtaaatagtgtaataaataaagaaagtaattttttctttgtatctggccatggaggaactggcaaaacatttttatggaatactattgtatcatttttgagagctaaaaaagaaattgttctaacagtcgcatcgtctggagtagcatcattattactaccaaatggtcgaatagcccattcaagatttcgaataccagttgatatagatgaactatcattatgtgatattaaacgtggaacaaaatta

SEQ ID NO: 37117 - DNA, 1065 bp, Oryza sativa
  unsure (1)..(1065): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccaccgtgctgatcggcatgagctcaccggaggggccgtcgaccagctgggcttcgtccgtgatctccggcgaggcggcgaacgccgacgtgttcgcggcgacgaactgctccagcatccgctgcacgcagtcgacgtcgtagagcgtctcgacggcgtagccggtgttggggatcaggaggtcctccagcgccgcctcctcgagctggttcccggccatcctctccagcgcgtcgcggcacgccgcgccggcgttcaggatcgtggcggtgcggaggagcccgagcaggaacctcgtcgtggcgacgcccctctcgacggggagcagcgcgacgatctcctccaggagcgccctctgctccacgtccgagagcacggtccccgacgcgccgccgccgccgacgtaaccggagtggcgggtcagaccggagaggtggcgcttggcgtagtgcgtcagcgagccggcgatgttctcggggctcatgcccttggacctcatcgccgtgatgagcctcttgtacaccggcagcttcagcgacgacgcctgcttgtaccaccagtccgggcccggcgacctcggcttgccggcggtggcgatgccgtccacatcaccgtcttctcgaggcccctcgccgtgtagtactccaccatcgggcaacccaagagggtcgggtcggcgcaagccttgctcgccagcgcgttgatgcaacgcggaacgacaggagctcctcgcgagcgggaggagcgcgccggtcgaacgaccgcagcgcgcgc

SEQ ID NO: 37118 - DNA, 680 bp, Oryza sativa
agcctctccatttccttctgcaatcacaataatgcaacttatatctctatgctcactattcaggcataaaaaaaatcaaaacaggaaaacaccaaatgtctgagatgtatgagttcatgtcatattgcatgctgtttcaggcataaaagaatcaaaacaggaaaagagttgatgtcatattacatgctgtttcaccaagtaggttgtcttaaaagaagatacttggatctacaacatatccattttgcagacagaacaatcattgacagttcgtaagtgaagcaatcataacaaatgaaacaggggggagagcagcatcccacaaaacagggaattaaatcataacaaaggcccagtaaagctgaatgaaaacaatatcatgcaacagcgcattgcacacaccctcaacttaacaagggccacaagcatgagttaagagatagtgcctcaaatttatcacttgatgtcatactatctactgcttcctcaagtatgttctccctgaatcagggacttgaatccacagaatatatattttgcagacatgatcatcgttgataacaactagaaaaggcacaaaactcagggcatggctctttgataggatacatgatgagcacaacaagacttccctatgactaaaaaattcaacagaatatcaaatgcatcagatttatctg

SEQ ID NO: 37119 - DNA, 3814 bp, Oryza sativa
  unsure (1)..(3814): unsure at all n locations
nnnnnnnnnnnnnnnnnnnnnnnnnnnnnnnnnnnnnnnnnnnnnnnnnnnnnncagtttaaatttgaaccaacgggagaattttcacagagagagaattacagagattttgctactgttcatatgattttatatagtcttccgctgcaaatagatgaaattgatgaaaattagtgtttctaaaattaaatttcgaaccaacgggagaatttaattttaggaacattaattatgtgctatgatgttgtaattttctgaccaacgttgttaattgcaatattatagttatggttatatgtgttatgtctaattctgcccaacggtgatgtaggcttaatgcataatattttaatgttaattttgttctcaccgcacatgattatttcaggtggctactccttgatgggttgcattaaagatattccgaccctaaaaggagataactacgcagaatggaaaagaaaactcgaccttgcttttatcttgggagaggtggactgggtattgactaccccatgtcctatagaacctgctgaccttgtcagaggtgaaaatgagtcagatgctgactggcaaaagagacagagggacaatgctcctctcgtcatgtcgtatgacattgaacaaaagaaatggtccttagccaacaagaaatgtttggctgtggtaaagaatacaattgagcctaccatattgggctcgatcccagagtgtgacgctgtctcagagtaccttgaaagaataaagagtcagtttactggctcttcaaagacttatgctacacagctgatcaagcagcttgtgacagaaaggtaccatggaggtggtgttagagaccacatacttagaatgagcaacatggcttccaaattgaagccaatggatttgggcataacagatgactttctggtccatctggttatggcctcattgccaaagcagtttgacaattttattgtcaactacaacataagtccagagaaatggaactttgagaagctcattgctaattgtgtgcaagaggaggagagaatcaaagaatcaaatggtggttcaataaactatgttaaagataagaaaaagaaccacaagtctcccacctcaaaaggtaaacagtctcagcatctgcctcaacaacaacagttcgctgttgagaaagatcaatgtctccactgcaagaagacaggacactacaagaaagattgtcctgactttttgaaaatgatcatggcaaagaaaggtgagaacattattacatttgtaaatgaatctcattatgttggttactctagatccacatggtggattgattctggagcaactattcatgcttgtaattgtttaaaggcattccgttcgacgaggactacgcaaagaagagaaagcaccattagagttgccaatggagttgaagaaaaagttgaagctgttggagatcttcctctagagctcgcgaatggcttcatacttttacttcgagatgtcttttatgttccttctttgcaaaggaacttaataagtgtatcaaagttggattttgatggatatgattgccgctttggaagtggcaaatgtgaactatggcataataatgcatgtattggtcttgctgtgttgcgagacgagctttatttgttatctctttctgagaatgtgaatgttgtgtcctcgttgacaaaagaaaacaagaaaagaaagcgaactcccgatgtctcatcgaaattatggcactgtcgtttgggccatatttcgagggggagaattgagagactagttaagaatgaaattcttcctccattggagttctcagacttagaacaatgcatagaatgcattaaaggaaaatttgtaaagagcatcaaaaagggtgcaaaacgaagcgcaggaattttagagatcattcatacagatatttgtggtccatttcctgtgaaaagtgtggatggctatgactcgttcataacattcacagatgattactcccgctatggttatatttatccaattaaagagcgatcagaagcactggataaatttaagatattcaaagctgaagttgaaaatcagcatgatataaagattaaagtagtaagatctgaccgtgggggggagtactatggtcgacatacgccttatgggcaagtccctggaccttttgcaaggttcttgctagagaatggaatagtagcccagtattcaacaccgggcgaacctcaacagaatggggtagcagaaaggcgcaaccgtacgcttatggatatggtgcgcagcatgatgagctactccacactaccactcggtttatggatggaggcgttaaaaaccaccattcatattctcaacagagttccaagcaaatcggtgcccaaaacaccgtatgagctatggacagggagagtaccctcgctaactcacctccgtgtgtgggggagtcctgcagaggccaaagtatttaacccaaatattgggaagttggaccccaaaacagtcagttgccattttattggctatcctgaaagatcaaaaggctatcgtttctactgtccaaacagttatacaaagtttgtagaaacgagacacgccgtcttcttggaagacgaaatgattagggggagctcggtagtttgagaaattgatcttgaggagaggcgggtgtctgtacctgctccgtcgactcaggaacctttcttctctctacctgctgatgttgtgcctgcaatgcctgtcattgaggtaccagcactgacggagctcgtggctcctcaccgggagaccgcgcaggcccccctttgccagttcggccgggggcttagggtgaaatctcaagctctcgctctccctctgtatctggaaagatcgtctgcccgcaagacacacgagacacggcgatgtatacaggttcgggccgctgcgaagcgtaataccctactcctgtgtttttgtggatttgtgtatgaatgagctacaaagtgtgagccaacttctcccccgttctaagctctaaatctggaaaagaataaaaaaaaacccccctctctatgggcaaggtcctccttttatacttcaaggggataccacatgcacccttccctttccaaactggacttttcttctctttatggacggagattggtatggttgctgtccgaatgacactccgatgggacagcccacacctacctccactcccggcggagacaggcgcaacgtgggatcgtggctgcccgttgctgacgcgaccagtgccagaccggtcattcttgtccaccacgcgtcagtttaacaacatgcatgtttgcccttccttgtgtaacaccttgcctgtaatggttaggatgaagcctggtatatatcgatcggggttaacgtgccatctctgggatgtaacacgctagctccagctggggacgagtgcttagaagctcacaccttgacgggatggggtaaggcgtgcgtcagaccgccagtcgccacctaacccgtgatctgaccggtctgtgactggtcacagaccggataaaggaacgcgccgtactgcgctgcatgcagcgtgacacgcttgaccagactgcaataaatgctgttaggtgagcacagctgtgctcacttatcccatatatgtggcgcagacttccttaagggggtcggggtgcctcggccctcggggccggggcaagcgcaacccgaccccccctcgggggaaatcaggaggagggcggacacctaaccctcgggcccgacgttcccgaaggtgccaggcccacgtgggcgattgtgtctgcctaaacctctagtcatgatactcccggtccca

SEQ ID NO: 37120 - DNA, 8730 bp, Oryza sativa
cccgggttcgccaagcggaggaagctgctcgggaggagcccgccgggctcgccaagccgaagaagctgcccaggaggagcccgcccgggctcgccaggctgaggcgacagctgctgctggcgcgtcacttgggcctactccctcgggcggccctcaggcgacatcctctgaggcggctcgcgacgaggccgcgggcgcatcgcctgggcctacctcaccgggcgacgcccaggaccaaacgggcccgggggacatccccgagcccagcgcatcctccggggggccaagccgcgtcgccttttctccaaggcggctcttctcctcatcttctgtcgccccgctgagcgccgagccccttctgcaggccctggccgccgcaaacaccgcagtgctggatgggttcaacacccaagtggaggccctgcgtgcagaacgagcggagctcgaggccgcatgggcgcgtgttgaggaggggcggcgctcggtggacgccatggtggaggtgggccgtaaggctcaccgccgtcatgtctcggagcttgaagcccggaaagcggcgctggcggagatcgcccgtgaggtggaggaggagcgggcggccgccctcatctctaccaccgcgatgatcgaggcgcaagacactctccgccttcagcacgcaagctgggaggcggagctgaagaaaaagctcgacgccgcccaaggggtccttgactccgccgctgcccgagagcggcgggtaacggagactgaagcggcgtttcggcggcgcgaggaggcccttgaggcccgtgccatggcgctggaagaacacgccggcgccgtggagaggggcttgacggaccgcgaggccgccgctggtctccgagaggcgacgctgccggcgcatgaggccgcctgcgccgaggaggagtgcgcgctccgcctccgcgaggacgcactcgctgagcgggagcgagctctcgaggaggctgaggccacgaccaaacggctggcggacagcctgtcccttcgcgaggcggcgcaggaggagcaggcgcgccgcaatctcgaatgcgtccgcgccgagagagccgcactggagcagcgggctgctgacctcgaggcgcgggaaaaggagctggacgcaagggcgcctatcggcggggcggccgcgggcgaaagcgacttagccgcccgcctcgcagctgccgaacacaccgtcgcggaaatgcagcgagcgctggactcctccaccggggaggccgaggcccttcgcttggcgggcgagattgggcccgacatgctttgggatgcggtctcccgcatgaagcgcgccggtcggcaagcaggcctctggaaaggccagacgacggtgccccccaccaatctggaaggcctcgctccgcacctcaacaggatggcctgggtcctcgaacgactccccgaggagctcgagaagaccatcaagtcatcctcgagggacctcgcccggggggcggttgaactcgtgctagcgagttaccaggcccgggaccccaatttctctccctggatggcgctggaggagttccctcccgggaccgaggacgacgcgcgcgcgcgcgtcggggatgctgctgaccacatcgtcaacggcttcgagggctcggcccctcggctcgcgttcgcccccagctccgacgaggagggcgacgccagcggcgaggacgacggtggcgacgaggccggcgacccgggcgcatttgaatgagcccccaggcccccgccaatcttaacttttttcttgttctttcttctaaggccttcatgcctcttttttgtacaatttaacttaatctgcaatgagaaatgatgaaaaaatttttgtgttagttttattttgctatatatgagatgaggatgatctgtgccgtggtctttttgcgtcttagcttgaaataagggcccgtgcccaagtcccagtcctcgaaaagcgcgggtcggggctagtgcctggggagatccgcatgtcgagactggccaggccgggaacgtggtgaccgagggttatgggtgacccgattgtgggtttttgccgattcccccccggagttcaccacgccccggggcacggctcggttctgggccccgtttggcgattttagctgaccgaaccgagcccccgagggcaaggttgagcacgagtgacattatttcaagtcaagattcttcaaaaggaaaaaacggcacagacacaacctttagaaaattgaaactgcttttattgaaatgctgaaataaaggaaaaagggatatatgtgcatgtgtggtagcccccggccaatcctgcacacccgaggggggtgcggggttggcccgagccaaaacctgacacccgaccccccccctttcaggggtagaagcgacgaaggtgttcgatgttccacgggtttggcagctccgtgccgtcgcccgtggccagccgtaccgagcccggccgggggacaccgatcactcgatacggaccctcccacattggtgagagcttgctcaatccagcacgcgtttggacgcggcgtaggacgaggtcgtcgacgcagagtgatcgggcccggacgtggcgctgatggtagcgccgcaggctctgctggtagcgcgcagctcggagggccgcgcgccgccttcgttcttccaagtagtcgaggtcatctctacgaagctgatcttgatcagcctcgcagtacatggtggcccgaggagacctcagggtgagctcagatgggagaaccgcttctgcgccgtagacgaggaagaaaggcgtttccccggtcgctcggcttggtgtggttcggttcgcccagagcaccgctggcaactcctcgatccatgaatcgccgtgcttcttgagaatgttgaaggtcttggttttgaggcctttaaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgacagtggtatgatctgcagggcctgggccggctgatggatttgcttggcgtgaaactgacacgctctgcatcgccggaccagatcgactgcgtcattgagagctgtcggccaataaaatccttgacgaaaggccttgccaaccagggtacgcgaggcggaatgggctccgcactcgccctcatggatgtcagcaagaagctcaacgccttgttcctgaggaatgcacttcaggaggattccgttagccgcgcgccgatagagggtcccttctaccaacacgtagcgtttggaaatgcgttgtacgcgttcactcccttcgcggtcctcaggtagagtcttatctgcgaggtatgtttggatctcagagatccaagcaatcaatctaaaggagcttggagcgctcccttcgggtcccgaggcctggactccgacgggcctcgggggccggtcaggcgcatccgtctcccctaaggggtcgggtcgcgccgacggctgagtaagcctttcttcaaaggcgcccggtggggtctgggctcgcgaggacgcgagccttgagagttcatcggcaatcatattatcccgtctgggcacatgccgaagctctatcccgtcaaaatggcgctccatacgccgtacttggcgcacgtaggcgtccatctgcggatcagagcaccggtactccttacagacttggttaacaaccagctgagagtcacctaacaccaggaggcggcggatccccagcccggccgccactctgagtccggcaaggagtccctcgtactctgccatattattggtcgctcgaaagtcgagacggaccaagtatctgaggacgtctccgttcggagaggtcaacgtgacccctgcaccggcgccctggagagacaaagaaccgtcgaactgcatcacccagtgggcggtgtgaggcagctgagaggggttcgtgctggcctcgggtattgagacagtctctggagccggggtccactctgccacaaaatcggcgagggcctggctcttgatagcgtggcgtggttcaaagtgcagatcgaactcagaaagctcgattgcccattttaccactcgtcctgtaccctctcgattatgcaagatttgaccgagggggtaagacgtaaccacagcgatccgatgcgcctggaaataatggcgcagtttcctcgaggccatcagaatagcgtaaagcatcttctgggcctgtgggtatcgggtcttggcgtcccggagggcctcactaacaaagtagacaggggcgttcttcgtccgagtggcccctcggggcgttcttcgtccgagtggcccctcggggcgttcttcgtccgagtggcccctcggggcgcactcgtcttctgtgccgatgacctcggggtcggaggacgacaggagcggccttcccacagtggcctcggggccgtcctgggggtcgggggctcctggcgtcatcggacaagcgggcaaagggccaactccggtcgtcaggggccttaggccaccgttcggctcgggggcctcttctccctgctctctcccgggtcgaatcggtacagggttagcctcggggtcagagggcgataggtgcggcctccccgcagtggcctcggggccttcctgagggtcgggggcgcccagcaccgtctgacgagcggggagagggccgactccggtcgtcaggggccttaggccaccgttcggctcgggggcctctcctccctgcttgctcccgggccaagtcagcacagggtgggggtgcgcggaatgaggattgtcttcatcgcgctccacagccaacgctgcactaactacttggggggtcgccgctaagtaaagtagcaggggctcatttggctccggggcgactagaaccgggggagagctgagatatgcctttaactgagtaagggcatgttcagcttcctccgtccaagtgaacggccccgagcgcttgaggagcttaaacaagggaagcgccttctctcccagccttgatatgaaacgacttagggcggccatgcaaccagtgacgcactgcacatccctaagtttgctgggggggcggatccgctctatagctcgtatcttctcggggttggcctcaatgcctcgggcagagaccaaaaacccgagaagcttgcccgcaggtacaccaaacacgcacttatcggggttcagttttatgcgggcggagcggaggttctcaaaagtttccgctagatctgagagtaaggtctcttggttgcgcgtttttacaaccaagtcatcgacatacgcctcaacattacgtcctatttggctacccaaagaaattcgagtagtacgctgaaaagtaggacctgcattctttaacccgaagggcattgatgtataacaataggttcctacgggggtaatgaacgcagttttttcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccggatggatgacctcacggatgaacccggcctccaaaagtctagccacctcctcgcggatgaaggcttgacgttccggggcttgccgccgcactttctgccggaccggccttgcgcccggccgcacggcgagacggtgctcaatcacctccctggggaccccgggcatatccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggccatccgctgcctcggggcggtgggggcagaggggccaagcctctcgtcaccaccctcgggcttggacgcagcagcgaggcggtccgcgcgctgctccatgcaagcaagcgcgactttaaggtcgccacggacagagatggggccaccggggcccggcatcttcatctggaggtaggcgtagtggaccgccgccatgaacttcaccaacgcgggtctccctaggaccgcgttgtagggcagactgaggtccgccacatcgaagctcacccgctccgtgcggaagttggcgggtccaccgaaggtgaccggtaggtcgatgtgacctaatggccacgtgtgccccggcgtcacaccgatgatcggttgagacggctggagcaccatccccggggccttgatagcatcaaaggccgcgggggaaaggatgttgagagccgctcctccatctatgaggacacgtcccaacttcacgttgcagatggtgggggaaaccgccatcgcaacctgccctccccgggcaatgcacggtgggtggtcggtctggtcgaaagtgagagcaacctccgaccaccgcgcccgacgcatcgcctcatgggtaggggccatggccagaagctctcgcttcatagccttgaagctccggcgagagacgtgagcacatgctcctccatcgacggtggcaatggtggccccaggttcttggaaacctaggtcatcatcaccatcatcgatgtcaacagcgggggccttctgcttggcctcacttcgccgtttgccggaaggaaccgccggggacttgccctcacggcgttcctgcctcctgtcctcctcccatttcctcgttcgctcggccaggtttttgaccgcacgacagtccgcgagatcatggagggaggtgttgtggacagagcaccacctgccggcgaggcgctccctgctgggtgtaccagcctcgttctttttgtcgctcgcaggcctcccctttcgagtggcccgcggagcgccctcgacggcgaggacatgaccctcgtcgccggaacggtccggcctcttcttcctcctcctgtcacgccgccctgtctgagcggcggatccgggggcggccgaagctgccactccggaaccggaggagttccaggtccaggcctcctccttacgagccactcggtccgcgagctgaaaaagctctgcggtagtctgggactctttggaggcaatcttttcgagcatgcggttgtgccgcacaccccccctgaacgcgtagatcaccgcgtgtgcagggatgcatggtatagtattgcggacttggcaaaaccgctgaatgtacgagcgaagcgactcatcatcgcctcgctgtactgcatgcaagtccgcttcttcgcctgggcgcggatatgtgccttggaagttcatggtgaactgttggcacaaatcttcccaggagtggaccgacgcgggtggcaggttcattagccaaccccgcgcctgtccttttagggccatgggaaagaagttcgccatgaccctgtcgtcacccccagcggcctcgatcccggtcgtatagacctggagaaactcggtggggttgacgctcccatcgtacttctcggtgatggtgggccggaaccttgggggccaacggacattccgaagactcgccacaaaggctctacagccaacaccaccggccgggggcacggagggctgatcttcacgtccgtgtcgaggtgacactctggacgaggaggcgccctccgttgcacggggagtacgccggctattacgccggcgctcgatgttgaggctggcatgcctgctgcccatgctgatcctccccgagtcgacggtgtcgacgagggagtggcagccgaatgacgtgcagccgccgccgctcgccgcgccctccgccttgatgacacggagccggtggtagcggcgccggaggtcttggtggtggcggaccgtccaccagcacccaggcgctgctgtgccgtcatgaccaagttggccacgtcttccagccatcgttgggctggagactccgggtcatggacgacaggcgggtgtcgtaggagcgcgccagcagcctgaagcgcaccctgaggcgtgctgccgtcgccgtagacgaggaggcgacgctccccatctcgccgttctcctgcatcacctgcgactggtgatgccacggatttgtcgaccctctcaagcgcctccccctgcttagggctttggcgcggaggaggtgggggagtacgagctcgacggcgtggattcggctccccgtcgtcgccgctcacactcggagagaggtcgtgcgcttttccttgctcggccattaggctgaacaagaaaaacttggcgcacacggaagagtctgagagctcagaaaacacacgctgagccccctacctggcgcgccagatgacggagctcgtggctcctcaccgggagaccgcgcaggcccccctttgccagttcggccgggggcttagggtgaaatctcaagctctcgctctccctctgtatctggaaag

SEQ ID NO: 37121 - DNA, 3106 bp, Oryza sativa
gagggggtgaggacagtcatgtacctcagctgctggggtcccaattagctaggccattagtgttagctcggatggatctcgatctgctctgctgggtgtccgtttgacggtagcagccatggccggagacgtaattggccggttgctcccagctgatcgtaatatatcacgatgatgatgaaaaattctgctacttgagtacaattgcttcatgggtcattttgcctttgtgattgtgtcgtctagaacaatttatgaactgaccacttttacggtcatgcacgcaaaaatccggccgtgtcatcaatttaagatccaaactttctgggagaaaggtgttctgttcttttgatactgcaccgtaaaatttatgatcgaaatgatggaagaaatggtagcaatctagtttgtacttaatacttaccacttgttactgaatgatagtcagatctgtaattcaattcaatttggtatggaatttttttaagagaatggaaagattctcaacctttgcttaaaagagctacagccgctctacataattcactgaatggagagcataaaaaacattaaagatctaaacaataactaattgtccctaactaataataccaacataaaatatagaagcatttattcaagtttatttgtaaatctccatccgaatatagtaaaaatgtgtatgaccattgtctctagcttacggcatgcaatatatataagtattgtggaatgcacgaacgagaaaacatagatataacaaaaatcgataaatgcaataacaaaacatatgattgtaaaacaagaagaagaaaaaaaattagagaaataaccgtttgatgtaacgtgaaaaaagttcacataaatgttctgataagattggaccgtatgttaaacttcctctaatacttacatttatggctaattattttagtgttactctcccagaatataagaagttttagagttagacatggttattaaaaaagtactctctccgtctcatgaaacatagtactggatgtgacatattctaatacaacgaatctggacaaatgtatgtccagattttatagtactatgatgtgtcacatccagttctaaattcgtttttttgggacagagagggtaggttgaagggaatggtggaggattgtgactgaatgagtagtgaagttagacggaaaaagtgaatggtggatggttatgattggttggaaagagagtattgatggagaagttgttatatgttaggataaatcctgatagctaaaaattgttatattttgagacggagggagcaggtgatatagcacttgacattcagatgtttgtgatgatttcgttaatcttaaaatttatcggctcaattcatcgggggttcttaatgataaggtgtatgtccaatcatttgttccaaataacgctataaaaagatatgaatcctataacatttatctgttctaaactctaaagccaaaagaggcctaaagttatctattatattattaaaagaatagaaaaaggagcctccacgttcgctcttatggtctaaaaattctcacattaatcggagaaaaagaaaaggcagagtccatatagaaatacaatttagaaatagttgaaattcggaattgaaaaataatggatattagaaaaggagactagagtccatatagaaatacaatttagaaatagttgaaattcggaattaaaaaataaggaatattagaaaaggagactagagtccatatagaaatataattgagaaatagctgaaattcgaaattaaaaaatagggaatatcaaaagaggagactagagtctatatagaaatacaattaggaaataactgaaattcagaattaaaaataaggaatattagaagtagagtatagagttcatatagaaatacaattagaaaataatagaaattcggaattaaaaataaggaatattagaagtagagtatagagtacatatataaatacaattaagaaaaaaaatagaaattcggaattaaacaaataaggaatattagaagtagagtatagagtccatataggaatttaaaactaattaaaatttggaataaacataataaaattaaaagtagagtttagagtccatataaaaatataatttacaaataactaaaattcgagattaagaaaaacatgtgaagaagagtttaaagtcaatataggaatacaatttagaagtaactgaaattcgaaattaaaaattaaagaatattgaaagatgagtttagagtccacatagaaatacaattagaaataataaaaattcagaaataaaaataaataatataggaagaagagcatagagtatatatataaatacaatttacaaaaagttcggaatttaaaaaaagaaatattaaaagatgagtctagagtccatataggaatatatataattttcaaataactaaaatttgatattaaaaataattaataactaacacgtatataaaatacaatatgaatattacacattagtagttttgtaaagttattataaaatttaaaattatgttgtcattttaatatatttgaataatatattaagaaaacatatatgctattatatgagagaaaatagaatgatgcttttggaggccaccatgctagtttgaagtaattaagcaccaggcaggtggcttctagtggtgtgtttgtctgcatcttagcacgcatgcggtcagcatcgtcagcaaaacgctgggtgcagcagaatgcagcacctggtatactggaaaccatgctgtccagcccctggattccccctgcccgcctcccataactccgcgttcaccgtcaccggaaagaacatgtggtactaatttgttactagtaacaataatctgcacctaacgcatgtgatgtgagtcagtgccggcaaagaaacgatccatcatccatatagtttattgctcaccaagaaggtaagaagatcacaagatgcctcaggcctcagattagtagtattattttttttgatgaaaagattagtagtattgctttgaacggattagattagtagtatatggcagatccttatcatcctgtaagctgcaagggag

SEQ ID NO: 37122 - DNA, 5169 bp, Oryza sativa
  unsure (1)..(5169): unsure at all n locations
aaattaaactctttagaccagaaaagatcaaacaacacaaaatctagtctactttttgacttgcagacatgtggatcacccccagaaaaaacgaaaacagttcacctctacacaattatacattgcacctgcgcatctacttccctgctagccaatggaagaactccattgtagaataccaactttctaaatgacgggtattattccactttcttaaacaaaaaccgagtatttggactccttagtccgtaccatagtccagtacataataacggcggcacacgccctggtctcgttcggcaccagaatttcaaccgggcacggcaggcggccggagacgagacgatggcaaacgtcacggcaagtggccagctagctataggctatagcacacggacgcccacaaccacaaccacaagaagcacaccgtacgcgccgcaatttgcaaacctcgttccgcgcgcgagcaagagcgcggccaaccagagccacgcaattctgcacccggttttctgggagccccccaccgattcacccgcacgagtccaaaaccgcgcgtacgcccacgccacgccacgccaccggcagcgacggctcgcgctctagcgatcactaatcgggtcgcgcgagcttggtctctcccctataaaaccacggctccgcgccaccaccattccggcagaaggcaacacacacccaaacacaaacaagagcatcatctgagcgtgcagagctcacacaaacacacgtacagatcgttcgtacaagtgcaacaaacacatggcgagcggcggagggaaggcgaaggcgtcgtcgtgggcggcggcgataagcgtgggcacggtgaggcgctcaaggaccaggccggactgtgccgctggaactacgcgttccggacgctccagcagcgcggcaggcagcaggccgtggccgggacgagcggcgccaagaccggcggcggcgcgcgtgcgctgcagcctgcagcggcggcggcggcgaggaggaaagcccagcagcaagaggaggagctgaggacggtcatgtacctcagcaactggggcccaaacaactaattgttactgagctgatcagtcagattaggatcgtgttaggtggttagattggttttggtgcttgcaagatggaactgcttgtatatgcagacgagttttgcacaagatgtatatatacgatatatatgatatggcaactaatcaagagctttggttatgcacaattctgtttctcctgtcctttgtgtttggccatccagacgacgcattgtcacttcgcttgaaagttggaacttgccttgatgaatctggaataaactcagaatctgaacccgttttcctcccatcctccaggcgtgcatcagattagcagcagaccaaagaattcttcagtatcaagtgaactaacgccatcagatgagtcatccgtcaaccagtatgacgaggaaaaagctcattcttcaggcagaaaaggaattcgcctgatggtagttgctcacttgtttttcgaagtgatcctttccttgcattggtggttggtaggatagataattgagtatccttgagcggttcagcaacactgtgcccggctttaatcaatttgttgtaatacaaaatcaaattttgtctcgcacaagatggatcctgaaaccaacaaaatacccggaaaaaatgtcgccatcgataccacttcccatccaccatattccaatgctacctgtgtgctgcaaccttcaagtggcacaacagggaagaagtactctcatgcacgacgctttactccaacacctccaaaaagtacacgataatactgaaaatgtccccatccatccccatttcttcagagttcagaattcatatatccctcccctctgtgtgctacgtctcctccgatacatcgcgctttcctgctcccttttggattcagttaccattccgttttgtccttagcgacaaattgcaactgaaaattcagttgatggaataccactactcgcagtgacgagagcgcacaacacatcccacatactggcgcacaccggaaaaagaaaaacacggtcaggagcaggtgcagtgaatagttggttgaatacagccgccaatccagcatcaaaaccgatggttttggaacacgacggaatatcactatgctctccctgtatatatacgcttaccagcattaagctttgtacgtgcaagaaacttcaaaggtggtaaagattaatctctgagtttgagcgatcgatccatcgaccgatgagcctgaggtacgcgagcagggtgttgctgagagcggcggcgcaggccatgagggccgcgaggcagccggcgcctgcggtggccaagccggtgccagcggcgaagccatcggcggtggcgccaggcacggctcagcggcagcaggcgaagcggctctccggtggcgtggctgagccggcggagaaggcggccgtggcggagaggatgaggcggcggcgcagggagaagtccgagaatgtgatgcagctcgtgtgctggggacccagttagccgcgatgcttctgttgctgctgtagtgctgtgacatcagttgagcagagtgactagtgtgatttgtgccttatgttcgtttccttttgtaagatggtagaatctgtgaaattttgacggtattgtattctgcaagatgctatgaaatagtgaagtactgttccttttctgaaattttgtttagccaatttcattttctgaacttaggaatgtatgcatggctctatttaggatttctcttaacattcttcgctctaaggagctaagatgttctttttgctcggattatgtgaaacactgcaacatccactgccaaaaatcatcctcttttcccccttctttctgtctttttttgcagaacatacagaaggacgaaaagggtacatgcagcatactgaaatttcaagattggtagtaaaaaatgtcaaaatggaatcagtccaccctggagaagccgagaagacgggaaaatgattcactacttgtagaagaggggagagcaaaacaatcttcagataattgatccagtacttgcagaagagagcacaatgatcttcagaaaaatcactacaggaagtgtatacacagacagactgactaacagtatttacaacaaagagaagaggcttaacaacacaaccgaggtacaagaataaacagtactagtattttctgtaccatagatgaacagacagacagtattaacaagaagtcaacaaagaaggattaacaacacaagcgagatccaagaataaacagtattttcggcatccatagacgatgattcacatacttaattacatcttcattcacatctgagattttcacagacgcagaacaaaaccttcacaccaccgtatgcagataagctatcgctagcctacacatctactagtactagtcttcatcaggtgttgggaccccagacggagaggaacatgacggtgcgcagcgactgctccgcccgcctccgcttctcctccgccgccctcgccgccgccgccgcgctcaccctgcccttctccaccgaccccgcggcgggtgccctgctgccgccgccgctgctcctcgccgccgccgacgacgtcgacgtcgtcgccgactgcgccttgtccttcaccgacctccccgcgccctcccgcacggcctgcgccgcgcgcgcgcccactcggctcatgtgcctcaggctcatggatcgatcgccttgcacgcaaacttcttctccgggatctctctcctttgctttgctttggttggattgtggtttgacgtggaggaggaggagacgtggggggtttatatatgcggagaggagaggaaggcgatggccgctgggaagctcggcttctggtgggcggggagcgcgcttagccgctaaccggcacacgggtttcgctttcgctggcgtgcgatagttatcttcttctgatgatgacgacgaaacggcgggcgttagcttaagctccgcgcgggtgaagaaaagtctagaacccgtttcgcgcgtcgccgatcattatcttattactactactctacttataggtgccatctgggacgtgtacattagttgatcaataattgttcttttgtactttccgagatacacagcgaaagatattttcacagaagataaaactcgtgatatagttctaaaagtaaaaacaaaaaaaaatccgttttactccgtaaactatttcattgcttcactcaacatcttaaacctttttttttcttattttacactttgaactattaaaaacaggtcaccttcctctctaatgatattgcttctttttttttccctacgtaagtcatgtttctcaataaaatttggtaggattaatagatacaatatagcctacctatcaacatttttcataattttttatcattgtatatatattcgaagcactaaacctgatttaaacatcgaggttttaaatttcaaacaaatagtcatgaacttatttttttaaaaaatgaactttaataatcgtgttgtctatggctatataaaatttcaatctaaaatacaactcgtataaagagaaacaaataaggcaaatgcttttagagtgaaccatctatcttctattatattattaaaacagccttaaaagaaagcaccacgttcgctgtggaggctaaaaattcccacattaatcggaggaaaggagaaaaatattaaccgttagatcatagtatatctagattttagcacctcagatctaatagataaagatatcagagttgtacagctaatagaaatctttccacggaagcttaaagaaacatactagaaataggaatcggagtaaaaaggagaaacgtacttaggaatcagagtaaaaaaagagttcgagatcaatacgactaaataaacggcctgtacatatatgtgaaaccaaccaatctgaaaaggaaaagtttatttctaaccgggatatttaaattcgttttgtctatatgaagtatttgaactttttctcatattaaaattaatgtattgatccacagcttgcgttccttaaaaacgaactcatgtccatgtcaaatttataacgatcannnnnnnnnnnnnnnnnnnnnnnnnnnnnnnnnnnnnnnnnnnnnnnnnnnnnnnnnt

SEQ ID NO: 37123 - DNA, 2970 bp, Oryza sativa
attagtcttagggtgctctgaatttgaaaagccattgggtcgccattagacttgagcttcttaaaggtggcattccatttggggagccccttttcagggacctttttttgttaaatcaaaaacctgtaaaaattgtggatccaaatatgagataatatgagagaatgatatgaagtcctactatggctcaagggaatcttttcagcattccatcttcccaaactactagattaggtacctgcgctttattgagaagctcacgatacgttttgatcaaactgcttccgagttggccgccacttctagagttgatgaatactactacagggcaacatggtgcctgatcaacgaggacttgttcagagtcaggattcagaatgtaatcagggatgcagtagtctgttaatggctcgcatggcttagagcaggaaccattagtgccatttgtatgtccatccatcctgcaaaacatttttatgagtgaaaagagattagacattattgatctatgcgcttcacggaaccctttttccacttccacgattgttctttttttttttttgagcaagggcataaacttccacgattgttctacaaacgatagtatgtaagtagaaaattttctgatgtggagtgagcctgaaagcctaaattttactactggctatcccaccattgcttgatgggaaaaatcagatcctcaaaggaaaatgcgacactggcgctttacgagattcctactaaaagattcacaataattgttcgataagaatcttgtcaagtaggaattaataaaataatggaaaatcagtaaaacgtggcagtatcaacaccagaaagaacggaattgttcattaaatgaacagaaggagttgaaaggaaaaaaaaaaggatgacaatgctcacaaaaaagcacagccttttagaataaagaacgtagatcgatacagacgccaagcgaagcatgttccgtaataattctactaaaagagaaggaaaaaaagggtaattttttacatatcacaatgcagcagtttctcttggtaaaacaatgccataatcttcacagttaccaaaactgaaaatgtctagtcctgtctgcaggaagcgtctagcatgaaccatgggattggagaacacaactgccatggaccgaagccaaagaagcaaattggagatcctcaattcacagggaaaaccgcgtttcttggacccatactatcatcgcccaaataaccacaccatacggatctagcgggggaaaaaaaaatctgccgtacaaatgcatgaattcgattcagaatcttacggcaacaacggagatggaattcggatcagcagcaagcacatcaaaactcaaaatgcacaggccaatatgcaagaaacctcaagacaagatccctcgcaggaggactcatgaagctcggcgcctatggacattacctgcgatctcaagatttgggggggcgcctccagttcgtctttcggcgcgtttccgactcgctgaggactgaattcgggttgtctcaaatttggattttgaggaatattaatagggcgatggtagcgaggacgaaggggagaagaagaggacaagagaaatatagaaagcgacctccgttcgaaatttccttctctacatggagttggagttgggcattattgcccaattgtcgtctcatctgtcccagatctgcatcatccattggcacccatgaggccatgatgacagatgcttctgacttttctggctttttatttatacttttttgcctttgcgtgcatcactgtattcaggttagtgagcagattacagtgagcaaagatcgatttcatcagatttaaggttatattattcagacctgtttatgtggtcgagggcttcagatttgtttagagtagaaaaaatagttcatttttgcatgggaatctagattctagagaagttgccgtgttgctgacacggttaagatattttccatcacccattaagaaagacgagttgaccaaacacagaagtttcccaagcgttagaacctgcatttgaacattctatatatttgctgcttatttccttctgtcgacaaacggattaggcgccaacgcaactactccttcctctcgtctgtctctacatgttcaattcaatgccctcacaagtctaacgtaaatccaatcctaagtccaattttcagagatgccaaataccaaccatgtatgcatctagaactgatcagtgcagtaatacaagtattgaactcgtgcgcgaatgaacacgcgacgaccaatcacatgagccgaaccgcaagttggacagtagcagtatttgattaaggccaaccactctagcttagcagtctcgctagtcgctaggcgacgcgagaatctgtgcttctgtagattttcttttcgccggaacactacaagaggaacccccctctagcagcgaatatatgtgtggctaaaggtctaaataagcgttgtaaggtccaatagcaacacattgactatgtgttgcctatgccggcgttgctaaggtctatacgttgctacgatctatagccatacatacataagcgttggtaacgacataaataactgttgtaagtgagcaataggatgcaactggaagatactgttcacatttaccaaatacatattacttacttgccaatttgtaattaataatttacactacgatcttatataggttccatttggacaagaaaaactcataagtactataagaaaaaaatcacaatatattaattcacaaatctcttataagtacaacttgtgtatacaccacagcatattagtgagtgtagtacaaacatatgttgaatcttgcaaaaaaaaaaaacatcatcttgaattttctctgtgaccagatcaacattagtttctgtaacttgggcacttggcagcaacaacaatatcttctccttagcaatttcttcttcctctatc

SEQ ID NO: 37124 - DNA, 2678 bp, Oryza sativa
cgcccctcattccgccccgctctaccacccacgggaagcttcttcgtcgacggcaatggctgatatgggaaggtaggggagaagggtatagagaggagaaagaaattgctacagcctacatacggggtccacgtgggccccaccatatttattttgttgtgtagttgacatgtgggccaccgtgggccccaccatttctaaattaattttttttgtgtagttgacatgtgggcccgctgtttttattattttttgagatataattgctacgtaagtgccacgtcaatgccacgtgggacggagacctagtcaaaccagccacgtaggcgccacgtcagccaaaactgctatccaaaccaccttaggacctgaccttatgtgcgctggttttataagttgggggatatgttgtatccggttttacacttcagagacaaaaatcagactgtacgacaaatagagggacctaaagtgaatttattctttccgcatgtgacaactagatctggcctgcttacggtataggccgctaacggcaaagcccattagtcggactggcctccaggggaggggattcgctgccggcgaggtggtgtgccgcggcgacggcggaggcgacgaggccgaagccgccggcggtctggccggcgatggaaggggggggggggacccgccggccgtaggcgcgatgggtcggccgcccagatcctctccaccgtgaagatctccccatcttatcctcggcgatctgcgtttcccttgctcggaaaggcgacccagaatcagtaactacgtactactcctcccttatttcacctcagattttaagcgatatttttggtataggaatgcacgaaatgtcatcctgcctgcatgaatgaagaaatttctgggttgttaggtcccgcaaaaatttaatcccagttccatcctgttcccacctatacccgtatagacaatctacagggattgtgagttagggatcgggaagatagttagaaattttagttattcgccgcatatgttgactaatctgataatctgcaaggacgtacatttccgcgtctcaattttcatttttttttcagcacttggtccatgctagactgtcccgagatttctccggctgctgttaatttgttgccacttgccaacgaaaagcattgctctatgaaaaaaatgcattgccttcttcgctcctgtcctaactcctaagcaaagctaggaggtggcatggtcagatagtgacatcctaagattgtttattcatgatctcgtcaacaaatactgaacttgtcaagaacatggaatggttgaagtggtcaagcgaaggataacagtgtctaatacatcacgttccattgtcttataaatttatcagtttttatttgtcattctaccaatcttgttgaccagttgttctgtttgataagaacggagcattgacaacatattatcttgcaaatccacgaaatttcgatgttgacatgcattcctctaggcaaagcataaatgctcaattgtcttagtgagcgctgatactgccatcttccttatcggcatcatgctcatgcatttctgtgtgtttggatgcctgaagaaatttgtcataaagcaaatgggtaatatttttattactgacttcttcacatgtatttggattccttctacgatgtcattagtgtttctttctgttgtatgatttagaggaataatttgtatgatacatgccattgttcagattatgaatatacaaggctaagacttcataatattctacggccaaacataatttcatgacagttatctcttagtcttagagattgctgatatagttcagtttgcgttaacagctgtctggtaggtttatatctaatatttttactaatctgcaggcataaggagaatacaagcaccacggctgatcacaaaagaagctggaccacctgcagatgaagctatattcagaagtgattcagtgaaatccgcagttctaagctcaccactagttgagtttagcacgatttattcagcaacaaataattttagcaacaagcttggtggaggcggatttggttttgtttacaaggtatggtcatttaaacattttatcattttatcctatcttgttaatatgaatgaaattgttgtttttactatctttgttctgacctggaattcaaaatcgtaatgctataagatcaatacctgaaccaacatagttgatattacttctagggggtactacctgatggccaggagattgctgtcaagaggctgtcaaacagatccagtcagggattggaagagttcaagaacgaggtgatagttctatccaaactgcaacaccggaatttggttaggctctttggttgttgtgttcatggagaagagaagatgttgctgtatgaatacatgcccaacaagagccttgactcatttatttttggtaacgtttagtttgattcctgcaaatcctgacgttctgattttgtttagatgtaagccagtaactgaacttgtctgctaatttggtgctttcatgtgaatcttattagatgaaagtaagaggctaatatttggatggaaattgcgatacaagattattcagggaattgggagaggattattgtaccttcatcaggaatccaggctcaaaattattcacagggatctca

SEQ ID NO: 37125 - DNA, 1389 bp, Oryza sativa
  unsure (1)..(1389): unsure at all n locations
agcatgaactgatctctctctatgtctttttttttttgtctgagtaacagttgagaccaaaaggtctctgattgtactagttgtcccacctgtagctgctaccattgctattcttttgatcgcttttggggtttgggctatttggtgcaaaaagaatcacggaattttaggtaaatccaggcttttaatcttaaggatatttattatgaagttctaagctaacaaactgtatgctaaattgctaataccacagatgttattccagataacccttctatgggcgttgcttcagtcaatctagctactataaagtctattactgaaaatttctcagaaaattgcttgattggtgaaggtggatttagcaccgtttataaggtgagcctctctcttcagaagatagacacatgtaacatgaaagttgcactaatcctcatgaaaaaagaaattaaacataagttgcaaatacttaataccgtacactggcaaatgccaaaaatgcaattgcaatcacctgaaatttggaaatgaccagggagtacaatctgacgggagaatggtagccgtgaagaggctaaagcagtcagctctgacgaacaaaggcaagaaggatttcgccagagaagtggcagtgatggccgggctccatcacggtagccttctccgcctcctagcttactgcaacgaaggcaatgagcgtatactggtatacgcctacatgaagaacaagagcttggacaaccacattttcggtacccaccctgttctatctgaattcagcttattaagctacatcactgacctgatcataaattcaccatgacatgaataaataatgtcaccttccatgttcttcttcatttcaggcccgttgccgcgtcgagctaatctgcactggagaagaagactcgacataattcaggccatcgcgaaaggtgtcgcgtatcttcacgaaggaccagacgggagtgtaatccacagggatctcaagctgagcaacattcttctagacgacgaattgaagcctaagattgcagactttggcaccgccaagctgttcgtcgccgatcagtcaggccagaccctcgtggtctcacagtaagtaaactaatggctgttcctagtagcaatgttgctcaagttttgatttgaagccttgaattgaattcgtgaattgaagaggttatgcatctccggagtacgcgttacgagacgagatgacgctcaagtgcgacgtctacagcttcggagtcgtcctcctggagacgctcagcggcgttcgcaacggctcaatgcagacgcttcttccacaggtaatcaagcagtgcactgannnnnnnnnnnnnnnnnnnnnnnnnnnnnnnnnnnnnnnnnnnnnnnnnnnnnnnn

SEQ ID NO: 37126 - DNA, 14886 bp, Oryza sativa
agcttgcatgcctgcaggtcgactctaagatccccgttcgaattggatcgggtttcgtctctccaagccgagctttccttcgccgtctccgccgccgtgggccttcgccgccgcctccttgcacctatttaaggacccccgagctctcctctacccgtagccaccctcgccttcgcctctcgtcgtcggaagagctctagcgccgtgtgccctagcttcgccgtcgccgccgccgctccagccgtgcgccgccgtcgtttcagccgtcgccgtcgctcgggaagaccgccgtcgggttcgcaaggtcgtcgccgtcctcgtccgccccttcgccgtcgccggagaccgccggagcttcatcgccgtcgtcaacccgaaggtttccgccgcttcctcctcgtcgccgtcgccgtccgttgcttctccgccgcttctttggtcaccggtgagttcgccgcgtcgcgctctacgtcctggtgctctccgttcgcgtcgccgcgccgtcgttcgccggcgagcatgcgagcccgagccgccgagccgccgccgccggtggtgacgtcatcgctgacgtcatccaggccgtccgccgtaaaccgccgtggacccgatcgatctcggccgtccatcttggattggttcgatctcggccgtccgttcgcgtgaaccgccgcccgtgcgcccggtccaccgaaaccctagcccgctgacgcaataatccttcttttccttttcaaaaataattcattattgcgtcataattcaattaaaatcagtttaaaggttttaatccgatttaatctttaaaaattcatatctaattcatcttaactcagtttaatgtggttcaagttgcaaaagttgtataaaataaagatctacatattaaaattgtccataaattgaattaaatttatttaattctttttaaatgggctttaattagatttaatcttgtaaaattcataataaattcatttgaagtcagaatgaggccgttcaagtctcataattcatctaaaaatatgatctacatgtttgtttactttttatgtattgtttatttggtttttattagtctttttcctcgttttgcgtgatagcttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcattgggtggaattaacctattctttgttatggcccttttgttcttgattactttattccttgataccttgggtgattataattggactagttgagctttatatatattggttcaactagatattagatatgattgcttagccatgcttagaaacattagcacacatttgggataactaatgtttcactatcacttatggttatatttaatggtagctcacgatggtcaatcgtgattggttaattaattacttgccaactaaaacttgataatggtgggttgtgagcacatggttttgagagtcgtgctcatgacaattaaggaccggttcgcgagctactgttgtgaaacattaaccgtgccaaccacaagccagcgtgggcaacggctttatcttttgtatagcatggttcattgcggggcaccagactgagaagtggcggagataagcccacgggggtcgctggggagtccatgccttgttttataagggggtgattatgatccaggaatggtgcgctgcggtggattgtgttatgcaaggggtactgtcacagcccctttccgaggtaccgtggtggtactgaggcacatggtgacatgatgtggggctgtgtcttgtgggtacagtggtacacctctggccagagtaaaactattcgaatagccgtgcccgcggttatgggcgagttgagcaatgtttttcgtgattagtcccacacctctcaccataattatagatgttataactggtaataatttgcttagctcctggtttggagttagatctgttcagccgggtatggttgttcagaatggttgggcctgtgcagcatgggtgtgctgttcagtgttggttaaaatttctgattaattactccactgttttacttctcttaaatgttttgctaaatgctgcttttgcaaatgagccgatattatgccatcctttggtatccttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagattttattttccgctgcagttttcttcttggtgaggactaagtgcctcttaagtaagtatttatcggtttagttaatttgatgaatctgtatattaaattgtcagtttgtgtacctcggctgattcctggacgaggattttatgcacaaataagttcggaaattactagtgaattttcgggcgtgacactttgcaagcctgctgagttttcctcaacatccgcgctgaaattcgcgcctgcaaagagcgtggaattcagcgtatttctccaactcgtgatgtctattgtcctattcacaagacaaagaatcacgacctctcaagttgcaaggtctttctcagcaccatgaaagcgccatctcctaaggtccaacagtcacacatccccatcagggataaagacaaggaacgaggagcgacgccaacttcagatcgatttgttggggtaatcgatatcgatcctcacgaaccatcagtcttgcaccttctcgaagactatggatcatcaacaacgagcacgccgcgggaggtattggctatcgatgatgtcggcacgtcagcgcgcaccaatgcagaagcggagaatcaattggccaccccggcccagcacatcagagccgtcaacgctatactgagggaaaccccctacgatcctgttttgaacgacgatatcacgcattggacagaacgactacgggaatcagtgaccaacctcagcaacgcgtccgaagaggccgccgccgcagcgcacccggagcaaccaccaactggcgatgccaatggtgaagaccctgaacggagggaatcgcctcatcgagccacccctccacctcgcggcactagcgatctccgagatcacctcaacggctgccgagaggcacgacgcgcacgagacaatgagaatcgttcccggcgtcatgtctcttcacggcgccataataacgaagatcgaggagaccgctcaaacgaagaccgaggccatgataaccgccacaaccgccacgatcacaacgatcacgaacggcgggtgccagacgatactggtcgaggacgtcgccataacgatgacaatgatggagaccggcgccgagacaacagcgggagatgacgacaagattctcgagatccaggccgacatcctcgtattcgtacgccggaaccaagcgacccatcgtcatcgtcatcatcctcgtcttcctcatcatcagacagacatccacgaaggacacacgatcgccgacaacccaccgcccccagcgctgggtgtagggctttcagtcgttccctacgtgatgtccgatggcttgagagattctgacccggagcaatagaaaagtacgatgggagcaccgacccagaagagttccttcaagtctactccacagtactctatgctgccggagcagacgacaacgcattggcgaattatttgccaactgcgttaaaaggctctgcacgttcatggctgatgcatcttccgccctactcaatctcttcgtgggcagacctgtggcaacagttcgtcgccaacttccaaggaacctacaagcgccacgcgatcgaagacgacctacacgcgttgacacagaactcgggtgaatccttgagggaatatgttcagtgcttcaacgagtgcaaaaatacaatccccgaaatcaccgatgcttctgtaattcgcgccttcaaatccggtgtcagagatcgctatactacccaggagttggcgacaagacgcatcacaaccactcggagattgttcgagattgttgagcgatgcgcccacgcagatgatgcgctaagacgcaagaacgataagccgaagaccgggggagagaagaaaccagccacggacgcacctgagtcaagcaagaagaagaatcgcaaaaatgggaaaaggaaagctcaagcggaggtcctcgcagcagaatacgcgaaccctcccaagcacccagacccacaaagtagcgacacaaagaaagcatggtgccccatacacaagacggacagacattctttggaagattgccttgttttcaaaaaatcgctcgagaagcacattgcatctgaaaaaggcaaacgagtacgcgtggtcgaaaaggacgcggaggaatatgtgttcgcgagtaggactccttgtctctggcagaggaatagaagcaaatcccgagaagatcaaggcaatcgagaacatgaagtcgcccacaagactcaaagaagtacagaagctaaccggatgcatggcagcattgagcaggttcatcgctaggatgggagaacgagggcaaccttttttcgctttgctgaagaagcaagacaaatttgtatggacacaggaagccgaagaggcattcgttgcactcaagcgctacctatcaaacccccctgtacttgttgccccccaacctaatgaagaattattcctctatattgccgccacgccatattccgttagcaccgtcatcattgtcgagagagagaaagtacaacgaccagtctattacgtcagcgaagctctccacgacgcaaagacaagatatccacagatccaaaagctgctttacgcggtcatcatgacatcaaggaagctacgccactactttcaagcccacagagtcacagttgtctcctccttccctctcggtgaagtcgtgagaaacaaagacgttgtcggccgcattgcaaaatgggtagtcgagctgagccagtttgatgtccactttgcgccacgaacagccatcaaatcccaggtactcgccgacttcgtagccgattggactatgcctgataacaaatcagacaaccaagtcgacaacgaaacgtggacaatggcgttcgatggtgcactcaacagccaaggagcaggggcagggtttatcttgacgtctccctccgtagatcaattcaagcacgcaatccacctcaacttcagggcgaccaataacacagccgaatacgagggactactagccgggacaagagctgcagctgcacttggggtcaagcgactaatcgtaaaaggggacttcgaactagtcgcgaaccaggtgcacaaagattataaatgctctaaccctgagttatccaagtatctcgcagaagtcaggaagctagagaaaaggttcgatgggatcgaagtccgacacgtctaccgcaaagacaacatcgagccagatgacctagcacgacatgcgtctagacgagaaccgctcgagcccggcacctttctggacatcctaacgaagccatcagtaaaagaggttagcggtgaagttagcccggtcacccccgacattagctcggaggccacaaaggcagaacacgccgttgccgatatcgagaccacagacgactggcgcatcccactaatcaaattcatcaacagcgaggagttgcccgaggacgatacagtggcccaacaatctatacaagaaagcgccaaacggggtacttctcaaatgtgtctcgtccgacgacggtagacacctcctccttgatatacatgaaggcatttgtgggtcacacgccaccggtcggacattggtcgggaaagcttttcgacaagggtttttctggccaaccgcccttaaagatgcatgcgacatggtccagcgatgtgaagcctgtcaattccacagtaaacacacaaagctatccgcgcaagcgctccagactatccctcttacttggccgttctcgtgctgggggctagatatactcgggccattcccacgaggacagggcggctacaggttcctattcgtggcgatcgacaaattcactaaatggatcgaagcagtacccacgggagaaatcaaggccgacaacgccatcaaattcatcaagggtatattttgcagatacggactaccgcaccgcatcataaccgacaacggctcccagttcatcagcgctgatttccaggattactgcatcgggctgggagtcaagatatgcttcgcctcggtctcccacccttaaagtaacggacaagtcgagagggcaaacgacatattactacaagggatcaaaacccgcgtctacgacaggctcatgtcacatgacaaaaaatgggtcgaagaactcccatcagtactatgggccgtacgcaccacaccgacaatgtctaacaaggaaacacccttcttcctcgtgtacggcttcgaggccatgctccccagcgagctacgacatcagagtacactagtacagaagcattccgacgaggaccaggaggagcagcgaaacgtcgatgtaaatctactcgaggaacatcacgaacgagttgccgttcgagcagccagctatcaatagaccctccgccgttaccacgagaagcgcatccaagcatgcatactttcgatcggcgactacgtcctccgacgggttcaaagccaagcagggcgaaacaaactctcacccaaatgggaaggaccttacacgatcacacaagtcttgcagccaggcgcattcaaaatcgcagacggcgatggtcgcgagttagcaaattcttagaacattgaccaactacgtaaattctatgtatgagtcaataccatccgtacctgtaaggcaccttacagtatcaataaagcctattcttaggcccatattacaatcaaagtatttccgcccgatgatcccttaccctgatgacacctagcgttgaaacctatcctcatgtccctttacgccgtcttgacaaggcctccgaggaacctaagggatcttcggctggggacgcccagagccgataaggccttgtcagatcctgtagagacgaaagaccatgtaagatctggtcgtgtaagagttctcaccgtgcgtattaaccaagccgcgaaatcggaaattaactttccaacttcacggctgggagctaggatcagagcttattcaaccaaggcagatcaaaggtccaagagccttatcctccgagaaaattcctccgacgacaaggctgggggctagggagagtgttcgactcaaacgactgactaaagtcgtgaactgagaacatactcttacacacgacatccggagtaagaaagatttgttaaagatagatctcttctctatttcacaaaatacttcttacagttttaacacaaatccaaagctatattacacctttttcctgagatatctatcacagggtacgaagactaccaagaaggccaacgccagtccatagactggaagatcttctccgccaacggcgccatcgacctcgccaggtggtctatctccgccggagtcctccgagaatgagcaaaaccctcacggagaaaatcgaggtccaggtgcgggcgatgatctcgtaggcaagccaacacgtgccctccggcatatcggctcgatcgacgacactcctgcttcaaggcctcgtcgatacgcttgccgacgccatcgagttgagcacatgctccgttcagccatgagatgtatccggccgccgactcctcgggatctccatggggcactcgaagttctctacagaccttggccatggatgtgcagcaactcttcaagtacgagttgaaccacacctcatgaccccggagcgtttccacagcctgctctttcttcactgcaagcatggttctctcgagttccgctacttcaaattttgtcttccaatattggatacgacgatcttggccagcaagagcactctcgagatctgctcaatgtgggaacaactaagtcaagctacacgcctctttcgagaacatagttgatctagtcggaagagcagaaagggatgaatgggctactaacctaaggatgtcgtcgccatctccgtccccgtagcaagggtctggtctacattgtcgggcgacgcatgtggttcaaacgcaagaaccggaataatcgctggtgactcgggctgcccgcgctgctggacatcctcgtcatcaacatctctacaagggacaaaagttctcaagatcaacatacaagagtaagctagaacaataattgcacgcacaaaggcgattaagattcagttttacacagcatgtcttgggagtacaagaggtcctactcttcaaaaagggggagaacagattcccccagatcaccgacttcttccatcacctccttatgcgtgttgctagccgccccctgatccaagatctcgcgcaaatcgagttcaggatgtgccagctttacacacgcgaggacgtggcacgccccggtgtagatcccgttcgacgtctcctccccgatcctggccgcatgcttggaggggatctccctcatcgccgccgccagctccgcaagagaagatgtaagcgagaactcgtcgggattcgccgggatagtagacttaatgccgcactccccggcaagctggtgcaggccagtgtgtgtgacccgcaatgagccacggatttccgacaggttgttcccgagcttcgacatgcggtcctcgagcccctgccgttgtcgctcgttgccggccaccaactccctcatcttcttgaggtcttcacgagcctccgccaactcgcgtacctgccggtcagcacactcgttcgccgacgccgctgccgacctcgcctccgcaatctcacggccaatgccgcgagcaccagcctcgaggaggcgccccatctcgacctggagctcctcccaggtgaggatggccgccggtggaccacgaccagccgcaggattgctgactgggccgcttggtgtcgcctcgcgtctcccgggcgcaagcacgacatccgtcgaggctgcagtgggagacacgccggaagtccctccagactcgtcttgcaccgccttcgcccgtgccgccctatgagatagctatggttcagataacactcgaacaaaatcacggagacttaagttcatctacttacttctcgccaaccgtcacaagacgttgtcgtcgtggaggcggtagagacgcgtccgaggcctgaaaaacggtcgatgcgaagtaaggcgaaattcttctggttgtacgatctgatgacaggatagcttaccgagggggttgatgccttgcgacgatgtccgcttacagaggagaacttcctcccctttgtcggaacattgccaccacttgtggtagcagcagcagcatcagacgcctccttggcgaccttctctttcagagatgccgtcacctgatggtccgcgagtggcccgatgatgtcagtcagaggaagagcctacgcttaatcaagtcataaagtgatctcagaaggaaaacgcaggatgcctatcgagaacacttacgttgatggcagcatcacgtttggccgcccccttttcacaaaggggaacggggatgttactcgccgttgccaggccgctgatcatcacctggctgacacgacgtcccacggtttcgctgttcagtcctgtgaatcgagaaccaaattttgataaatcaggaggaacgtggacacgagcatgttaggataaatgcaagaaagataccccgaggagaaacccgggtcgcgtcctccggtccggaatagtcaaaggctgggtggactcgagcctagagcggctggatccgtctaccaatgaagtctgcagcgacttcataccccgacaagcctcatactcggagatcgtcgacaatgtcgatgaaggattggagagaaggggtcaaagggggctttgcggtccaagacgggatcttgtccggttgttcctcaggaacaacaaagacagggtccgaatctttgatctgaaggtagaaccacctcgtccaccacttgctgcgagaagagggacactggaaggggatgtaacgcgacttcaggccatcccgaagtcggaacccgacgcatccagacaccctgttgggctccatccaacgcagctcatagtagaagcgaaagagatcgagaaacggctctaccccaatgtaggcctcacaaagatgagaaaagatgctaagaaaggcgatggaattggggttcaggtggagcagagaaagaccgtagaagttcatgactaagagaagaaattcggaaggcggagggagaaaaccgcagagaatgtagtcttcaatcgcaaccatgcgacctaagacgggctggggattagtacctcctgcttccctttccatggtcccacgaccgggaagggcgccgtcttcctgaatcttcttcagcgacgcgctggtggaggatgatttgccaagatccatcgtcgatcggagatcgccggagaaggggctaaggtcgacgaactagggtttcttgtggaagcggagaagactaagagcgtttgcaggcgggatgttttctgcacgatgggcggacttcaaaatggatccccaaaattcctttaaagagacgcactaccgacggtgcgaattccaaggaacggagagagatgcccgccgaaaatttctgggtccgttacgcgcaacagttttttggactttagtttaaattcgctcgtgaccattgggtttcaaacggtgttctcgactacgtcatgtctctacggtcctcgcaccaggaacgacaacaatctcgacacaggaagtcgcgaatggttacacgagctcatttaagcagaagtcgggggctactgtcagggttacgggttaggtataccctttactctttgatatacgtctcatatcggtatggtatacccacgcgtatacggatactctccgcatatattaaggaaacccctcacggagtttacaaatggaaggagtcatactcggacaagactgggtcatcaatgtatcgtgtaaagttcgatgtttccgagttctacttggaaaccgcctaacctgtgatataaaagggaccccccggggagggcctgaggcatcgaatctcagagccaacacaaccctcacagcatatgaagtcggagcctacaaggagccaaaccgctagggatctagtcgaaccaactcgactacgatctcgccggatccgtcgatttccattgttccctttgtaacctgtgttttccatcatataatcccacatcaactggattagagctattacctatcaaggggcctgaaccagtataatctttgtcttttgtctgcttgatgtcgtattacgtagatccttgtaccagcgtaccccaataacctctatatccggcctacgggtatcacccatcgacaacatgcaagatcaaattcaacttctacatgttacaacaaaaataacaaattaaactgaaaatagttatcgcatattcgcaactatatttgttatttttgttacaacttgtagaaattaaatttaaagttgtttgtttgtggagtgatatatctttccccctgtaactataagtggattaatcgaactgtaccgctagcatcctgtagtgtagcaaagttagctagcagttctacgcgggaaggaatcgctggttttcttcactgacccgttatctgacctcatcgacatggcaaaatgaagagccaagccaagcgtgttgacctcaaattattgaccttaatcacttactttaaccatttatctgtggtatttttatctcaacgatcatgcatgaacgcaaaaaacaaacccaaaatatattgtacgtgtaggtgcggctaggtgcacactcctgcacaagttgtaacttactccctccgtttcacaatgtaagtcattctagcatttcccatattcatattgatgttaatgaatctagacatatatatctatctagattcattaacatcactatgaatgtgagaaatataaaaatgacttacattgttaaacggatgaagtaattccttggatgcaaacgctactaatacaaaatgtttgtgctctctaatcgatgaacatattcgttcaaaaaaaaatgatgaacagatgacaaagtcagaactttaatttgactttaccttaccaggctgtacatacttgcgttggaacctctgtagtaaactgcactagacaagccttgataactgataagcattgcagatcatgtataaatgagtagctcatgaactgagcaagaaaccaattagcgtcgtggtgattaattaatggcgaaggcaacgactggcatctgcctcgttgacgtcatcctcttctcgttcttcctcgttgctcccagagccttcgccgccgccgcggccgttaccgacacgctccgcggcggccggaacatcaccgacggcgagacgctcgtgtcggccgacggcacgttcactctggggttcttctcccccggggtgtcagccaagagatacctcggtatatggttcacggtctcccctgatgccgtttgctgggtggccaaccgagacagccctctcaacgtcacctccggcgtgctggcgatcagcgacgccgggatcctcgtcctgctcgacggctccggcggcggccatgtcgcgtggtcgtcgaactcgccctacgccgcctcggtggaggcgcggctgtctaactccggcaacctggtcgtccgtgacgcaagcggcagcaccaccacgttgtggcagtcgttcgatcacccgtcgaacaccttgttgccgggcatgaagatgggcaagaacctgtggaccggggccgagtgggacctcacgtcgtggcgctcgccggacgacccgtcgccgggggcctaccgccgcgtgctggacaccagcggcataccggacgttgtcctgtggcaagacggcgtcgagaggtacaggtcggggccatggaacggccggtggttcagcggcaacccggaggcggcgacgtacacgacgaacctgatcacgttccaggtgaccgtcagcccgggggagataagctacggctacgtctccaagcctggggcgccattgacgcgctccgtcgtgctcgacaccggcgtggtgaagcggctggtgtgggaggcgacgagccggacatggcagacgtacttccaggggccgagggacgtgtgcgacgcctacgccaagtgcggggcgttcggcctgtgcgacgccaacgcgccgtcgacgtcgttctgcggctgcctcagggggttcagcccgacgtctccggcggcgtgggcgatgaaggacgcctccggcggatgccggcgaaacgtgccgctgcgctgcggcaacacgacgacgacggatgggttcgcgttggtgcagggagtgaagctccccgacacgcacaacgcgtcggtggacacgggcatcacggtggaggagtgcagggcgaggtgcgtggccaattgctcgtgcttggcctacgccgcggcggatatccgaggaggcggcggtggtagcggctgcgtcatttggaccggcggcatcgttgatcttcggtatgtcgaccaagggcagggtctgttcctgaggttggcagagtctgaattaggtatgtgctgaattttatcagagtgatttcagttctgcacgtcatttccaagcacatttcttggcttagctgacacatttagtaaggatcaggttcgatgtaatattaaccatggctatctattgatgattaactctggaaaacttttgagctatgacagatgagggtaggagccggaagtttatgctctggaaaactgttattgctgcaccaatatctgccacgattattatgctcgtactgctacttgctatttggtgcagaaggaaacacaaaatctcaggtaaagtgctattctccaatggcttgtatacgcttcacttttttttttcatcggcaacatttgcttcggtaaactctagttttgtggtttttttttaggatactctaaatctgtggtaaaatttgaccattttttaatacatcttttttcccatgaagagataaaaacttcacaaaagatgattttatccttgagccaccttagaagattaaatctgaacaaattttagctgaatttaaatatattttacaaaattcaaaacttgttcaaaactacaaaaatgagaattgttatattttaaaaatagaaattgaacatatattgtctgagtttaaacaagttttttaaaatgtttttccacaatttggaataagttttatattttgcaaaatatgtttaaattcaaaaaaaagcttgaatttaaatcttgcaaggtggccaagtgtaaacttgagaagattaggaatatacgcaaaacgaggtgggccattagcgtatgattaattgagtattaactattttaaattataaaaatggattaatatgattttttaaagcaactttcttatagaaattttttgtaaaaaacgcactgtttagtagtttggaaagcgtgcgcgtgaaaaacgatgtgttttctcacccaatatcactggaacgaacgcactagttatatctcaccattggaataggatatgttaaaataatagtcagagcatattctgactaacaaccataaaataagagtgtcttgaagcaaatgtctgagcaaattttgccttctagattacgcttacagaaagaacaaatttaaggtaagcgttagacatttcccaggaagttccagacccagactgatt

SEQ ID NO: 37127 - DNA, 2375 bp, Oryza sativa
gtgcagatcgggctcctgtgcgtgcaggatgcgccggaggaaaggccggccatgtcggcggtcgtcgcgatgctgaccagcaagagctcacgggtggatcgtcccaagaggccaggggttcacggcggcagaagcaggccaccgttgcgcgagtcggagctgctgggcgccaccgacattgacgacgatctcacgtagtacaactgtacagggttatatatatagtccctccgtctctacgccatttactttactaaacatgttttaccgttcatcttatttaaaagatttaagtaattgttaattattttcctatcatttgatttatttattattaaatatacttttatgtatacatatatttttatatatttaaaaaaaatttcgaataaaatgaatggtcaaacgtgtttaaaaaattcaacgacgtcagatatatttaggaatggagggagtatatgggttgtgctgttctagcttctatacgtgtcgaatcattgagccaaacagaagtttctgccgatttcttttcctttttttttcctttgccaatcaggcatgaactgaactaccttgtctcattttatatagtactcccgattttaatgttgccattcaaatctgcaagttgtcaagaatatacaagatactcggaagacaatgccttcctcgcacacaactcaaataaaatatttttacactcattgacaattatggtactactagtattctgcagcagtgcaagtgactactgaccattcgcatgctccaaagtccaaacggtgaatcaatctgtactctccatttcatattataaattatttgacattttccctaagttaaaattctttaggtttgatcattttttttaaaaaaatagcatctataatattaaattagtttcattaaatttaatattaaacatattttgataatatgtttgttttgtattgaaaatattaccatatttttctataaatttaatcaaacttaaaaaagtttgataagaaaatcaaacgacttataatatgaaacggaggaagtatatgcttgcagagaagacaaaaatgttcatgggtaaacaaattagcaggttggctacaaaatgtaattgctagttatgactcagacgctacctgcagactgcagttacaattatcctccgagacacaatacaaatatatatacaatcacactcatcagttgtatattctcttttgccaaaaatcgatgatgaccaagtcagctgcttaacctccaaatgccaatccatataaatattaggttaacctccaagtgataccagctttcaatctccagtctatatgtagacgacagagatgcaaatctagcttaagcatccaggtggttaattaccttctctactaatcagccatgagctcaatgttcctaatcatcctatcatgcatgcttctcctttctaattctggcagaacaactacaggtgcagagctaggtgacactcttggcaagggccggaacatcaccgacggcgagaggctcgtctccgccggcggctcattcacgctgggcttcttctcgccggcgtcgtcttcgtcgtcgagcaccagccggagatacctcgggatatggttctccgtctccgacgacgtcgtctgctgggtcgccaaccgcgaccgccctctcacggacaccttcggcgtgctggtgatcaccgacgcggggagcctcctcttgctcgatggctctggccacgtcgtgtggtcgtcgaacacgacgaccgggggcggcgcgtccatggcggcgcagctgctcgagtcgggaaacctcgtcgtcagtgaccgcggcaatggcggcgcgggcgctgtcgtcgtgtggcagtcgttcgaccacccgtgtgacacgctgctccccggcatgaagatcggcaagaacctgtggaccggcgccgagtggtacctctcgtcgtggcgttcgtccggcgacccgtcgccggggaactaccggtacaggacggacacgaagggcgtgccggagaacgtgctctgggacggcgacggcgaggtgtaccggacggggccgtggaacgggctgtggttcagcggcatcccggagatggggacgtactccgacatgttcagctaccagctgacggtgagccccggcgagatcaccttcggctactccgccaacgccggcgcgccgttctcccgcctcgtggtgacgggcgtcggcgaggtccagcggctggtgtgggagccgagcagccgggcatggaagaacttcttccaggggccgagggacctgtgcgacgactacggcaagtgcggggcgttcggcctgtgcgacgccggcgcggcgtcgacgtcgttctgcagctgcgtggagggctt

SEQ ID NO: 37128 - DNA, 1840 bp, Oryza sativa
  unsure (1)..(1840): unsure at all n locations
tctcagctattcctgtgttgattagtgtacttatccccatgtcccagcgtcagaacgccgtcaacactgaaaaattcgggtttctgatgaacggaggaaaatccatctcgtgtccttgaggtctttcggactattcttaagcttcagcaatcatgtgtacagaaatcgttgtaggaagtttttgcacacaagtgtactgtgatgaccagctaacaaaagcaaagcagctccaccctcataatgcactcatcatgcgtcaatgccaccaactaaacgggttacgcacgcatgcagcgctgacttctcgcaacttttacgagttttctcattctctccaaggtgattttagttcccaactttttcttcaaatttctaacttttccatcacatcaaaactttcctacacacacaaacttccaacttttccgtcacatcgttccaattttaatcaaactttcaattttagcatgaactaaacaaacccttagtatgatttcgtagcaacactttcctttgcgcgtgcacctccactcatagacccgtagacgaataaaaagtctcggccatacgttgactcacgggaattactccaaagctatttgtgaatcagtgaatgtgatgaccagacaagttatttcttcaggcttcacagtcacaggcaagtgaagaacaaaccaaatgaatatggcatgcctcccctttctcatctgcttgctcctcatctccttctgcaagtgcgatgatcagctgacacaagcaaagcagctccacccaggcgacgtgcttggctccaagagcggggtgtttgcgctcgggttcttctcccctggaacctccaacaagagcttatatcttggcatatggtaccacaacatcccgcagcgcacatatgtttgggttgccaaccgagacaacccgatctccacaccttcatcatccgtgatgctcgccatcagcaatagctctaaccttgtcttgtcagattccgaaggccgaactctttggacaacgaacatcaccataactggaggcgacggtgcttatgcagcgttacttgacacaggaaacttggttctccagctgccaaacgaaacaatcatatggcaaagctttgatcacccaactgacaccattctgcccaacatgaagtttttgctgaggtacaaggcacaagtcagcaggcgacttgtcgcttggaagggcccaaatgatccatccaccggggaattctccttgagtggcgaccccagcttagacattcaggccttcatctggcatgggaccaagccatattaccgcttcgtcgtgattggtagtgtgtcagtgtccggcgaagcatacggcagcaacaccacctctttcatatatcaaactctggtgaacacacaggatgaattctatgttaggtacacaacctctgatggctcagcaaatgcacgcatcatgcttgattacatgggaaccttcaggttcctgagttgggatgatagctcgtcatcatggacagttcgcttacaacgcccagcgagcaccatcgactgctatacctacgcctcatgtggcccattcggctactgtgatgccatgctagccatcccaaggtgccaatgcctcgatgggttcgagcctgacaccaccaactcttcgagaggatgccgaagaaagcaacagttgagatgcggagatgggaatcattttgtgaccatgtccggaatgaaggtccctgacaagttcattcctgtcccaaacagaagctttgatgagtgcacggctgagtgcaaccgcaannnnnnnnnnnnnnnnnnnnnnnnnnnnnnnnnnnnnnnnnnnnnnnnnnnnn

SEQ ID NO: 37129 - DNA, 4677 bp, Oryza sativa
cggggattggaaccacccgccacacataaacatagaccccaagcgctgctggagcacttcgccttggatagattcttccatccttaattagatgacctttcaaatacctgctcaatatatttcacaaaagaaaagacgcatggcaaatgatcacttgtgtggatctctaatcattattctgttagaggagtatctattcaatttttgaacataaattagctcttcctaatatattgatagagcaaagcagatgagaaaaaaacaagtagcacaagcgcacaaccacctacggaatgcattctttccaatatctttcagttcattgtttactactccctccgtttcacaatgtaagtcattctagcatttcccacattcatattgatgttaataaatctagacatatatatctatttagattcattaacatctatatgaatatgaaaaatgctagaatgacttacattgtgaaacggagaaagtattccgtactaatgtactatacaaccatccatctgtttagagcttatgctaaaacatttattcagcggccttctagtatagtcagactcacattattaacagatttatctgagtattctcttggttcttctgattcataatgcctctgcacaaaatatataggttgtgttggaattgggtgtggcatgtcctcgttctccagcatagacacaacgaatgacatcagtggcctagcatttgggctgtcctgaacacacatgagtccaatatggatgcatttaaaaacttcgctgagggaacagctctccaaaattgatttgtccacaaaatccctttgtcttccatctttccataagttccatgcctgaaacaagagaataacttcaatatttgttctggcaatgttatgtttgttctttgattgttaaattttgaagcattgggtaccggcaacacttacgtaagctataaggtttggaaaatccatcacaagatgatgaggtgagctgatctttaatccacttacaatttctagaagcaaaataccaaagctatatgtgtcggacttgactgaaaaggtgccttccattgcatattcaggtgacatgtaaccactatttgaataagaaagaagtttaataatttccagaacctgggtatttgaataatttggttggcaagagcagaagttacttactatgtcccaacaactcgtctagtactttcttgttgctcattgcctccaaatatcctcgccataccaaaatccgatattttggggttcatctctccatcgagcagtatgttgcttgctttgagatctctatgaattatcttcattcttgaatcttgatggagataaagaagtcctcttgctacccctttgataatgttgaaccttgtcagccaatcaagtgtagcctctgttgtatgatctgcccagaacacagttaggatagtagaatcaaacaaataattaaccaagcaagagtatttctttggattggtcgaacatactgaaaaggaatttatctaagcttttgttgggcaagtattcgtaaataagcagcttctcatctccatgaatacagcaaccaagaagtctaactaagtttttgtgttgcagtttggcaataagaaccagttcatttctgaactgctccatcccttgctcagaacacttgctgagccttttaacagcaatttccttgccatcctccaatgttccctgtgtgatttcatcattattaaagtaataggagtaaatgacatcgctattcctcatatcattgacagaatgacaaggtaaaattatatatcaccttatatactttgccaaaacctccttttccaagcatgttggtgtcatggaaactgtctgttgcagcagtgatgtcttcaaagctaatacatggaaattccagattttgatcccacaaatcatgaatagtgctcaactgttgaatgacaggtcttttcgttttttccttgttttgtcggacgccttatagtaaaatcaacaatgtcaatacttacagttactgacaagatatatgcacgctttgcaattaagcaggtcctactgcttatagtacctcttgacttgcatttactgacaagatatatgcacgctgtgagtattagtaggcacactatagctgggagtacaatatttaccaccatgtgcctcttcttctttctgtttactgtagaatttgaccctgtgaagaatgtgggtgaacagaagttacagcgtcaaacatacagtagcttgcaagcttgtgggagatagtaacctggtggtcgtgttcaaaaacaggcatgctaaatttagactaccaccttcactagattcttttttctttctgttgagtttgaagtgtgtcctatcaacacaagtgaacaaaattcaggactgctaatctaagagctattctatcgtcgcaggggaaaaagggtgggcataccagtagaatcggccaaccggaggtacaggttctcagcaatggtgttcctgatgtccctccacgcgtcggcaagctcccctgtccaaagcaaacaccttggctggttggacatggtgccggttgcggtcaagttggtgtaggcgtaggccgtgcacgagcagttgcgggtacactcgtccgtgcactcgtcgaagtttctgttctggacatgcaagaacttgtcaggaaccttcattctagacatgatccaaaatggtcatctccacatctcaattgttgctttctccggcatcctgaagaagaattggagccaacaggctcaaacccatcgaggcattggcaacttgggacggccgacgtgaggtcgcagtagccgaatgggccacacgagccataggtatcgcagccaggggcccttgggagttgatttgcgacagtccatgaggacaagctgctgttccaactcatgaacctaaagttgcccatgtagtcaatcatgacgcgcgtgtatggtgaatcatcagagattgtgtacttgaggtaaaactcatccttagtgttcacgactgttttatagacaaaagaggtgctgttgtgcaagtatgttgcaccggacaccgagacactatcaaacagaatgaaacggtaatatggccttgtctcgtgccagatgaagatctgaaagtttgacgtgggatcgccgctgaaggagaaatccccggtggatgggtcatctgggcccttccaagcgatgaaccgcatggcgacttgtccgtaggatctcactaaaaacttcatgttgggcagaatggtatcagttggttgatcaaagctttgccatatggttgtattgttcgatagccgaagaaccaaatttcctgagtcgagcagcaccgcgtaaactccgtcgtcttcggtgacaatactgttgggacttgccatcgtcgtccatagggtgcggcctttggaatctgacaatacaagagcagaattgttgctgatggagagcgtcgcggatgaagatgcagcgatcgggtcgtcgcggttggcaacccaaacataggtgcgctcggagatattgtgataccatataccaaggaataagctctggttggaggtggccggagagaagaatccgagcgcaaagtctccacctttggagatgagcatgtcgctaggagagattagtcgcttcgcatgtctcaactggtcatcgcatctgcagaaagagattagtagtagcaagtggatgaaaactgggaggttgtggctcaggcaggccatatttgttctgccttgtttcttcgcttagctgcgagcctgcgaagcacgaagcacacagaaatatacattgttatcattcagtatatatgttactgacgtacgtatacattgtttccagaatcttgagaccgaaggaactaggaagcgacgtgtatgcagatacttttttgtccgtcatatcgggatgaaacacaaaggaaattaggaaaacctgtacgttcaaaaacctactagacagaaaaacccagcacaacaggctgcgttctcaacagattacggattactaacgacggatgaaaatgactttattgactataaatcgagagtacaaacggaaaatattaaaaagttgccgtgcaaactaaaactttagaaataaaatatgaaccaaagtataatttgctctgggcaattaaaaggctgactagcagctgagtccatagacgagcaaggtggtgcaacctgcaaagaaggcttaccgcgatgatacgtggccgcgcattatcttctaatccatcagcccttttctcggcttaccgcgatacagggcagagcatcttcatggccatggtaaaaagagatgcatggcagataagtgaggataccgtacgttgcccttgaccccaagaaaaggatatcgtaataggatggcatcaccataaatgtcatgctgtgtattcttagaaaatgcagttaaaggagaattctatggtttatcattgacaaacgctcgaatctggtttctcattagggaacatgagtcgtacagtgtatatgcaatcctactattgttttcctttccttaaccagatttattgtacctagacagggtgggtcgaccgatccagctacacaatgacgaagccaggatttagagataggggtggtggcacgagacgtaagaactcatcaacgcctcggtagacaatgatgtgaatcttgg

SEQ ID NO: 37130 - DNA, 2218 bp, Oryza sativa
gtgtcggcctacatttccaagaccccctacctctttatagtagtcatttttttcaaacctcagttttataaagaggtccatcgcagcgaaatttaaccgtcgatactcgatcgaacggtgggggaggagagaaaggagacacgtggcatattttcagaggcgcaaaacttgatttctgagacgccacgtggcccaatctttggctagggttagaaccctataatcggtattagagattagataggcactgcacctttgagaggtgtgcaagttcaacagagacctgccgcgcttcttcccttgatgccgtctgctccctgcttaaccgccaccgcctgcatcctcgatccggcctccacgtcctggccggcggccgctcgctctcctgcctcgccgcgccttcgcctgcaacatctccgccacctcagtagcggatcgggaattcgggaggaacggcctccacctcggatgggccgccccagtgccggctcggtggcctctactctacggctgggctggctccggcgggcctataattagtccatcaacgatcctgtgatttaatccatgaagcctataaggaaatgaacgagcaccacctccagcatcatcgagatgggccgagtatttacagcccaactctaccattgactacctgctgaggaaataagttcactttaggtccctctatttgtcggtcagtccgattttcgtcccttgaccgcaagaccgggtacgacccgtcccccaacttacgaaaccgggtaaacgaggtccctcggcagtatggagggcggttttggccgacgtggctcctttgactaggtcttcatcccacgtggcgttgacgtggcgcttacgtggtaattttatcccgaaaaaataataaaaaccgtaggacccacatgtcagatacatgtaaaaataatttaaaaaggtagtgcccatgtggtcctacatgtcagcctccctcttctctctatcccctctctccctctcccatacactgcaagcctgcaaggagaagggcgagcggtggcggacggtggccttgctcccggtctccgcgggcgccgccaacgacatcggcgctagggctgtcaacgagccgagctcgagcgagcttgcctgcctatgctcgagctcgatataagctcgaactaagcctgtttgagctcgatcaagctcgagctcgactatcgagctcgatttttaattagaacaatgtatatttcaaaggataatttttaaaaaaatttaatttattgtttatcatattagtataagaggaaaaagaataaaataaacattcgatgctaatacaaggcatacaaataacatatttgatctaccaatttattaaatagcaataaaaaatcatatattactaggctcgttagaagctcgagctcggctcgacaaagctcacgagctttgggacagctcgggctcggctcgtttggagctcgagccgagctcgaatcgagcctaggacgagtcgagctcgagcagctcgcgagtctcgagcttttttgacagccctaatggccgcggtggcggcggcaacgtgtgacgacaccgtcggggagtgcgacgtggacgatgaggaggaggtggaggagatggcgttgatgggggcggccggcgccgccgccggggagaccggttgtcgcacgttgcagcggaggctgctcgattacctcgccgcgcgccccgagtggcggaggtccggcgggagggaccacgtcgtgctcgcgcaccaccccaacgggatgctcgacgcgcgctacaagctctggccatgcgtcttcgtgctctgcgacttcgggaggtacccgcccagcgtcgttggcctcgacaaggacgtcatcgcgccgtaccggcacgtcgtccccaacttcgctggccaacgactccgccggctacgatgaccgggcgacgctgctctacttccagggcgccatttaaaggaaagatgtgaatgccttgttacttactgtactctttaaaagattcttaggttcaggccaataatataatgcatgctaccactttggcttgtatagatcgagctgagagagaaactgaagattttttttggcagcagtagcagttgctcacgtacgctttggatagagtcgatatgtacatacacatatgagagcagcgtattcactgccgccgccggcaacggcagtgacgccggcgaaggaagagg

SEQ ID NO: 37131 - DNA, 5857 bp, Oryza sativa
gcgcagttctggtagtaggactgaccgcgcttattgcacgacaccttgttggcgtccagcaccgcgtagctcacctaccagttcgtcggccgccgcatcagcgtctccccggcggcggcggcggcggccgcccccatcaacgccatctcctccacctcctcctcgtcgtccacgtcgcactccctgacggcgccgtcgcacgtctccaccgccgccgccatctgccaccgccccgacgccaccacgcccatgtcgtcggtagcgcccgcggccaggagcaacgttcaccgcccgccgccgctcgtccttctccttcagcgtaagggagagggagagaggggatagagaggaggaggctgacatgtggaaccacatggccccaccttttttaattatttttatatgtagctgacatgtagccatatgggttctacggtttttattattttttgggataaaattggcacgtaagcgccaccttaacactatgtgggatgaagatctagttaaaggagccacgtaggcgccacgtcggcaaaaaccgtcctctatactgccaagggatctcgtttgtccggttttcgtaagttggggaatgggtcgtatccggttttgcggccaagagacgaaaatcggaccaaccgacaaatagagggacctaaagtgaacttattccacctgctgagtgctgagcaagagcatgagattacttcgccatggcaaggacaaaagcatatctgcatatgccgcgaggtttcgctgccgtcgacttttctcgatctctatcgagagttcagttttgtagcgatagtttatcttttcggcttttgacggaagaaaataggtctcggcgacagattgttcttttttttttcttcaccagatttttgtcacatgttatttactcccacgctcgatcttcttttttttcaaatagtttggatcatttattctaagctatttgttctatgtaaaataatctattttaatagcccgtgcaaaaatcatatgtgttgtctcagttttccaaatatgtgtttatagaggtgagtgtgtgaacgttatactgtgttttaaaaaaacatatatattgtaggccagctatttgctctaaactattttgtgttaagctacctgtactaagttattttgtttttttaatgtttcttaacgaaaaatgaggtatgtaactaggacttcccatgaggtctcgtcaactatagacttgttggctgacgggtggttagtacagcgctaccgatgccatgaaatggaatttggttaatcgtggagtgaggtcgatgtcatgacgcagatcatcaacgtgccgcgttcaactctcagatcattttggtcttctggcttatttggaaacaacgttaatgcaaaaatcttccaatctgaatccaatacgcctctggagtctggaggttagaagatcaagaaggaattttgcgtctcgcctgactgctgatttctatttttttttgagcggaacatatattccatttacttattactgatacggccaaatcgccctgattgctgatttctttgtttcataccggtttgataatacttttcgttttggataagggcacggtctctaaaaaacaactttgaccattatttttcattataatatgtataaaattgttaacaaatatacgattatattaaagtactttttaagactaatctatacatatagtcaccatatttaaaagacaaatattttaaaaatgatttataatcaaagattataaagtttgactacacccttatccaaaacgacaagtattatcagcctggagggagtagtaaactttcagaaattaactagagatttctccttttgctgtaaccgtttttaacaggatctattgtacttgttggcagccttgttttattagttacagttgtactgttctggccaggttcttttgccgtcccgggaaaggtaaaaaaggaaaaaggaaaaaaaaataacagtataacggtttcgctctcgttgattttctcgtcgtatccgaacttcgttttcgctttgcgcgtgcatcctgatctggaaggacagaaatgtcttggccgtatgtttgctttcttcggtccaaccatgctctaagactatgggaaatcatctagtatgcatctgataattggatacatatgctctatttcttcacatttacatttttgaaggcaactaggaaacagaagaacaagacctaatgagatttagagccaaagtatggaaggaaaaggaagatgaatgcaagaaccttggtggttggtgtggcaggaacggaacagaagaatttccaacaccaaagccagagggagaagcaaaagtagctgcccaattgtgcaggagttaaatcagatagagcttagcagagcttagcctggtaatttcaagagctacgagagcagttctcctttttatcagatgtacatcttcttttccagttgcctcgcctctcctcgggctcttcttttgtaagactctgtgtctttttaatcgcataatctaattttgattttgcagagctcctgccttgcttgtccaaaaaagaagaacaagggccagatgaatatggcctacctcccagttctcatctacttgctgctcatctctttctgcaaatgcgatgatcagctgacacaggtaaatcgattgatctcccccagcggcaagctcgtctccaagagcggcgtctttgcactcggtttcttctccccagccacttccaaccagagcttattcctcggcatatggtataacaacatcccagagcgaacatacgtttgggttgctaaccgtgacaacccaatcaccacaccttcatcagcgatgctcgccatcagcaatagttctgaccttgtattgtcagattccaaaggtcgcaccgtctggacgacaatggcaaatgtcaccggaggtgacggagcttatgcagtgctgctcgactcaggaaacttggttctccggctgtcaaacaatgtaaccatatggcaaagtttcgatcacccaactgacaccattctgtcgaacatgaagattctgctgaggtacaaggagcaagtaggcatgcggcttgtagcttggaagggccttgatgatccaacaacgggggacttctcatgcagcggagaccccagctcagaccttcaggtcttcgtctggcacgggaccaagccatattaccgctccattgtgcttgacagtgtgtgggtgtccggcaaagcatatggcagcagcacctccttcatgtaccaaacatatgtaaacacacaggatgagttctatgttatctacaccacctctgatggctcaccatacatgcgcatcatgcttgactacacgggcaccttcaggctcctgagttggaacgtcaactcgtcatcatgggcaatctattctcaacgcccagcagccattggcgattgtgatccctacggctcgtgtggcccattcggttactgtgacttcacgtcggtcatcccaagatgccagtgcccggatggatttgagcctaacggctccaactcttcaagtggatgccggagaaagcaacaattaagatgtggagaagggaaccatttcatgaccatgcctggaatgaagctccctgacaagttcttttatgtccaggacagaagctttgaggagtgcgcggctgagtgtagccgaaactgctcatgcacggcctatgcttacaccaacttgaccataaccggctctcccggtaccacagccagccagtcaaggtgcttgctttgggttggtgagcttgttgacatggcgaggaacaatcttggtgacaacttgtacctccggttggccgactctccaggtatgcccaccttttatccctgtggtgacaaatgacaataaagatcttagatagcctgaacatccaattaaaagcaacatccatgcatatacctgcaatctatggttagaaattctgaaagcttcttcatttctcttaataggtcataaaaagagcaggtatgtagtcaaggttgtagtccccattatagcatgcgtgctaatgctcacgtgcatataccttgtctggaaatggatatcaaaaggtacagcaggagccaatactcaacaccgactcatatcatgttttcctcctgtaattgtacttatgatattgatgttcctattaggtgaaaagagaaataatgaaaatcagaatagagcgatgctaggaaactttagagcttctcatgaagtatatgagcaaaatcaggaattcccatgtattaattttgaagatgttgtcactgcaacaaacaattttagtgattcaaatatgcttggagaaggaggtttcggcaaggtttataaggtaacaatttacacagacaaacgcaacagtggagaaacctacaacattttatcatgctaaaatgatgttattatacagggcaagttgggaggtggcaaagaaattgcggttaaaagactcagtacaggttccacacagggattagagcattttacaaatgaagtggtccttattgccaaattgcagcacaaaaatcttgttaggcttcttggttgctgcattcatggagatgaaaagctccttatttatgaatacttaccaaacaaaagcttggatcacttcctttttggtactgttcagaaacttaccacatgatccagatataattggctgaatgcttactaattagcattattcaccattgttgatagatccagcaagtaaatttattcttgattggccaacaaggttcaagataatcaaaggagtagctagaggacttctttatctccaccaagattcaaggttaactataattcatagagatctcaaaacaagcaacatcttgttggatgcggatatgagtcctaagatatcggattttggtatggcaagaatctttggcggaaaccagcaagaagcaaatactaaccgagttgttggaacatagtgagtgatttatgtgttagtgtttagaatgatatttatttcctttcctgaaacaatatttgttacttattgctaaaactgttaagcagcggttacatgtctcctgaatacgcaatggatggggtcttttcagtcaagtctgacatatatagctttggtgttatactcttggagattgtaagcggtttgaagattagcttacctcagctgatggattttcccaacttgttggcctatgtaagtacggtgaaatgatctatcttcatataatgcaaactttttttcttttttttttgccgggtcggccgaaggaaccggcgaccaaatttcattaagattgggaggaatataatgcaaactaactgtactgattttatatggaccctattctattggttcaggcatggagattatggaaggatgataagaccatggatttggtggactcatccattgctgagagttgctcaaaaaacgaggttttactatgtatccacataggcctgttgtgcgtgcaagataatccaaatagtaggccactcatgtcttctgttgttttcatgttggagaacgaacaggcagcacttcccgctccaatacaacctgtgtattttgcacatagggcctctgaaaccaaacaaacaggggaaaataccagcagctctaataataacatgagtctcacggtattagagggacggtagatgtttatgttacctattttctgcatagaaagcatttagattttaccacttctgtaattagtttgttcttttccataaaatattagaaacaaagggcagatgttacattttttttggatgagttttttcttttatcatggcccttgagatggtatttttaatgtgcaggtattacaa

SEQ ID NO: 37132 - DNA, 2585 bp, Oryza sativa
agtaggctatatcaaaaaacactcccaagacaactgtatggagtgtaggatcataacatgcgtgattgtgtgcaatatattttggcatgacaattttttttgaggggaaatatgggaataacaaagtctttgatgacaaaattaattatttactatcgctttttatccactttcaatcattttcttcaggctcactcaataccaccaattaaaagtctgaaaaatatcctcaatctaaaaacttcgaccaagtcctagtagttaatcttggaatataaatccaaatcagaacttcagaagtataccttggcttcaagtggctcgcgacgaggtggcaccgtggcaccggccaccgggagcttggcgccacgacttgtaaccccgtgagggccgccgtcttcccccctcagccggctgccgtggcgtccgccgctacttctccaaatgcttcagccgagagcgattccccctaggctggcaaacttcctgtcgatgccgtctgctccctcgcgtggcagcacccgcgttgacgccacccgacgcgggctcgccggccatggccatggccgcagccactcgctctcctcccgccgcgcggcgccgctcccgtgccgccggcggccgccgccgcacgggattgggtcaaatcaggccgcatgtacgggagactcctggtccaatgggctagtgggccgtactgagttattgaggcccataaatacgaggccccagacggctcaaggcctaccaggtcggcacataaaacgagaaagtcattagtttaagattagtcaagttttaattactagtatgaattagaaaattaaatttatttgtggttttagaaaaacctttgtatagaaagttttctcataaaacatatccttaagcagtttcgaaacgtaatagtgaaaatcgagatagaatctacatcttaatcggaaaataacagggttcacgcgggctttttgaatgaggcgagatgttaatcagatgatcactacgctccttgcttttctgcgcgatatgattctgaaccacttaagtacagtagtactagcatttagcacgacttcacggatctttagctaggtcaaacgaagtttaataaagctatcgtcactttaccagcagttttcaacagcacgactatgatagggatgtgttgtggacttatcactttgatgaattatggtttccttttcttggggtcgagggcaacagtatccctcacttatgtttccattcatctctcttttgaccattgccatgaagatgctttaccctggctatcacgacggagagtacaccatgcatgttatatgcagtcacgaatcatccatgattccatggacagccaatcttctttgcagtttgcattaccatgcaactcacccatatggattcatctagctagtcaatcatgggatattactgtactacctccgtctcagaaagatcatagtttcacgttatttatgttcaacgtttcaccgttcgtattatttaaaaaattaaaatttttaaataagatagtcaaacgttagagacgagaatccacggctgcatttaaactggtacggagggacggaggtggcaggaagtaggaacgcacttgcagtcttcctatgcggcggggcactactagttcctagattccgtatatggctatgtttagttcagcgtaaagtttatattttggttaaaattagagatgatatgactgaaaagttatgtgtgtatgacaggttgatgtgatggaaaagtactgaagtttggatccaaaatttagattaagcacagcctatgtatggtgctcgtgagtcgtgagacactgaggccggccggcgtacgtgctccctgcacagcggccgtgaacaattttccaaggagatgcaaggaaaaaaagaatcaacagttatggaagcagcaaccaccaacattttctaccgtcccgtcatcttcttctccgtgctcctttgtttccaataccgtgccgccggcgttgcatcggacacgctcagcaatggccgcaacctcactgatggcgacacgctcgtgtcagccaatggctccttcactctggggttcttctcacccggcttgccaagcaggagatacctcgcgatatggttctccgagtcggcggacgccgtctgggtggccaaccgcgacagcccactgaacgacaccgccggcgtagtggttatcgatggcacgggcgggctcgtcctgctcgacggcgccgccggccaggccgcctggtcgtcgaacacgactggctcgtctccatcggtggcggtgcagctgctcgagtctgggaacctcgtcgtgcgcgaccagggcagcggcgacgtgctgtggcagtcgttcgacaacccgtcgaacaccctgatcgccggcatgaggctcggcaggaacccacggaccggcgccgagtggtccctcacgtcgtggcgcgcgcccgacgacccggcgacggggggctgccgccgcgtgatggacacgagagggctagcggactgcgtctcgtggtgcggcgccggcaagaagtaccgcacggggccatggaacgggctgtggtt

SEQ ID NO: 37133 - DNA, 2822 bp, Oryza sativa
tggcggggtcaaccccaatgttcccttcccaggggtccatgagggagacctccggtggttgccggaggaacgcgccgctggagtgcggcaacgggagcaccacggacgggttcgtgccggtgcgcggcgtgaagctccccgacacggacaacgccacggtggacacgggcgccacgcttgacgagtgcagggcgaggtgcttcgccaactgttcctgcgtcgcctacgccgccgcggacatccgaggcgccggcggcggcagcggatgcgtgatgtggacgggtgacgtcattgacgttcggtatgtcgacaaagggcaggatctctatttgaggctggcaaagcctgaactaggtacaacactgaaactaatgtgttcgagctaatgtgttcttgaggaggtaccataaggtaccactttttctattgtaaatttggtaccttttggtaactaggtactataaggtaccaaattttacactaaatttttgatacctcatgataccttcttaaggaccgtagaattgctcaatgtgtttggcaatggttaattacatatatatttccttcgctgtaaaatatcctagtactcggttaaacatcgcctagtactcgattagagtctataatatttgtgatgtctgattgagtactacgttactatattttagcgtggaggaagtactaattattttggtgaaatatttcttttcgcagttaacaataagaagaggactgtgataaaagttctgctcccagttacagcagcatgtttgcttctgctgatgagcatgttccttgtgtggttacgcaagtgcagaggtagataccgagccacctcacttctcagttctcacagcttatctaattaagaataatactactattaatattaaaatacacgatattgatattcctgtcaggcaaacgtcagaataaggttgtccagaaaaggatgctaggatacttgagtgcattaaatgaacttggtgatgaaaatttagaactcccgtttgtcagttttggagacattgctgctgcaacaaataatttttctgacgacaacatgctcggacaaggtggcttcggaaaggtttataaggtagcccacaaaaactgtattgaaaactacagtaggacaaaactatcgcacaatattcttcaattttagagcatattttttaggagtattacagaagaagtgccacaattagtactccctccgtccaaaaatataagagattttgggtgtcacatctacccaaaatcccttataccataggacggagggagtagtttactactgaaaagtgaaaacagtgataccatatgaaaatcccaattatggatgatgaactttatttttaaaaaagggagaaccgacaagaaacatggtgttaaataattaagaagaatgtgtgagcgtgttaagaatcgaataaggaaccttggggtcgaaaccacgtcccttatattgcggtaaaaagtgcatctcgagatgaactttcttaataaaaaaattaattgattaaattgtgtagggcatgctgggtgataacaaagaagtggcaattaaaaggcttagcaagggttctggacaaggagtagaagagttcagaaatgaagttgttctaattgccaaattgcagcacaggaacctcgttaaacttcttggctgttgcatacatggagatgagaagctgctaatttatgaatacttgccaaacaaaagcttggaagctttcattttcggtactgttcaaaaacataccatgcgatccaataaacttcactccatgcttactgatagagaaattttattgttcttgaaaaagtatctcaagatacctaaattttacactaaaatttttggtaccttgagatatttagtatctgaaggtaccaaaatttacaataaacaatgtgatacttaccagtactttctcaaagatgataaaattatccttactataagaacattgtataccattcttgatagatcctgcaagtaagtatgctcttgattggccaacaaggtttaagataatcaaaggagtagctagaggacttctttatctccaccaagactcaaggttgacaataattcatagagatctcaaatcaagcaacatcttgttggatgtggatatgagccctaagatatctgattttggtatggcaagaatcttcggtggcaaccagcaagaagccaatactaaccgagttgttggaacatagtgagtgatccaggaatttgttttttactattacattgatttcctgaaaaatcctttgttacttattactaaaactgttaagcagtggttacatgtctcctgaatatgcaatggatggcgccttttcagtcaagtccgacacatatagctatggtgttatactcttggagattgtaagtggtctgaagattagcttacctcggctgatggactttcccaacctattagcttatgtaagtaccatggaatgctctatgtccataaaaattcaaaataactataccgcttttatatggactgatctatttcactgtttaggcatggagcttatggaaggatgacaaggccatggatttggtggattcatccattgctgagagttgctcaaaaatggaagttttactatgtatccacatagggctgttgtgcgtgcaagataatccaaataataggccacccatgtcttctgttgttttcatgttagagaatgaagctgcagcgcttccagctccaatacaacctgtgtattttgcacatagggcctctggagccaaacaatcaggaggaaataccagcagctctaat

SEQ ID NO: 37134 - DNA, 4385 bp, Oryza sativa
  unsure (1)..(4385): unsure at all n locations
nnnnnnnnnnnnnnnnnnnnnnnnnnnnnnnnnnnnnnnnnnnagggcgattttgtactgtgctctatatttttttatataaatatcaatagttatcaaatctttttatattgaaaactatacaagattaaaatctccaagactggtaaaatacaattttattattttttagggcatatttggaatgttaccgtacaaatattttgttaatgccaaaatataagcaagttttggcactaccaaatatttggtaaggtaaaattgcatttgatcatatttggtttgctgccaaaatgtaaaattgtagtgaagaatgttgtacataatctcaattctagattacgtattaccaattaataggcttccattttcgtgtgtggtgtggtagtgggaaagaagatatgaagaggttgccttcagattgtcaattatatagcgtcgttttcactgcaatacatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtgcgcgctactggatatggcactaccgtgaagcgccgaaagtgtgttgttgtgagcataagttgttcaagcaccatacgaatgaaaagaactacgtagacgagacaaacacaagtagtactgcagtagtaatagcaaaagtagtactgctttacaagtttgtaagccaaaagaaacggtcacataaggactgaagaggtagaacactactgacgaggcctctaacccctgtccctcctaccctgcgccntaatgtgcccctggaagtacgtgagtcggtccgggggtacggcacggccaacccgtcctgcctgtacaggtgtgacctctggctgctcctgagtgtgcgcctctggagctcctccaagctgagaggagcctagtacgtcctggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtacaggtatttaacagtattaataaaaagtaaagtaccgtgtgggcgagggaacgacgctccgtgagaggaagagctggcgaacgcgcccgaagaggtggcgaacgcccctgcggagctcgcggaagcgccggtcgtgcctgcgaacgcgctcgaaggcatacgaggtcctgcgatgaggaaacgtgcagttaaaacatggtgacacattcgtgcaaaagctgaaacaaaaatgaactaatatctgggctgaactgtaccgtgcgaaaccggtgctgtaggtcgcactgctccgaagctaggggcgctcgaagacaaacgaggtcctgctccgacggtaggaccgcgaggccgtgggtgtaccggaccagctggaggtacgacgtccacggcgctgcgacaggagaagacgcgcatgaccgcacgcatcttctcctgcatccggtcgaaggtcgacctctgctcaacgtcagtcaagtgcaaacctctgctcaacctcacctggactgcggtgatatcggcactgatatcccgtgccgcatcagcctatgcaagatggaaataaaaaattcagtagttgtcctatattatgcaagataaatgacataattgttggaagtaatacgaaattggacgtaccgccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattgtatggctcgatgatgtaattatcataaaaatttagaaatgaacaatccgaactcacgagtggtcggcaggggggacggtcggctgcacgttgcccggaaacacctgcctaagtccgaactgtcgcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaaggaaaaaaaaagaagaggactgataaacttataacgcagggaagttgcactaaccccacgtcgacaccagtaagtccccatcgtgggaccgtcctctggccactgcgcgctgcgaccaaccccgtagggtgcgctgtccaccactggtcgccctatggcaaacctctcggctgcccaaagctgaagcaacataggacagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcctacagttaagaatgaaatgttagtacaaaacactcatccggtcgcaaataagcatgtatgataataacaacttatttacttacagtgaactggagcaaccaagccttgctaggcccgactgtagagtacggaggaagggtggtggtcggtcctaggtgtggaaggcgcatcacctgctcgaagcgcgcagtgatatcctccttccacccaaaaacaccgtcgacgggaccaactggtgctcccgccagcggtagcccgagcaggtacgacacgtcctgcagtgtcggagccatctccccacagggaaggtggaacgtgtgcgtctcaggtctccagcggtctacaagagcggcaaggagtgaccggtctgcatcccaccgcttcgctgggtcacggtcgtccgccgccgcctcaacaagcctacaaagtggtagaaggcctgccgcacgcaacctgtatagagcaaacttcaaacataagtgcaaaacaaagcaaagttgagttcaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacagttcaacagcgccggtgtgtcgtacgccatacctgcatcaaataggttgatcagaaacatataaataattagttcaacataagtaataaatgttcataagcgaattactaacacatattaaacaagagtacaaacaaacaaaagtgtttagtccgaacactcatcacgataacattacgatacaacaccgaatagttcgcaatactactagtacaacaatagtcggaggtactcattacaacaagattgaattgaaattacacgatagaagtatttagtccgaacactcattacatcattttatttcctaaatcgaaagcattgttacaccatggaatcgcctggagtcgagctgcaggcatgcaacttgcgcgcctgcttgttgttccttcaccaggtggtcgcctaccatcacttgcctgtccagatggactagcatcagcgccgcttggaacttctgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagaaagaacgtgtgagcaaggaaggtgatgaagcttgagtattnnnnnnnnnnnnnnnnnnnnnnnnnnnnnnnnnnnnnnnnnn

SEQ ID NO: 37135 - DNA, 559 bp, Oryza sativa
ttggaaggaggcaaagaagttgctgtcaaaagactcggtacaggttccacacagggggtagagcattttacaaatgaagtggttcttattgccaaattgcagcacaaaaatctagtcaggcttcttggttgctgcattcatggagaagagaagcttcttatttatgaatacttaccaaacagaagcctggattacttcctttttggtatgtaataattatatattctctttttacctttttcacttttggtgggagaggccgagagggttcccaaagcctgaacaacaataagtttcctttcataatgtccgtcgtagatgattcaaaaaagtctatgcttgattggcgaacacggttcaacataatcaaaggagtagctagaggacttgtttatctccaccaagactcaaggatgacaataattcacagagatctcaaagccagcaacattttattggatgagcagatgagccccaaaatatcagattttggtatggcgagaatctttggtagcaaccagcatcaagcaaacactaagcatgtagtcgggacatagtg

SEQ ID NO: 37136 - DNA, 757 bp, Oryza sativa
  unsure (1)..(757): unsure at all n locations
cccaagtgacgtcggctgccccggcacggaggcgccacgtcaacccgcgaacgggcgcgggtgccgcggagccatccgtcgaacaggggcagtgaaccggcggagggcggctcggcccgcacgtcaaagtgccccgacgcccggcgtccgccgctcccaatgcagcgcgcgcgagatggaagccgaaggggttgcatcatgccattgccgcctagggagaggacaaaaaaagcgctcggctgaggcagtagggagggggacggattagcggccatggcagccggctgatgaggcggaagacacggcgagcctaacctgcactgttccggacgctcacgggtgtcacatgcttgtgcggcggtgacacaagttcgcggtgccacctcgacacgacgcgacgtcgcgagccccatccaagccaggtattgctaatttcgatttcgaattctatttcaagatcagctataatctttgggaaaataaaaaaggaaactcgtttccagtacaatgggatcaaagtttgtgtactaaggaatttgttaagatttgttagaaacttagaataataaattttgtagaatataattatatggcatatatgttatgatcctactctagctccttaagattaattactcctatgcatgttcaccgtgcattcctcctttttggtacgtataacctggtgtagaacttccgactnnnnnnnnnnnnnnnnnnnnnnnnnnnnnnnnnnnnnnnnnnnnnnnnnnnnnnn

SEQ ID NO: 37137 - DNA, 1647 bp, Oryza sativa
  unsure (1)..(1647): unsure at all n locations
taaggggtagtaactggtgtgacttttaaaaactatagcattagaaacacgagaatgataaggtatgtagtggacggttgtagaggagtataatggtaacgtttgacgggacttatagaaattataaaaatgaagcctaacaggacgataaactctatagtttagatccaatttttaaaggttccaaggagaataaatagaaacagtggtagatcaagtggtagatcaagcaaactaataaagaataatatgatagaagtaaggggtagcaactggtgtgacttttaaaaactataaaattagaaacacgaggatgataaggtttggtttttcaaaatcttaagacatcgaaataactatttaataaattttaagtaaaatcatattaaaaatatataattttatatgggtgctagccgtgcaattgcacgggccacccagctagtttttaataatttaaggggggtaaaatgagaaaacaaatagtttaaatgttaagtgaacaagttcgggtaagtaaaatggaccgttttttcaagtaaaaagcagcttgacatgagtaatttacacttccccgcaaaaaatgagtaatttacgctagcaaacctatacagagggttcaggacaagaagtttgttttggcacatgattttctgggaatagaccaattgcgttgcatgaaaatatgacattactcggaaaattttgcagttctcgaatacagccggtcgaatctacacagggctgataactaataaactagtagtatatataaacccccaaaaaggcagtatcgctaacagtagtagcgaacattctgaaatctgaactctgaatcacttatagctcagctaaggtgagcaacatcaccctcatcagggaacttgaacgtatcagctgcaccaaacttcttcctcccctcctcccactcatcttcgtcctccaagctgttgcgctcgtcgtcgtcgtggttgctacagcacatcggcgacgaggggtcgttgacgctcttcgacttgcacgggtcgctggcgagcatggtgacctgacggaggtgagagatctcgacgaccacggtgtcatcgtctttgggaagaggctgcttccatggctccccatcgatcctcatgaacgtgtgctcggctgctcctttgtggaactcgaaccggattctatgggcctgaaaaatgtgaaatgtgtgactgcatcagcaatgctagctgaaatgtagggagttcaggaaatgggttgagaacagatgcatcacctgtgctagacgagttccatggccattaggggcaagcaagacaagaccgtgccaggcatcgcgaaagccgacaacctcgataaggccgtcgtcgacaaatggtgcagtcaggtctctctgcatattgccatgaaaacttataaattctttgcccatggcaaagccattaggagtgaaacgacaacagaagaggcaagtgctctacttacatcttgtactttcctggtgccaggtgttccccaaggattcagtcctccagaaaaacttggcagattcagacagacgattgatcgaatgctgaaacaatagagggaatatatgttnnnnnnnnnnnnnnnnnnnnnnnnnnnnnnnnnnnnnnnnnnnnnnnnnnnnnnnnn

SEQ ID NO: 37138 - DNA, 2226 bp, Oryza sativa
  unsure (1)..(2226): unsure at all n locations
gtgagacgaacctgcgagggggtcggttgaatggccaccttggaggagaaatcaggttcccccggcatggttccgtctcccccgtcttgcggagccgtttcttcttgcgctccccctcgggctgcgacgtcggcgcggccccctccgggcgccgactggtggcacgcgccgccccgccccctcggggaggagatgggggaggtgttcctcccagcttcctcttcccctgggcgtcggcagggcggctttttcccgagcccccggcgcggggcccaggagcacgactccctcctggggcagattgttcccctcggcggcgctcgcccgcgccatcgtggcccttaggggctctctcctctgaggccccgacccccatcataatggttagaatggaggcgcggtcgggatcgctgcagagggggaggatctcctgaggaatgcgagacgcctccgcggagctaagattcagcaccctttggaccacgatcttgaagtcctcgggagcccaatcccatctggctccctggtgggtccgcatgtagtcttcaggcccagtgtactcccaggcgttccgggcgcgccgttggagcggcgcaatccggcgacggaggtaatcgccgtacaccatggccccggtgagcccctgggatcgcaggcccgccaggcggtcgaggacggcgtcgtagtcctcccccagatctactggtgcccgccagctggagacctgtgccgggggctggcttggaagtcggaggcgcgcttcgttggtgaggggggtgtagaaccagtcgctcttccagtcgtcccacttcttgcgaaggacgcaggggatgtagcggttcagcaccggcccccgcggctggaagtagcagccgccaaccaccgacggcggtgacaccgactgcacggtgaagaaccaccggaacagctgaagagaggggcgcaccccgatgaacatctcgcacagatgcgcgaagatggccaatgtcatcaccgcattgggggtgaggtgcgccatctggaggtcatagaactccaggacatccatgaagaaatgagaaaatggcgggaccagcccagccatcgcgaaggggaggaagaagatggaccgccccgggtagtctggtgccgggcgcccctcgcccagcatcactatctcccgaccggtggcggactccggcatgaagcggcgcggcagtccggcgtgcctctcattcacgatgcgggaaggcggtagtacactgccgtcgagcagagcagagccccgtgccatggcggcggaggaagagatgattgagaacgagcgcgtgtggcgaaagtagggcgtagcagagaaagagttagagctcaggtggcgaaggcaagaggaacaatggcgaaaggaaggaagcaaatccttttctcgatgcttttatacccttgccatcgctgggcctgactcctcgtttctcgcgcccactacctcgctccctcgtatctcgctatctcgctccctcgtttcccgtgcccacgcttccactaatcccattcgcccgcttacggcgcattgagtggatatgcggttgtggcaatcgaaatggattgtatcgtgcgcgcgttaattacgctcgccgaccgaagcggcgttaccatatctccgggcgagacgaatctgctcacccagattcgcgcgctgctcaagtggtgtggcagtcttgaatagaccgcccattatggacaaccaaagttaccaataccaatgtgcatggattgagaccgttgggtattttgcccaactacggagaccggtcccacctgtcacagggtggcgtcacacctgaccgcttcccttgggaagggaaattgctctggcataacgccgggggctactgtcggtgatatgggaccgggagtatcatgactagaggcttgaggcagacacaatcgcccacgtggcctggcaccttcggggacgtcgggcccgagggtgaggtgtccgccctcctcctgatttcccccgagggggggtcgggttgcgcttgccccggccccgagggccgaggcaccccgacccccttaaggaagtctgcgccacatatatgggataagtgagcacagctgtgctcacctaacagcatttattgcagtctggtcaagcgtgtcacgctgcatgcagcgcagtacggcgcgttnnnnnnnnnnnnnnnnnnnnnnnnnnnnnnnnnnnnnnnnnnnnnnnnnnnnnnn

SEQ ID NO: 37139 - DNA, 376 bp, Oryza sativa
  unsure (1)..(376): unsure at all n locations
nnnnnnnnnnnnnnnnnnnnnnnnnnnnnnnnnnnnnnnnnnnnnnnnatatcaaggctgggagagaaggcgcttcccttgtttaagctcctcaagcgctcggggccgttcacttggacggaggaagctgaacatgcccttactcagttaaaggcatatctcagctctcccccggttctagtcgccccggagccaaatgagcccctgctactttacttagcggcgaccccccaagtagttagtgcagcgttggctgtggagcgcgatgaagacaatcctcattccgcgcacccccaccctgtgctgacttggcccgggagcaagcagggaggagaggcccccgagccgaacggtggcctaaggggtaccgagctcg

SEQ ID NO: 37140 - DNA, 905 bp, Oryza sativa
ctgatcctgaaaggatgttgaaatatttttttgtacaacacacaatcttgggagaaccacatattccacatattctagttagtgtaatgttaatactctctccttccctaaatgtttgacgccgttgacttttctaaacatgtttgaccgttcgtcttattcaaaaacttttgtgaaatgtataaaactatatgtatacataatagtatatttaataataaatcaaatgatatgaaaagaattaataattacttaatttttttgaataagacgaacggtcaaacatttttaaaaaagtcaacggcgtcaaatgttttgggatggagggagtatatgtctcttgtttctattaattttatggaaatccacaatccgattacaggacttgtccaaaggaaacgctttgtgcctttgcgtgcaaaaagtaaatctaccgtccttctaataccgtgaggctcatgttattattagagctgctggtatttcctcctgattgtttggctccagaggccctatgtgcaaaatacacaggttgtattggagctggaagcgctgcagcttcattctctaacatgaaaacaacagaagacatgggtggcctattatttggattatcttgcacgcacaacagccctatgtggatacatagtaaaacttccatttttgagcaactctcagcaatggatgaatccaccaaatccatggccttgtcatccttccataagctccatgcctaaacagtgaaatagatcagtccatataaaagcggtatagttattttggatttttatggacatagagcattccatggtacttacataagctaataggttgggaaaggtcatcagccgaggtaagctaatcttcagacacttaccatctccaagagtatacaccatagctat

SEQ ID NO: 37141 - DNA, 335 bp, Oryza sativa
  unsure (1)..(335): unsure at all n locations
gaccagggcggactctgccgcttgaactacgcgctgcggtccatccacaaggcggccaaggccaacgccgccggcagtctcgcagggcaagaagctgccagcttctgcggcggcggtggcggataggaggagagcggagaaggccgaggaggggttgaggacagtcatgtacctcagctgctggggtcccaattagctaggccattagtgttagctcggatggatctcgatctgctctgctgggtgtccgtttgacggtagcagccatggccggagacgtaattnnnnnnnnnnnnnnnnnnnnnnnnnnnnnnnnnnnnnnnnnnnnnnnnnnn

SEQ ID NO: 37142 - DNA, 744 bp, Oryza sativa
  unsure (1)..(744): unsure at all n locations
tcctcccaatcttaataaaatttggtcgccggttctttcggccgacccggcaaaaaaaaaagaaaaaaagtttgcattatatgaagatagatcatttcaccgtacttacataggccaacaagttgggaaaatccatcagctgaggtaagctaatcttcaaaccgcttacaatctccaagagtataacaccaaagctatatatgtcagacttgactgaaaagaccccatccattgcgtattcaggagacatgtaaccgctgcttaacagttttagcaataagtaacaaatattgtttcaggaaaggaaataaatatcattctaaacactaacacataaatcactcactatgttccaacaactcggttagtatttgcttcttgctggtttccgccaaagattcttgccataccaaaatccgatatcttaggactcatatccgcatccaacaagatgttgcttgttttgagatctctatgaattatagttaaccttgaatcttggtggagataaagaagtcctctagctactcctttgattatcttgaaccttgttggccaatcaagaataaatttacttgctggatctatcaacaatggtgaataatgctaattagtaagcattcagccaattatatctggatcatgtggtaagtttttgaacagtaccaaaacggaagtgatccaagctnnnnnnnnnnnnnnnnnnnnnnnnnnnnnnnnnnnnnnnnnnnnnnnnnnnnnnnn

SEQ ID NO: 37143 - DNA, 875 bp, Oryza sativa
gcccctccccccctccgtggccggcgttgacgacggccggcgccgaggtaagaattagggttagggtttttggttcttttgatccgtgcggatcttgtgcttttctttctttggatttctttccccgaaacgatctaaacactagggttgctctgataccattgttatactttgctctaggatcacctaggttagatctagtcgggtggttctatttgggtttgatgaacgacattgtagatgaaagggagagggtttagataccgaccggttgaggagttcgtggaggaagaggcgccagacatcgtcgttgtcgtcgcggcttgacgtggatgcggcgccggtgaggtcgacggtgatgacggctgcggcagtggtggtcgtagacgtcccggcgataaggcgtggcgcgacggtggcgtttcccgtcactggctgcgccccctctcgatcggattagggttttgtggggtggagttgccgacgccggtgaatctcgtgtgatgtgccgtgccggcctccacccctcttttatatggcgcagtgtgacgggggacaaccagccattgggctgggcgcccccgatcagggcgcggtcaaggcccccttgagccgttgggctcaaggggagagagatctatctaacattctcccccttgatctcactttttcttttagctttttctattccatcacagatttgtaaatagagcatgtttcatcgtcacggtcaatcgccgatggattcgacagccactatacacatctctattcagaaacagatactttacttttgggccctgtagtccaggattcataaggcttcccttaaacccatgccggctatatgttccttgaacacgttgggtggtagg

SEQ ID NO: 37144 - DNA, 689 bp, Oryza sativa
gataaggggagtaaaccgaaatctcttttattttgatgaggggaaatacatcgttttaaattggtcaagaaacagggcatcaggattggatgattcattgatgtgttgtaaagaaggaaataagaaagagtcagtttttgcgctcttttcggtctcggtggttctagagtccatcctttcggatgaccggctgtggtcgttagtggacgttgcttcctttggggacttgttaggagtacagcgtggttctgcctcccttccgctgtttggagtagtgtaacccgtcgtacgagtttttctttttcttccttgtttttttagtctctgttttcttctttccttggtatagaccggtttggctgattgcgtaacaagaactctatctatctattatctatcttctatctatctattatctatcttctatcttctattatatactaaaagtccattaaacttcctaaaaacgctcgcatgccgccacatggcgctctaaaaacgctatcaagctgccacatggcgctctaataaaatagagaaaatcttagaaattctgagaaaagaaaaaaactagccctcgattttcatttaagttggtggccccattagtttacgccgttagattagatccattatttaatagtaatctatctctcctaatttaccatgtaatacttacctaaatataa

SEQ ID NO: 37145 - DNA, 1203 bp, Oryza sativa
  unsure (1)..(1203): unsure at all n locations
tggtcttaactaaggttgaacgtgaaggtttgttctcatggaaaaggtcaccaccaagtagcacaaaatcaacctgcaattcagtatgatttccatcatattataattcataattcataaatagaaggttatcccccaacagaatgagcaggccaataaattttgcaacacaagcagaaaagaatggaaaaatgtgcagctcctacaaaccttattctgctctgctaatgagcatatctcttcaaacgcctcaaatgaatcaaacctacgaatctcgtccttttccatgtagccgagatggcaatcggttgccacaagtacacggagtgtgttgctttcgtctcccctgaaacacaagttgacagtgaatatataatgagtcaagcgtcatgtctgtcgcagtgtaagtatcaggtgacagttaataggatgctctgtgcaaccaaatagttcattctaagcaaagcccaaagcaattcgacataacaaccaatatcaatgtacttatctaataccatcgctccaccagccaccagatactaatggcttaaatataccatgaacatgataactcacattgccggtgttggttcagcttcagacttgagcccaagcactttcctgatcaaaccctcactgcatcgataacagtaaacaagcagcaaaatgtgatatcaaaacaccacgattggttccatacgtccatattctattagccgaatagcatcctctaatttcatactaatccactaatgaaatatctgaccaaagcaaaggaactcaccggaccaaaccaaaccaaaccaaaaccctgcgagcaccggcgaagcttaggcgacgacaacgcggtggcggcttcccctacttcgcgagcagttcggagaccgtcgtacgggcctctgctctggtcagcgtcggcgagctgctcggggacggcggggtggaggcggctagggggcggagcatcagtcgtcgccgggaggggcgccgcggcggcgagctgtggacgagcggcggcggcggagtgggctaggttgtgcgcgcccttctcgatgtagcaatagcaatgggccggcccatcaaggcccattaatatcaatacacgagcccactttccatatacacggcccgttttcctctagggttaggccaaggtctcttcccctnnnnnnnnnnnnnnnnnnnnnnnnnnnnnnnnnnnnn

SEQ ID NO: 37146 - DNA, 809 bp, Oryza sativa
tgcccaacagcgcgtcagcactagcggttcctctttttgccgggtcggccgaaggaaccggcgaccaattttattaagattaggaggaataaaatcaaagtacaagtagttttcgcttgcaacgacaggtgtcgaattagactgtggcaggaaccacagcccggcaaactaaagaactggaacgtcaacacaacagaaagaaaactaagaactgcaattctcgaaatagcctgcttctttccacactaagatctcttctttgatagcctctgctaactggttagggcttctcgatctttggtcgaaaacacgcgcatttctttccttccaaatctaccagcaaatcagcatacaagcgctgtcgaagtttgtcctgtagcacttccgaaaatatgttctggcctgcaaccaccactctgtcaggcatgtgttctcgctcccagggatggggaagtaagcgctagctgatccattgccgcatccactagcggttcctctcttaggctgcaaggctgcaaagcctccaccacctcgcggcgtaccactgccatcgcagtggcggacgaaccaaccccaggaggtccgcgactccgccccgccgcggtctcggtgccctctactccggtggctccggcgggcggcggccgaacacctaactggggtagaggcgcattcggcggcttcggaccatctcgagcacctatggcccaaacccatcagtgggggcctgtgttggcaggaggtgaggcaaagcaggccggcccaagtcggtaaaagctcgttgatggactaatgggcctcaatgaggc

SEQ ID NO: 37147 - DNA, 1219 bp, Oryza sativa
cgacgaggggtcgttgacgctcttcgacttgcacgggtcgctggcgagcatggtgacctgacggaggtgagagatctcgacgaccacggtgtcatcgtccttgggaagaggctgcttccatggctccccatcgatcctcatgaacgtgtgctcggctgctcctttgtggaactcgaaccggattctatgggcctgaaaaatgtgaaatgtgtgactgcatcagcaatgctagctgaaatgtagggagttcaggaaatgggttgagaacagatgcatcacctgtgctagacgagttccatggccattaggggcaagcaagacaagaccgtgccaggcatcgcgaaagccgacaacctcgataaggccgtcgtcgacaaatggtgcagtcaggtctctctgcatattggcatgaaaacttataaattctttgcccatggcaaagccattaggagtgaaacgacaacagaagaggcaagtgctctacttacatcttgtactttcctggtgccaggtgttccccaaggattcagtcctccagaaaaacttggcagattcagacagacgattgatcgaatgctgaaacaatagagggaatatatgttgattttcatagctacattctgtggtgatgataacattctagaaatgtgtctaagaaacttggagatggaaaatggggttgggattttggaagaaccagacattttagatgaagcaaaatggaaattgccttgtacaaatacactgcaaaggaagcaaggatttatttacctgcgaggaatcttaagctcttcccattggccaccaggtcttttcatgatccgcacctttgcaagttgagcaatgttcctgaaaatgggagctgtacacgtcatgcatatccgacgtaaaggcatataatagctaagcgtggtacttgaaatgctaacaccgatcaatgaggataatttgatcaatatcaggggcatcatggttgcattagtgacaggctacctcgaggatgggtgagttagtgaagcagcaaaccatccttgtttaagtccaagcttagcatatgtactctgcatcaaagaaatgcatcacaacattcagcataaacaaaatgaaatgtgccacaagacttgccctacagaaacgagaagaacctgatttgttagctggttcttgaacttctcgggtcgacctaggcatgcctcttcctctcagagtgaaattcgta

SEQ ID NO: 37148 - DNA, 1699 bp, Oryza sativa
attacttctagggggtactacctgatggccaggagattgctgtcaagaggctgtcaaacagatccagtcagggattggaagagttcaagaacgaggtgatagttctatccaaactgcaacaccggaatttggttaggctctttggttgttgtgttcatggagaagagaagatgttgctgtatgaatacatgcccaacaagagccttgactcatttatttttggtaacgtttagtttgattcctgcaaatcctgacgttctgattttgtttagatgtaagccagtaactgaacttgtctgctaatttggtgctttcatgtgaatcttattagatgaaagtaagaggctaatatttggatggaaattgcgatacaagattattcagggaattgggagaggattattgtaccttcatcaggattccaggctcaaaattattcacagggatctcaaagcgagcaatattctgcttgatgatgatttcaaccccaagatatctgactttggtatggctagaatatttggtgaacaccaacttcaagcccttacccaccgaattgttggaacctagtaaggctctttttcacttttgttcactagagtaaaattgaacaaaaattctacgatccaactcttaactgtactgacctgcctcactaaactactgctttcttcttgcatcattaactctatgattttactacattatttagatcataacaaaatccacctgctagttgacattacgagatgtcctagaaggcaaactaaatgtgctaaaatctgtgagatgcagtggctacatctctccagagtacgcaatggagggcaaattctctgagaaatcagacatcttcagtttcggcgtgttgatcctagagattgtgagcggacgaaggaacagctcatttgttgatgaagaatggtcaatgaatctcttgggttacgtaagatgatactatcttcttccccttgtcattttccagttaaatggcaaactatatggtaatcaatacacgttttatgattggcatcttctaattcactgtacccatttcaggcgtggacactgtggaaggaaggcagtgtctcggagctgatcgatccactcatgggcaccatatgctcttacgatgaagtatgcagatgcatccaggttggtcttctgtgcgtgcaggaattaccaggtgataggccaagcatgcccctggtgctcaggatgctcagtggggatgttacacttcctgctccgaagcaagctgcatttttcgtcggaagggttcctctggatgataacaatactggatcggggaatcagttgacgtatactcaattgcaaggcagatagctccttgtcagtgcctctgaatctcttgttcaacttgccaacctggattactgaagttggtgtctctcattttccctgtttgtttgttgttaacctagtaataaacctgttattatttttgtatataggtttgcttgtaatatgtggaactgtaagcgtatttgggaattggaatgccgtttgtttatacatctgggtatcagggtatgcaacaccaggaaatttatcctcctgttgtgggcctgtttggttgatgccctgagcaccatgcttctgagaagttcttgaatgttacctggccaggcggcctaaacttttgcatgtttggtttgccgccgctgcctgagaaggg

SEQ ID NO: 37149 - DNA, 1570 bp, Oryza sativa
  unsure (1)..(1570): unsure at all n locations
ctacggctacggatcggtcgcaacggccggcgccgcgccattgacgcgcgtcgtggtgaactacaccggcgtggtcgagcgcctcgtgtgggacgcgagcagccgggcatggcagcgattcttccagggcccgagggacccctgcgacagctacgcgcggtgcgggccgttcggcctgtgcgacgccgacgccgcggcgacgtcgttctgcggctgcgtggatgggttcaccgccgcgtcgccgtcggcgtgggcgttgcggaacacctccggtgggtgccggcgaggcgtggcgctggactgcgccggcggcggcggcgggagcaggacgacggacaagttcaaggtggtgcggggggtgaagctgccagacacgcgcaacgcgtcggtggacatgggcgccacggcggcggagtgcgagcggaggtgcctgggaaactgctcgtgcgtggcctacgccgccgccgacatcaacggcggcggctgcgtcatttggacggacgacatcgtcgatcttcgctacgttgaccgcgggcaggatttgtacctgagattggctaagtctgaatttggtatgtgcattgctttattttcaattttatcttgaaagattatgttctaaaacaataatgaaaatgggtttcaatccgagcctatattttgaatgaaaatgaccccagataaaagattagcgaaagaaatgtcaaagtaacagttcttttttttaacaaagtaacgatcctgatgtcaccgtaaaagaaatgccgacatatgatactctctcgaatataagtcactctcaccttttctttttcctattcaaacttttttaagtttaatttagtttatagaaaaatataacaatattttcaatacaaataaacatattatcaaaatattttaatattatatttaatgaacctaattgatgtcgcaatctcttttaattttttatataaatttgatttaatctaaagaagttttaactagaaaagtcagcgaagggagtaattctgagcatgaactgatctctctctatgtctttttttttttgtctgagtaacagttgagaccaaaaggtctctgattgtactagttgtcccacctgtagctgctaccattgctattcttttgatcgcttttggggtttgggctatttggtgcaaaaagaatcacggaattttaggtaaatccaggcttttaatcttaaggatatttattatgaagttctaagctaacaaactgtatgctaaattgctaataccacagatgttattccagataacccttctatgggcgttgcttcagtcaatctagctactataaagtctattactgaaaatttctcagaaaattgcttgattggtgaaggtggatttagcaccgtttataaggtgagcctctctcttcagaagatagacacatgtaacatgaaagttgcactaatcctcatgaaaaaagaaattaaacataagttgcaaatacttaataccgtacactggcaaatgccaaaaatgcaattgcaatcannnnnnnnnnnnnnnnnnnnnnnnnnnnnnnnnnnnnnnnn

SEQ ID NO: 37150 - DNA, 2925 bp, Oryza sativa
aaatgaaaatttttgggtgtcacatcggacgtttgaccggatgtcggaagtggttttcggacacaaatgaaaaaactaatttcataactcgcctggaaactgtgagacgaatcttttgagcctaattaatccatcattagcacatgtgggttactgtagcacttacggctaatcatgacctaattaggctcaaaagatttgtctcgtgatttacatgtaaactatgcaattaatttttctttttatctatatttaatgctccatatatgtgtccaaagattcgatgagatgtttttgagaactaaacaaggccataatatccgaaaactgttgaatatgaatgataattcataagcccaatgacccaaagagcaatcacattttcactgggacaattttgtttcctgtaaatttcattccgtagcggttaattctataaccagctcattctgaaattaaagagggacaatcatatgatcagatcaagtgatgaattctgcaacaagttgattctgaatccaaacttctaacgcccctgtagtgtggtaaggctcatgctgtttacagatttgttggcgtcctgtctcgtcccttcggccatataattccttggcacgaaatatgcaggttgctttggagtaggacgtgctgtggtctcattctctaacatggccacaactgatgacatgaatggtctagcacttgggtcttcctggacacataacagtcctaagtggatacagagcaaaaactcgctaattgcatagctttccagaataattgagtccacaaaatcctctgcatttccatctttccacaagctccaggcctgaacaaagagaagagagtttctaattagtgcaaaactttagctgttgaaactttgtgcactatatgtcatacaacttacacgggctataaggtttggaaaatccattgtcagatgaggtgagctgatcttagagccacttataagctccaagactaaaacaccaaagctgtaggtgtcagacttgacagagaagatgccttccatcgcatattcaggtgacatgtaaccactgtttaaatcatgtcaccaactgagtgtaagtagtttgaatgcgttcaagtatatagaagtttgtattttatacacaggtagttgaagagttactcactatgtcccgactacatgcttagtgtttgcttgatgctggttgctaccaaagattctcgccataccaaaatctgatattttggggctcatctcctcatccaataaaatgttgctggctttgagatctctgtgaattattgtcatccttgagtcttggtggagataaacaagtcctctagctactcctttgattatgttgaaccgtgttcgccaatcaagcatagacttttttgaatcatctacgacggacattatgaaaggaaacttattgttgttcaggctttgggaaccctctcggcctctcccaccaaaagtgaaaaaggtaaaaagagaatatataattattacataccaaaaaggaagtaatccaggcttctgtttggtaagtattcataaataagaagcttctcttctccatgaatgcagcaaccaagaagcctgactagatttttgtgctgcaatttggcaataagaaccacttcatttgtaaaatgctctaccccctgtgtggaacctgtaccgagtcttttgacagcaacttctttgcctccttccaacttcccctgtatagtaaaattattttaacaggataaaaattataaggcttgtccactgctacaactcttagtgtaaattgttaccttataaaccttaccaaaacctcctttgccaagcatgttggaatcactgaaattgtttgttgcagtagcaacctcttcaaaattaatatttggaaattctaccttctgctcaaaaagttcgtgagaagttgtaaagtttcctaacactgttctcttcttattttcgtcatttctctgtttgcctaataagaacatcattatcggtcagtagttacaggaagactgcatagtgttagttagtattgagtattgaccctcactgtaccttttgtttgccacttcctgacaaggtatatggatgtgaatgtcagcaggcatgctataattgggactacaaccttcactacttttttgttctttttgttggcttcagaagtgtaccctatcaagaaaagtgattttttttctcagaattccatgtacaagctatctaagggtatcatcaatgtatatggcaaaagtagtctatatagatgggatccacataaataaactttacctatagcaatcctcacaatgtatatggatacaatgtgacattaggagaagagagagaagtagagatagataatattatttatgtcatatgggtagtccatatgcatatggataccttttgctattttctttatatagactagttgcacaatattactagatgactgaatggaatagtttattccctatggactacttttgtagtacattgtggatgccctaagagttatattgcaactgcaggggaaaaaaggtgggcataccaggagagtaggccaaccggaggtacaggttctgaccatcaccaaaaccagtcctccccgtgtcgactagctccccagtccaaagcaagcaccttgattggtctgccgtggtgccggctatggtcaagtttgcataagcataagccgtgcacgagcagttgcggttgcactcagccgtgcactcatcaaagcttctgtttgggacaggaatgaacttgtcagggaccttcattccggacatggtcacaaaatgattcccatctccgcatctcaactgttgctttcttcggcatcctctcgaagagttggtggtgtcaggctcgaacccatcgaggcattggcaccttgggatggctagcatggc

SEQ ID NO: 37151 - DNA, 1699 bp, Oryza sativa
gaaagttttgatgtgatggaaaagttagaaatttgaagaaaaagttgggaactaaaatcaccttggagagaatgagaaaactcgtaaaagttgcgagaagtcagcgctgcatgcgtgcgtaacccgtttagttggtggcattgacgcatgatgagtgcattatgagggtggagctgctttgcttttgttagctggtcatcacagtacacttgtgtgcaaaaacttcctacaacgatttctgtacacatgattgctgaagcttaagaatagtccgaaagacctcaaggacacgagatggattttcctccgttcatcagaaacccgaatttttcagtgttgacggcgttctgacgctgggacatggggataagtacactaatcaacacaggaatagctgagaagaaggttcagggggccacaaacaacagcaaactctctctatccaatgcgatttcttgtgagctgtgacatgccgagccaagcacgagacggtcagttcaggctcggcccaggtctgtcgtgtgaggccggctctgtgtcagatactacttgtgaaactgaaggctcgcatctgctgttgatcatgggattcttgggcatggctatctgtgaactgtatttggttagcattgagacaacctgattcatggtaggcctgtcatcgggagattgctgtacgcagagaagcccaatttggatgcacctgtctagcccaagcaggagatcaggctcaggtttgatcagtcctaaatcaagaatgtcctcgatctcatgctgtttccaagactcccaggtctgccaaaaagaaaaaaactcacttacatgatagtgcccatttgcattttctaatagctatatttttcctttcaaaaaattattaactttgcctggaaattcattattttttttctaaaagagtagtactgaaaattatgaacttttatgtcatttttttgcgggtgcttagttcagtctgttggcactggcttctcaacttctgtttatgtgcttatttgctttaggcaaatcaattgtgcgacttatatgttcacttacctcacgaagaaaagttggtaatgtcctgttccttttaccactgattatctctagcaacacaactccaaagctatacacatcgcacttgagcgtcagatttccttgagctgcatattctggagctatgtagccccttcattaacaaaaaaaaaaaagcttgtcggtcagttgagacctctaaggaaaacatgcagaaaatgccagaaaaacttgaataggaacattagctgaagtaatgaagttaaaaatcatacgctgacagaactaatgttggatcagtctggtcgttgataaacagcttggcagtgccaaagtctgctaccttaggtctccgattgtcatctaggagtatgttggatggtttcagatccctgtgaataactttcacgttgtgaaggtactcgacacctatggcgatcccgcggattatgtctaatctttgcacccaattcagagaggctcgcagtctacgatcttctcctgtcagttccaaataggcccgtgtgataagcatgcagaagatcagagctttacaggaatatacagaagataattatgcatcacatttctacaaagattaacagactacagtgagtaatgaatttgtttttttggttaggaatgggtaccaaatatgtagaga

SEQ ID NO: 37152 - DNA, 658 bp, Oryza sativa
aaatgtctgagatgtatgagttcatgtcatattgcatgctgtttcaggcataaaagaatcaaaacaggaaaagagttgatgtcatattacatgctgtttcaccaagtaggttgtcttaaaagaagatacttggatctacaacatatccattttgcagacagaacaatcattgacagttcgtaagtgaagcaatcataacaaatgaaacaggggggagagcagcatcccacaaaacagggaattaaatcataacaaaggcccagtaaagctgaatgaaaacaatatcatgcaacagcgcattgcacacaccctcaacttaacaagggccacaagcatgagttaagagatagtgcctcaaatttatcacttgatgtcatactatctactgcttcctcaagtatgttctccctgaatcagggacttgaatccacagaatatatattttgcagacatgatcatcgttgataacaactagaaaaggcacaaaactcagggcatggctctttgataggatacatgatgagcacaacaagacttccctatgactaaaaaattcaacagaatatcaaatgcatcagatttatctgttgatgtcatgttatccactgatttgtcaagtaggttctccctgaaacagggacttgagtccacagggcat

SEQ ID NO: 37153 - DNA, 887 bp, Oryza sativa
ccagaggaggagctacaacagcctcaaatagataatgtgccagtacaggagactcatcaagagcctcaggtacaggatgtgccaaatgtgcaggcccctagaaggtctgaaagagtcagaagatcggctatccgtgatgactataaagtttataatatagaagagtcgcatatggaggatgatcccacctcatatgaagaggccatgagaagcgctcgctcatctgaatggttggaagccatgaaagatgaaatgaaatcaatgaaactaaacgatgtttgggatttagaagaaattcctaaaggagccaaaacagtaggctgtaaatgggtctacaaaaccaaatatgactccagagggaatatagaaaagtttaaagcgcgacttgtggcaaaaggcttcacgcaacgagaagggattgattacaatgagacattttctccagtctcttgtaaagattccttcaggattataatggcactagtggcacattatgatttggaattacatcagatggatgtaaaaacggcatttctaaatggagatttggaggaaaaagtatacatggcgcaaccgaaaggttttgtcatgaaaggaaacgaaaatatgggatgtcgtctaaagagatccatttatggattaaagcaagcttcgagacagtagtacttgaagtttgatgggacaataaagaaatttgggtttcaagagaatgtcgaggacaactgtatttattcaaagtttaagaatgggagatttattttcctaattctgtatgtggatgacattctactggctagtagtgatgtcagtctactgcaggaaacaaagaaattcttgtcctcaaactttgacatgaaagaccttggtgaggcttcatatgttttggg

SEQ ID NO: 37154 - DNA, 2233 bp, Oryza sativa
  unsure (1)..(2233): unsure at all n locations
nnnnnnnnnnnnnnnnnnnnnnnnnnnnnnnnnnnnnnctagctaattagatcgtgctatatactaattggtgttagactttgctctaggatcacctaggttagatctagtcgggtggttctatttgggtttgatgaacgacattgtagatgaaagggagagggtttagataccgaccggttgaggagttcgtggaggaagaggcgccagacatcgtcgttgtcgtcgcggcttgacgtggatgcggcgccggtgaggtcgacggtgatgacggctgcggcagtggtggtcgtagacgtcccggcgatgaggcgtggcgcggcggtggcgtttcccgtcactggctgcgccccctctcgatcggattagggttttgtggggtggagttggcggcggcggtgaatctcgtacgatgtgccgtgccggcctccacccctcttttatatggcgcagtgtgacgggggcccaccagccattgggctgggcgcccccgatcagggcgcggtcaaggcccccttgagccgttgggctcaaggggagagagatctatctaacaattgggaccccagcagctgaggtacatgaccgtcctcagcccctcctcggccttctccgctctcctcctctccgccaccgccgccgcagaagcaggcagcttcttgccctgagagacgccggcggcgttggccttggctgctttgtggatggaccgcagcgcgtagttccagcggcagagtccgccctggtccttgagcgcctccacggcgcccacgctcatcgccaccatccacgacgccttcgctgcacccgccattgatcgagctctcttctttcttgctaagatcgaccggattgtcctgtggtttcttgctcctgatttggtttgcagtagagttgttgcaatgctgagtagttgatgctgtgctggtgagaaagagggaactcgggttatatagaggagggtgtggagaggagaacgacgggttgggcgaaacaaggaggcgccgcgcgttggtttcccaggataccgggtgctttgctctgcttgattacgccggaattcgctttcgtccaggctcggtggcccgcatccacctcatctcgaggcgtctctgttggcggtatggaagctggttgtccgttgcgagggtccacatgagcagtgtaaccgatgaggacgcgtgtcacttgagatgccacgaagggctagtgtctgcatgggcctgagttttgtgtttagctcagcactgtaaaccattcttcctccttcagcaatagttattcaatcatctattctattattattatatactaaaagtccatgaaactttctataaacgctctcaagccgccacgtggcgctctaataaaatagagaaaatcctagaaattctaagaaaaaagcaaaacatctatcccttaatttttacttaaattggtaggtccaatattatacaccgttagataaaattgatcttaaaacaaactaaataccatggtcccacctatcctcttcccacacattggcaggtgtagtatatacgtacgtacatacgtacgcctccttcccccccctttttttttcctttttttcttttttttcttattttttccatttatatatataatggatatatttttaaataattaatcataattttacaaacaaataatctaccatcatataacttaaaccggtgtacttttttactttgtactactattttcaaataatgcactattttaaaataaattttacacaattatatcatgtatactaaaagtccatgaaactttctataaacgctctcaagccgccacgtggcgctctaataaaatagagaaaatcctagaaattctaagaaaaaagcaaaacatctatcccttaatttttacttaaattggtgggtccaatattatacaccgttagataaaattgatcttaaaacaaactaaataccatggtcccacctatcctcttcccacacattggcaggtgtagtatatacgtacgtacatacgtacgcctcctttccccccttttttttcctttttttcttttttttcttaattttcccatttatatatataatggatatatttttaaataattaatcataattttacaaacaaataatctaccatcatataacttaaacccggggacctttttactttggactactatatttaaataatgcactttttttaaaataaaatttaccacaattat

SEQ ID NO: 37155 - DNA, 1950 bp, Oryza sativa
cggcgcggatgcggtttctccggcgagcttctctgcccccctctctccggctttctcgccacggagcgatgcatgtgattcgtttttctctgacaaaagttgttacgctctaacgtggctctcggaactaaagaagaatgcgcgaaccaggtgtagtcacgggccccacctccatttctcctccacacatgcattttgctaacgtggataaagattaccacacgccaactcaccgcactgtgaaatgtcctaatgagcatttcttctcacgcaccaactcgcatcacacgagcacaccattttatgcgggtgacgagaccggagttgtgggaggctagtactagcttggaccgaaacccgaggctcggagcacatggtttccatgtttacggatgcactgtaatctaggcatacaatccagacccctttccgcccgaatctgatccaatatctcctgaataggtctcgtttagaccgagtttagttctaaacttttttttaaaacttttaacttttccatcacatcaaaacttttctacacacacaaacttttaatttttccattacatcgttccaatttcaaccaaacttttaattttagcgtgaactaaacacactagtacacaaactgtgaaagaaactgcaactttactccctccattttaaaacataagtgaaactataagagaatttatttggatttcagatttactaatactatgatatatccaattctaccaaaaactcatattttgataaggggagtaaaccgaaatctcttttattttgatgaggggaaatacatcgttttaaattggtcaagaaacagggcatcaggattgggatgattcattgatgtgttgtaaagaaggaaataagaaagagtcagttttcgagctcggttcggtctcggtggttctagagtccatcctttcggatgaccggctgtggtcgttagtggacgttgcttcctttggggacttgttaggagtacagcgtggttctgcctcccttccgctgtttggagtagtgtaacccgtcgtacgagtttttctttttcttccttgttttttttgtctctgttttcttctttccttggtatagaccggtttggctgattgcgtaacaagaactctatctatctattatctatcttctatctatctattatctatcttctatcttctattatatactaaaagtccattaaacttcctaaaaacgctcgcatgccgccacatggcgctctaaaaacgctatcaagctgccacatggcgctctaataaaatagagaaaatcttagaaattctgagaaaagaaaaaaactagccctcgattttcatttaagttggtggacccattagtttacaccgttagattagatccattatttaatagtaatctatctctcctaatttaccatgtaatacttacctaaatataatggccggaataagccaagaaggcatatacgtacgtacgagttaaatagaaaaagcatactgcatgtatacgtactaggtactactggaacttcctctgtattttttaaaaaacattgccaacgttaaatatttagtgaaactaccgaaagaaaacaacgattttaaactagatttttctattatacttcctctggattttttttattttctttatgatgatcaacgtcaaatatttaatgaaggtggtagcataagaaaaatatattacttcataaaacatacacaccccaaaatagatctataatataatataaaatatcaaataaacatatcatttcacaccacaattgttgagtatagatagattttatttgcatcagtgggtctacattgatagttcaagatgaaacaatgagtaattaaaatattacttgggacatattgtcagaaactcaaataaaaaatgtattgtttaaaaatatgttgcattttttctcgccaaaca

SEQ ID NO: 37156 - DNA, 520 bp, Oryza sativa
  unsure (1)..(520): unsure at all n locations
gggcgaattcgagctcggtacccgtcgccatctctctctcacacggtgggggttagagacggtggggggagcggagaagagaaaaaaaaggagcgccggccatggcgcggcggcgcgagggccgccggcgtcggcgacgccgctcggcgcgaccgcgcccgcccgagagagagaaagagaggagaagctagggtttcggcggccggccggggcacgaggggttttgatccccgttttcggcgcccggccgtccgatcgcaaaccctaagatcggacggccggcggcggccggaccgaaatcggcccaagtggggagcgcgcggcggcggctttcccggcccaggcccaggttgcggcctgggggaggggagggggcgctcgcccgcgcgcaaggtggccatgggccgaccggcaaaggccggaaaaagtccatataaggtccctccggggccgaaaatgaatannnnnnnnnnnnnnnnnnnnnnnnnnnnnnnnnnnnnnnnnnnnnnnnnnnnnnnnn

SEQ ID NO: 37157 - DNA, 1723 bp, Oryza sativa
catcggccagccgaagagggtcgggtctgcgcaggccttgctcgccagcgcgtcgatgcagcgcggcacgacgaggagctcctcggcgagcgggaggagcgcgccgtcgcacgaccgcagcgcgcgcaaggcgtcgtcccagctgccgagcacgtcgcggaggaacgcctccgcctgctcgacgaggttgccctcgccgccgtggtcctcggtcatgccgaggtgctccgccgcgcaccgcagcgcgaccacgttcccggcgtcgagctccgccctgacgtcgtagcagaacctggccgccagctcgaacgccgcggcgccgccggggacgtcgtggagcttgacgctgcacggctcgccgtcgtcggcgccggcggctgcttcgcttatcagcttttgcagcgtgccacttcggctcatcaatgggaactggaaatggaagagcaatttgacacacgtcagtagagaaaaatcttaaaatgttcagattatgcagaatttaaggcttctgtccctgttcttgaacatttctttttaatctttgtagtagttaattcattcatttaaaccctcaaatagctgtcacaaaaatcagataatccatcaatatatcgatttcagctacctcaaacaggacatggaacaagaaaacaggatgacagatgatatcttttcatcaagaaaccaaattgttgacgcatgtgtaatgagttcaatttaggatcccctttgtacttcaagactcaatagtgaatttgcactagaaaaagataggagattgaaagagagatcagtgtagcagatgtaccttgtggagatggaaggagaaatctccaacctcaacgaccacatcgcttacaagctcagtcatgcaagtcctgcaagattgagaaattttgattttgtcaaaaaaaaaaccaggataacatgcaattccactagcagagtgcaggaaagagacccaaaagattctgcactgttcatctcaaatatgctcatctattctgttaatgtgtcaaagtttacatctcagtttattttctctgttatgtgctacattcggtcaaaactgaaagttaagttcatcttacaggtgtattatgatcgagttactgtcatcttaacctgatcaaagatagcgatattttttttggaaaaaaaaaacctgaaatgaagaattttcatggaagaaaatccatgcagtctgtgcgctacagggacacaatcaacaagtcatatgttaggatcacattgaaccctaacgaaggcaaatatatatatacatatatatagaagttaacgaatcgtttaggagatgaacacacgcaaagcgtctcaaacatgaacaaggagatgattggggatagatacgataggggataggacgagcgacaggtgaagaagtaccaggaattaggatcttgaaattggaagcagtcggcaggtttcgatccgagaaccttcgtaatcgccatcgccaaatccgatctcaaaccctcaacgatcgattaatagggattagatagactgaagaacacaatcaattccgccccagaacgacgcagcaactgcacaatttcgcattgatctcccaaatggacctgatcgtggatgatgaggaggcgaagaagaaaaagaagaaggtggtttggcaatggcggcgagcttgttcgttcgtcagtgaagaactgggcagaggattaatcatcaaacagaaatggag

SEQ ID NO: 37158 - DNA, 281 bp, Oryza sativa
aacatcgggctgaaccccgccatgcagctgcagaagagcgtcgacgcggtgttcacgttgcacagcccgaacgcgccgcacttggcgtaggcgtcgcatacgtcgcgcggcgcctgcgcgaacgtgttccaccccttgctgctgggatcccacacgaggcgctggatcacgccggcctcactcagcacgaggcgggagaagggggccgcggcggtggcggcggtgaaaacgtaagcgatctcgtcgggcttgaccaccacctggttcgcgaacatggacga

SEQ ID NO: 37159 - DNA, 1492 bp, Oryza sativa
  unsure (1)..(1492): unsure at all n locations
nnnnnnnnnnnnnnnnnnnnnnnnnnnnnnnnnnnnnnnnnnnnnnnnnnnnnnnnntgccgcgtggtgctctaataaattagggcaaatattagaaattctaagaaaaaaaataaaattatctattacttaattttcacttaaatcggtaggtccaatattataaaccgttagattaaattgatcttagaacaaactaaatattatggggtcccacctcagcataggtgcgcacctacgtgcgcgggttcgtacgcatcccctccctttttttcatttttctctttcttcttttttcccatgcatatgcttccctccctttattactatatcacacgccttcatgagatgatttaatcaaaagagttttgaatatcttgcactcgcatttttcatttgcggccatactacacggtatgtatatagatagactgtatgataattaactaccaatagtttcttatttactcgagaaaaaaacatgatttaaaagttgtaagtactaaacccatctcctactcaaaagttcgtgaatggttttctaagataccttaagaaaaatagaacccttaaattattataaaataaaattatccaaactttagtttgccctaaatctatgagacaaaatttttgaacaaacaataatcttaccttttaataatataagtgcccgcgcatacgcgcgggccaccttcctagtttctttaatttttttttctccctcattgtcatacacaggtaaaacttcttcagtttaaggaaacaaacgatgctttctgctccgcactgtctcgctttcaaagtttcagcaaaatctgccaaatctactacagtacctttttgtgattcccctgcatcctagagtctgtacttgcactaatgggaaagaaatttgtgcttttattcgtggtgaacgagtaaactaaggctgtgttggctcaggcgtgttcctaaccagaacggtgcacacagaaaatagaacgatccattagcgtatgaataattaagtattagctaattcccttttcaaaaatggatcaatatgatttttttaaacaactttcgtatagaaactttttacaaaaaatacaccgtttagcgatttgaaaatcatgcgcacaaaaaacgagggagatgagttggaaaacctatggtaaagaacatagcctaagaccattcacagggcattttgccggacttcgtatgccatatagacccaaaaacaccaaaacacaatgttagccacaggttttcacggtgctatatagtctcaagtagggtctatataaataaaaaaagtttctcagtttacttttccccatactctccccatcaactgacgctttctttccccctctctctcctcaacacgaagccagcggagctcggggtcgaggagacaaccgtagtcggcgcagatcggaggacgacgatgggctccgcagcggcgggccaagcggcgacggcgacggccgtgggcggggagcca

SEQ ID NO: 37160 - DNA, 3141 bp, Oryza sativa
gaacttcctctgtattttttaaaaaacattgccaacgttaaatatttagtgaaactaccgaaagaaaacaacgattttaaactagatttttctattatacttcctctggattttttttattttctttatgatgatcaacgtcaaatatttaatgaaggtggtagcataagaaaaatatattacttcataaaacatacacaccccaaaatagatctataatataatataaaatatcaaataaacatatcatttcacaccacaattgttgagtatagatagattttatttgcatcagtgggtctacattgatagttcaagatgaaacaatgagtaattaaaatattacttgggacatattgtcagaaactcaaataaaaaatgtattgtttaaaaatatgttgcattttttctcgcaaaacatagttagccgttaatgactcaattaatatacgcttttgatttgtacatatttagtaataaatttaaggttgagttctaaagtgtttatcagattggctctccctcatttatcttgagcatgttcttcgaactattaaactgtgtgtgtgttttgcaaatattttctataatttttttaaaactatctattttaatgtttgtaatatttaatacttaattaatattgcgttgatgacctacattgttttccgtgcccggcataagctcaaccaatgagatagaatgtagtttaagtaggagataaattagattatttactatataatttaaaattaaataatcaagttaactacattattaaaaaatttcattactttggatcatatatatttaagaaaaaagcaaataagttttgttgtctccttgctatttcttagctattaactaaaataaaaacaatagacaatgttggatttttttttgaaacaccgcccgcgcacaccctacccttttgagtacctccaaaagactaagccagcacattttgagactgacgatgtcaccacgggcgtctcgctgtcgacgggtatgtcacctaccactgaaagaataattagtcgtaactgcgaacacccatgtcaagtctaggacttgaacatgggcatgtttcaccaaaagaaacctaaccaattaattgagccacgctcacttcgcaataacgttggatattaaaataaccataatttttcagctacattactggaatacttatatgccttttagaccggtgaactattagttataaccgttagatctatcttatataaaagttaagcatgtatccatggtacatgatatttccaaaatattattgtgcaattatatttcgttattatcgtatccatattaggttgcatggagcctctcacccaccctacttgaaatgttcatagatggatcacctctcaaattacatcaatcgtattagcttatataaacccatacatttaatggagcttcatgtcccacccaattcatctcttaatgaactattataatagatatccatttactttcgctgacatgtattctaaaaaaaagtctactttatttttaaatgataaagaagattataaataattgcttatagatattatttaaatatgatattactaataggttagaaacttattaagcaattaatactgatgaaaacaatttaatatctcacggcagatgttctccgtttaatatttcgctcttatatttatctcaaacatagcgtacgatgcatgcccgcgcaaatgcgcgggctaccttcctagttattctaatatattgatgtgcaatcttcattcgcgaaaaaagaaggaaacaagaaagaattatccacataggattgaaattaaattgatggcaccactgccaagttgatcatgatcccatcggcaattcaaacgtactagaagaaattgtagctatccagtagaagtagaagtatgagtactacgccatgtccaggagtactagtgctttgtagcactatgccatgtccaattatgtttatttgttataatcaaggggcagggttcgtacggtcgtctcgtttttgtcatgataagtagttcttccccttcaaaaaccaaatcacgtactgcatgctacaggaaatgcttgccaagatctcaaaagcattttgaacccatgaggcatcgagacaccagtatactcaagtaacagaagttttcatcatcatcatcttcgtggtatatacaatcaggaggaattcaacaagcaaccggcaagtctcagccatgcttgccccttccaaacccgactctatcctactactattagctagctatagtagacagagctatactaattggtgctccagcagctgatgtacatgaccgtcctcaacccctcttcggccttttccgctctcctcctctccgctaccgccgccgcggaggcaggcagcttcttgccctgcgagacgccggcggcgttggccttgcccgccttgtggatggaccgcagcgcgtagttccagcggcagagtccgccctggtccttgagcgcctccactgcgcccacgctcatcgccaccatccaagacgcattcgctgcacccgccattggatcgatctcttctttcttgctgagaattggaccggattgtttgtgatttcttcttttggtttgcagtgaactattgtatgctgtgttgaggatgaggaggaaggagaggggcgggttatatagaggaggagggcaggaggctgtggagaggagaaggacggggttggggcgaaacaggaggcgccgcgcgttggtttcccagtataccgggtgctctgctctgcttgattaggccggaattcgcattcgtccaggttcggtggcccgagttgtctctgttcgcggtatgggagatggttgtccgttgcgaggagcccacatgggcaggagtaaccgataaggacgcgtgtcgctgcagatgccacgcagggccagtacctgtatgggcctgaattttggggtttatgaaagcttagcacgatcagactgtgagctatttttcctctctcagcaacaggtaaaacttcttcagagtaaggaagcaaagcaattctttctgtactgtactcctacctatctcgctctcaaagtttcagcaaaatctgccaaatctactactccctccgtttcgaaatg

SEQ ID NO: 37161 - DNA, 1125 bp, Oryza sativa
  unsure (1)..(1125): unsure at all n locations
taatgagggcggcaagctgacgtaccaaacggcggctcgacggcgccgtctgcaaaaaattgcatttagcccctaaagtttggctggtactttttgcatctggaccccttgccgccctactatagggcggtaaggggccaagatgcaaaaagtactaggcccgggctggcttttttgcatggggccccttgccgccctaataaaaaacggcaagggttttcgtgaaaaaaaccctccctcccccgtctgttgtcaccgcccgtccctccctcgtttgccacgtcagcttgccgctctagtggagggcgccagggtctatttttgtaattttttacgctgatggattatttctgtaaatattaaaagaaaaaaatttaaaaataaaaaaaattccacgaagatatacaagtgccctattgtgtcaagcttttcgatgcacatgtcacactccagtaatcacgcggtcgacacgagggaatatccgtgtgattttggctgcgctcccggctgtcggcctgtacggctgtgtgatctccgatccgggtgctggaaatgcagcgttctgcttgagtcattttctgtgtgctataggcaattgccaattgacatgagcttacttggttcacttgatttcttcgtgccttgcacgccgccactgcgaaggtaatggatttttcagagactcggagtattgcgttgattggtggcttaaaagttttaactatcgtttggttcgggtcaggtgcgttaatttgtttagctggctattggtaaagtcggatctgtgacagaagcacatgagttgcgaccagactgcagctcctcagatgctaaacaagtgactgcataataaaaatcgttgggctggatgagtttgtcagctgaggagcacattttcctttccctcctaaagctagctgttcgaagtcaaagatcaaatgctagcagattgagttggtatggtatatgccttggtccaacacagtatgcatgctcatatgaacttcacctctttgaggcaactgtttttccaaaaaaatgaattttttattcgcatgtaaacttcgtnnnnnnnnnnnnnnnnnnnnnnnnnnnnnnnnnnnnnnnnnnnnnnnnnnnnnnnnn

SEQ ID NO: 37162 - DNA, 1538 bp, Oryza sativa
ccgggttgttgattaccgttgagaagttaggtggtgtttggatccagggacttaactttaatctctgtatttagacactaatttagagtattaaatatagactacttacaaaactaattacataaataaaagctaattcacgagacaaattttttaagcctaattaatctataattagagaatgtttactgtagcatcacatagggtattcatggattaattatactcaatagatttgtctcgtgaattagtccaagattatggatgagttttattaatagtttacgtttaatatttataattaatatccaagcatccaatgtgatagcgacttaaaagttttagtcccatctaaacagggtcttaacgtcttttgctgcttgtcaacaagttaaccaaaaaaaaggaaaatggttccagttaactgctcctcatatcatgttaatctgtagttagaatcatgaatacatcagccattcaatggaatatctgcaaaaaaagatgaccacacaatgacacaagtcacaagcagccaagcagaagagacatctacaaagagaaactaagtcaacacagacatgcatacaattacaagcagagaaaagaaaatccttctcttctactacacctgagcacggccaatccaggcagtctgcatgcattaggtgagatcggttgtggttgagccttggacatcactctgacgaagcggacgcatggcggctctgctgtcaagtgtcggtctcttgggctgctccatctgcgacgtcctgctcgtcagcatggcgacgatttcggacatggtcggcctatcgtccgccatgtcctggatgcaaagaagcccgatgtggatgcaccgttctagatcgggcaggagctctgcatcgtcgggtgcaggcctcgccattgccgggtcaaggaggtccatgaggttgccctgttcccacaacctccatgcctgtatgcacgaaagaggtctaactgaaggatccaaatgccattgtcttgcaatgaagatttgatgtgttcagtgcactgcttgattacctgtggaagaagcgtctgcattgaccgttgcgaacgccgctgagcgtctccaggaggacgactccgaagctgtagacgtcgcacttgagcgtcatctcgtctcgtaacgcgtactccggagatgcataacctcttcaattcacgaattcaattcaaggcttcaaatcaaaacttgagcaacattgctactaggaacagccattagtttacttactgtgagaccacgagggtctggcctgactgatcggcgacgaacagcttggcggtgccaaagtctgcaatcttaggcttcaattcgtcgtctagaagaatgttgctcagcttgagatccctgtggattacactcccgtctggtccttcgtgaagatacgcgacacctttcgcgatggcctgaattatgtcgagtcttcttctccagtgcagattagctcgacgcggcaacgggcctgaaatgaagaagaacatggaaggtgacattatttattcatgtc

SEQ ID NO: 37163 - DNA, 1398 bp, Oryza sativa
  unsure (1)..(1398): unsure at all n locations
acgggtgatacccgtagaccggatatagaggttattggggtacgctggtacaaggatctatgtaatacgacatcaagcagacaaaagacaaagattatactggttcaggctccttgataggtaatagccctaatccagttgatgtgggattatatgatggaaaacacaggttacaaagggaacaatggaaatcgacggatccagcgagatcatagtcgagttggttcgactagatccctagcggtttggctccttgcaggctccgacttcgtaggctgtgagggttgtgttggctctgagattcgatgcctcaggccctccccagggggtcccttttatatcacaggttaggcggtttccaagtagaactcggaaacatcgaaccttacacgatacattgacgacccagtcttgtccgagtagaactccttccatttgtaaactccgtgaggggtttccttaatatatgcggagagtatccgtatacgcgtgggtataccataccgatatgagacgtatatcaaagggtaaagggtatacctaacccgtaaccctgacacatgtttgtggagtgatatatttcatattaatctatgttgttatttttttcaaatatatttataactatttaaatgatttacaaataacaggggatgtcctctcgtgggatgaaaatcatgtgttacatgagacaaaacgtatgcacatgtataaaattggcccattaccatcgtgactttggaatgggccgggccggattacccgtgacgtgctttacggcacgccaacttccgggttgttgattaccgttgagaagttaggtggtgtttggatccagggacttaactttaatctctgtatttagacactaatttagagtattaaatatagactacttacaaaactaattacataaataaaagctaattcacgagacaaattttttaagcctaattaatctataattagagaatgtttactgtagcatcacatagggtattcatggattaattatactcaatagatttgtctcgtgaattagtccaagattatggatgagttttattaatagtttacgtttaatatttataattaatatccaagcatccaatgtgatagcgacttaaaagttttagtcccatctaaacagggtcttaacgtcttttgctgcttgtcaacaagttaaccaaaaaaaaggaaaatggttccagttaactgctcctcatatcatgttaatctgtagttagaatcatgaatacatcagccattcaatggaatatctgcaaaaaaagatgaccacacaatgacacaagtcacaagcagccaagcagaagagacatctacaaagnnnnnnnnnnnnnnnnnnnnnnnnnnnnnnnnnnnnnnnnnnnnnnnnnn

SEQ ID NO: 37164 - DNA, 933 bp, Oryza sativa
  unsure (1)..(933): unsure at all n locations
ctcagctccagtccccaggcctccttacggagctcctccaccaaactatatgaatccacagacgagcatttggcatatctagcaaggcagctaatttgtggcgataagcgaacactggacatggtaccaagaaaagtagtttaagtagatatgcgcgagtgcgtgacctataagttccagggaacctttggcagttcggctcgcagatttttgtatagttatatgcacgcataaaccattctccgtatgtatccagtttacgacttttgcatgatcaattagtattggtttggccaacgcagagtgttatgtcgtgaacaactttcggacgctcggtcaggtacgcctgaatcatgaaaacgtatattctagtctctgaagaacacctactattgatgatgagaatcccttgtgcccgcatgaatgtcatgttgccaatgtacaaactgacatccagcatttagcagctacaagcacgtaaatccatgaggctaaggaatgtacaaatcacgcgagttggcgttccagtagttcattggaaacttaatttgccaggcagacttagactaacaagaggtcatctcctcctaacagctccgtagttcctagtgacctgcagagtaacacaaagtcgtaaaaccaacagtttgtaggtcgtattctaaaaaaaaaacagtttgtaggtcgtaaaaccaacggtttgtagtatcagtgcgtgtacacaacacaatgcaaacaatttaatgacaaaccacaagaagacccgtcaaactgacaaaatgtcaaggtgattcacttacccgaggtggaggtttcttcggcctgtcatcttcatcatcgtcatcatcatctttgctcatcagcatgctctggatggatgaaaaatctgtttttcaannnnnnnnnnnnnnnnnnnnnnnnnnnnnnnnnnnn

SEQ ID NO: 37165 - DNA, 694 bp, Oryza sativa
aatattactagatgactgaatggaatagtttattccctatggactacttttgtagtacattgtggatgccctaagagttatattgcaactgcaggggaaaaaaggtgggcataccaggagagtaggccaaccggaggtacaggttctgaccatcaccaaaaccagtcctccccgtgtcgactagctccccagtccaaagcaagcaccttgattggtctgccgtggtgccggctatggtcaagtttgcataagcataagccgtgcacgagcagttgcggttgcactcagccgtgcactcatcaaagcttctgtttgggacaggaatgaacttgtcagggaccttcattccggacatggtcacaaaatgattcccatctccgcatctcaactgttgctttcttcggcatcctctcgaagagttggtggtgtcaggctcgaacccatcgaggcattggcaccttgggatggctagcatggcatcacagtagccgaatgggccacatgaggcgtaggtatagcagtcgatggtgctcgctgggcgttgtaagcgaactgtccatgatgacgagctatcatcccaactcaggaacctgaaggttcccatgtaatcaagcatgatgcgtgcatttgctgagccatcagaggttgtgtacctaacatagaattcatcctgtgtgttcaccagagtttgata

SEQ ID NO: 37166 - DNA, 827 bp, Oryza sativa
  unsure (1)..(827): unsure at all n locations
nnnnnnnnnnnnnnnnnnnnnnnnnnnnnnnnntgtgaaatccttcttgcctttcttggtgagggttgattggtgtacccgttttacagcaatcattctcccatcaggtaactggccctacagattatacaatttatattgtaagcaactgagaatacataaatttcatccacattcctccaaaaaaaaatcatccacattgactctttgacaacctcactacaaggaattttcattagaaaaatggaagcacacgagtgtcaagagttcatgaatcatgaccgagcgagtatgttctatcatgtagaaattagaaaaaggaaaggaggttaccttgtaaactatgccaaatcctccttggccaatcacatggctctgtgagaaatttccagtggccgccttcactttctgcagatcaactgaaggaactgttgtagcaggattatgaggtataccttctgcaatataaaaagaatcagtctgggtctggaacttcctgggaaatgtctaacgcttaccttaaatttgttctttctgtaagcgtaatctagaaggcaaaatttgctcagacatttgcttcaagacactcttattttatggttgttagtcagaatatgctctgactattattttaacatatcctattccaatggtgagatataactagtgcgttcgttccagtgatattgggtgagaaaacacatcgtttttcacgcgcacgctttccaaactactaaacagtgcgttttttacaaaaaatttctataagaaagttgctttaaaaaatcatattaatccatttttataatttaaaatagttaatactc

SEQ ID NO: 37167 - DNA, 1484 bp, Oryza sativa
gactcgttgtactgtagtgggttgatgctgtgttggttaagttgaggagagcgggtggggggtggtgcggtcttttatactggagtggcctggcgaaacaggcggcgggcgcgcgttggtttttccgggataccggtggttccactgcttagctgtggcgctgcacgcactcgtcgctttccgcgcgggttggtggctggctgtggctcatcacacgcccggcgcccacctcgtctcgtcctggttggttgtttgcggcatggtggaggctggggatgagttggagttggcccgctgcgtgcggctggcccacgcgtgcagtgataggataggagtagcggagtagtggatcccacgatggtacgtgccacttccatgtgggtcccacgaagcagtggaaaaatcgcggatctacggggagtccatgagcttgtcaatttagcagcacatttcttttttttttccttttttttttcataagtaaagtccttaatttctcgtttgagtaagtgtttgtttgacacgactccactctagctatatctttcctgaggttagaactcaaccaaacgatttcagcttaaaaaaaattggagtggatctattagagggctatcataaaatgaattacgcatattattgtaagttcgtagggactaaccaagttattataccgaaataataaatttacaatttagtatatctatttacactcaccacgtaaattcatgtacagtaagcataatttacttgtcgtagcacacaggttttcgcaagtacttgctactagagtactggggcttctaatgtaggctggctcgtcctagaagactggagttttagcgagcgtccgagcgattgcttctttttcctgcactagactcacatcagtgttgcacgcgttcaacagactgcatgtcgtcgaattgggaagcgtattatgatctgctgcctgctggtgactctgagagcggagttatgggaggtggcatggaaaaccaggggctggaggacatggtttcccatataccgggtgcgagtacgccaacagaaatgtttaggggccgttttgttcaatacttcaacttaccacaccatactttaggctgccacatctccttagccttgtgtttggttcattgccatagttatggcaagtcatactttcttaccatcttaccccacatgttatagactgaattctttgtctaactttgccataagtgtggctcataatttattagccacaaaaagtgtggcaagccacacttgcctaaagtgaggtataaatgttagttaataaccaaacagcccaacttcactcagtgtcatggtccgggactctcctgtctcctccaaggctccaggccccacgcttaattagtagcttcatttatactagtacttcattagtgccgttgttaccagattatactactttgaagaacttgtggttgttcttagcaattttatttgccttccat

SEQ ID NO: 37168 - DNA, 780 bp, Oryza sativa
tagatctgttacagctcaaagtaacctgaactctttcagtgatgatgaagacaccagggagatgcttctcggtgcaagaacaactaatgctggaaggaaagcatctggatttacaagaccctctaaagatgctaccgatgttgccaaaactggaacttccagaaggggcaggggaagagggacggcctcaatgaagcagaccactctgaatttcagccaatcaaggttattaaattaattgctaccttgcatttataccataactgtgcaacctatgccaaaatggaatagccatggtacagtctaatttgcattttgagtgttaaaggtgtttgaaatcgtgtgccctggttttaactctgcagtagatgctccaatgctaattttaccatccaatattttgcaggtcaagtgctgctatccgcagtgaggaagtgcaatcttcttcagatgaggaaaatgagactaatgaagcaaacgaagttgttgaatcttcagtatgatcatttcctctatttgtagttctgtactttttctgtattaatacgcataaatataatgtgcgcttttgctcgtggcaaatgacctggtgaactgaaacattgtatattcttgaatactcacaggaaccggaggagagtccccaacaaactggacggaaaagggcagctcctagaggtggtagaggtaggggtagaggcgctactgcaaaaaggggtagaaaagcagatatttcatccatccagagcatgctgatgagcaaagatgatgatgacgatg

SEQ ID NO: 37169 - DNA, 2494 bp, Oryza sativa
cttgtatggtgcgggccttatgggctattgggaatctgaattaggccggcctagtacacatttcggccttgttcgtttaatttcacaccataataggtgtgagattaatctctttcaaatcctccttaatctcattagacttctggagcctcgttcattagacttctggaaatatgtggtgtgattgctttttctttcgataatccactctataatctagtaatccactttaaagatgcttattttagattattgggtggctaccagctaacaaatagcttataatccagagaaacaaacaactcaaagcttattctatgtcggcttattataattcagcttacagtaatctggcttaataatatatattacaataattttaagctgaaacaaacagaggcttagtttatttattgagagaatacggtagtgcagaaggtggagaacggctccgcttttacactagtagacacaaggaagacatacgtgttaccgtttgcgcataataccatatatttcaacagctgaaacacacttgtgtttacgtaaatgcagtggcggagctagaaacaataaattttatctgccatgaaggtgactatcagtaaattatttgaattttgcttaaattcaaattaatctaatttttttttgtcaaatggagggaggttatggtggttattcttctttatgtactccagtaggaaataaaacaataaatgcatgactaagattgaacaataatgaatctgttggatcagttggcaagtgtaaatgattgtactaaccgggaaattggtattagctattaatttatgaagttatgtatttatttttcttcatgcagacatgtgctcctacgtatcaaaaccatgtttcattttttacttcccccagccacagatccttgttggtatcctttccaaaacagttaaaaccagcttatcatactagtaaaaatattattattgtcacaaccatctatcaacttcctaattaatggctacctgtagtaaacaaatcaaaatgggtaaaccaaaccataactaattaaaaaacaatttacacttgtctgcatatttttttaaaaaatattcgataatattgagtttgttatagtttatcactatacttttatatactccatccatcccataaagatttcattttttttctttttccaacacttgactacccatcttacttaaattttttatggattttttatatagtcgcatataaagtgctatttatattttatcatctaataaaaatagaaatactgatgatagaaaaattttaaataagatgaaaagttaaatgttatataaagactgaaaaatagagtttttatgggagagagggagtaatacggagtaataatacacaagtttatcaattcttttacgacgtgctattgggatggtatagaatggacttccttttcttttcctacctcacctaacatttgatgaagagaacggtgaaccgggaaaagccctgtgaattttcaaacttacccagtcagtggatgggatgctatgcgatcatgtgagcgacaagttacaagatccaaaccagtcgtggagcagtcaagccgcgcacgcagagagaggcaggcaaggcaacgcaacgaaggcgaagctgcctgcctctgccgcgccgcgccgcgcgagatctgggcggaagggaaggcgcggcgcgacgcgacgcacgagagaaacaaaaggaaaagggaggggcgggggggacaaaaaccttcgccgcacaaagcggttaccgcgtccccccagatctcgtcgccgtgccgtgccgtgccctgcccttgccccgctggataccggcggcgcaccggcgcggccgcgcgatccgatgaggcggcggccgttcctcgaccagcggcggccgtcgtcgttcaagcgccggtggcagcagcgcccgtggtggttccgcctcgcggtcaccctcctcctcgccctcgcctgcctcttcctcctgctcgcgctccggggctcgcccgaccccgacccggtggtgctcccctccaccgactcgtccagatccgcggccaccacctcccctctcctccatcaggtgagcgaatcgcgtctcatatctactttgcttcacatttcgttagctcatttgcatttggcttttgagttgatccggttttaattagttcatgatcatgagtagcgtttgaaattcgtggctcctgtaatgtgcagagatcttacctcgatggcgttacggatgcgttcaacatgaccgacgaaatgctgagtgctcactcgttttcaaggcagcttatggaccagatttcccttgcaaaaacctacctcgtcgttgcgaaggaagccaataacctgcagtttgcagcagagcttagctcgcagatacggcgggcgcagagcatccttgcgcatgctgcagcccatggtggcacggtgacggagcaggatgcggagaaggcaattagggacatgtcggt

SEQ ID NO: 37170 - DNA, 1350 bp, Oryza sativa
cttcaaggtgaggcacatgctcttcaaaatttgattatttagtccttatagagattaggagcataaagtttggcacttgacttttgttagtgtctcgtaagacgctggcaatagctaggatgcctgcacttgtatctgatcccagagtaggatgtcttggatcacaaatttattccttggacaaacccacaactttgcatacagtccattgaactcttctttctataggaaagtggtccgtatctttgggatttctaccaaataagcaaataagcaattcatgacaataattttgacaaacgaactgtttacaaaaatggcttcatgagaagaattgttacaaacgaactcaggaagccataatcctcagcaaaaaatatttcgtagagaaacgtggaaaagcatactctaaaatttgatctcaatcgcaaacgagtcctggcaggctggcactctaagcaatatgaattcattatacacaaatatcctccagaatgatgcactgtgagagccatcttggccctatctcttctgaagctacaagctcgtagaactagtgcatcgcttccaagtaagaagtttctaactagtaaaccatacaactcagttctagcccaaatgaactggcaagtcaatggctgaagctagctgtccttgtgaattgtgatgctttggctatctgtccttgggattctttagttcgaagttactctaatcaatgcagcctgctgacctcttcacaactgtgaatatctcgatttctttaaaattttaatactattcatcagttcaaccaaagacgtgcgccatgtttgtttcctgcattaagtcagtaatcccaattatgagttgacaactttcagaactgacaacatcaataccaagcagaattatgaacttcacctgacaattttcatttcaatcaatatcatatacctagcaatcaattataccaaaaaaaaggcaacccattccagaagatgaaagtattatgcacttttggcaacagacagctatataatcttcagaacgtcgctgaggacaagagcccattgtgtccaatgtgttcctccctgcaccgttacatttccagaggaaaggaaccatcagcactagggatggatgatagtagggtgaaagattggtacatgtaactagtctgaagcatgacttcaactaacctgacagaatacagcgtatggatctcttaagggcccatcacatgatagctcacttgtgcttccatctatgaatgtcccatcagcaaaaatgacctgattcaatttgattaaccattcttgtatcatagcacactaatgaaaggtctttttagaacataaaagaaaagaa

SEQ ID NO: 37171 - DNA, 1457 bp, Oryza sativa
  unsure (1)..(1457): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccatgtcgaaagatcctcccgccgaggcggagaacggaacatcgacgacatccgagctcgagaaggattctaatgcggccaaaccttgtcgttccgacatgaaccgcgagctgacgaagatgacttccgaagtgacaaggtcctggtgtcctatccacaaaaccaggaaacacactttgtgtcacatcctgattttcgtttcaggatttataaattatttaataaattattaatagaatttatattaaatgttctttaatttacaagtgaagttaaatgtgggaaataaaatttcctaaatataaagcatggatggatttaatttttattaaattctccatgattaagtcaactctctgaaattttctcggatttttcagagctcaactcttaataatacaaagaacagttcagtaattatttgatcattaatgatctaattataattgttaaagagcttttcttgtttaaaaatccttaaattataaattgttgtttaaaaggaattattagaaatgattttaaaagcttataagagaagatctaattttaatttgttaaatctcaatataaaattgggctagataaaatttcattaaatactttgcttaattctataattcctagatttttctgggatttatttgagctaaggaagtatttttagtaaatggaattgcatttaagaaataatttaaattgaaaaaggttttaaaagtcttcttttggctttgggccgaaagtcggcccaaaacctctcttctctccctcctcggcccagccggcccagtccgccgagccgccgctctcctctctctctcagccgctgacaggtggggcccgcttgtcggatccgtcttcctcgcgtcgccgccgccgcccgaaaccctagcgcaagccgccgccgtctccttccaaattcggccgcgtctttccttatccggccgaatcgtttgagggaaaatgatcctcgggatctcctctaccttttcttctttggaagcttcgcctaaatcggtttggaaatcgatggattcgagttcgaattggatcggttttcctctctccaagccgagctttccttcgccgtctccgccgccgtgggccttcgccgccgccttcttgcacctatttaaggacccccgagctctcctctacccgtagccaccctcgccttcgcctctcgtcgtcggaagagctctagcgccgtgtgccctagcttcgccgtcgccgcgtcgctccagccgtgcgc

SEQ ID NO: 37172 - DNA, 1625 bp, Oryza sativa
agtatcatctccctatcccacacctgaaaaaacaccagacagacttgaaaagtaagtaaattgagcttaacggcaggtttttcacatggaaggaattatgtgcaaggatcaaggaagttgattacatgatggagattggatttgtgcctgaaccagcgtagattaatcgtattgcccccttggtcgctcgtgaacccaacatgcattggctggatggacagataaaatagttagtatgttgatgtgtatgaactgttgcagggagtgcatgagagtagactaattggtaaggttacctgatgaacatctcccatgaagtgtgacaagaatagcagtgcttcagtcatgttatctgcgttacaagcagttacaacaatatgaaagaaaatgaacagtcagacaagagatacatgacaactaaactatattggttgatatgatatactacaactgcgtagttctcacatttgcgatcggcgctgccgtgattatagtgcataagctgagaggtgaagttcgcgatcgcgccagcgacgcacatatcctccgcaccatccgcgccatggcaatcccctgaaaacccaaacgcgacagacagatcaacatatacaccattatcacagcagattcagagtatagcataattcagaaactgatggaggagaagagttgcctaagcgtacttgagtagacgaagctgcaggctttgtcaggggtgtcgatgaagtggagagggctcgtccacctgtacttgtaccagtgcctgacctgatccggccacacgcacagcgccgacaggtcgccgtccgcctcctccgtcagcaggttcctcaccgcgtgcgccgcggcttggctccagcagatcctgcatccaacacggcatcataatcatcagtcattcagcctaaatgttcaggaatggttcgattgatagtgatcattcacctgcgcgattcggcatgtgagcatgtgaccctccttgctccacgaatgagccaccggcgccgacgcgaggacgagcactgcagccgctgccgctgctagtagaaacgatgagcacttgtctgatgccattgatcaacgagacgagcttgatcctgatgagagaaaacaccgggacacagcaagtgatatagagcagcatgcagcaagcggagcagtgggaggcaatgatttaagcttagcttagctagccttcgttgagtgcaagcattgtgtggcgtgttaccccgcatgctttgcttcgcaccatcaaccaatcgccgttgggggtggtttcgcctttttgaaagagctactaggttgctgggcctgggccgaagcagattctctcgtaatgggcctcatcagacggccacggcccatttctcgcttcacatggccgcattaggctgggcttaagggaggcgaaacatttcgcggggacgaggataacgtctgcccaagcggagcgaaagggatgacgggcgccgccgccgccgtctccccgctcgtcgcgtggccccgctccgcgcccgcctcgcggggcggcaggcgtgcggcgcgcgcgtctgcgttccacccggacgtgtcccgcgcggtggagtcgctgcaagcggagttccgggaggtggaccgcgcgctcg

SEQ ID NO: 37173 - DNA, 2789 bp, Oryza sativa
taaggactaaataatcaaattttgaagagcatgtgcctcaccttgaagtaagtgaagcatagcagtatacgctagctaacagcctgcacctcccagtgccatgtttctccatcactaagcaagttacttttctttccagaatccaagcaaccaaaaagacaagttcagtttcttcatattgctgccatagtagtagcctcattctgcagtaaacagcacaagatactggaagggtgtcaataagagggggcatggattcaagcaagtacagatcaagaggctacacgatggcaagcagcaacaacaagaggccacctccttacctcctcctgctgctgctggcactcggcgctgcggcgctgagcgtgggcatcctgcacaagatgagggagcgccgcgtcttctccatcctcctccaggaacgcgatcagcagcttatctcccttcaagccctcctgcaggtatggatatatttctggaatatcatgcatcgaattcttatacattggccatccaggaagttgtagccaaaaaatagtctagcattatatattttttaatcaacacatcatgttcacataatacaagtactgaaataaattcaagctcccctaagaggctagaagctgtactcccggagaatgtgaatgtgtactcggtatccctgtgcatattaatattccctccgtattttaatgtatgacgccgttgacttttcgaccaacgtttgaccattcgttttattcaaaatttttgtgcaaatatgaaaatatttatgtcatgcttaagaacatttgatgacaaatcaagtcataataaaataaatgataattacataaattttttgaataagacgaatggtcaaacgttggacaaaaaatcaacgacgtcatacattaaaatatggaggtagtagatgaagtatacacctcaccctgcactactgcactcacaaaagttatgtaaagcccaagctgtgtaatctggaactaaaattcaaacttgccaaagacttccatactgacagcgttccagagaaacttcgagctagatacatcatatcagaaatccggagtattactttcaaatagacagagatatatactcaactgaacatcctcttagttcaatctataatcattccgaaaggtaaacactgcaataccagtagcattctagatttttttttagataatagatacaagcactctagatatgtaaaacttaagaatgtatgcctttcagttactgggttctataatcattttttgggtcagttcagatacctgatctttgaattccataatatatcgttaatcacatagtaatgttttattttgccagaaagaacaagaaatcagtaaagagatgaggagaaagatggatgaattagaagccaaaacatctgtcctaagcattgagaggacagaactgaaaaacaagctcatggattctgaaaccaccacgacatatctcacaaatacccagaaagagctggaagcggctctagtggaaaaagagggtcatatcaaccaaatgaaagagaatgcggctgcttcaggccctgaacaaatggcagctataaaggaacttctgcagcaaaaagaagctgagcttgaagagatcaagaccaagttgcacgactacaagaaatcagatacaaatatcagcgagagcattttggttggcacaaacaatgagaatacaacttctgacacagcggtacctgagaattctgcaaaccctggtgactctgctccagcagaagaacatcattcttacgacaatagtgcgtcagagagtaaccaagatgagagcactggagcaagcacaaacaacgaaaatgcaactgttgatactgtggtggtcgataagtatgcaaactcagtgagtatgcaactagtgattccacacctgctactacagaagaaccgcatccctacaacaccactgcatcagagagcaaccctcaagaaaatagttccccagaacaacactttataaagcttagaactaacagggaagatgatgaaccacaagacaaaacaacaggtgatgccaatgataattcaaatgatgctctagagggaagccacttggggaaatctgaacttcctcagtggagccccaaattggcagatagtcaagataatagcacagaagaactagatagcactagacagttggagaactcacaaggtgaggccaactatgaaagcagaggcagtaatctgctggagaaagaggtggaagccagcaacgaagttgaaccaatgaaggaaaccagtcctgagactgagctggagacttcgaaggatagcttgagtgaagccaaccaaaacagtacacaggctgttgaacctgtggctgatcctgcagatgtgaagccccgtatgcccatatataatgatgaaacaaaagagacaagcaagagacgtaggcggagaaagtttagatccagaaggaaaaagaggaccaatgctccttctaccaatgttgatggagaagtcaccaaagtaaggtagccacagcaaaaccaaaaagatacttggatttggaaaatgactgcaatgcaatgatgaatcataaaaggtatagataggaaaactgcaaaacaattcaaaagagatgacccagatagctgccatatgctaaatagccctgaagagaaggaaaagaaaataatagctaagcagctgcagttaccagatcgtagcctatggcagcacaaataatatttctgttctgaatatcacactttgtttcgtgtaaacactttcaagcacgac

SEQ ID NO: 37174 - DNA, 4176 bp, Oryza sativa
  unsure (1)..(4176): unsure at all n locations
nnnnnnnnnnnnnnnnnnnnnnnnnnnnnnnnnnnnnnaactagcctctgtttgtttcagcttaaaattattgtaatatatattattaagccagattactgtaagctgaattataataagccgacatagaataagctttgagttgtttgtttctctggattataagctatttgttagctggtagccacccaataatctaaaataagcatctttaaagtggattactagattatagagtggattatcgaaagaaaaagcaatcacaccacatatttccagaagtctaatgaacgaggctccagaagtctaatgagattaaggaggatttgaaagagattaatctcacacctattatggtgtgaaattaaacgaacaaggccgaaatgtgtactaggccggcctaattcagatccccaatagcccataaggcccgcaccatacaagagcccagccctatatctaaagccttctccttccctttgccaccatccgtaccgaccgaaccgaccacgacgagctcgaaccatcgaagccgaagcgcgcacgaagcgaccccccccccccctcctctctctctctctctctttctctctctcgcctcgcgaaacccagcgagccctagccgatggcctcgccggagcgggaggaggaggaggccgcgcgatcgcctccgccgaagcgcccccgccgcgacggtgacgccccgccggaaccccagcctgcccgcgtgggcctcaacccggcggactgcgacctcggtacgcacggttcttcctttgcaggttgcaatcgatcacgcgctctgctcaccactccctcttccgttgctgtgtggcggccagatttcgacgtcggcggcggcgggctccggggggaggcgctgcatgatggcgggttcgcctactgctggtcgggcgcgcgcgccacggtgggcgtgaggggtggcgggaagtactgcttcgggtgcaaggtcgtcgccgagcaggccgtggagatggaggacacggccgcggaccagcagcacctctgccgcgtcggggtctcgaggggcggcgaccccgtgggggccctcggggagaccggccacagcttcgggtttgggggcacggggaaattctcccaccagggcaagtttgtggagtatggcgtcaagtttggggttggggatacggttgtctgcgccgtggaccttgattccaagccgttggcgtcgatcgggttctccaggaatggggagtggcttggcattgccaagcacttcgatgcaagtgacaaagggctgggtttggttgaatctcctgtgagctcaatgcaatgggagtcggcaatctttccacatgtgttgctgaagaatgttgttgtcgagatgcaattcagcaaggaggatggattgcagcttgttgatggttatgagctctggccctcagcttgtgtcgatgggaatgcggtatctggccctgtgtttgcagaacaaaaagagtgtgaaatcatgatgatggttggtctcccagcttcagggaagtcaacatgggcagagaagtgtatcaaggagcacaaggagaagcgctttatccttctcgggactaatcttgcattggtgcaaatgaaggttcctatgcttgtttcacaacttgcatgctctatgatttccactattttcagtttatgactttccttttgcaggtgccaggattgctgcgtaagaataactacggtgaacgctttgaacgtttgatggatcgtgccacaatgattttcaacacattgctgaccagggctgcgaagatccctcgcaactacatcatcgatcagactaatgtttacaaaaatgcccgtagtcgcaaactaaggccatttgcaaactaccgtaaggtaagctgcgaaaggataacagtttcacagtttgccgtgttgttgctgaattaataaatgtcaatgttggatgcgtttgtggggtgtttaatttcatatacttgttgtgcaacagactgctgtggttgtgttcccatcgccaagtgaactcaaggtccgggcagcaaagcgtttcaaggaaatggggaaggggatgtgccagctgatgcagtaaatgagatgacaggtatccagccaaatccatcactgctatctcgaaatgttcattgtctatgttctatgcatcaattacttactatattgccataaacacctattttcagctaatttcgtcttaccactgtccaaggacatgcctgattctaaagagccctttgacgaggttgcttggcattgctgtactccatcttttggttactatcaagtttttccttaggtcattacacttttcaacatgtgcaggtaatctttgtagagctttccagggatgaagcccagagaaacctggatgagatgaaacgtttgctgccaaaagcctcaactcccagctatgccaatttcagtaaccaaaatgtatgttaccattattgctgcttatggatttggtcctatgttttgtcatcatgggttagcttgatcttttgattcatgtacaagtcctaacgtagatgcttacaggtgagctcaacatatagtgggactattgctgggacaatgccatctctgtcaccaggttatcaccgacaaatggacagtccatatggaagtggtgtgcagacaccaagggccttgacacaccaacaggcagcatggggtgttcagggtttccagagtccagcagggattaaccaccatcaagtccacttaagcagctacccaaataccccataccaacatcaacaaatccaatcaaaccatccaagcaccccataccaacatcaagcccaatcgacaagctacccaagtaccccttatcaagatcaaattcactcgagctacccaagtaacccaacccaacatcaaattcatctgaactaccccagtaccccaaaccaataccaaagccattcaacatatccaaataccccatttcccggtcatggaaatagcgtatatgattccaatggtggcccaggtccatacaatcctaatccttacagcatgaacaccgatatgcaacaaagaattcaagctcccattggtgacaggaaccagtcctatgcagttgtgtcaaatgaagcctatgggagatctggctatgaagcggcaaattctgttggaaggcctatcaatacacatcctgccgtgtacaattctggcagtggcaattacatgccctatatgcagcattctcacggtaagtggctagctcaggctctttcttttcagttcattttgttacaagctaattcaacttggtggattacagattcactatacaaactcttaaaattacgaagtgagaaaaataagctctgtaactagaaacttttatagcacatttgagtacattagcactcatcatcatagggttctttgacctattaattggctacttggaattagagattatgttgctacccgtgaagtaaaactacagatctttctttgactgacagtgtgctaacattgaagtaaaactaacacatctttctttgactgacaacagatgtgcacaactctggatcacagtactcagctccagtccccaggcctccttacggagctcctccaccaaactatatgaatccacagacgagcatttggcatatctagcaaggcagctaatttgtggcgataagcgaacactggacatggtaccaagaaaagtagtttaagtagatatgcgcgagtgcgtgacctataggttccagggaacctttggcagttcggctcgcagatttttgtatagttatatgcacgcataaaccattctccgtatgtatccagtttacgacttttgcatgatcaattagtattggtttggccaacgcagagtgttatgtcgtgaacaactttcggacgctcggtcaggtacgcctgaatcatgaaaacgtatattctagtctctgaagaacacctactattgatgatgagaatcccttgtgcccgcatgaatgtcatgttgccaatgtacaaactgacatccagcatttagcagctacaagcacgtaaatccatgaggctaaggaatgtacaaatcacgcgagttggcgttccagtagttcattggaaacttaatttgccagnnnnnnnnnnnnnnnnnnnnnnnnnnnnnnnnnnnnnnnnnnnnnnnnnnnnnnn

SEQ ID NO: 37175 - DNA, 3863 bp, Oryza sativa
ttgcatgcctgcagtcgactctaagatccccttattaatacacaaaaggtacggaactacaaattgaggaaatgatcatactggaaattcaacaacttcgtttgcttcattagtctcattttcctattgagaaaatgccctttcctactggcgatagcatcacttgacctgcaaaatattggatggtaaaattagcattggagcatctactgcagagttaaaaccagggcacacgatttcaaacacctttaacactcaaaatgcaaattagactgtaccatggctattccattttggcataggttgcacagttatggtataaatgcaaggtagcaattaatttaataaccttgattggctgaaattcagagtggtctgcttcattgaggccgtccctcttcccctgccccttctggaagttccagttttggcaacatcggtagcatctttagagggtcttgtaaatccagatgctttccttccagcattagttgttcttgcaccgagaagcatctccctggtgtcttcatcatcactgaaagagttcaggttactttgagctgtaacagatctacctccagtatcctggtcaagtatcataagagcaacaaacaatcagcaacaatgaaaaaatggcatacaacattaagggcataaggacattgaaaccaccaagttttgagagcttgacgtgaaccgtgaatcttccttggagcggagggacctttccttcacacgttcctaagtagttaaaaatattaaccttttaatcaccccacaacctcataggaacaatagtagattgctccaaatacctgcatgcactcgccaactttgactattatatcttcttcctctattttaaatttatctgcctctgaattcaatttagtctgcaggtttcaacaaaggatttcaattttagatgcatgcaattttatcaggcagcaagcaatcaaataagaactaaaaaaggctacctctgtattctagtctcatttctattaatggaaatggagagctacggccctttgataaaaaaaaagaactaaaaccaacaatagaaaatgtagcaaagcatactctggtttcttcaagattccgctgcaaacaggcataaaacgccatcttgtcatccttgctcacaaaatcatgcaatgcaatgtccaagtcatcaactggaagaatctccattttctggaaacaagatttgtgtcatgaagcttatattgttactctaatatttttttttaaaaaaaagaaggatgtaagaagctatccaaagaatctatagaacaaaatcaggaattccagacccacaaacccaactaagacaattaaatagtccttgtttcacagtaccactgttagtctcaggctattattgtaaaaagctcatatggtgaagtgtaatgggaccagatagagatgtcgctcattaaattattggctgttattcaatagctaccataatgggcctcctagccagaagtacctttcttgccattatatttctgaaaatttaattatatttcagcctaatactgtaggagtcaagaataaacacattaccatccatttagtgcataaggcagtataggaaaaaggcaagatctttgttttacatttatgatcatcatatatacaactaaatggaatcccatcaagaaaaacagatagcagcaattatttctcctaggagaagagcaaaactgcaaaataatacagaatatgtagtttcaagaagtaccaagttattttcggcaaccaaagcttcaatagtttgttggtttagttcctcgggacgaagtttctcagagtcatcaatattgcctactgtatatatacatagacatagtcagttaaacaaaaaagtcagaataacatggcatctgttgctcctcatagcttgatgcattctgccactatgtaaataacttgtgcactgtctttcttaaacataaaggaatacctccagtagtctgacgcttttttgctgattttgagaagataagaatatcctgggggtttgcaaccttacaacaagaagctatcaaataagctcattcaggtaagaattctgagtaagaacctaattagggactcagataccttcccgacatacttctgaccaaatcgttgtggattaattgttgaaaacccagagtaatctacctacagaacaatatgagcactttcattgttcctgtcttgattaatttgtgcggagtacatctcttctgttttttttaccttgattctaattagtggaagtttggtctctggtctactggctgttggctgactactcttcttaataagatttcttacctgaaacaattgagtattatgagattgagggttaacgacttcattcaacaaagaaaactagactgacaacaaacgggcaaataagccaatgttgaaccaattccacaccagcatgccaccatgcttctcaataaaatggaaaagattataacaaatcatggaaaactgaaaactcacaattttatccaaatgttcaagaacagaggcctgatcattgggatcaacatccacttcatcttttaacacaacctatatattaggacagtgagacccaagcactgaaataagcatgaaatgaggggtatcatacctcagcatagtgaaagggcctaacggatctcaaaggtattttggttggcctatactggtttccctgtttaagaataaaaatggaatgagaaaacaccaaactgaagttttgttcaacatgaagaggagagctttcaataggaccttgatttctaacaagagaacatgctttggttttgcttcaccatcaatcagggaggttgcaactgatgagcctggttgagtgatgtgaaaacccatcccaggtacctcctataaacaattgatcatatgacaagtgcatattcacgttattttttaaaaaagaaatcaaataaaatccaagtcattacctggggatcaataaggcattcatgctcatggccccatactataaagtccagaaaacgtggtaagaaatgctcattgattgcgcttttagggtttgtttttatcctgtatgatttcaggtttcaattttcttttcagtaagcggcatgaagattataaaaaaatgaacaagaatattgaaccagtcagatactgacattccactacagtttgtcaccattcattcaccgcccatacctattctgatgaagaacaagaatattgaaccagtcagatactgacattccatcttgagtttcaggtcgcatccattgtacagcatgaggtgtctgaataattgatataaaaatatgatatcaatgttcaaatgatcaagaaagtttcttgctctagtgctgccaagttgcgaattaacttcaaattcttagaaaagtcaatggaaatgcacctgaaacatcctgtttaatcgttcatctctaatgtttccaaggccatagagcgcaacaaaagttgtaccctgaaataacaggaaaaacagaggattaacatgtgagagttcatggtttgcctgcagctgaagtagcgcaccttttttacgagtacaggatagactgctatttcaccaacaccagagccaccaaggtccatcttcccaaaataatttacaagattgcaggctgagagaatatcaattgcagagagattatcctacagagaggggcaagaatgcatgagaaaagctggcacccatcataagcataataaccataataacagaatgtcagaacgagattctcataccacaccagctggatcatcatggtttccatggatagtgaacacaggcaatccaacattgaagtttggatcttcataatttacttggccgaatc

SEQ ID NO: 37176 - DNA, 4758 bp, Oryza sativa
  unsure (1)..(4758): unsure at all n locations
nnnnnnnnnnnnnnnnnnnnnnnnnnnnnnnnnnnnttgtgcgcgcccttctcgatgtagcaatagcaatgggccggcccatcaaggcccattaatatcaatacacgagcccactttccatatacacggcccgttttcctctagggttaggtcaaggtctcttcccctcctcacctctattaaatccgcaggagaggccgccgccaccaccaccgtccgcatcgcgatcacccaccaccacatcacgccggagaagtagtcggcggcggcggcggcgaaggcgaagatggtgtgcatacggcaggcgacgatcgacgacctgctggcgatgcaggcgtgcaacctgatgtgcctgccggagaactaccagatgaagtactacctctaccacatgctgtcgtggccgcagctgctgttcgtggcggaggattacggcggccggatcgtcggctacgtgctcgcgaagatggaggaggacccctcggagccttgccacggccacatcacctccctcgccgtgctccgctcccaccgcaagctcggcctcgccaccaagctcatgtccgccgcgcaggctgccatggaccaggtgttcggcgccgagtacgtctccctccacgtccgccgctccaaccgcgcggccttcaacctctacacctccacgctcgggtaccagatccacgacgtcgaggccaagtactacgccgacggcgaggacgcctacgacatgcgcaagccgctgcggcagccgcagcccaagaagcaccaccatcaccaccaccatcatcacggccccggtggttgttgctcacacgatgctcctcccgcggcatctgggtcttctccgccgtcctctaattcgccagagaagaccgattcatgatgggtaagactcttgattaatttgtttattattatagctatagaggatgtgcaaaaatcgaatgaaatcttgaggtagtatttgccatgtgggtgcctttcctcacctttggctccttgaaaatggtctttctcatggttgcccagtcatggaggcaaaaatcgatttctggtgagtttaacgtgggagataacagtaatctggtggttatgcttctaaaatgtctcaccacattaattattattttttaagtctctgtttgctgagaaacgtggtttaagacaatctcggcaatcatgttcaatgcttttgtttggtgcgtaatttagtacggttttgattgctttttctgaggttatcacgctatatgaattgtatgagataaatttgaaagccctctttacagtattcttaattatagtgcaagcttgttcaagcaatatttgagttgccatctgttgtattttttttgtttcattagtagactatgaagagttgcccaatgtgtgagatgtaggtagcttcaagggcctgtttttcaggtttgaacctacttggggtcctacattgtaatgagttatatgggctttttaaactgaagtctactattaagtagctcatgattttttgaattgtaactcgcttttgtagccatagtcttgtatgtaagagaagatattttagatggtaatagaatgtgacctatgatgcagtgcccaaaatgtgagatgtaggtttctccaagtccctgttagtcagggagaacctacttggggggcctacattataatgagattaatgggctgttactgaggtctgaacctacttgttggtactcctatttgttacaagtttttactgagcattattacttgatagagatgtattcaaacttatgttcatgttttttgcgaatgatgatattgtctgcaaaatggatgccctgtggactcaagtccctgtttcagggagaacctacttgacaaatcagtggataacatgacatcaacagataaatctgatgcatttgatattctgttgaattttttagtcatagggaagtcttgttgtgctcatcatgtatcctatcaaagagccatgccctgagttttgtgccttttctagttgttatcaacgatgatcatgtctgcaaaatatatattctgtggattcaagtccctgattcagggagaacatacttgaggaagcagtagatagtatgacatcaagtgataaatttgaggcactatctcttaactcatgcttgtggcccttgttaagttgagggtgtgtgcaatgcgctgttgcatgatattgttttcattcagctttactgggcctttgttatgatttaattccctgttttgtgggatgctgctctcccccctgtttcatttgttatgattgcttcacttacgaactgtcaatgattgttctgtctgcaaaatggatatgttgtagatccaagtatcttcttttaagacaacctacttggtgaaacagcatgtaatatgacatcaactcttttcctgttttgattcttttatgcctgaaacagcatgcaatatgacatgaactcatacatctcagacatttggtgttttcctgttttgattttttttatgcctgaatagtgagcatagagatataagttgcattattgtgattgcagaaggaaatggagaggctgaaggagttggtgagcccgttggacttgcatctggtgcactcactcttttgataagaagtccagcgaaatcatttcctaaggaaacaaaagatatgtactgtgattatgtgtgtttgtaggcatctttgttggccgatgattcacccatgggccagggtccactgtaattctgtttgatggacgtacaaatacttttgttagctacttggcatttgctgtcgtgcctgtaatatctccccatacttgcggaattttttttggcacatctgggcatatgtacttggctacattctgtagcacgcataaagtcatttttggtgtatctccttgactcaaaacacctgcgtgaagttattgtttgccaaaagaagtcagatgaccttatgaacaagctcctagccttacactatcgacaagaagtattggggctttctaggatttgcaagtactttgaaaattgatgagtaaaatgttcaactgaatgctagaaatgaaaagttgaaaacaatccgacagcaatttctgatccatatattcttgaaactgattcttcgtaattaagctgtgtttctggctttggtctctggcatacaaaggaagtgatacaggtcgtcatgtactgacatgtaaaaagcccaattaggcacaacgagtgtcgcaagacaaaggaaccctctttaattcaaagaaagtgatcagtgagctctatcaaccgagaaaaatgttgacttgatgaaccctgtttctcggtggagacgccggcaagaccaccaaatcaccatcatccataaacggatgatggagctagaaaccagggtcgtcccactgcaggacagctgagcccacgttctgctccctcttgagcttgtccttgacgaaccagtcgcaaacaaggcctgcgttgagctcctcaatggggacgccttcttgctccgaaatcactctcaagagattcaacgacgatatctgtcacaaaaaatcacatggttactcgtcatcgtcaacggctcgttgagacaaacacctcacctaaacttcacaactttgatatgctaatctgctcgccactgtaatatctttgcaatcgatcagtagagatgcacacttacggtgaggcggcagaggaatcgctcgtgtgtgctgaggccggacatctccaccagcccggcctcctccaagctgagaaatgttctctgctcttgctccccatcaccaccaccgccattgctccgctcttcctcctcctgctgttgctgctgctcctcttcttggcatctcctcctgaccaccaaccgcgacgcggcgctggccctcctgagctccccacccgctcccgctgcacaattgcatccagttagcactaagcagtaagcacacacgcgaagaaccgatgcagtgggaggtagtgtaacttgtaaccacctgcagggaggcagggggacgctcgccggagcaacggccgcggggacagcagcgcggccggccgaagttgatgggccttgcacaagccgaccgcctgccgcatcgcctcgatccgtcgcggcacgtccccccctgctcaattccggcgacacaagatcagcttgggagaatcgaacgtgacacaaacacgagggacaggaggaagaggtggtgtgcaaccggataacgttagcttgacacacagccaggccgggccttcgtatgatcacatgggccttagattcgtccatgttaagattcgagagcccaaaaaggattaggcgccgagagaagagaactgtgtgggatgcatcagctcgctagtggcgcgcgtccttgtcaccttactccatataaacccatattatccccacgaatccccacgaatctgccagttgcgcacttgcgcgtgtgggacaaagacgagacgggacgggcgccaagatggtgagtcaccaacccagccgggacagatagcgaggagcaagcggctgaaggaagcacccggtatcgcgggaaaaccagcgagcgcggccacctgtttcgcgccacccccactggcctccctccagtataaatccagctccactccaaccctcctcctcaacaacaacaacaaagcatcgttcaattcagttcacaaatcacaacaacaacagcgcgagaaatttaaagaggagatcatcggannnnnnnnnnnnnnnnnnnnnnnnnnnnnnnnnnn

SEQ ID NO: 37177 - DNA, 1926 bp, Oryza sativa
  unsure (1)..(1926): unsure at all n locations
ccaaactttaggggctaaatgcaattttttgcagacggcgccgtcgagccgccgtctgctacgtcagcttgccgccctccattaggacggcagggtctatttttgtaattttttgcgccaatagattatttctgtaaatattaaaagaaaaaaaattaaaaatgaaaaaaattctatcttcgtgagactcggccctctacctgcgttcagcttcgtcggcccaaattccaggcccattagcccagttgcatactccatgttgcaagttgcaacagttgtgtggggcacgagtcctcgtcacgtaacgttgttcctatcttatttccgcccgcaccccgccccacgcgagacgcgacggacaaaccgcttccccgccgcgatgtgccgatgatgcagcagacgagactagacgagacgaggcgggccaccactgagccgggacgcacccggtatctgggaaaaccaacgcgcgcggccacctgattcagcccgcaccacctgatgaccccctccccctcccttcaagtataaatcccacctccactccccaccagattctcatcaaacatagcaccaatcaccaatcacctatcagtagtacttcactgctcgctactagtcccctgaattcagcgatcagtataacagcgggaagctcaagaagagatcgtcgatcgatggcgggtgcagcgaaggcgtcgtggatggtggcgatgagcgtgggcgcggtggaggcgctcaaggaccaggcggggctctgccgctggaactacgcgctgcggtccatccaccgcgccgccaaggccaacgcgcgcgccggcgtctcgcggggcaagaagctgcctgcctccgcggcggcggtggcggagaggaggagagcggagaaggccgaggaagggttgaggacggtcatgtacatcagctgctggagtaccaattagtatagctgtgccttctactcttctactactagctttgctataggagtcaggttggaacttggaagtggcaaccatggctgagacttgccggttgcttgttaatttcctccgggttgtatataccacgatgatgatgatgaaaacttctgttacttgagtatacttgatgtctcgatgtctcatgggttatcaatgcttttgccttgagagattttgacaggcatttttcatggttgtacatgatttggattttgacggggaagaaccactagtatttatcttgacaaaaatgatacgacagtatgaaccctgcactttgattacaacaataaacatccacgttgaaagttgaattgctgatgagatcatgatcagagatcagtcatcaggttgtcaatacattaccacgcacgaaaatcaggcagtggcgccatcaatttatccagtcctatgaatactcctatctgaataattccttcttgtttccttcgttataccactcaaccaatcctaatttctgccattcttttttttaccaaattaaactgatgtagcaaaatcacaatacagtttctttcccagtttgtgctaaacgatattgagtcggaggaattggatcagagtcatcagactggtgcggaaaagcacaggtgtcttctgtctattgcatacccagaatgcaatgcatcaataaattaagctggaacgagaagtattatgcaattattaagcccctgacatcttggaaaaccatgtgctccagcctctggtttcccctgtccagcagcctcccacaactccgctctcaccatcacccgaagaaaacgtcgtcgggcgatgcgagttggtgcgtgaaaagaaatgctcacttgtttactcgctcaccaaagaatgcaagtacaggatccagaatcatattatactccctnnnnnnnnnnnnnnnnnnnnnnnnnnnnnnnnnnnnnnnnnnnnnnnnnnnnnnnnn

SEQ ID NO: 37178 - DNA, 716 bp, Oryza sativa
gacccattttttgtcatgtgacatgagcctgtcgtagacgcgggttttgatccctggtagtaataagtcgtttgccctctcgacttgtccgttactttaagggtgggagaccgaggcgaagcatatcttgactcccagcccgatgcagtaatcctggaaatcagcgctgatgaactgggagccgttgtcggttatgatgcggtgcggtagtccgtatctgcaaaatatacccttgatgaatttgatggcgttgtcggccttgatttctcccgtgggtactgcttcgatccatttagtgaatttgtcgatcgccacgaataggaacctgtagccgccctgtcctcgtgggaatggcccgagtatatctagcccccagcacgagaacggccaagtaagagggatagtctggagcgcttgcgcggatagctttgtgtgtttactgtggaattgacaggcttcacatcgctggaccatgtcgcatgcatctttaagggcggttggccagaaaaacccttgtcgaaaagctttcccgaccaatgtccgaccggtggcgtgtgacccacaaatgccttcatgtatatcaagggggaggtgtctaccgtcgtcggacgagacacatttgagaagtaccccgtttggcgctttcttgtatagattgttgggccactgtatcgtcctcgggcaactcctcgctgttgatgaatttgattagtggg

SEQ ID NO: 37179 - DNA, 792 bp, Oryza sativa
  unsure (1)..(792): unsure at all n locations
tggctgctctgagtgtgcgcttctgagcttcttccaacctaagagaaccatagtacgtcctggtggtctgcaccgtgcaagtcgtcgtcgtagaccgggctagtaggaccagtcctaccggcgtgagacgaagaggccccagtaccgaagatcccgcctgcaaatcctgctgaacaaggaccatcagtttcgtacaggtatttaacagtattaataaaaagtaaagtaccgtgtggcgaagggaccgacgctccgtgagagaaagagctggcgaacgcgcccgaagaggtggcgaacgcccctgcggagctcgcggaagcgccggtcgtgcctgcgaacgcgctcgaaggcatacgaggtcctgcgatgaggaaacgtgcagttaaaacatggtgacacattcgtgcaaaagctgaaacaaaaatgaactaatatctgggctgaactgtaccgtgcgaaaccggtgctgtaggtcgcactgctccgaagctaggggcgctcgaagacaaacgaggtcctgctccgacggtaggaccgcgaggccgtgggtgtaccggaccagctggaggtacgacgtccacggcgctgcgacaggagaagacgcgcatgaccgcacgcatcttctcctgcatccggtcgaaggtcgacctctgctcaacgtcagtcaagtgcaaacctctgctcaacctcacctggactgcggtgatatcggcactgatatcccgtgccgcatcagcctatgcaagatggaaatnnnnnnnnnnnnnnnnnnnnnnnnnnnnnnnnnnnnnn

SEQ ID NO: 37180 - DNA, 266 bp, Oryza sativa
  unsure (1)..(266): unsure at all n locations
nnnnnnnnnnnnnnnnnnnnnnnnnnnnnnnnnnnnnnnnnnnnnnnnnnnnnnnnnagcgacggctcgcgctctagcgatcactaatcgggtcgcgcgagcttggtctctcccctataaaaccacggctccgcgccaccaccattccggcagaaggcaacacacacccaaacacaaacaagagcatcatctgagcgtgcagagctcacacaaacacacgtacagatcgttcgtacaagtgcaacaaacacatgggtaccgagctc

SEQ ID NO: 37181 - DNA, 783 bp, Oryza sativa
  unsure (1)..(783): unsure at all n locations
nnnnnnnnnnnnnnnnnnnnnnnnnnnnnnnnnnnnnnntgtgaacgttatactgtgttttaaaaaaacatatatattgtaggccagctatttgctctaaactattttgtgttaagctacctgtactaagttattttgtttttttaatgtttcttaacgaaaaatgaggtatgtaactaggacttcccatgaggtctcgtcaactatagacttgttggctgacgggtggttagtacagcgctaccgatgccatgaaatggaatttggttaatcgtggagtgaggtcgatgtcatgacgcagatcatcaacgtgccgcgttcaactctcagatcattttggtcttctggcttatttggaaacaacgttaatgcaaaaatcttccaatctgaatccaatacgcctctggagtctggaggttagaagatcaagaaggaattttgcgtctcgcctgactgctgatttctatttttttttgagcggaacatatattccatttacttattactgatacggccaaatcgccctgattgctgatttctttgtttcataccggtttgataatacttttcgttttggataagggcacggtctctaaaaaacaactttgaccattatttttcattataatatgtataaaatgttaacaaatatacgattatattaaagtactttntaagactaatctatacatatagtcaccatatttaaaagacaaatatttttaaaatgatttataatcaaaagatataaagttgactacacccttatccaaaacgacaagt

SEQ ID NO: 37182 - DNA, 1323 bp, Oryza sativa
  unsure (1)..(1323): unsure at all n locations
tgataaactagttaattcaggtagtccggatctgtctatttagaatttgaaagaggtacatcaaatcccatacgacaatatctaaattctctcaaagtcgtactccaactaattggctgaatttattaatttgcactcaattgggtgtgaaaaaattgcttaaaaagtgcaggtcaatgtgactgcttcgttccaaagatttcttcgtcttagcacgacctgtggctccccgtaaccatgtagcagagctttacattcttttggcctgaaaaaggaaatggagaagcacaatatgcatcctagttatccaatgggttaacacaaggcaaaagtctcccgtgcacgatgtctcacaaatgactttttacagacactcaaatcctactcaaaatagcaaacagatttgataaccggtcactagggcctgtttggttgctaccctgaaaaaaatttacctgacctgagactagcctgactcgttctaggctctgtttggttgctagcctgacactcttttactcaacacggagacgcgtgattagcctgagtcaaatcggtggcctgagcctcaggcgcagcgaggacagaagattaccatcataatctgtttcggcagccagcagaatgaagctgccctcccgtgaagctctgatgccgccactgcgtgaagcccttgcctggctgcctccgccgccgtagctatcgccgccgagtgaagtccatgccaccgtcgccttcgtctacgcgaaagcccctgctgccgtcgccggcgtgcgacaccagatttatcccgtcgtctttcgcggcggctgtcgattcttcggatcccgtcgttgttgcaacatcttggcgcgaagcttcagccaatgctgtgattcttttcgctcctgtcgttgttgccgattgaagcttgccgactgctgcttggatttggggatatttttaatccttgtactcctttggtttccctttttttatgtatgtgattaattgctattggaaagctacgatttcagttggaactgtcaagcaatctcgccgaaatttgcgtcttcttgtttagcacttaacttactagtgaattatcagacccaaatcactttttcccttctcaggcagcggcggcaaaccaaacaagcaaaagttcagccgcctggccaggtaacattcaagaacttctcagaagcatggtgctcagggcatcaaccaaacaggcccacaacaggaggataaatttcctggtgttgcataccctgatacccagatgtnnnnnnnnnnnnnnnnnnnnnnnnnnnnnnnnnnnnnnnnnnnnnnnnnnnnnnn

SEQ ID NO: 37183 - DNA, 1868 bp, Oryza sativa
  unsure (1)..(1868): unsure at all n locations
nnnnnnnnnnnnnnnnnnnnnnnnnnnnnnnnnnnnnnatataaaaatatatgtatacataaaagtatatttaataataaataaatcaaatgataggaaaataattaacaattacttaaatcttttaaataagatgaacggtaaaacatgtttagtaaagtaaatggcgtagagacggagggactatatatataaccctgtacagttgtactacgtgagatcgtcgtcaatgtcggtggcgcccagcagctccgactcgcgcaacggtggcctgcttctgccgccgtgaacccctggcctcttgggacgatccacccgtgagctcttgctggtcagcatcgcgacgaccgccgacatggccggcctttcctccggcgcatcctgcacgcacaggagcccgatctgcacgcacctcgccagttcatcttccatctcggtgtgatcaggccctgagactgagagagggagaccgatcatcgcgtcaaggagggacatcaccctgccctgctcccacagctcccatgcctgcacacaaagccgatttggtgaattaatccaaatgtatatgtatatttggtgatttggtgtatatatggtgatgcttacatgtggaaggagactgtacatgggaccattcctctgtccgctaagggtttcgagaagaacgactccaaagctgtagacatcgcactttagtgtcatctcccctcgccatgcgtactccggagatgcgtatccccttcatggaaatgtaactcgaccatgtcagtgacacagtaatactacgaaacatgaccagttggctgattgttcatgagcaagagaatggagggtgtgaagtaactgacggtgaaaccacaacggtgagattggaaggctctggctggtctgctgtgaatagcttggcggtgccaaaatctgcaatcttgggtctgaaactgtcgtccaacagtacgttcggaggcttcagatccctgtggatgacgcactcgcctgatccctcgtgcaggtacgcaataccattggcgatcccatgaatgatgcccaatctttttctccagttgagcatgagtcggaggccagaatcgcctgccagtgcaaggtacatcaagttagcaaatgccatacgagaattgtataaactgtaagaatgcagccttttttttttctgtatattcgtttctctaagtaccaaatatgtagagatccaaactcctgtttgacatgtagtcgtatatcagcacacgctcgctgccttcgctgcagtaggcaaggagacgaagaaggttgccgtgtctgagcctagccatcacctccacttctcttgtgaaatccttcttgcctttcttggtgagggttgattggtgtagccgttttacagcaatcattctcccatcaggtaactggccctacagattatacaatttatattgtaagcaactgagaatacataaatttcatccacattcctccaaaaaaaaatcatccacattgactctttgacaacctcactacaaggaattttcattagaaaaatggaagcacacgagtgtcaagagttcatgaatcatgaccgagcgagtatgttctatcatgtagaaattagaaaaaggaaaggaggttaccttgtaaactatgccaaatcctccttggccaatcacatggctctgtgagaaatttccagtggccgccttcactttctgcagatcaactgaaggaactgttgtagcaggattatgaggtataccttctgcaatataaaaagaatcagtctgggtctggaacttcctgggaaatgtctaacgcttaccttaaatttgttctttctgtaannnnnnnnnnnnnnnnnnnnnnnnnnnnnnnnnnnn

SEQ ID NO: 37184 - DNA, 1149 bp, Oryza sativa
cttgatctgatcatatgattgtccctctttaatttcagaatgagctggttatagaattaaccgctacggaatgaaatttacaggaaacaaaattgtcccagtgaaaatgtgattgctctttgggtcattgggcttatgaattatcattcatattcaacagttttcggatattatggccttgtttagttctcaaaaacatctcatcgaatctttggacacatatatggagcattaaatatagataaaaagaaaaattaattgcatagtttacatgtaaatcacgagacaaatcttttgagcctaattaggtcatgattagccgtaagtgctacagtaacccacatgtgctaatgatggattaattaggctcaaaagattcgtctcacagtttccaggcgagttatgaaattagttttttcatttgtgtccgaaaaccacttccgacatccggtcaaacgtccgatgtgacacccaaaaattttcatttccccaactaaacacgccctatatgttttacgaaaagaaaaaggtaaaatcctttcgtcgtcaaatttcactaaattattggaactggaaggttgggtacctgggtgcatttttgcaatttgcactaggcgataaaaaaacgaagaatacgaatccgcatctatgtgattcatcactgttttaatcagtagtagtactagtacctgcactcgaggggcgttgaaatggcacgcctgaacctgaacctcctcggcgaaaccacgtcacgaccggaggttgcgcgtctgcttcggttccccctcagccgccgccggcggctgcgccgccgccgcttgcccaacagcgcgtcagcactagcggttcctctttttgccgggtcggccgaaggaaccggcgaccaattttattaagattaggaggaataaaatcaaagtacaagtagttttcgcttgcaacgacaggtgtcgaattagactgtggcaggaaccacagcccggcaaactaaagaactggaacgtcaacacaacagaaagaaaactaagaactgcaattctcgaaatagcctgcttctttccacactaagatctcttctttgatagcctctgctaactggttagggcttctcgatctttggtcgaaaacacgcgcatttctttccttcca

SEQ ID NO: 37185 - DNA, 394 bp, Oryza sativa
  unsure (1)..(394): unsure at all n locations
nnnnnnnnnnnnnnnnnnnnnnnnnnnnnnnnnnnnnnnntggttgcaggccagaacatattttcggaagtgctacaggacaaacttcgacagcgcttgtatgctgatttgctggtagatttggaaggaaagaaatgcgcgtgttttcgaccaaagatcgagaagccctaaccagttagcagaggctatcaaagaagagatcttagtgtggaaagaagcaggctatttcgagaattgcagttcttagttttctttctgttgtgttgacgttccagttctttagtttgccgggctgtggttcctgccacagtctaattcgacacctgtcgttgcaagcgaaaactacttgtactttgattttattcctcctaatcttaataaaattggtcgccgg

SEQ ID NO: 37186 - DNA, 753 bp, Oryza sativa
  unsure (1)..(753): unsure at all n locations
caactcactgtggatactgtttttacttgattctttctattacagaagtagtagccaatagccatggactttcacttttgaatagtatggacaattggacaggctgagaactgaatatatagatctttaagcttgcttagcagttttttcttttatatttttgttcaggagggctaccacacataccgtggaggattttggaattactttagtatgggtaagagttcctctggtatccaaggcacagcatgatgtttttttttttttttggtttatgctagttcttgctctaacagatatcaaacagtcaccgttgttatccagtaccttttaatcaggacttgttaacaatattatcgtagaacatattttagtatcttttaagcatatcatgattaataaggcagtaatagaaacatggtcatcatgacttcacatactgcagggatggatgcacaagtgtcttacgaatttcactctgagaggaagagaaatcccgagaagttcaagaaccagctaacaaatcaggttcttctcgtttctgtagggcaagtcttgtggcacatttcattttgtttatgctgaatgttgtgatgcatttctttgatgcagagtacatatgctaagcttggacttaaacaaggatggtttgctgcttcactaactcacccatcctcgaggtagcctgtcactaatgcnnnnnnnnnnnnnnnnnnnnnnnnnnnnnnnnnnnnnnnnnnnnnnnnnnnnnnn

SEQ ID NO: 37187 - DNA, 1937 bp, Oryza sativa
  unsure (1)..(1937): unsure at all n locations
nnnnnnnnnnnnnnnnnnnnnnnnnnnnnnnnnnnnnnnnnnnnnncctttgttctaatttttccaatcaagcaatggtgggatagccagtagtaaaatttaagctttcaaggctcactccacatcagaaaattttctacttacatactatcgtttgtagaacaatcgtggaagtttatgcccttgctcaaaaaaaaaaaaagaacaatcgtggaagtggaaaaagggttccgtgaagcgcatagatcaataatgtctaatctcttttcactcataaaaatgttttgcaggatggatggacatacaaatggcactaatggttcctgctctaagccatgcgagccattaacagactactgcatccctgattacattctgaatcctgactctgaacaagtcctcgttgatcaggcaccatgttgccctgtagtagtattcatcaactctagaagtggcggccaactcggaagcagtttgatcaaaacgtatcgtgagcttctcaataaagcgcaggtacctaatctagtagtttgggaagatggaatgctgaaaagattcccttgagccatagtaggacttcatatcattctctcatattatctcatatttggatccacaatttttacaggtttttgatttatcagaagaggctcctgaaaaggtgcttcacagattgtattgcaactttgagaagctcaagtctaatggcgaccctattgcttttcaaattcagagcaacctaagactaattgtgagtagcctaactagaaaacataaagaatgatctttttgctttaggatatgtcctcttaactaatgatctttgaaataggttgctggtggtgatggcacagcaagttggctgcttggtgtagttagtgaccttaagctctctcacccacctcctattgcaactgtgcctctgggaactggaaacaaccttccattctcatttggatgggtatgtctatgactattgttttgttccaacacatatattctcttcagttgtgataatctcctccctttagataattcacgcttgttgtgaatttgtgatcatatacgagctgtttttgttgttgagctgtttgacaacataagaaggtttagcattaagaaacatgcatttttgaattaatagtgaaatagtgatcatacgcttgatacctaaattttatgtcttattgactgtgagctgtgaggggtgcatgatttttcattctaaagtagaagattactgaatctgagattttcttgttagtttgatctggattccttggccgtctttttacctagtctgcataatctgcagccatgatctctgaatcttccctggcatctagttttatacctctattaaatttaatttgactgcaggggaagaagaacccaaccactgaccaagaggcggtgaaatcatttcttggacaagttaaaaaagcaagagaaatgaatattgataggtaatatctcaagcacacaatgttatatttgtttctgttttttctgtcatgcttgtgaaaagtacaagtcctgcccaataattcactgcgacagctctttcatatatgttgtgtagcagtcatttttagttttaaacatgagtaaaatgtaatcccttatatattctgcatatgaaagaaaacactcatttgaatgtacttttttaagttggcatatcatcatgaggatgcgagctccacaggaaggtccatgtgaacctattgctccgttagagctgcctcactcattgcatgcattccaccgtgtatcaggaagcgattcacttaatatggtaagacaactcactgtggatactgtttttacttgattctttctattacagaagtagtagccaatagccatggactttcacttttgaatagtatggacaattggacaggctgagaacgggtaccgagctcgaattcgcc

SEQ ID NO: 37188 - DNA, 597 bp, Oryza sativa
  unsure (1)..(597): unsure at all n locations
nnnnnnnnnnnnnnnnnnnnnnnnnnnnnnnnnnnnnnnnnnnnnnnnnnnnnnnnnnnnnnncagtaaagcccctttggaagctcctcggcagcaatctgcccatacttggtgctcttttccgcctcagctttcgatttctcctctagggattgaatctgacccttcaacttcatgattgtaactgcactatcatagcggaactgctgcgcctggaagaacaacaccgacatgtccctaattgccttctccgcatcctgctccgtcaccgtgccaccatgggctgcagcatgcgcaaggatgctctgcgcccgccgtatctgcgagctaagctctgctgcaaactgcaggttattggcttccttcgcaacgacgaggtaggtttttgcaagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 37189 - DNA, 716 bp, Oryza sativa
  unsure (1)..(716): unsure at all n locations
nnnnnnnnnnnnnnnnnnnnnnnnnnnnnnnnnnnataataacagaatgtcagaacgagattctcataccacaccagctggatcatcatggtttccatggatagtgaacacaggcaatccaacattgaagtttggatcttcataatttacttggccaatctgtgattgtaccaagaaaattcatgtaagaaaattaaggggaaaatgcatatctgcatacacgtatgatatatcaaacctaaatttcagcaaaagtgacacttttatgaaagattacattgagggatcaccaaatttagagtacactcaagaaaaaaatggcatgatagagtgatataactcatcgtcaaaacctgtttggaaagttgattgtctgatcactgacaacctggaacttcactggctggtcattcaagcagtaacgccgtagaatctcaatggtcttaactaaggttgaacgtgaaggtttgttctcatggaaaaggtcaccaccaagtagcacaaaatcaacctgcaattcagtatgatttccatcatattataattcataattcataaatagaaggttatcccccaacagaatgagcaggccaataaattttgcaacacaagcagaaaagaatggaaaaatgtgcagctcctacaaaccttattctgctctgctaatgagcatatctcttcaaacgcctcaaatgaatcaaacctacgaatctcgt

SEQ ID NO: 37190 - DNA, 2062 bp, Oryza sativa
  unsure (1)..(2062): unsure at all n locations
atccaatggcgggtgcagcgaaggcgtcgtggatggtggcgatgagcgtgggcgcagtggaggcgctcaaggaccagggcggactctgccgctggaactacgcgctgcggtccatccacaaggcggccaaggccaacgccgccggcgtctcgcagggcaagaagctgcctgcctccgcggcggcggtagcggagaggaggagagcggagaaggccgaggaggggttgaggacggtcatgtacatcagctgctggagcaccaattagtgtataaactcgagatactagtacgtagctagagctgaagtagcaaaccatggcttgagatttggccggttgcttccttgatgtgtatatatatcaagatgatgatgaaaatttcttgttactaaattgccccgtggtttttttgccatgtgaattgcgatcacgttggctcgtggatttgttgcccctgaatttcagtctctctagctagtggctaaggccatctcttatttggttcagatgacagtaattcatccaggtctccaagttctaggattttcagaactgcaacttattttatcaaggaatctttaaacatacgaacagatcacttaaagttcttctgaagcaacttaaagttatcaggcatgcatggatcttggaggaatcagatgtgcagtcagggaccatagcacaagacaggcgtcttctactggtgctaccagcaaatgctggaagccgggaacactgggtacgttggaaaccacgtgatgtgaagaagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctgatttaaaagagttgtgcagatgatccgtggcacgaccttacttgaacgggatctgttctataggctcgtaccgttgcatccttgactaataaggaggcaagcacttaagcttggttgatgacgcatgacctgtgggccagagcgtgattaacggccggatcactggctgatttgatcccacggctgtagaggatcgtttcttgccgggcctcgcctggccaggatggctctcaggttctctgacaggctcccattttttttttcgttttgcattgagttttctccgtcgcatgtttgcagttttattttccgttttgcattgaaatttctccgtctcatgtttgcagcgtgttcaaaaagtacgcagctgtatttcacttatttacggcgccacattttcatgccgtttgtgccaactatcccgagctagtgaatacagcttggcttcacacaacactggtgacccgctgacctgctcgtacctcgtaccgtcgtacggcacagcatttggaattaaagggtgtgatcgatactgcttgctgctgcagcaactgtggctgcaagagctaaaaatggctgcagcggcagcagctgaaaaacagccacagccatagcggcagcagcagatagcagttccgatcaggccctaaatccaagtcctacctaaacaggatgctccattgaacagccaaaccggcctcacatggtctatccaaggactctaccacatcagctgtctttgcatccccatgttcccaacccatcttcctcattttccgcgcgcacgttttttaaactactaaacgatgcgttttttttaaaaagttttctatacgaaagttgcttaaaaatcaaattaattcatttttttttaaaaaaattagctaatacttaattaatcacgcgctaaaggaccgcttcgttttccgtacgggagggattggcttccatcactggactccgaacacagccatgtcctccagctaacggttttccctaccagctcccataactccgctctagctcaccgtcacccaaagacacaaacattaatttttttaaaaaaaaaatgacttcgacttatatatatagaatcaataacgatcannnnnnnnnnnnnnnnnnnnnnnnnnnnnnnnnnnnnn

SEQ ID NO: 37191 - DNA, 1026 bp, Oryza sativa
acgcttgattgggctgggattaaggcccatttatacacggccaccatgcttctttttaccaacgaacgaactgtcgcattcaaaagaagagaaaacacccccccttcttctttctccttgacgtcatgtcagtgaacttgttttcctttccctccttcaaaaaccatgtaagcaaatccaggagagaaaaaaataaagatctagacatcggacggcactatccaagtttaccacatcctgcgggcagagctcgcgtcactgccgtcacaccgtagggagtttaacgcgcctaagcatccacacccctcgccgggcgtccgcatcaacgctgctgctcccgtcgccgtgccacccactccaccatcagtccatcacatattctctcgtcctatctctgatggcgctgtccacatgcgccaccgtggcacgcgccgcgccgcgccgcgtcaggcgtccgtcagcgggtggaaacccaccggtaatgagaacgaacgccaccgcgaccacacacagaacccgctcggaaacacaaacatcggcgttgaacgcgcgacgaattccaacgcgagaacgcgcccaaaaccgcaaagcagccgagcttctctcgcgcgcgcaccaaccgccgcccgtgcccggtgctccccccactcacggcactacaacaggaatacccctccaccaacgtataggctgcaacggaagtgataatcgttgttaagcatccgctttcaaccactcggccacgcccagcgacccaagtcaacagaaacgcaaccaaccattatcttttcctgaaaaacctcccctcacaatcctcgcccgatcgaaaaggatcgtgatcccagatcgctgccgtgtcaatgctgcgccgccccggcccgagcaccgccgcctcgtccctgccctgaccccgccgcatcctccagttctgccgtcgacgctgcgccgcctcgacccgcatgtcgccgctttatcctctcccgtgctgcgccgacggctgaccggcacgccgccgcctcattgccc

SEQ ID NO: 37192 - DNA, 1775 bp, Oryza sativa
  unsure (1)..(1775): unsure at all n locations
nnnnnnnnnnnnnnnnnnnnnnnnnnnnnnnnnnnnnnnnnnnnnnnnnnnnncctccagctgctgtggttattggtgcatccattgcttcagttgttggggttcttctcattattttgttggtcctcctatatgtgattaggaggcgtcagaggcctagagtatcaggtaacaattcgtaatactctgaaagtctgaattcctgataactattttgttcagtttactgggattttttttgccccttgagatgatgacccatcgtttctcccacgtcaactgaatagtcatgaaaaaaattgataagatagattaacatatgatatattgctccatgagacaaattaaacttctacaaattataaaaaaaaaacttctaatgtatgaatactttaatttgttgttttctacaatttgtagaggttaaaatttaactttacatgtactattttttatattttttcataactatttagtcgacgtgcacaaacgagaatttgactttatatgtaatatattttatagttcttttgtttttttaataactatttgacgatgtgctacaaacgggaggcgtctagagaggagaaaatcatccccatagttttctactccctccgtttcaggttataagtcgttctgactttggttaaagttaaattattttaagtttaactaagtttgtagttaaatatagtaatatttataacaccaaattagtttcatcaaatatataattgaacatattttcataatgtatttgttttgagttaaaaatgttactacttttttttctacaaacttaattaaacttgaaatagtttgacttttaccaaaaacaaaacgatttataatatgaaacgaagggagtgctttgatatacaagaaggtgtaaatcaatgcaattatattcaccagatgatgatgcgggcgttccagctgctactgctgctgttcatgctcgtcctaatcctgctttggctgccccttcaattaatctgtctagtgtgaaggaggctacagggaatttctctgaaagcaatatcattggcagaggtggtttcggcattgtctatcaggtctgcacttttttcaacaatttgacacctttatgtacgcaaactaagttacgatttgacttcactaccacaaatcttgaaatgcaaagtctgcattgaaacatctgattttacaatcaccaggggaagctgcccagtggtagaaaggttgctgtaaagaggctcacacagtctcttgttactgacaaacgcaaggaggatttcataagagaggtggagatgatgtcgaacacaaggcacgcctaccttgttgagctgctctgttactgccaagaaggaggcgagatgatactagtctatgaatacatggagaacatgagcttggatctctacatatttggtacccattcctaaccaaaaaaacaaattcattactcactgtagtctgttaatctttgtagaaatgtgatgcataattatcttctgtatattcctgtaaagctctgatcttctgcatgcttatcacacgggcctatttggaactgacaggagaagatcgtagactgcgagcctctctgaattgggtgcaaagattagacataatccgcgggatcgccataggtgtcgagtaccttcacaacgtgaaagttattcacagggatctgaaaccatccaacatactcctagatgacaatcggannnnnnnnnnnnnnnnnnnnnnnnnnnnnnnnnnnnnnnnnnnnnnnnnnnnnnnnn

SEQ ID NO: 37193 - DNA, 2536 bp, Oryza sativa
  unsure (1)..(2536): unsure at all n locations
aagcgtctcaaacatgaacaaggagatgattggggatagatacgataggggataggacgagcgacaggtgaagaagtaccaggaattaggatcttgaaattggaagcagtcggcaggtttcgatccgagaaccttcgtaatcgccatcgccaaatccgatctcaaaccctcaacgatcgattaatagggattagatagactgaagaacacaatcaattccgccccagaacgacgcagcaactgcacaatttcgcattgatctcccaaatggacctgatcgtggatgatgaggaggcgaagaagaagaagaagaaggtggtttggcaatggcggcgagcttgttcgttcgtcagtgaagaactgggcagaggattaaatcatcaaacagaaatggaaggtggcgagacgaacaccgtggaatccagcagttcgcttcgctaaaaaactacgttagatttgcgtcaaaaaaaaaaaaactacgttagattagcacctagctgctgcgtgcgtggtgtggggcctctaaaaccgcgccgtgattagtgaaacaaactccccgttttggtcagtgtcgaactactatctcgatagggaacagtcagatttatgcgctggaaaacgcgtgtgttgcatgcacatgtcttctgtttaattattcatctgatgatgatcatggatagtcatttcactagagataacaaaaaatcctggccaaaattatggtgtcaagactcaagagcatttcgggcttatttatattgttcctttacaaaaacaacaaaattcagtaaaattagaaataaagaatgtctaaatttgtcatgactgcgttaaaaaaattgcaacgtacctctatcattattatttccaaaagaatctgtaacgcgagtaatttggcccatgcatgcagcccatgggataattcaccatcgcggcatcaagcagaaaatcacgataaagagagaatatcggccagaactctgtggcaaatgaaatctgcaaagccactcacgtttgtagcaaaactgagtatgcaacccaactttggggcatactagcaatttttttttaaaaaaaattctagtaggctataaagcagaaacagcttggtgcaatgagagtagtatagtcattgaatcttgtctagatacaattaatcatacatgtggatgtacatctctttatgatcagaaaagaatggaattggtttgctatgtcctgttgatttcaagcgttgcttacttgtattactatgtggttaattaatcagcattgttggcatcaactattcatcgtaaaaatagagtcacgtatcacgtaaaaataaaatgaaatggatgcggccgttagattacacgtgtggttaacttctgaattttctgagggattctgaagagtcaccagctatcagttcaggctggtgatgcgacgtcacggttgtgctccccgaagagccgattcaagaacatggccagcctaactcccccctgcgcgattcgtcgtgtcacgatcgggagccgtgagccgaagtagtcatctggaaataacaaattgacaatcccatgacatcagctaggttcagacttcagagatgtgtgcttgttctagcaaaggcagcattacctgacagagtttcgccttcacggacatcgttgtacgcccatttgcaagccaaatttatgctctctgtagcgtacctgttgtatgatagaaaaatatgattcgaatgcaaaaaaccaaggcgattctttctttgttaaacaatacagaattgtggtttcagaattttggattgtactgacttggttgagcaagacaggagatcctcgcagtctccccaagaggatacgtcatcagaccacgttccctggagatgaaaaattgcagaaattcgttcgttcaaaataattttgcaggaatttttctcatgtttctttgcttggaagagttgttttcaggcagttctcttaccgtggtgaagttgtgcacaaggtccttttgaaacgcatccatgtccttgccgtagaattcagcaatagctgtgagtatcatctccctatcccacacctgaaaaaacaccagacagacttgaaaagtaagtaaattgagcttaacggcaggtttttcacatggaaggaattatgtgcaaggatcaaggaagttgattacatgatggagattggatttgtgcctgaaccagcgtagattaatcgtattgcccccttggtcgctcgtgaacccaacatgcattggctggatggacagataaaatagttagtatgttgatgtgtatgaactgttgcagggagtgcatgagagtagactaattggtaaggttacctgatgaacatctcccatgaagtgtgacaagaatagcagtgcttcagtcatgttatctgcgttacaagcagttacaacaatatgaaagaaaatgaacagtcagacaagagatacatgacaactaaactatattggttgannnnnnnnnnnnnnnnnnnnnnnnnnnnnnnnnnnnnnnnnnnnnnnnnnnnnnnnn

SEQ ID NO: 37194 - DNA, 1459 bp, Oryza sativa
  unsure (1)..(1459): unsure at all n locations
nnnnnnnnnnnnnnnnnnnnnnnnnnnnnnnnnnnnnnnnnnnnnnnnnnnnnnntaatatattgacgcgcaatccttttgcgcgttcgtgaaaaactgagcttcttgtactagtgatgagctctttgttaatcggttccagttcttctccgggacgcacgccattgcctgtgctctgtttgctcttctgaggcctggacacgaggtaagagattagagaacacctggatgaactgagttttcgcattgcttctgctagcttagaaactgggagctgatgaaaatttagaaaatgtgtagctcctggctgtcgctggtcctccctatgacaccttggaggaggtgattgggatcagggggtcggccaatgtgggatcgctcaaggattttggagtggcataccgagaagttccggtttgttgatttcttcaccttacaaacaccaggaatgctttacattgtgctatttgtgagttactgatgtggcttcagttgtagcttgcagcagatggtggccttgattgggatgctcttgcaaatgctgtcagacctgagaccggatgcgccttcatacaaagatcttgtggttattcgtggcgcaagagcctaagcatatcggatatccagcgagctatagatttgataaaggcaagatgatatgttgtgaattcatggaccagcatgttctgtatgtgcattaactaatgcatatggtgatatttgctcatggagtcatgttttggaactcattgcagatgcaaaatccaaactgcatggttatggttgacaattgctatggtgaatttgttgagacgtcagagcctccaatggtggtatgttcatgcttgtagccaccttaagcattagattttagttacctgattgggtactttcatggcagggagcagatttgattgcgggtagtttgataaagaatccaggtgggacaattgcaccttgtggtggctatgtcgcagggaagaaagatttggttgcggcagcagcagctcgcctgtctgcacctggacttggggtagagtttgggtctacacctggacatgtgatgcgggcactgtttcaaggcttgtttcttgctccgcaaatggttggagaagctgtcaaggtaagttatttataaatttccacatctttaaccaataaaatgaaaaaataaaacagcatgcaagatatcaagtgacagtcttataccatccacagggaggcatgcttattgcagaagtcatgtcaaccaagggctatagagttcagccacttccaagggttcctcgccatgatattgtgcaggttggatctacatgtttaaacatcacttcaccagcacaaaaatattcatacagccatgatagtgcggcatatatggctgaaggaaccatccaattagaagtttgattttgagtactgacagaaggccaaccaagccttaaaagagtttagaaca

SEQ ID NO: 37195 - DNA, 2010 bp, Oryza sativa
aaggaaaaagaggaccaatgctccttctaccaatgttgatggagaagtcaccaaagtaaggtagccacagcaaaaccaaaaagatacttggatttggaaaatgactgcaatgcaatgatgaatcataaaaggtatagataggaaaactgcaaaaacaattcaaaagagatgacccagatagctgccatatgctaaatagccctgaagagaaggaaagaaaataatagctaagcagctgcagttaccagtttgtagccgatggcagcacaaataatatttctgttctgaatattacactttgttttgtgtaaacactttcttgcacgacaattcatcaaaagttctgtaagcactaaatttctctctgaggttaaacatgataatccttatgattactacgacatcatgtcataaagtcacatttcctggatgagctaactttgtttatactttatactaacattgcatggcctcataaagggcatgcaaagtgcaaaacaacatttagaaaatatatacgataattatgctttgtgagacatttaaacaataagctttactctgaacatccaataaatatatatatctcaaaacttgctgtgacaccacaagaattttaaatcaaatctacaattatgccctcaattttctcacccaaaaaatcaaaattgaaaaaattacattggtggttgcgagttatgaatgtatataatggacgctgctcaaataacagcctaatccatggcaatcttggctctttctgatgtttacctgtgccagtcacatctgtggttgctgtacttcatcaactacaggtagtataaacggccgcccatgtctaatctgaggatgtaatttcaggacaaagttaatcagttctgttactgtgttcacgtgtggctgttgagtaaggcattgaagcatttccactaggaagttcacaaaaaattctaatgttgatacacattcattagtgcgtgaagcaccgctgaagcagagggtgtgaatagtctacatagttatcccagaagcccttgtacttctccatcccaatttttagccatggcttcatatttccattgtaatgcaacactgcaccttctttgatagtagcgggatccactgttgtgtagcccagtcccaagacatgccatttggggtccaatggctcaaccaagccatagaaagcaagaagaccaggtggtaaagatccaagcttccatagggtatgatcagcattgcgctcttgccagtaatgatatatacctgtcacattcttattcctccacatcacaagatcaagaacattcataccaaatgcccagccacaggcatcaggatcaaaatgagcacggattagaggatgggaatggttaagatacttatggaacctgtgaaatgtctccatgcaagtctctacagctcccataacatttccattgaggttgatggtaaacaattccgacaagtccttttggacaacaatgtcatcatcaagaaatacgaccttacgcaattctggatagatttctgggatatagaacctcaggtggttaagcattgataagtacttagggttcctgaatttgactggtgttccacgattaccactgccagagaagtagtagttctgggtggcagcatcctggagctgtttaagaacaggaacatacgatgaattgagccaagtgaaatcctctaccttttgaatctccacagtggctcctctgtaatcattcagggcgaaccacgccctcatgggagcataattcacctcgtcagtcaccaagtgaaaaacaatcttttcagggcgcattgaatttagagttgtagaattgacgacaacagaaacagcaaggatgttgtccgagaaaacacagtaatggtaaaggctgttatcccttaggttgctctgtactgctgggctcctctcagtaaacttcctctggagctcagttgtcttgaaccattccatggttaaccggactccaaggcagtaaagcccctttg

SEQ ID NO: 37196 - DNA, 1144 bp, Oryza sativa
  unsure (1)..(1144): unsure at all n locations
gagaatgtcgaggacaactgtatttattcaaagtttaagaatgggagatttattttcctaattctgtatgtggatgacattctactggctagtagtgatgtcagtctactgcaggaaacaaagaaattcttgtcctcaaactttgacatgaaagaccttggtgaggcttcatatgttttgggcatagagattcaccgagatagaacaaagtatgcattgggactttctcaaaagacatatatagaaaaggtgttgaagaaattcaacatgtacagatgcagtgctacacctgctcctataatgaaaggcgaaaagtatggggcatcgcaatgtcccagaaatcagtatgagctcaatgaaatgaaaacaaagccatatgcgtcagctgtaggaagcctacagtacgcgcaagtgtgcacacgacctgacttggcatttgttaccgggttacttggcagatttcagagtaatccaggcctagagcactggaaattggtaaagaaagtcttgcgttatttgcaaggaacaaaaggcctcatgttgtcttacagaagatcagaatcactccagatagtggggtactcagattctgactttgcaaaagataatacaaagtcaacatcgggatacgtgtttaccctggcaggaggagctatttcatggaaaagctcaaaacagactatcactgcagggtctactatgtatgccgagtttatagcatgctatgaggcaacggggcaggtgaactggctaaagaagttcatacccggtttaaaggtggttgacagtattgagaaaccactaaagttatactgcgacaacgaacccgcagtaatgtacgctcacaacaatcagtcaagtggtgctgccaaacacattgacataaagtactatgttgtgaaggacaaagtccaggatcaaacaatcagtctcgagcacattaaaacagaaaggatgctcgcggatccgctcacgaaaggcctaccacccaacgtgttcaaggaacatatagccggcatgggtttaagggaagccttatgaatcctggactacagggcccaaaagtaaagtatctgtttctgaatagagatgtgtatagnnnnnnnnnnnnnnnnnnnnnnnnnnnnnnnnnnnnnnnnnnnnn

SEQ ID NO: 37197 - DNA, 1499 bp, Oryza sativa
tctagtaaactgagccaccccatctccctctcgttcattccctcgccaccaccgtgcccttgccgccttgctaccgccgtcctcgcctccctcctccatcgcgcgtgctggtgaagccggcgtgcgcgcgaggagctgacgcgggactccaggcgccgtctccttccccttccccggcccgaggccggagagctcgctcccgcgtcgtcggccgctcgtcacagcgtccgtctcggctcaatagtgcatctcccgttctccctcctcgctccctctcctctccttagctctgggcagtagtgcgagtagccttccagtagcaagctggcgccgccccgaccgccgccgctgctcgccgtaggctcgccgccgtcgctgcccaaactcagtagtagccgctcgtcgccggccttcctcggtgtagcctcacccaatccgactctagaaatgaactccagaggtcgcgtagatgctcaagtccctaggaatcgagctctcatcgcgtcgtcgtcgtttccctcttttgccgccgccggcaagcgccgccgcgattcgtcgtcgccggcctccctccggcgaatccgatccgggggctcactccctctcgtccgtcccatcgttcaggtgtactccctctctctcgaatcgtcacgacgagctccggtgaactcggccgccgtccgccgtccatctcggcccgccggcccgcgtggctgccacgtaggcgccatctcggtgccacctcggccttgaccgggccaagccggtcagccgccccctccctccgtcttccctcccgtgtgcacggtccacggcaagccgtgcggctgcacgtgggcccgccaccatccgtccacccggtgcgccgcgcccaaaccacgcgcccccgaaaccctagcgcccgcccccgcgtgcgccctccccaccgtgaacccaaccaccgccatgtgggtcccgcgtggtggaccgcgtccacccgcgtcggcctctctctccccgcgccccctctcttgggccgcccctcccgcgctcgcgccggcccattaggtccggccaagccgcataaacccctcgggccgcgcctaagccgcccgaggaagtctatatggcatccctcctttcttttttcaagggatttaataaaccctttttcccctattccataaatcaattccttattcccaaaattccataaatcatttccttggtcccgcacgtcagtgacggtcaataatattcttgagaatattatttctataaatttcataaatcaatttcctcttgttccacaaatatcttcctttgcccagaaattccaattaaacttccaaaattcatatctctcaatccgtagctctgattgactccgttcaacttccagtatttccataaaattgagatctatttaatgtcactactaattagtctaaataggatctttcttttggtcttttgtttaggttttcaattgtttgcgtatagttgcggttaccggattt

SEQ ID NO: 37198 - DNA, 1031 bp, Oryza sativa
atcccgccgggcgtcgagagcgccgaggggctcgcgtccatggcggcgttcgtcaccttcaccgacgccgtgtcgctgctgcggccgcagttcgaggcggccgtcgccgccatgtggcctctggcgagcttcatcgtcgccgacgcgttcctgtactgggtcaacgagtcggcggccgtgctcggcgtccccaagatgtccttcttcggcatctcggcgttcgcgcaggtgatgcgtgagctgagaaaccgccatggcctgtgcgccgttatggagcccggcgacgtcgacgacgacggatacccagcgacgctcgcggtgccggagttcccgcacatcagggtcacgcttgaggatctcatggcgacgttcggcgagccgtcggctgtgaggatgatgatggagctcgacggcaagctggggaaggccatcgaggagagccatggcctgatcatcaacacgttccatggcttagaggctccctatatcaagttctggaatgagcatgtcgggcctagggcctggcccatcggcccgctttgccttgcgcaatcggcatctgcgaccgccgatgcccggccctcttggatggagtggcttgacgagaaggcggctgccggccggcccgtgctgtacattgcgcttgggactctcgcggcaatcccggaggtgcaactcaaggaagttgccgatgggttggagcgggctgatgtgaacttcatatgggcttgtagggccaaaaacattgaccttgggctagggttcgaggagcgtatcaaggataggggcctagttgtaagggagtgggtggatcaactggaaatttttcagcatgagagcgtacgagggtttctcagtcattctggatggactcctgtgctagagagtgtcacaactggtgtaccactagctgtttggcctatgatccccgatcaacctttcaacgcgagattttagtcgacgagccggacattgcgattagggttttaccgattgataggaccatgcggggtttagttccaagggaggag

SEQ ID NO: 37199 - DNA, 706 bp, Oryza sativa
  unsure (1)..(706): unsure at all n locations
tggtgatcactgatcagtcaatcaattgaccaatgaacagtatgatcaggaagttataatgagagtatatatcaaacttaccgttgcttgtttgtcttgatgatttaggagaacaagcagtgcttttcggacgacgtgttgcccaacggttttagcgtcagcaagggggacggggtattctacatgccctacgcgatggggaggatggagttcttgtggggtaaagacgctgaagctttccgacctgaacgttggctcgacgagcacggcgtgtttcagcagaaaagcccattcaagtttacagctttccaggtgaaattttactgaactcaccatcatcgtgatcgaattttctgaacttggtgatgagacagtcgtgaattctgactacctgagtgaatcttgtgtaggccggcccaagaatctgcatcgggaaggatttcgcgtacaggcagatgaagatcttcgcggccgtgctgatccgttctttcgtgttcaaacttcgcgacaagaaggacaacgtcagttacaggacagcgattacgcttgccatcgatcaggatctccatctgactgctacggcaagatgagtgtacagtgtacactatacactatacagtgacagtggcacgtagggcagctgctactccgnnnnnnnnnnnnnnnnnnnnnnnnnnnnnnnnnnnnnnnnnnnnnnnnnnnnnnn

SEQ ID NO: 37200 - DNA, 1498 bp, Oryza sativa
  unsure (1)..(1498): unsure at all n locations
nnnnnnnnnnnnnnnnnnnnnnnnnnnnnnnnnnnnnnnnnnnnnnnnnnatcttggataatttgtgtgcagtttcctcgggggactcgcgtgttgagaggaaccgtggccggagaggaaccgtggttgaaatgtccaccgctctgaagcatctggaggaggcatttgtcaagtgcagccaagggaagaaatacttcggcggcgacaaaatcggctacctggacatcgctcttgggtcgttcctcggatggattaaggcggtggagaagttcgccggcgtcgagctccttgacgaggcgaaggttccaaacctggctgcttgggcggatcgcttctgcgcgcatccggccgtggtggacgccatgcctgacgccgataaattggtcgagttcgccgttaagcatgccgcttcgatgaaggctttggatgctcccaagtgatcagcgaattaagcattctcctttgtgttgcatgtactgcattacatcatcggatctggttccataatttttagtgcttaagtaggaaggaaaccgtgttgatgggcgggcattttattttttataataaaaaaacactaaaagaagtattatcttatcatattcatcttatatattcaccataagagtaaattattttataatggtaactaaagaagaagaaaaaataactatgccatgaaataaatcgtagtctttgttatactaaatgataagaatgtctctcaaattttaaacaaaaatcacttagtctcgcttggatgtaaatttcagagaattagtagatccattataacctactcattccgttttatattataagtcgtttgactttttttctatttaaactttttgaatttgactaagtttagaggaaaatataatactattttaaacacaaaacaaatatattaccaaaatatatcaaatgttagatttaatataactaattcgatattttaaatattgctagattattctataaacttgatcaaacataataaagtttgcctagggaaaaagtcaaacgatttatagtatgaaacggaggggtacccgttaacattttgttaataatttttttaccactgtttacataagatgaaagcacaaattttgaaactttgataatgatgtcatttaaatggcttttttcttaaaatacgactcatataaagagaaatattattgaggacagtaaagtgaatcttttttaaaattttataagtaaaatgagaaaaaaaaatttagatgttaagtgatccaatgaaatagtcgggagattaaaatggaatttttaaataattaaaaaaaatccccaatgcctgcaaatcgttttcaaataattaattttgtgttcgaccatttgatcccgaattccagccacgaggcttccatcgtcgtctcattttcatgctcattgcttcacctatctaactccaacatttgctccactgttaatttttgttcttaaattgctcgatgttcatgtggtacac

SEQ ID NO: 37201 - DNA, 12113 bp, Oryza sativa
aaaaactgcgaaaatatcaaagcacacgataatcaaatatagttgcgctcaaacttcaatataccgccgcctgtgcctgtgcctgcctcatcttctcgagctcgaccagcctgccgatgtccggcatggcctccttggcggcgtcgagctcgtcgaagcgctccaaccacgccgccaggagcggcgtcttggcggcgtcgaactggttcaagccgaacacctcttcgatggcgtgcacccacgcgacgaagcctccgagcacgacgtcgacgtagccgacggtgtcgccgccgaagaagggcttccccttgcagcactcgctcagtgctccctccagtttctccgccaccgcgaacgtttgcttcaccccctccgccttctcctcctccgtcttgcctctgaacaccggaatccacgcaccgaacagctgcaaacgcacagaacacgtatacaccaatcaatcacacaaatgccaagagaaaatcaagtactccctctgtattttaatgtatggcgctgttgactttttaacaaacgtttgacttttcgtcttattcaaaaaacttatgtaattatcatttattttattgtgacttgatttatcattaaatgttctttaagcgtgacataagtattttttatttgcataaaaaatttgaataaaacgaatggtcaaacattggttaaaatgtcaacggcgtcatacattaaaatacgaagggagtaataatcaacagaagagtactctactagtacatgatcatcgtaacaaccttttcgtcgatgtaggaggcccagaagcgagcgacggcgcgatcgtgggggtcggcggggaggagggtgacgccggcgtcggggaacacctcgtcgatgtactgtacgatgacctgcgactcgcagatgggcttgccgttgtggatgagcacgggaaccttcttgtgcaccgggttggagctgaggagcagctcgctcttgttcttgaagtcctcctcgacgtagtcgtagctcaggcccttgaagctgagcgcgagcttcgctcgcagcgcgaacgggctcgcccacatccccagcagcttcagctcatctcctcctccggccatggcgatcgagtgttctacgcacgtttcgaagattggagcttttggcttctcttctgctcgatcggctcgctctctttgggaagaagtatcgaggacgcagtcacacggtatatatatatagtcggtgcctcggcctgcagtgtttttcgtgcatgtcacctaaatagtcataaaaatatgaaaaaaattagcaacatagattaatttgaaatatatcactccacaaacatacaagtttaaactgaacttctacaagttgtaacaaaaataacaaatatagttgcgaatgtgccataactattttcagtttaatttattatttttgttgcaacttataggagttgaatttggtcttgcatgtttgtggagtgatatatttcgtattaatttatgttgtcaatttttttcaatttttttgataactatttagatgacatgcaaacaacaaggggatgtcccctcgagggatgaaaatccacatccgtgttttttcagataaaacagagtaaagcagagagtatatcatcctgtgcttgcgtagtcctacttggctcagctgctggtaaaacattttgcgtcgatgatctgatcagtgacgcgtaccttgtgccttcttttctcccaaaagaaagtagaagctagcaacacgtgctaatgacccagcaaagatatttctctgggttcaccggcattgatgtggtttttcggaacgtccaaccttcgctgggttcagctttgagaaaatgccaagacgagatcaagttttgggctgtgcgtttcaacgctgaagacagggtcataatcccggtctggaaacatgtaatttcttcctccctacaatcacttgatctgttgtaacctctacgctttgtcttcccaaactgttggttttgggacttgtctaaaaaaacacgtgctaatgacgggcacctactgcgttccttgaatccttcgctccaaactgagccagattttcagcgcatgtcaaaacagaaagctgattagcacacaactaattaagtattaactattttaaacttgaaaaaaatatatttatttgattttcttaacaacttctgtatagaaaacttttgaaataaatacaccatttaataagttaaaaaaatacgctaacgaaaaatgagcaagttaaagtttagaattgaattaaagaatcaggctttaaatttatttcatcaccaagtcaaactcaaaaatattacctccgttctaaaatgtattggattaacatcaccaacaactatgaacctgaactagatttgacgtaacctagcactacgaagctgaacatgttgtttagattcgcagatgatgtcaaatctaatcctacatagctacttcctccgtccaaaatattgtgacctaagatcgggccgtcatacagcgatcaatctgtccgtctgccataccactggcgagtctgtccatccgccccattgccggtgtcgctactcagtgctgccattaccatgctggtgtccgagtccgtgccattggggatcgaagagcagaggaagagggtgcaggcacgggcatttaccaggaggagaggaaaaggataaggagcacacaagcgcgcgcgtgtgccatcggggtatagcgcacgctgcaggagaaacctgtctggagaccgcggccattgcctggacgacgaggagcagcgtcagtgctgcctctcgttcatctccggcctcacctaataatgatggagaaggtggccagcggcgcggacatagcaatcgcttgagggtgtgaaatagtggccatggagattgtgttccatcgctacaaccacagaaaatccccttcacatgacgaaagagaacacatcaagagacacatcagcccactgctagactgctaattaaccagtccgctccaagcgtgacaaacaccaagataaaccatagtgccatactatgacgcacgcaacgacgtacgtcaaagcagctttcaatagtacaacctccgcctcattataagtacaatcataggttttcacgtcaaattttaatcgtttgtcttatttgaaaaatctttataattagtatttttattgttatgagatgataaaatataaatagtattttactcgtgacttatgtttttaaatttttttaaaaaaaattttcaaataagacggacggttaaagttaggcgcgaaaaaccataactgcacttataatggaacggaggtagtaagaaaaaagcggtccatataaactaaactagtgcacaactacacatcagcttcagtctgctcactgaactcgagtaaaccagcagcttctgtttcttggccacatcgagtaaaaatgtcctcgtcgtcgacgagcggttcagccgaccccgcggcggcggtgcgcgtgctcggcagttggacgagcccgttcgtgatgcgcgtggtggtagcgctgaagctgaagggcgtggaggagtacgagctgttgcaggagacgagggggaagaagagcgagctgctgctggggtccaacccggtgcacaagaagttccccgtgctgctccaccacagcaagcccctccccgagtctctcgtcatcgtcgagtacatcgacgaggtctggccggcctccaatggcggcgccccggccattctccctcgcgacccccacggccgcgccgtcgagcggttctgggcacggtacgtcgatgacaaggtaagggcatgtcttgcgtaatttttttttgtctctgaacattttcttcttgtttcttggagaatttttgctcttgctttgatgatatttttgcagattctaccagggcttcgggttttgagaggatcggtggccggagacaaggaccaaaccgcaggtgaaatgtccacgactctacagcgtctggaggaagcatttgtcaagtgcagccaagggaaggaatacttcggcggcgacagcatcggctacctggatatcgctctgggttcgttcctcggatggatcaaggcggtggagaagatcgccggcgtcgagctcctcaacgaaaccaagcttccgatcctggctgtttgggcggatcgcttctgcgcgcacccagccgtggtggacgtcgtgcctgacgctgataaattggttgagttcaccgttcaatatggttctgtgctgaatactgtgaatgttcttcccaagtgatggatggtatgctgctttgtgcctgacgataaattggtttgagttcaccgtgcaacgtgcttcgtgttgccatttagtatggtcactagtgaaagatgatggtcatttacgttgttttgtttcgtttcttcggaactgtagtttccctttccgtctgagtctgtaattttgcttgtaagacttctctctgagtcttttattactacttctctcagtcttttattactactactactactgatgatgatgatgatattctaatgaccatcagccattcgctaccgtatttagtgtcagatggggataggctagctaccagctagcgacgcgtaaagatgaaggttgcacgggagaacggggtcatcgtcagagttggtttgaagtttagataagataaagagatcaaattagagatttattaaagtttgttactagctagatgcagtatataatctgagacttgcgggattgtttttcacgttaactaagatgttaaccagccgaaaacaattgtcaccagcccatagcattatgtaactctggttttatccatatattaggctcaaagtcttaacagatcaccaacccaggtacgagtgctccaaaaggctccaaagttctcaccgccctgcgaatttttattgatttttaagccattttttttaaaaaaatttatttttaaatctgaacctcttagctgcgccatatgcagtggatgtgctagtattgtcttgtcacgtcagtctaaataacgtggctaacaatttcacttttgaaaataagttctttttgagaaaaataaaaaacgccctgcaacacaagagatctggacagacgaggcatcccggcgtcatgtgcagccaagggaagcgatactttggcggcggcgacatcggcttcctgaacgccgttctgtggtctcacattggtcattggccgttcaaggagtcgatcggagaagatccccggcgtcaacggcctcgacgaagccaagttggccctgtagctgacccatgctgtgagcagcgtcatgcctgacgcggacaggctcgtgtcgagttcagtctccattgctaccattgaaggattccaacttccaagtgatcgaaacatcacaaaatcatatcttgtcgctttctcaatcaacaatttgcgttaactttagacgagtaacagcttgtgaaatgtagtaatatgcttttgttatgaaacaaagttgcctccgcatccgcagcctgtagggaccgtctgactatggtagtgcagtgtagggctggagccgcccacatgtggtggaatgcaattatgcaaatgggaaaaagccgcgaattttggctagaatttctcaaaggcatttcaaactacaaatctacagtggtctcagactagccgccgccctaccagaagttgcaaattcatcgtaggcttcttgaatttcaggtgcaccgtgcacgtactcgtaaatcattgccggcggaaactttattagtggagttatagtccaacactcaaacgatcaccaatggtgtgtgattattcaatccattgttttttactttgcgttcacaaccatttttcagtaactcgccaaaaccattttctttctggaactccagttcaaaacagtttttgtttcgactttccaggaggctgaaaaccatatttgtagctcttcacgcgggtataaatagacgcctacattatcactaagcaagatatataagcctataaggcctgcatctgtggtgtgcatgcagcagcaagcatatcgcgcacacgacgagcttccatatatgggaatggacggcgattcttcatactcaccggcattggccgccgtcgccggcgccgtcgcgctggtggcgttctgctcctactacctggccgtcacccgcgccaccggcgacggcgaggcgaggcggcggcggcggcggcacccgccggtggtcggcacggtgttccaccagctgtaccacgtccggcggctgcacgactactacacggcgctgtgccgggagcacacgacattccgactgctcgcgacgcccggccgccggaacatatacacgtgcgatccggccgtcgtcgagcacatcctccggaccaacttccccagctacggaaaggtaagctgagtaaccgggcctcgcatgaatcgcgcacccattccggcccaactacttatgggccgcacgtgagttaaaagcctgttagggcccaattgtattgcgctcatcttacgaatttttttatttatacatttttttattaaaatatttacaaaaatatttttttgtttcaaaaatttacaaatctaatcgcctgccgccctttgggagatcgcccttccagagggcagcaagggacctaaatgcaaattttccagcacaacttgttagctctatgattttacaatttaaaattatattatataaagttagatgaaataaaactttatatcaaaattgtagatctccaggagatctgcaactttgtagttaacaactttttcatttaagatgttttacatatccaaatattcgttacaaaatataaaacacatttaaaaaaatctcatatctacatttcaaacgacattggatggagataaactttatataaaagttgtagatcttgatgagatctataactttgtagtttatcactttttcatttaaaatcatttggagtatcgaataagcattattagtttttaagcaattaaaaccggtggaaagggtttgaacacaaataaaaattttgtatttaggtcccttgccgctctctgggagggagatttttgaaaatatcccttcctaagggcggcaggcgattagatttgtaaattttcgaaacaaaaaattatttttataaatattttaataaaaaaatgtataaataaaaaaaattccttatcttactaacggcatgggaaatttcaaggagataaataaaaaagcgttctaatacaaggtgctttcgttgataaccctagtgacgaaaatctgggagaaggctaaaacctaaaccctagcaggagctaaacgactctcaaagattatcccttagatttctttttcttctatatactccctccgtcctaaaatataaatatttttagacttcgacatagttttcgagttactactttgatcaaccatatctacaaaagtaagatgttttaaataaaaagagttgcactcccttcgtttcaggttataatacgttttgactttggtcaaagtcaaactgctttaagtttgaccaagtttgtagaaaaaatagtaccattttcaacccaagacaaatttactatgaaaatatattcaattattgatttgatgaaactaatttagtattataaatattattatatttgtcaataaacttaaataaaacttgaaacagtttgattttaaccaaagttaaaatgtcttataaccataaatggagggagtgtattatgatagcttgtttaatgataaatctagtaacatcaaatgtacatgattaatctttttttctattaataattaaaattttaaaagtttgatttgatatattctaaaaatacttatattttgggacggatggatagagtagttgtttcttacttgtaaaatactagcttttaacttagcacactcgtttttttaaaaacaaatgtattgtgctgacatgtgccatgtatggtttaagggcccgttgaactccgagatcctgaatgacctgttcggggaaggtatcttcgccgtcgacggcgagaagtggaagacgcagaggaagatcgccagctacgacttcaccacgagggccctccgcgacttcagcagcgacgtcttcaagaggaacgccgcgaagctcgccggcgtcgtctccaaccacgcggcgtcaaaccaatccatggacttcaaggtaagtgcatgcatgccatatcaataccaagctcacgtactgacgtatactacatcgatcgttttcttgatgtccaaatgttcgtttcttcaggggttgttgacgagagcaacgatggactccatcttcaccatcgccttcgggcaagacctcaacacgctggatggctccggcgaggggcgccacttcgccaaggcgttcgacgacgccggcgagtacctcctgctccgctacctcaacccgttctggaagctggccaggctgctcaacgtcggcgccgaggcgacgctcaaggagaggatcaaggtcgtcgacgagttcgtgtacaagctcatccgtgccaggtccgacgagctctccaacaccatggcacaagatcatgtaagcaatacctcacatcagtggcatgttggtacatcaatttgtgagtgaccagacgcttgaaactgagctgaatttcgtaactgaaacagcgttccagggatgatctcctgtcaagattcatccaggcaacgaccagcgattctgggacggttgattacaagtacctgagagacattgttctgaacattgtcatagccgccaaggactcgacatcggggtcgcttgcttggttcctgtacatggcgtgcaagcgcccggaagtccaggagaagattttcgacgaagtcatggagaccaccaacgccggggactgcgcttccatcgacgagttcttgacgagccttaccgaccaagcactgaacaagatgcactacctgcacgctgcactgacggagacgctcaggctgtacccttcagttccactggtgatcactgatcagtcaatcaattgaccaatgaacagtatgatcaggaagttataatgagagtatatatcaaacttaccgttgcttgtttgtcttgatgatttaggagaacaagcagtgcttttcggacgacgtgttgcccaacggttttagcgtcagcaagggggacggggtattctacatgccctacgcgatggggaggatggagttcttgtggggtaaagacgctgaagctttccgacctgaacgttggctcgacgagcacggcgtgtttcagcaggaaagcccattcaagtttacagctttccaggtgaaattttactgaactcaccatcatcgtgatcgaattttctgaacttggtgatgagacagtcctgaattctgactacctgagtgaatcttgtgtaggccggcccaagaatctgcatcgggaaggatttcgcgtacaggcagatgaagatcttcgcggccgtgctgatccgttccttcgtgttcaaacttcgcgacaagaaggacaacgtcagttacaggacagcgattacgcttgccatcgatcaggatctccatctgactgctacggcaagatgagtgtacagtgtacactatacactatacagtgacagtggcacgtagggcagctgactctactcacgctagtgacagctccttgtgaaaacataataataatatctctcgaaaataatatagctgcaaacttaattgtgtctgattgcaaatattccgtctagcttgctggaataaattactatttcccgtgcatctaaaatttatttaaaattatacccatcctaacactactagaaaaatagtttttccaggcggcaaaaacagttttgtaagcaaaggcctgcgatgcccgcctacgaaaatcaggcggcatctccattattgtaggtgttagattccacctgcccgtgaaaatcatcaatgcgcacaaaaataaaaacagccgtcaccacccctacccgccggcgccaccattggcctcctcggccccctcccaaaacagccgtcaccacccctacccgccggcgccgccaccggcctcctcggccccctccccctccggcagacggctctccacctccgtccaaggggagtgccacttccgtaggccagctctcctcttccatccagacatgggaggggaagggcctgcgttgtctgcgccgccgctgccatccgctcctccgctgtcacaccccaatctggcaccgccgtacaacggcacctgacaggagcgtgtcgtgggaaaaagggcacgaaccgcttcctacgaaactgcgatctcagtaccagtcccaggacatagcgctggtacccacggtgacaaatatgaatcattgcaatccttaaaagaaatagaggacttatttaccttaacttaggttgcagctcagaacagcccgagattgcaaccgacgacgcggacgaggaaacaccaacaacagcggcagcagcggaaccaacggactaacacccaacaccacaggcgacggctgggaaccaggacgaaaccctaatcttcactttacgtcatcttcaacttccgggcggaggaactatatatatttatatagagcaagggtgagtactttcgtactcagcaagtcacgggaatttaggtgtttaatgcaagcttagaagagaggcaaggttgttttgcaaatcttttatttgaagacattttgaaatcactaagtgatttatttctttctaagtttggggcgaaaagagacttgcgtctcgattcgactttaagagatgtttttcaacagctcaattggtaatgtactgacctcccgggtcagatcattacttcttggctcccagagccattccacttgattaatcggctcccagagcctttttcattttctcggactcccagagtccagctgcccagcagcacaacaatccgcttccactcgggaagcctagtctatgatgcccgtagacatcccgaatcacacagattcgtttcttgaccactcaggtcatccatctgccacataggctgataatggtaacgattccccaccagaacaacttttcacaaagcacaggcaaacaaatctacgctacaggaaacacctcacatccgcccatgaccgcgggcacggctgtttgaacagttagttaatctctgcagagggggtatactttacccacacgacattactaacccggatcacccagcccgtgagatcagccacgtcgggagaccttaaggctttcatgacaaggcatttcgaaagccaacacaggttcaccatatgccaacgagaggggtcccagaccaacaccagattaggtcccagaccatactgtgccaggaagcccgagggttcttcccgacaccaccccgttgaatccacatgtctcttggcatcatggctccccccgattagctaattactcagccaggggcgtcccattgcacccgtgtggtcgcacttgttatatgctcggatgaatttcccacaggaatcagtccttatatgcgaatacgggacagtgccacacaggcacaacccccgcatcgcgagttttcacaatccattttattttcaaacacactgacgccacatgtcgggttttcaaggcttctcaaacccatttcccaagttttcgacaaacaatggtgtatgtgggatatttggtatacgcgctcagagagcacggataccgaggttccacaaaggtggagtgacaaggaaatcagggtagtacaacctacaggaattagtgcgagtgtgcgactactgggtaggtccgtcggtttggcacgcataccgagaccaagcaagttgagtgtgtgattctaataatgcaagttgcaaacaaaataataatgattttccaattataggagcaattggtcaaagggtgacttgccttgctcaaggtcttcacgaagcttcacgaatcttcgagaaaacccgcgatcgacgaaaatccggtaaccgcaactatacgcaaacaattgaaaacctaaacaaaagaccaaaagaaagatcctatttagactaattagtagtgacattaaatagatctcaattttatggaaatactggaagttgaacggagtcaat

SEQ ID NO: 37202 - DNA, 8509 bp, Oryza sativa
  unsure (1)..(8509): unsure at all n locations
tgcacgtacctggccgtcgtcgccacccgcaagcagaagcggcggcggcggcggcggccgccggtggtcggcacggcattccaccagctgtaccacgtccggcgggtgcacgactaccacacggcgctgtcccgcgagcacatgaccttccggctgctggtgccggccggccgcgagcagatatacacgtgcgaccccgccgtcgtggagcacatcctccggaccaacttcgccaactacggcaaggtacgcagcgccactctttattactgcatgctcttgtgattctgtaaactgctttactactcctatacggctatactttagtccccgttctctctccctttgtccaattggagagatatttcccgtgaacctaaaatgagaaaagttattagcacataattaattaagtattaactattataaggttgaaaaatagatttacttgattttttaaacaatttctatgtaaaaactttttgtcaaaaagtatcatttaacagtttaaaaaatatgctaacggaaaacgtgaaaactgaagtttggagttgagaaaaaagaactaggcccagtcttttcttcaacttactcgtttttattagcacgttttccaaacggttaaatattgtgtattttgcaaaaggtttccatatagaagttattttaaaaattaaataaatttattttctaagttttaataattaatacttaattaaatatatactaatgagtgcacagaaaatctctctccaaacggatagaaccaacagtcttattactgctactagcataaccctatgtagtcaaaaaggatatttctctagtcaatttgacgcgtacggccccatctaatatgggccacacgtgcgccgcgaacatgttccagcccaacttgtacgtatcgtcacaatcctattcatcctatttattgtggaccatacgttagtcattgagttctcaataaaaaaagaaacgttagttattgtctttgatctaacacaactatcatgggcccaaatggattatcctaaaaatctactcgggtggaagaaagaggttgtgggcttgtggccacacaggccgcgacgttgacaacagcagcatagtgtggcggaggagagaaccgggacttccgggtacttgcacacgagtacttccgggtgtttgcacaccatgcacgaagagataaaaagagaggtgaagagccgaaggagaatgatgggagtagaggagaggaggaaaacgctataagttatggtacccggcaacccgatcaaataagtgggtaatctattggtcaatccatttaatttatttataaatagatttacgggttgatccattcatacctttttaattgtaggcagctcgatatctagctaggtaacagcgacgatatacatacccggttagtcagttacgagcgtgacactcgaaaggaaataggcaaaatttgttacaggatcctcaaaaactgtgtaatttgctggtatatatcataaaaacgtgccacggcttaaagacacttaaaaaaactcgtaatttgtccacggacacttttggcttaattgaagagagattcttcgaaaagacaagaatgcccctagggtcaaaaagcttttgagctgagattggagcaaagatgaaatataatatacactagtgatatacttagggtgatgacaaacttaaagttgcataattataaatgtttactgtaacatcatgtttgtagcatttggtactagaggcattcatgttgatcccaaaccagtcagctttgcaagcagccatttgaggctgctagctaggccggtgcggttcatgtttgtggatttgttgctgccctgacacgtatggtttctgtgaaaaatactaaggggtcgtttaaccacgggaacatgagcgacctgttcggggatggcatcttcgccgtcgacggcgacaagtggaagcagcagaggaagatcgccagctacgacttcaccaccagggccctccgcgacttcagcggcgacgtcttcaagaggaacgccgccaagctcgccggcgtcgtctccagccacgccgcgtcaaaccaatccatggacttccaggtaatcaaccgatcgtaactatcgatggcgccagtggtgtgttgtgtttgtatcgccattgaggacgtttgttcggttgtttcttcagggtttcttgatgagagcaacgatggactccatcttcaccatcgcgttcggccaagacctcaacacgctggacggctccggcgaggggcgccgcttcgccgcggcgttcgacgacgccagcgagttcaccatgctccgctacctcaacccgttctggaagctgtcgaggctcctcaacgtcggcgccgaggcgatgctcaaggagaggatcaaggtcgtcgacgggttcgtgtacaagctcatccgtgacaggtccgacgagctctccaacaccaaggcacacgacactgtaagcactacctgatatgtccaattgtccatccattttgtgagtgatcaaacacttgaaattaaggtgaactttttgtgtgcaataggattcgaggcaggatatcctgacaagattcatccaggcaacgactagcgattctgggacggttgattacaagtacctgagagacatcatattgaacattgtcatagccggcaaggacaccacagccgggtcgcttgcttggttcctgtacatgatgtgcaaacacccggaagtacaggagaagatctgccacgaagccatggaggccaccaacgccggcgaggccgcttccatcgacgagttctcgcagagcctgaccgacgaggcactgaacaagatgcactatctgcacgctgcactgacggagacgctcaggctataccctgcagttccactggtaattaattacgatcacaaagttaatcaaacgaaattaattctcttgcccaatgccaaatgaatcgaagtatagtaacaaacgtagtgtcactttgtttctgacgatgtttcaggataacaagcagtgcttctcagacgatgtattgcccaacggattcaacgtcagcaagggggacatcgtgttctacatcccctacgcgatgggccggatggagagcttgtggggcaaagacgctgaatccttccggcctgaacgttggctcgatgagaacggcgtctttcagcaggagagcccgttcaaatttacagctttccaggtgaaatttactgaactccaagaatctttctgagttccggttacccacttctgaaagttttctgaactttgtgatgagacaattctgaattctgatcacctgctccttctgtaggccggcccaagaatctgcctcgggaaggatttcgcgtacaggcagatgaagatcttcgcggccgtgctgctccgtttcttcgtgctcaagctgcgggacgagaaggagatcatcagctaccggaccatgattacactctccgtcgatcagggtctccatctgacggctatggcgagatgagggcacacactacagtctgggcacgcacagcagctggctcctgtactcatgcaagtgatagcttcttgtgcataccaaaacgaacgagatctgcaaaccttaattatgtctgatcgtgaataacccgcattgcaccctagaataataagtgcatctgaactgcagtcagggtcagagtaacttattggagtgaactggtgttgtagggaacttcaattgtacaacttggagggcgcaatacaaatgaatggattaaatagtagaaagttgattttaaaagggctttcaacaaatgctgatgatttttttacaaaattgtaatgtttttatgagcttggaaaaggtaagtttggaaaaataaaaaaagataactcaaaactcatggcatcagcttgcattgagctcggcttagttcggctcgaactcataatcaactactttggttgcgttcggcactgcttgttaccatcctctactctctcgtttttcatacacatgttttccaaactgcttaacggcgtattttttgcaaaaaaaaaatctatagaaaagttgttttcaaaaattatactaacccattttttaagtttttttagctaatatttaatttttcgtgcaataattcatcgctccgtttttcgtgcagaaaatgagggctgccaaccctcactcaagaactctgccttagtttggctcggagtaataataataagtcaagctgatgtgggatttcaagtcgtgagcataacaagccagctcatgagctacttgtttagttatcttcgaatacttagttctttcagttacaataaatcaaagttttgtcatcggcaaaaactcaaatatatttataataaatctataacccaagttgacaagaaataaggtgattctcatttttagtctggtcttatgaatgtcaaaagtactttcttaaatatgggtttttggattgtcaataatgggaaacaaattagattttggaaagataaatgaattggtaacttggcttttaaagataaatatccatctttgtatgcaattgttcggaggaaaacatcttctattgccaccgttatgggatcgatctgttccgcttaatgtttctttcaggagagctttagatggtcataatcttgtttgttggcatgagttgtgtgcctctatagtacatattcaattgaatgattcgtatgatagttttagatggaatttcaatcagaatggcttgttctcggtgagatctatgtaccaagctttaattaataatggctatatcgagagaaacaattgtatttggaagcttaaattgccacttaagattaaaattttcatgtggtacttgcttaaaggggttgtgttaaataaggataatttggcaaggcgtaactggaatggcagcttaaagtgttctttttgtttaaagaatgagtctattcaacatctctttatggattgtcattttgcgaagttcctatggagagcagttcagttctcttttggttttattcttccagttagcatatctcatatttttaatgggtgacttttgggagttgataagaaaatgagtaaactgatacttgttggagcttctgccatttgttgggcaatatggctgagtaggaacgatatggtttttgacaaatcaccatcattttcctatatgtaggttattttcagggcaactcattggctccggttttaggcacaactacaaaggtgtgatgaagatgaagagtttctgaaagttgtatgccgaaagttggagaccacggttgtcgaggagtgatcctctctagcgggagatcgtgagaacccccccccccctcatgagttcagccgggggaagaagctcgcctctagaaatcgcatatccgtccccaaggctcctagctagctcgcacacaaccaaattatacaggttcgggccgctatgaagcgtaataccctactcctgtgtatgggatttagactgagagttacaagggttcctaagctcgggagaacactcttacttccctcctccacaagctcagattttctgagagtcgtcccctttctcggtgggcaaggtccaccttttatacctcaaggggataccacatgcaccacctctacctactcttctttcgggtggggacccaccctatcttgactggaactcgaccagtgccttcgcctggaagctaaaccacagcttgtccttgagcggggcccagcgccgtccctcgcctgacacgggggacagccctgttattccctcattaataggtgaagacttgtggtggccgccgtccgaatgaccccctgatgggacgggtcatacctacctccactccgccggaagcagatgcgacgtgggaacacggttgtccgtccagtcatacgtgaccggcgtcaggccggtcacagaccggtcattcttgaccatcgtgcatcagtttagcacgccacacgtctgccccactgcattaaatacgacagggggcagttggggcgctgcgcgcattaaagtaagtttagcctgggccccctcctcgcttgcttcccccgccaaacagcggctaggcgggggcctaggggcaaagcagtgcaagggcccgaggggcataacgtggcaccccgaggccccgaccccccggccgctcctgcggttcacggaatgcggggacaggaccaggctgtagggacacgtggcaggatgggaaggtagattcccctcacttcgcataccctcgggcccatatctccgacaacggttatgcaactttttgctaattatggtttgagattttcaaatagacttcaataattgtgatctccttacgttaggctggtttctttgtttttcttttcggtgtgttctattcatttagatttatactatattattgaaagctactatgtaataattggttgtagttcttttgagtaaaggccggaatattatattccattatgtaaaaaaaactcaaattctaagtgttgccattaatgaggacatgtttcagtaaataccatcctataaacgattttatccaacaaatgacatcgccatcaactttctagtagcaaacatctgttatgatgttgtgcaaaggccattttaccccccacgtataacacgtactccctccgtcccaaaatgtagctatttctagcacagtgtcttgtcccaaaataaatctatttcttcacctacctcctcctctcaaccaatcacaaccattcttcttcacctactttctcttctcaaccaatcacacacttcctccaatcattctcacctactttcttaatacccgtgccaacctcaaaaatggcttcattttgggacggaggaagtagttaccttattactacaaggcccagatctgctgctacattgcctcgtccggcatccctgccatcgtctcgaagcctagaagcattgtgccactgctacctcgaagagccagcccaacaccactcagacagccacactgtccccacctaggctgtgtttagatccaaagtttggatccaaacttcagtcctttttcatcacatcaacatgtcatacacacataacttttcagtcacatcattttcaatttcaaccaaaatccaaactttgcgctaaactaaacacaaccctagattcatcctgctactgcttggaagttggaaatgccacgccaccatcttcctcgcctggatcaactgcactgctgccggatgcaaggacctcgcgacccttgccatcctagggtctctgccatgtcaccattactgtgaacaatgcaccgacgccgagcccacctccactgtttcactcatcgcctctgccgacaccttcctctgcattgccgtccatccctattaatgggatccggatctggtttttatcaatcctgccccgctgtccgccattggttaattatttttgtgttccattttacctagatatgccaatgccaaaaacacctatgcaccttgggacatgggtcgtggcccaagtagcaatggactgccttttgtataactagaaatttcgacataggaaaaagtacaccgaaggtccctcaacttgtcatcgagttacaaaatcatcccccaatcccaaaaccagatatccggcatccattaaccaatcaaaaccgattacaataggtcctttggtggttttggacccagttttgtcctacgtggcggcagagtcagcgtgggacctttatgtgggccccacgtgtcagatgccacgtcaatctcttttccttcctcctctctctttctctctctcactcttctcttctcgttcgacgccgtgaggagggcatggcggccggcggcggagaagcacacgctcttggcgatgccactgccgccgaggaggaggaggtgaggcggcagcccggcggcggcggcggtcacatcgtccttgccgaactgggtgctcttgtcatcggagtggtggcgcttgcgaggggatgcgccggcggtggtggtgaaggaggcgaagcgatgtactccagcaggcgaagcggcggcgtcgacgggcgagcgcggtggcggagtgacggcgtcggtgggcgagcacggctgcgaagaggcggcgtcagcgggcgagagcggcggcggcggcgggcgagcgccgctgcggatggggatgcatcagccttgtcgtcgtcgacggctccaggcgaatgcggcggccgcttggattgtggcggcacgggcgccacgccgccggcgacgctgttagaggtcacgctggggaagggcggcggcggcggcggcgccggtgacctggactactacgacgtgagcctcgtcgacgggtacagcctgcccatcgtcgccgtcccgcaggccggcggcggctgcgccaccaccggctgcacggccgacctcaaccgctgtacgtaacgtgtcacacatccatgcgtcatgcatgcatnnnnnnnnnnnnnnnnnnnnnnnnnnnnnnnnnnnnnnnnnnnnnnnnnnnnnnn

SEQ ID NO: 37203 - DNA, 3636 bp, Oryza sativa
  unsure (1)..(3636): unsure at all n locations
gctgtacgtaacgtgtcacacatccatgcgtcatgcatgcatgtcgtacatggcgaacgtgtttgtgctgcatgagcatatgtgcagcgtgtccgaaggagttgcaggtggacggcggcggcgggacggtggcgtgccggagtgcgtgcgaggcgttcggggaggaggagtactgctgcagcggcgcgtatgcgacgccggcgacgtgccggccgacggcgtactcggccatcttcaacgagctacgcctacgacgacggcatgagcaccttcacctgcaacgccgccgcctacaccatcgcctacacgagcaccttcacctgcaacgccgccgcctacaccatcgcctacaaaacagcgtcaccggcggcatggcgcccgtgccgccgcactccaagtggccgatgcagtcgccggtctggcgcttgtttcatcagcatggagacagagacaaccatatacaaatggatgaccaccactcagcactcagcaggaccagcgcgagtacagaacgaacagcaaaatactccgtactagtagtatattacatctacagtaatcgaagtgcggcttgcgagccacgaatcacgaacagatgcaggacgctactatctcaagcatcgatcacaaaaggagcaagcgggacatttgatttctccgaagctgcacagatgctgcaaataaatcgagggcttcgaaacccgacaccccggaggagtctatcgatgccttccttccgcgatgcagaaaagaacaggcagtgcagagtgcgggttacctgctggggcgcattgtggtcgggcggggcacagaagacgtcggcgtcgagcggcatgtcgacggcggagccgagctggcgccggtactcgctggtctccccggcgaagcacgcggtcgcgccaccaccgccgaccagcctgcccagggagatgagagagagagaggggaagggagaggagggaaagagaacatgatgacgtggcgtgctgatatgtgaggcccacgctaactcacccgccacgtcagacaaaaccgagttcaaaaccatcgaaggatgtaaagtgaactgttttgtaagttaagggatgttatatatctagttttgcggttgacggacgattttgtaattcgatgacaagttgagggaccttcggtgtactttttcctttcgacataccaacgttcggcccgagcccaataaagactaaaccctggttcctccctactagtactacggtctcaccggatgtgagaacaagacaaggggcatagtgccgccgatgccgatgcctcctaacacaactgtctccctgctcgacgcttgctccaggcgcctcccgcccagcggcctaggcccggccggttgccgccgcgcttccaacaacctgccaatccacaaggcgcctgccgcccctacccggcaaccccgacttgctggtaggcggcgatgccttatcagctcaactccttggctcgccggtgccgtcacaacattaagcaaggaggcagaaggccaggagcagccggcccgagcatatcaagaccagcccctttaggaccttgatcaacgaccagagatcactgagtttttcggtatctcttattattctcaaagagcaattttacgggacttgaggagatatcatgaggtactatttttttctattgtaaatttggtacctcttgatatttaggtattatgaggtaccaaattttacactaagttttggtacctcatggtatttcctcaaggaccgtagaattactctaaaaaaattgagtaattcattttggtatataagtgtattttgtaggttagttacttacacccttacctctcgttagtggtattttaaattcttcttccgaaattttcttaactaccatatgtactaattcatgtctttgatatgcatttttttttctctctataggatcaagatccataactacaattgaagagctaaggacagtataatattatgcttagaggaagctaacctataacaaggtatttgtatttatgtaacaaaccacaattaaatttgtattgtatctttttatcatgcattaaggaatatcctgtgtcgctgctactactcccttcattttatagtgtagggcacaactattttttttataatgtttcataatacaatacgtgtatgcttataagcaacttattgggttgatccaaacaaggaaatgattatatttttttcttaatctatacgttaatagtagttgcataaaatattttacaatggagggaatattaattatctacttcagtactgattgtgttactactcccatttcaattactgttctgccattatataatttacccttttttgttttggtgctaacaatgaatcagtgttgtgatttctgaattcagtggtgcgctctgagatttgataagtccagaagcagcatcagatctaccctgtttttgcttgcttgttttatcagccaagtgcgtttctggaagatagggttcttctttccggtggattgatcgttgtttgggggcaattctctatttgccattgctaatctttcatgatgattgttgatcacttctggattttagtattttgcggttaataatttaatactataccccctctggttctatattaattaacgttttggacaatgttgaggttaaacttttataactttgaccatcaataacttaaaaaatatttagtttaaagaaactagaaaaacatatatagatttatctttcaaaacactataataaaagtaaaacatgcattatttattgtatatattataatagaaaaataaggtcaaaggtatattttgtagagcgtgtcattgtccaaagcgtcaattaaaatgaaaccggagggagtatatagtttatctcatccatttctgcgtgttcaagtagacaatgtagtgttcttgcgtgcgacaatgaccaatgaccagctagatagggttacccatcgatttgatcttgtttagattagtgctgaaattgtgaagtccaaatggcaatttggacattgaagaagaattgacccttatgcagctgaatggacggaacccattaatgtattccatggatgggggctgttcgatcaggcatttatacaaaatttgactgggcaaacggaagtcaaccaatagaaacgtgacagcggtggcaaataaaaaagggacattgacatttgtacgatgatgtcttctagaaggaaaaaaaatgtctcaattatcttcataaactattatagtccaaattatctcctcaatcaaaacaacttcatattttttttcatttgactcttcaaatcagacgaataaacctcgtatcctaatacaaccagttttgatagggcgtgccatataatggggcaataaaatctagttttcatcctacattgcaacagtgctcacgtgacatcctctatctttccatccacatcttctccatgtgctgcatcatactatccacattcgcatctccatatccgtcggatttctaaaagcacgtaccatatcctcgtttcggacagatttggattggatattatcttattcgttnnnnnnnnnnnnnnnnnnnnnnnnnnnnnnnnnnnnnnnnnnnnnnnnnnnnnnnnn

SEQ ID NO: 37204 - DNA, 11743 bp, Oryza sativa
  unsure (1)..(11743): unsure at all n locations
cataaattagtttcgaaaactgtgctaagacatctaactccctccgtctctaaatataagggaatttgtttgttcgtgtagtaggatgtatcacatccaatcaaaatcttttatactccctccaacctaaaatataggccgtgtttatattcaaacttttttcttcaaacttattacttttctgtcacatcaaatgttcggacatatgcatggagcattaaatatggacgaaaaaaatcaattgcacagtttgcatgtaaatcgcgagacgaatcttttgagcctaattacgtcatgatttgataatatggtgctacagtaaatatttgctaatgacggattaattagacttaatagattcatctcacagtttacaggtggaatttgtaatttgtttagttattagtatatgtttaatacttcaaatgtgtgtccgtatacttaaaaaaattttgtcacacgaactaaacacagccatcataacttttgggtggatgggacatattctagtatagtactattatatgtctcattcaccctaaaattgttatattttaggacggagggagtatattataggagagagggaggaccagctgaaagaaaaacaatcaagatacagaagtcattctcagccattaaaagaaagaacgacaacttgttggaagcataataaataaacctgagtaaggtaatgcggtgctcgtccaatgctccagcctactccctccgtcccataaaaaaataacctagtaccgaatatgatacatcctagtatttcgattatggacatacatacgtctagattcatagtagtagaatatgtctggttctagattcgttttttatgggacggatggagtatcgacgaatgacaatcccatcattaattatatcctgcctatttggaacctacccggctataactaaagagatgcattatacagaatgacaaagatatcccatcactaattcgcgcaaaatacagaagggcgcatcactcagcgcggcaatccacaactaaagccaatctaactaaatatggaaaaactaagaaatgttattgataaacactcaaatataagaaatatcatcaacaagtgagagttacctaaaatactatcatacatgtgattttatcctagaaatatcattgttgttaagtttccattaatcggatccatatgccattataacttctttgattttgaaaaatatcataattatttgtttatttgaagatatgttattacaatttgaccgaaattagtaatatgccactagtaccatttcaatgtaattataaaaaagatttggactaaattacccctcctcctctctccttttttgttcaggatccaatgaagtcatgccaccggcaatggagctaacggtggagtggtcgggtagtctaggtggtgggggcgagtcctcaatgcttggtaggaatcagagcttctcatgttggctatgttgtggtgttgtggacgacgagagtggagaacagagggagtgcctatccggtgagttgggtggggattgccggatcggacttgtggaagagatgacaaatagtgagagggagaaggaagaagggggtgaagggaggagaaggggggcatttgtccaattttttaattgtgttgaaggggtacgtaatggcatatttctaatttacatcaaattgtaatggcatgtctcttaatatacgaatagtaagaacatcctgccgctgtggatctccattctctcgtccccgcttagtctgctgtaattggatttttttttctctctccttagtctgttgtttctctcctcccttcctctgttgtcggttgatgtaagtaacctttgttaatttaattcacgtggggacttctcccccagtgttttcagttaaaaaaaattatacgaatagtaatggtatgttttgaaatcgaagaaattacaacaatatggattcaattaacccataaataattgctcatggaactattcatgttcaacccttgacctcccatatttttcaaaacaaaatacaaatatttaaaaagagattatataatccaagtatattgtatcttaattgcaatcataagataaaacttcctactatttaagagtaactaattgtcaaattgtatgtgtagtagtcaacgctaaagtatattttaaaacgtaaggaccgccaaacaaaaccaaaaaaaatgtcaggaacaaatgtcattctctatcggacatattatatactgtatatataaaaaagaagaaaggcgaacgtgttgggaagcttttcttcttctttttttttatatacatatagtagatgaagtaatctgggagcataataaacactaaagaaacctgaggaccacgccaagtcattgccgtcgggccagttgattagtgttgtactgctgtcatgctgggctagtcgaacactaatgacgtatgacaggatatcttccgcttctgattgacagatatcccatatctccctgcccccttaaaaaaataatcgatagcgaaactattcgttctcattgtcaaactttgatctcttgttttattttgaaaatgttacgaagaattaaaacgatatgacaccatccaaagtatattgtgtcttaaatttcacgtattttaaccattcatgaggaattaatgatacagctataattgcaagtaaaaaaagatttggagggagagacgtctcacaaaaaaattaagaagaaattgtgaatatattgtggattgaacacgagactttaagattgaaaacaacaccccttgctactgcagtatcaaatgcatctctataatatgtcttgtctaaaggtaaagcctgatacagaatattaattagacaatacacattttatttagagactattcccttaaatttttgaaataataaatactctaatcattaattaaaaagttttttattactattattttatattttattctcatgcagccaagttctattttataaaaactaagagttgttattcatgagttgtcaatagtaacggcaatgttttatctctcttctctctgtttttccgtgtcagcaaatattcttaattagtaatataacagccattgtacatataaccggactagtgaatgttgatcgacatttaaaaaacggagggaggactaaactcattgcaaaaaccaaaaataaggaaataataatatataaatgtcattgtcagccattaaaataaataaagacaacttgctggtggaagagtcaagagtggaagcatgataattaaacaaatctgagaatagtgtagtgctgtgctagtccaacactccaaacatgtttacatgtcgacggctgacaagatatcttccactattttatcatgcagtccacatggagtaccccataagcccatcgctaattatatcctgccaatttggaaccttctcctatctataaattaaagagatgcattcgcgccaaatacaaaaggggaaaacactctcagtcgcgcgtccagcaatcggcagctagctaatcccatctcgttgttgcttgtagccatgggagcggaacgcggcggggactcttgctactctccggcggcggtaatggccaccgccggcgccctcgctctggtggcgatctgctcgtacctggccgtcaccagcaacaagcagaagcggcggcggcggccgccggtggtcggcacggtgttccaccagctgtacaacgtccggcgcatacacgactaccacacggcgctgtcccgcgagcacacgaccttccggatgctcgtgccggccggcggcgaccagatatacacctgcgaccccgccgtcgtcgagcacatcctcaagaccaacttcgccaactacggcaaggtttatctcctctcttcttttctttctttttttttttggaatttcacttagataggtatgattttttaaaaaaagaaactaagaagatggattgacgttatattttttagtttaaatttaacgtctacaagttgtaaaaaatatatatggttgtcaatatatgtatggtaaccaaagtttaaatatttgttttcttttgttgtaacttttggaatttcacttagataggtatgttttttttaaaaaaaaataaattaagaagatggattgacgttatatttaagtttaagtttaacatctacaagttgttaaaaatatatatatggttgtgaatatatgtatactaaataaagtttaatttgttttcttatattgtaacttgtaaaaaaaataagatttggagagagagacgtaccttcaaatattttttaagagaaaattgtgagtgtattggaaattgaatacataactttagagttgaaaccacacaccccttatcactgtataatcaagtgcatcttttttttttaatataacttgtagaaattgaaattggatttaaatgtttaaagattgtttgtaaactgctacagtatacgtagcttctagttaagttaaccctatatgtaaacctagttgaatattattccctccgttgaaaattataggacacataatatttcggaaagtcaaattttgtgtgtttgaccaatgattaatcaaattataagtatatttagtgcataaaacttatatcttttaaaaaaatttcccaagacattagttctacagataacaagaatatattttataggtggtcagtggtcaaatcttgtcttaagtacttgttccaaataaaatatgccctatggctataatctgctacggagggagtaacttctactatatgaaaaccacaattctacgcaatcatgtttggagttcgccaccaagcactgagagtcagtgtgttacatctacatgaggtttaaatatgatgcttaaaaatgacgtttaatagtttaaatgttttctggaacaaatagtcacaagatttctcttttattatgggccggacataagcctcagatgcattccggccttccacggacgccgtgctcgtctgataggcccattaattatcagcctcggtcgtaatcccgttccgacccaactatcaagggcccaaacagatcatcataaaccagaaatggaataagtacatgttaggtacttaggtcccttatcttaacattgggtttgaatcatttcattgaacatcaatatcagatataacacgtccctcaacttacgtctctcaacttgtaaaactgatgtacccaaaatcccaggacagtataatgccgatttcagctaaagtatcggctaagtcagcgtgagacccacatatcaaacgtctcactttaccatctctcattaggccaggaggtagacaatgagcaacgtggacaggggtagcgaccgatggggagaggaggggagaagacgaagaaagagtgttctgactctgactaaaataccctgacatgtgggtccaacactgacttagctgtcacctcaatcaaaaccaggaacgatactgttctaggacttctggtacaccagttttgtaaaaatgaggggcgtatgtatatctggttttgcattttaagaagacgattcaaacacgacgttaagatgagagacctaaaataaacttatccactcagaaaatcacaatagttcgaacatcccataggtaggcccatcggctttgcgcaagcagctatttcatgtttgtgccagtgtcgtggaagtcggccggcacagccgtttaatcgtccgtcaaaacggaaacggtagccagaccgtaccgtatcatcaagtcggagcaacattactatttcagagtaattatacagttgtatggcatgattagtcggttatttatcgataaatcagatgtctgtttatgaaactaacataaacttgcaacttgcagcccagctgcactattttgactaacaagcccaatactattgcgctactaaccatcagtattgatatctattgaactaataaatggtattttcataatatagttagagatttatacaaatattttttattaagatgatgcattttgtctccaccgttgccattaacatcaattatgtacatcttagtgcgaacgccaaaaatccgtataattccgtttaatcatccgtattacgattaatcgcttgacggcacctcgtccgtccgccacccgtatttcgttttccacgacactggtttgtgctgacacgtactgtacgaaacaaaggggccgtttaaccacgggaacgccaaggacctgttcggggacggcatcttcgccatcgacggcgagaagtggaagcagcagaggaagatcgccagctacgacttctccaccagggccctccgcgacttcagctgcgccgtcttcaagaggaacgccgccaagctcgccggcatcgtctccaaccacgccgcgtcaaaccaatccatggacttccaggtaaattaagcgatcgtaactaccaaatggctaataatgcacggcgccggtgagacggtgagtgacgtacggtttgtgtcgaacgtttgttcagggtttgatgctgagagcaacgatggactccatcttcaccatcgcattcggcacagacctcaacacgctggacggctccggcgaggggagccgcttcgccgcggcgttcgacgacgccagtgagttcaccatgctccgctacatcagcccgctctggaagctggcaaggctcctcaacgtcggcgtcgaggccatgctcaaggagaggatcaaggtcgtcgacgaattcgtgtacaggctcatccgtgccaggtccgacgagctctccaactcacacgactccgtaagcaacccctgaaactaagcagctcactacactccggtttgactgacatatatatgatagatccatttctggatgtgtaactaagctgaattttgtatctgtacagggttcgaggcaggatatcctatcaagatttctccaggcaacgaccagcgattctgtggtcgattacaagtacctgcgagacatcatactgaacattgtcatagccggcaaggacaccacagctggggcgcttgcttggttcctgtacatggtgtgcaagcacccggaagtccaggagaagatctgccacgaagccatggtggccaccagcgccggggacaccgcttccgtcgacgagttcttgcagagcttgactgaccaagcgctgaacaacatgcactacctgcacgccgcactgacggagacgctccggctttacccttcagttccaatggtgatcaattatgatcagtttcatactaccatcgagctaattaatcaaacgacatttctctcatcgagtgcgtaacaaacgtctcttgttgatgatgatccttttctttttcaggaaaacaagcagtgcttttcagacgatgtattgcccaacggttttaacgtcagcaagggggacatcgtgttcttcatcccctacgcgatgggccggatggagagcttgtggggcaaagacgctgaatacttccggcctgaacgttggctcgacgaaaacggcgtctttcagcaggaaagcccgttcaagtttacagcatttcaggtgaagtttaccgaactcagcacacaatcatcaatttctctgaagaagttggtgactagatttctgaattctgtttacctgcttcttccgtaggccgggccaagaatctgcctcgggaaggagttcgcgtacaggcagatgaagatcttcgcggccgtgctgctccgtttcttcgtgctcaaacttcgcgacgagaaggagatcgttagctacaggaccacgcttacactcgccatcgaccagggtctccatctgacggctacggcgagatgagtgcatgtcacactacacagcctgggcacatactgcagctgtcacctgtacactgtactcaatgcaagtgacagctcttgtgtgccaaatcgaatgatatctgtagaccttaataacgtctgatcgcgaatgatccgtattgcactctggaaataataaagctgccggtgcatgtacctaaatagcagtcagcgtcagagaaacggtgcccgacgaactatacattcggttttcagttcagatggcacacgttttggcttttgggcgttggtgttcatggcagatgcaacgcattcatcagtcatcactgtgccgcgaaatgtatcatggacgatcagacgatcacatcgtgtcaattaaagctacagcgccatgctgactgctgatgttaatcttgatctggacatggatcgagtagacatgccgatcaagctcaggaagacgcgtagaaaatgcaccgaaaaatgaatgaatcgaggaattggagtacagtgaatcagtggccatggcgtcagaatcaatggatcagcgtgtgaccatcctagtggttatagaattagttaggccattagttaaagtgacagtctacaacacacatcaatccagttcgactgcaataatgcaatgtgattgataaactaatccgtcgcgaccatattaatttccgcttcaaatatgcatggttgccgtgtcaggcaggacgcgggcagggcttatccgagccgtcgccatccatatcatagatgcggtggattggtggaacaataaactagaacaacaaggaaaacctaaacagaaggtggccatgcatggaacaagctgatttgcccaggccttgacttggtacttataattttagtactagcaacagtagctattagttagatcaagctagaaacatgtgcgggaaggagtatgtagggggtcatctttaggtggtgatgttcatttttttttaaaaaaataaagataaggatgaaattaggttatgcaaaacaagaatgtcattattttagttgagttttaattattataaatttaatagtggattttcgtttatattttaaaacaacttctatattgttgttttgtaaaacacaccgtttaatagtttaaaaatattaatgaaaatggaggtaaaattttacttcctctgtcaaaagtattatgaacatgagacacagtactagaatatgttatattacatattaaattaatttattttaaaatttaggaagtactttctttaaccaaaagatttaaattttaggaaagaatcaagacacgtagggagtactatcttaatagcacaagaacaccgcctttctcagcgagagaaatgggtacccgtgcgtctctgacatgcatcatgcatgagcaaaagtgtccgatacatataaaatggcgggaggagctagagtacgttcgagcctaccaaccagacacgacggccgtgctggtgcggtgcaggcacgtactacagtactaccatccatccgttcgtcacgttggattcttggatacttgtgccacgggctaaacatactcctcctccatacacaccgtcaccgagcaacctgtcctggatagcctaatgcagtacaacccacttagcttaatcatcaaacaaacatcgccacaggaactatggttaactggagagtggtagtttaatcctcgggaaccgggctgattaaaaagagagagaaagattaatcttctcgagagccgtggttgcaaagtttgcaagctcgtgggcagcaaatgtgtctgcatcctacaagacgatgtgctcgtgtacgtacgtttgctcgccgaggaggagagagatgcgagctagctagcgtggggttgggttgggttgtggtggagtggctacccaaaaaaagagcagtggatcgagtaggatgatggactgatgtccagtagcgccgcgtttgcctttggacgcgagcgagtgaccggccgaatctggtttggggatggatgtccgggttttgtctcatctccttcattcctcggtctcttccccgccatggcaagttcaaaatgcggctttgctccggggcaaattcaaacgcatgacgggtattacgtgcaatttgtgatgaattgcggtttcgcatgatggatggtgattggtgatccatacgccccctgtgcaccggcgggcggcggtggctctcgtcaaagcgtcctgagttgttgacgcggcttcacacgtccgtcgtcaaaaccccggggccccaaaccggtcaaccgaccattgaccaccaccacctcggcacctcctccatatacaatggccgaatggcgccgtcccgccttgtctcactccactacacacctccaccgccgctagctttcaaaaaaaaatggacgccaatccgcctcaccggctcaccaccactccagccactgacaggtgagcccccactcgaaaatatctccgtccgatccacccagcgcagtcgcagcggcacacgggcacgtacgcacgcacgcccgccggaatagggaggaaccccgatcccgaccggtccagctatcgccagtccacatgagagtacgtacgccacaggagccatccgggccccggtacgcgcgctacgcatctttcgaacccaaacccccccgcgacgacgccacgccactgccctccagctcactgccagtggtcccccatcactccactctccccccacgttttggcttgccgcaacagagaagcttttcagcttactccctgtggcaccctataaaacctcgcgctgcctctcctcgccggcattgtattgtacacacgatggagtggtcggcgatgcggtggtggtgcctcgccgtggtgctcctcctgtccacgccgctgcttgccgcgggttacctgcaggagaggaagaactacatcgtgcacctcgagccgagggacgaggccgccggcgccgctggcgacgcctncgtcgaggaatggcaccgctcgttcctgccgcaggtggccaaactcgattccgactccgacggcgccgacggaggcccgcgcattgtgtactcctacagcgacgtgttcaccgggttcgccgcgcggctcacggacaangaggccgaggcggtgagggccacggcggggtgcctcaggctgtaccccgaggagttcctgccgctggcgacgacgcgctcgccggggttccttgggctccacctcgggaacgaggcgttctggagccactcggggtttggccgcggcgtcgtgattgggatcttggacaccgggatcctgcccagccacccgtcgttcggcgacgacggcctccagccgccgcccaagaactggaagggcacgtgtgagttcaaggcgatcgccggcggcggatgcaacaacaagatcatcggcgcccgcgcgttcgggagcgccgcggtgaactcgtcggcgccgccggtggacgacgcggggcacggcacgcacacggccagcacggccgcgggcaacttcgtggagaacgccaatgtccggggcaacgccgacggcacggcctccgggatggcgccgcacgcgcacctcgcgatatacaaggtgtgcacccgcagccgctgctccatcatggacatcatcgccgggctggacgccgccgtgaaggacggcgtcgacgtgctgtcattctccatcggcgcgtcctccggcacgcagttcaactacgaccccatcgccatcgccgggttcaaggccatggagcgtggcatcgtcgtcagctgcgccgcggcaactccggcccggaccccggcacggtcggcaacggcgcgccgtggatgctcaccgtcccggccggcaccatggaccgcgcgatacgcaccaccgtgaggctcggtaacggcgacgaattagacggcgactcactgttccagccggggaaca

SEQ ID NO: 37205 - DNA, 6127 bp, Oryza sativa
gagctcaactacccatccctcgtcgtcaacctgctcgcgcagccgatcacggtgaaccggacggtgaccaacgtcgggaagcccagttccgtgtacacggccgtcgtcgacatgcccaaggacgtgtccgtgatcgtgcagccgccgatgcttcggttcacggagctgaaggagatgcagagcttcaccgtgacggtgcggtgggccggccagccgaacgtcgccggcgccgagggcaacctgaagtgggtctcggacgaacacatcgtgaggagccccatcatcatcccagccacggccgcgtagtaattttttgcaacttcagcatgtacagtatgtcagtaaatagctaagatcaataaagatccatcaccttggtttgacctgtgttctgttggtcaagatgtgaagaatgtagcactccttgactagttggccgatcctgtcaactttgacagctactactggagtactactaattaatttccatcttattcatcagaaactatacatcagagattatcattaatagatgagtcaatgctcattcatactctctccgtctaaaaaaaagacaaatctggtttccgtacccaatgtttaacaattataaaaaaaattaaaaaaacaagccacgcacaaaatattaatcatgttttatcatctaataccaataaaaatacgaattataaaaaaatttcatataagacggacagtcaaagttagacacgtaaatttagggtttgcctttttttttttttggacggagggagtattcaaagaaacaggtggttagatgcttcagggagtacagtttgctctgctttgcttacagaagaactgcttttgtttggtagtaggaggacaaacctattgcacatccatttccagcctgttaacaattgttgcgtcttgacgaaaggtcaggctaaacagtagtagtcagcattaaagtatgtacatgtagtaccaaatgtatcatctgctttttgtttgcctttgcacatgccctctgcaaacctgtcttgcgcttgctgtcacgcttactcagtacttagatctgaagttcatgtaccgtaattacgagcagttcccatctaaaattactggtcattgtgctgtattatgctgtactgtaatcttcaaaactgcacatgttcatgccattcactcacctcatgactgtacttttgtgaagacatgaatttttatccgacttcaaaagaaggcaaccgttgtttcaaccaccctactttcaaatgaaaattatcctagttcgtctgcagcaagcaatgccatggtggatcttcattgttcagaagatgggagatgtcactaccgaaacaggaatggcttgcaaacgtgtcagttgagacaatcaaattactgtttctgaaggtaccagagcagtcaatttgctgggacctccaagtcccctgagaccacacaaatattcagagaccacaagaaaaagatcaaagtcttcgggaagaatcaactcacattgatccgtctctgtggtcatgaactgatctgcataactgtgaatggctgatgtaaccagatcctgaatattgcaagtgaaaccaggaggcacgatgaaaacaaatgaccacttctaaaaaaaaaaaacaaatgaccacatcaaactgttgttttttcagcaatgaatttgatgcagtccttgtttttttcagcaatcaaactgcacacggtaaggtttggtcccgtttactttttaaaatgggacaccatcttaatataaaacatcggcaacggtctaactgttcgaaaaaaaaattgatgcagtccttgttttgcaacagaactaatgagaacatcgaacatggtggcctcacaaaagcagcagatatttttccatccgctactattcggatcttcaagaattccagatggagtacatgtctagctgaaagcaagcaacacacatcagcaaaagagattgataaactgaaaaggggaaggatcagattccagatcgtagtacttcctgctactatcctacagtactatcttctacaagcaaggatcatggagaaaagcttgatgaaagcattcaggcaaagcaaccttcggatgctgatgacagatgccaaaatgccatcaattatactgaccggggaccccagatccagcttgccgattcggcggctatcgcaagctatcatcgtgtgcaccgtgcagtgcagacaaattgttccaggtcgcattgatcaacagagggaggtcatcaaaccgagtggaaagggttatcagtggaagggagatcgctcgccgcgcagtcgctgacggctcgccggagattggccggcaccaccgatttgatccgcttcgtgggggagattgggagaagggaaactatatggtttgggttggggctctgaagccatcgtatgtattgggccggtatgctgatgtggctgaaaagtgggcccaatatagtactaaggtttgttgggccgaactaggccgttccgccaccttggcccaatggtactctgtctgactattgcttttgaaaggaagaagtcagtcaggtatggatccttgagtacgatccaagcaaaagatgagaacgagaagattcagatataccaatcgtcctaatcttctgtcattgcagatactactacgcggtttcagtgtatatatatgtgaatccatctgccaaaaacggagacagaatcatagataccagtataataattccacgggattcaattagccatccacagatcgaactcgaaactcgaacgtttgttcctttctgaacccagagagacagcgaatgcgatcgtttcccacccatgagaccacgatcatgtggctgatggcgtgatcaagaaatgagttttgcgcgtgtgcgtggcaaaaacggttggctctggtcagggcgtcaggccgttgggcatcagtgcagcaccctgatctgatcatcagcggattcagaaagtttcagttatcatactgatccgaggaaccttagcggcatggcatggcactcgtgatgcttagcctgtaagaaatggtgagacgtcagctattcaaagatgcattaaaatatttgcccttgtcaatgtataattggtatagtaaccattcaccctatccaataatggggagaaactagcagtttgcacgaaatggtgtctgtgtctctagcagtttttgtgaagaaaaaaaatattctatcaatatggttttggacaatgttccaagctgagattataactttgaatgtttatatatttttattttaaaatgtttaaattggatcaatggaaaccatatatgcatattcgactcgaaaatgtgtattatactagattagttttaaattgttctgcagtaggaattaacggtcaagtagcatcttgaaatcgtattagatgtccaatgtggcatattcttttgatgtcgggaaggaagtagtccaccaaaaagtaaaaattacaattgaaagctcaaaacacatattagactcgagcattgaaaaaaaagccatggagaccttttcgtacgtgacactgaccccacctacggaatgtatgagaaaagacaaaaaaagaagatttacttttttcagtataatatttacactccttccgtttcagttttatatgataagtctttcaacaatttcctagccaaactaagtttataaaaaaaattatcaacatataaaatatcaaattagtttcattgaatatattttgataatatgtttgttttatattgaaattattatgtatttttctataaatttgattaaattttaaaaaaagttgattagataaaaagtcaaacgatttaaaatataaattgaatagagtacattatgagttgcggtctttcaaaaagaaaaagagagagaaaaaataaataatttcctgctaagcaaatactgtccgtcacgaaatctccaatcgcgtcatcagctataccaacgcaacgcgcgttctcctcccccacccccctctccccagtgacgatgacacgtgggccccacacgacgttaggaacgaggcggtccgctcgcggaactataaaccggtcagcgtccgcacggcaccaaccttccttccttgtgcagttgtgcgggttggccggcccgcccgtggatcgtcttccaaccgggcgcgagtcggagtcgcgaccgcgaccgcgacctcacccaccgtttctcgatcgtttctctccctcctcctcccgcgatccggtcttcttcctcctccccgtcgtgctcgccgcccacgactcctcctcctcctccaccaccacccctccacgacgcggcgggcggcgagcgcgcgcctcgtctcaccctcacgcctcccacgccttggaacccaattggagatagaagaggggagcgcgaggtcaaaccaggggaatcggaatcggaatcggaatccgcgacgagacgaccctacccccgcgctccggcgaccgaccggcggcgatggagggcggaaaccacggtgggggagggtacccctacccgccgccgcagcagtatccttacccgtacgggcagtacccataccagtatcctccaccgcagcagcagccgccgccgccctccgcctacctctcgccgtcccgttcgttccacggttacccctccgcgccgccgccgcagccgcagccgcagccgtacgcgcaccattccgccccgctccagccttacccgccgccgcgcagcaccatgcctacccgccgccgcagccgcatccgccctcgccgtacgtctacgacccttaccacgcgcccgccgcggcgtacccttcctacccgagccccaaccccagcccgtccatctccccgagctccagcttccaccaccaccctgaaccgccatcgccatcgccctccgcgccgtcgtacccctccattgcggatgggctcgccaacatgcacgtctccgaccgccacgactacccgccgccgccgtcgccggcggccgtgcccgcggcgtcgtccccctccgtgctcccgccttccgcgtcgttccccggcggcgggagcagccacggcggtggcgggatgcagatggtgccgtacggccctcctgccggagggtcgcagcacggtgggatgcagatggtggcgtacggctcgccggccggagggtcgcagcacggcagcgtgaggccatccctgaaggtggtgctgctccacggcaccctcgacgtctgggtgtacgacgctcggaacctcccgaacaaggatctcttctccaagagggtcggcgacctcctcggtccgcgcctcatcggcgccgtcggcagcaaaatgtccagcgccaacatgaccagcgacccctatgttaccatccaggtctcctatgccaccgtcgcgcgcacctacgtcgttcccaacaatcagaaccccgtttggacgcagaatttccttgtccctgttgggcatgatgccgccgaggtcgagttcgttgtcaaggacaatgatgtcttcggtgctcagctcataggcacagtgtcgattcctgctgagaagctcctttttggagaaaggattaacggcatctacgatgtgcttgagtccaatgggaagccatgcgctcaaggtgctgtgttgcggctgtccatacagtacatcccggtggctcagctcaaaatgtatcaccatggtgtcattgccggcccagatagcctgggagttcctaatacttacttcccgatgcggcgtggcaatagagtgacactgtatcaggacgcacatgtgcctgatggttgtctcccggatttctgtcttgatcacggaatgcgctatcagcacgggcagtgttggcgtgatatctacgatgctatatgccaagcacggcggttgatttacattgtgggatggtcagtgttccacacaatccacctcatcagggaaggagttgagaagatgccatcacttggggaactgttgaagatgaagtcacaggaaggggtgagggtgttgcttcttgtgtgggacgatccaacatcaaggagtattcttggaattaagacggtatgagttattcattgagttcaaaattgctttgttcatgacttttacaccgcacacgagaacatgattttgtgtcaaaactcca

SEQ ID NO: 37206 - DNA, 3508 bp, Oryza sativa
  unsure (1)..(3508): unsure at all n locations
nnnnnnnnnnnnnnnnnnnnnnnnnnnnnnnnnnnnnnnnnnnnnnnnnnnnnnnnnnnnatgctattcgtggagcgcagcactttatttatattgagaaccagtatttcattggatcttcgtttaattgggattcaaacaaagatattggtaagcatatggtgtaaagttatttttttaattaatgtgcacccaccaataaaaaaaatccagaaacaaaatacagtgcacattacattttcttgatttgcaaaccatttcagcaattcagaacacagcaaatcccttatctgatcctaaattggtattcaaattgtgagttttcaggggctaataatttaataccaatcgaaattgctctcaaaattgcaaacaagataaaggcaaaagagagattctctgcatatatagtaattcccatgtggcctgagggtaatccaacaggtgctcctacacaaagaattctttactggcaggttagatcaacatgtctgctttgtgtcttgtttaatgtttatatagattatacccagttagttcatttgacatgatcgcatgttttttttgttgctcctgtagcacaagacaatgcaaatgatgtacgaaacaatatatagggccctgaaagaagagggtctagatgatctatatgagcctcaggattatctgaacttcttttgtcttggcaatcgtgaagttgctgacagtccaagcacttcaaactcaacaagcactcctcaggtaagacgtcttgttttttcctttgacaaactatgctgaggaccctccattggttttagttttccctgcaaggttaaatgcttttttttttcatttatagtattaaatacagtaattaatgtcacattgaatttcaacaaaagtcacaatatggtcccttaagcctgcgtcatacgagaatgtgaaagctgctgatcttgccgacctctgaagataaattttgctctgacttgccatattacactggttcttaaaggatattgatatcaagtcttgttctctgatcctacatggaggccaaatatccaatccactttagtttctttatcagatgatacatggaaattctggttttgtacacttgtgccttttatttagaagaaaacattcgatcggttagaatgatttggctcaattgtctagatgttctacaataatgtttcatcttgttggagcactgtgtatagtatttaacttttgatttatcaaaattacaggatatattaatatgtatgatatgcttgctagcaatctcgctgaactttgttatttttttaacatctgacttgcatgaaaactgcctgcatgcaacctcgttcatttattctacatttactacccaggaacaagctaggaaacatagaagattcatggtatatgtacattcaaaaggcatgattgtggatgatgaatatgtgataattggatcagctaatatcaatcagaggtccatggaaggtatcagagatactgagattgcgatgggtgcgtatcagccacagtatacatgggcaagtaaggtttctgcaccccgtggacaggtaacaacacttcatgcctgtatggctgtatcacatttctggagatctacagagaaccgagctggcatcatatgctcatatattaaacattgcgccttcagtgattgtacatttgcaactcgtttgctttacactgttattgtctgttgttcagcactactgcatcaatccagccatatatatttgttgcaattatcttttgttttggcagagtaacctaaagggaaattcgtaccctatcaatcatatttttttagataaggctaaaaaaagctaccactcactcttaagaatatgttaattggaagaaaaaaagagaagctaccattcattctcaagaatatgttaattgaagaaaaagagagctatctacaccatccatcatggtgggaccagattgtagctacaaatgtatggaaaatacaaatgtatttgtagaaatagagaaaaagttgcatatcaagtacagtcatatttcaaatagccctgtacaactgtgaaggaatctcgactagttgtctcttggtttgagggatatacctattttaggatgactgatatttctagaaccacactctaattcaaatctgctgatttcatgtgtagatttatgggtacagaatgtctctttgggcggagcatattggagtggttgaggaaggcttcaactatccagagaccatggaatgcatgagacgagttcgccaaatcggtgaacagaactgggaacgatttgttgataatgaggtgactgagatgagaggccacctaatgaagtaccctgtaagtgttgaccgtaagggcaaggtgaaacccttgccaggatgtacgtcattcccagacatgggtggtaacatctgtggatcattccgagccatccaagaaaacctcacaatatgaatttcgattatctgtaagtatacaattgctagtgattctgagctattctgcttcctgaggttatagatagcgtgaaaattttgctagcaatataggttgaaaccaagtaggacatgacaagaaaaggttattaccctgcattttttatgcctttcttaagagaattcaacatttccatcttaataggttttctttttatgtatactttttatcaatgtatagaagattaagaatgtttgaaagcccggaaccctctgtttagggaacatggctttggtagcaactttgattgatttaagtatgtagcgacatgtaaagccattaaaataagtttctagtgtaattattttcagccttgatttgctggttccattttctaagtgtcaatgaaatctaatccatttatttcttcgtcatgcccttggtaacataagtttccgctttgtttttgcaatgcttcttcaaggttacataatcaacaagcagatactgaacctatgtctagagaagagtaaaaattaagtgggtgcaaataaaatctactctaaactctaaagacagttgaacattttcttttccttgaattacatgcatttttttgctcctgaaacgaaattatcttttgttcatcatttcttccatctctcggactgaatcttcacacccatatacctgcccagtgtccatattgaaaactatactgttagtgtgttgttactcatggcaatgcactttcatgagctaaaatgatgccagttacctgccgagcatcatgacggtggcctgagggttggtgccgggggagtacttgaaggtggagctgtcgatcaccctgagcccctgcaccccgaacacccggtaatcgtcgtcgacgacggcgccgacatggcagccgccgtggtagtgccagatggtcatgacggtgtccatgcagtactgctccggcgagcgcgagtcgttgacatggcgcggcagcaggttgacggggaagttggcggaatcggtgaagatggactcgacggaggcgttggcgtaggtgaagttgg

SEQ ID NO: 37207 - DNA, 1118 bp, Oryza sativa
agcatcaccagcgttgagggagatgccattgaggctaaatggtggtggtgcagagggcatgattggttcagcgtagcacagggtgaggttaggaggaacgatgtggaagtggtggctagggcttgactatttgtttgtattggagggtggagataaaatgtagattttagatgacagatcttgcgattgagaatttgaaaaatctggtgggggattttcttactaatattacttggggttatttggttagttgcttcactttgtaatgccacattttgattatggcgtagttttctaggtaaatgtttgcttcgcccccacacctttttagccttaggacatagtatatgttatactactacctccgtttcaaaatatattttagtccaatttatagtattgggctgagtttagtgtcatagaaaatagggggagaatttactatttgcaactaccaaaatgatagcactcaaataccactctcctaaattttcattcccaaatgccatccgaacgcacatgtcagcctcacttttcattcaaacataagtggtgaggtccgggtgacatttaggaatgaatatttgggagagtggcatttgagcactagtattttggtagagtgacaaatggtaaattcttcaattgaaagcttaactatattacacttaactatttcttagccgcacttttatcaacacgccacaattacggcaagcttgcttacgcatctaacaaacatcagtctcagttttttcttttaccaaccactgcatcagttcacttcaggtaaccaactgacaactagcctctagtataacggaatgaacaaagcacacacacaccaggcaaggttgcctgcctaactactaccactacactactagccacttactagccagtagccactcgcagcgtcctctgttccagtacgtgtggttctggttcatcatcgtcaaacgaagcaaacgacgacgaaacaaactcccggatacggcgcccttctttggtcagaatctttcaaacttcaaagcaagaaaaaacacaaacaaacaagaaccatctttgcattccgccatacattcgcgtcgatcggtgtccactgtacaggttgatcg

SEQ ID NO: 37208 - DNA, 1412 bp, Oryza sativa
cgagatgaggagacccgcagatttttcaagcactcttcagttcaagtattgctttgcccacgatctgctgggaaacggcacagctgggtgaaacagcaggtattgtgatgccacacaaacttatccattatgatattccatttttgtttgtcacctaaattactacaattgattgcaccaagtgagtggtttcaaactttttatatgtctactcttcatgcttggaagttatgctgtacttcacaatcgctgttccttatacctgatcaggaagagaaatttgatattcacataatgcacacatatatttgttgttggattcttttgtataatggcatttatcaagcaatcttgtattgtattaattcttttagtaccatgtatttatcatatgatggtattgaaattcaggaaacaggaaccatttttactcatcatcagaaaacagttattttggatgctgatgctggcaatcataagaggaaaataattgcttttgttggtggcctcgatttatgcggtgggcgatatgatacacctagccatcctctatttaggtctcttcagactgtgcacaaggaggattattacaatccaaattttgctgtaagtgtttgattcctttaacatatacttgtatcttgatgtggtttctgatgtaaagctacaattaacttcttgcttttgagatgatgatagtaagaaacgtatctaatatttagttcctaaccatggaatatctttcgacagaaagctgttccatctttctcttatctttggttcctgaaagtttctttctctctctgcttttttttttctgcagacagttgatgctcgtggcccaagggaaccatggcacgacttgcattccaagattgatggtccagcggcatatgatgttttgcaaaattttcaggagcgttggttaaaggcatccaaacgccatgggattaaaaagttaggaaaatcatatgatgatgccctcctcagtattgaaagaatacctgattttataagcattaatgacgcaatatattttagtgacaatgatccagagacgtggcatgttcaggtatttatagtatcttgtagtcagtgtgtgtaagtttttccttgttttaactttctacttaaactttatttgctttgaaacctaggtgtttcgttctattgattcaaattctgccaaaggatttccaaaggatccacgggaagcaacccgcaaggtaattgagtactgtttgcatgtactaatattatattcattattatgtgcttttcgctaacacggggctttgcctagcagaatcttgtttgtgggaagaatgtactgattgatatgagcatacatactgcatatgtcaatgctattcgtggagcgcagcacttcatttatattgagaaccagtatt

SEQ ID NO: 37209 - DNA, 528 bp, Oryza sativa
ttaatttcaaaaccagtaattaaggtggtagctgcttcattcgttcacaaatataagcatttctcattaaagcactattttccctattcaactatttctcatgattcgtaaggtaactctcatggatatcaaattaattttacctcaacattaatctgtgctaaaacccttagaaatggttatatatatatatatatatatatatatatatatatatatatatatatatatatatatatatatttctgaccataacaaaattcctatccaaatttgaatctcagaattcaaattctgctattcgaattgtccctccaaaatcatccatatctcctagtattcaaaattccataaaattcctctccttataaatttaccaccaaaacctctctcctaaaaccctggttcaaattttggaaatcacattatctttcgaacccctcacctttccctccatatgatctcctggaactcataaaaatatcgtgccaaaaatattaaaaatctcagtcagggccctgtttgctt

SEQ ID NO: 37210 - DNA, 739 bp, Oryza sativa
tgatgctacttggagatctttgcctgcttgccctctgcctcttcagtttggtccattttgcgcttagtaccactcaaagtcatagtctcctcagcggaaccaacctctactaccatgtcatcatcgccacctgtattcgagtaaagcccattttgcagcacaggattagagctggatattgattgaggaagctgccacatttgcatcatttcagatggtgtgtgtacaattggaacattccgttgcatctgttcaggtggaagatatgccatctgtgcaacaggattatgccattgcatctgttcatggggaggaaatgttggcattggtgcagcgggatggcgccattgcatctgttcacggggaagaaacggcattggtgcaggggattggcggcattgcatctgttcatggggatgaaatggcatatgtactggggtaggatggcgccactgtatctgttcatgaggaaaaaccggcaccatctgtggagtaccaggatggcgccactgcatctgttcaagaggagcaaatggcgcatgcagcatatagtgatggtggggagcacaagggatgttattactagcaggtggggtgaaaattactgcaggatgggcacttgtctgctggcttgactgctctccttgtattgttgttcctgttggtttgtttgacctaatactctccaacatgtggttgcttctagtaactgcaataatatctactgttgagtttgtga

SEQ ID NO: 37211 - DNA, 1084 bp, Oryza sativa
  unsure (1)..(1084): unsure at all n locations
aacgacagtagcggaaaaggtgatcctagggggggcttcagctctactccacaggcaaaactcaactggggtctgagccttggtcctctaacttcgtcttcagctcggaagcactacacttctgaaaagggggaaccatagtaaggctcaatataaccaccatactcagcaagccataccaatgatgcagacgtgcaaggagacacaagagaggtttgtggctatttgcataaatgcggttgcaaaacatttattgagcaaaacagtaaaactgtagagtaattaaggtaatattaaatatccactgatcaatgctacaccacattgaacaggcccaaccaacccacctgagctaaccaatgcattcagtcgatttattaagggtgagacaaatcacggtgaatctggtcgatcgcccataaccgcgggcacggctattcgaataattttactctggccagaggtgcagaactgtacccacaagacacaatccaccggcatgtcaccgtgccatgcatgacatgtcaccatgtcgagtgattttgacaagacccttcatataaccccctctgaccaagcacaccacacctcaggtttcacccccactcctcaacaggcagcgggcagtcccttctcgtgctagatgaatccagaagcgacanaggttgtcgcaggggccatcccgctccatcacacccactcttgcttggatgcttgatgccttccagggtttcccgtgaaccggtccttatttgttataggtgcgaccagcaaaatcatgcatccatagcccaccattaagtcgcattttaattggataattacgaccaatgaaacatggtcagatttcttgagcacatagctcgccatgatactaagatgtctaatactgtaattatcccatcaactgagctagttgtaattaagcatggctaagcatatagttctagctcgatcatcaaagtaacacaagctagtcgatttatcacccaaggttgagaaaggacatgtatcaattaatatggcacaagcaaacagataagtaaaccccgatcctatgtaattagtaaaacatgcatattta

SEQ ID NO: 37212 - DNA, 2861 bp, Oryza sativa
agctcggattggcctgtgaaggtgcggctcagtggtggattgggggtgggaaacgacggacggggtgcggcgtggagcggcagcgctgtgggaggcagcagcacggccagaggtggcctgtctcgccggcggggagcagctggagacggaggaaagagcccgtggctcggcctcacggtgggaatggctttgcgggggtcgaaggggaggatggagtggatgccgaggtggagcttggcatggcggtggcagcgcagcgcgacggcggccctagcggagggaagtagcgactggagaactccggcgacggcggagggagtgagcgatgcgggggaatggtttctaggcgcggggagctcgaggaaaggggaaaagggacgaggtgaggtgcggtgatcattttaaagcactcgaggagggaaaccgtggccgggagtggcggaatcgggtggcaatggccgacgaggtgggttccggcgatgtgggtgagtggggctcaaaacggcgccgaaaattggggaaaagattggggagaggtggacaaggtggacggaaaccgatcccacgtggtttgggcgcgagggcgcgagcaggaggggtcggaatcagggtgacgtggggcggcaatggcggcttggcgcagttggggtaggtggaggaaggggatggacctaatgggtgggatcgtgggtcccacctatcggccaaaggagagaggagtggcccgtggagggaagcagagaggacttgcgggagagggaggggagcgagctgggccgtgcggctgaaagaggagaggggaggaggcggccgggccgggaaggggaaggggaggcttgggccgagcacaagagggaggggaggggattttaatttgttttctttttatttaaattgattaaatgaactttgtattattataattactttttgagctccgaaaattcacgggaaaatttcaaagaatctttagggcacaaagaatattacaaaatattctcggccatgatttttacgggaaaacttttaattccctctataatttcacttgattaaattgctttaaattttaatataatttctggaaatgcattattaattgttttttaatcccgaacaaaaattggggcgttacagcctgccaccgtcgctgctctagatcccgccctgaagtggagaggaagagaaacaacgagagatggaagacagggaggaggaagaaggatagagaggggatgacatgtgggcccacatgtcagtgggttccacaattctttttgtgtaaatgacgaatggggcccacataaatgtttataatacgacacatatatgttatatatgtttataacactacaaaccaggtcaacactgccacgtagatgccacgttagtgaaactgccctccaaaactgctaagggagcaaaattgcaccggtttaaatagttggtgattgatatatccgatattgcagttcaaggataccaatcagatttggtcgctagttaagggagtcaatgtgaacttattcccgcctggatggctcctacttgtcgatggccctattgagtagtttggattgttgctttatccaatgtagtggtttggttgaaagttttatggtagggtgtttgctacctgtaattttacccacatcatcaactaaataattaatgttgcgttcggaggcctcccgacatagaaaacaaagcacacaattatagtgagattaattaaatattatcctaaaaaacttgaaaaatggattaatatgattttttaaaacaactttcatatagaaaacgtttgtaaaaaatacaacgtttagcagtttgaaaattgtgcgcgtggaaaaccagggaagtgagttgggaaggaggggaaaagaacacagcctaagtggtggtacatgcaatatattatctctaatacactagttccaccagggggcgaagccatgagaccgaataactaatattaatagcaaaggaggtcaaatagtcactgtcaataacaatcaatgggtaaactagtccttatttgtgagattattcaatagtttacattgaaagaatttagcaatcaaaactagtttcatactttcaatgatattattaaagagctaaaacttttgacatatttttttcctcaaaacattcaaatctttactgtcggatgttctttaagatctgtgctagattcgatccgtggacttaagctcatgcatccagtgcgctagccacttacagcgttgcatgtttctgagagaaaagagcaacttacatattagttacataccagttacatattagttacaatatatataattacagtatagttacatttgaaagtttttttctcaaaaaaaaaactgtcgcatgtaggtactcccttctttttattcacttacatcacttttttctttttcctcctgaggttgcctcttatatgtgtagtggctattcctctatttacttctatccgcctaattatttgagtctatgcaatatcttggcaatagtgctaagaatctttaagcattcccaactctctacctcagctatatgttaaataaattgccacgtaagaaaaaaaaagctgaggtgaggaaacagttaacgaggaaaggggaaaaagataagaaaacagttaacgaggctacagcgtaagcagcggcgaaggcagcgctcccctacccttcctcccaacctcccatatatggctagagaaggggagcgacagcggcggcggccactgcaggcggtggcagaggcggcgcagtcccctcccctccctctcttccagttccagatttgggtggagaaggggagtgacgacgacagcggaggcggtgtggtcccct

SEQ ID NO: 37213 - DNA, 709 bp, Oryza sativa
agggtgacatagacaaatctcagacattcatttttggattcacggtagtttctaggtttgcaccacatattttcatgtattattatatatgtacctaaaagttggaatattcattatatatgctttatttgcttgattacagacatgacagaaaggctgttgagatggaagaacgatctttctgaagaaagggataaatacgggagtacacctcttcactttgctgcatcagtggaatcgtcactacacaatcgattcagttccaaagcaattgtctccaaagttcttgaagcttgtccttcttcagcatttcaaccagacaatgaagagtccctaccaatccatgtcgctgcatctgcaggtgtccggagcgccatagcaatcttgatagaaaaatggccaggttgtgcctcatttcgtgactctgatggaagaacattccttcacattgctgtcgagaagcagaggaatgatattgttaggtttgcttgcaaaaaagtagttctttcatctgtgttgaacatgcaggacaaagaaggcaacactgcactgcacctagctgtccagcttgggaacctgagtttagtctgctctttgctaggtaacaagcgggtactcttaaatctgacaaataaggttgggcaaactccactgaatgtagcaagaagaaaaattcctacagggatttggggatcctctagagtcgacc

SEQ ID NO: 37214 - DNA, 572 bp, Oryza sativa
ctccttttagattttacgtcgtcgatgcgtctctcgttttatacagatcgatagatagcctagtgggttccgaatgggcagaagtatgtggatggaatcgtgaaccgcatgccatgctacagcctacagtggtagatatcttgtgattgggcaatttaggtttggagtgtttgactactactttctcccttttacaatgtaaaaatttctaatattatccacattcatttaaatattaatgaatctaaacatatgtatatgtttaaattcattaaaatctatatgtatatagataatgctagaaagttttacattataaaacggagggagtagcagtctagcacggaaggacaaacactaaaccaactgacctggcggcgataactcggtgccgtacggtggttcgttttgtatgcttccagcaagttggtcttacttttttttcctttccgccggccgatcgagaatgacgtactgatgagcaaactttcgataggtattgattagattgatttggtgaaaaattgacactcacgatctggcttctggcttctggcttccgatcaatatga

SEQ ID NO: 37215 - DNA, 1453 bp, Oryza sativa
  unsure (1)..(1453): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatgtaagatgctgaacgctcataaaaggatgatctggcttttgacattctcgcagaatagtatactatttgggggataagttcaagaacgtccttttcccccaaattccaaaaggcaaacaaaatgcttggattgagctttactccaagctaaccacagatggatctgcagctagctagcatcgatcatcaatcaatcaagcagctggggctagcttagcttggtagtgcatgcattcatcaccatgtgggccttcagggagatatcgccaaaaaccccttcaggtcccatgcatactagtggccttgtgggggcatccacagcttcgtgtagtgcagcaattcgatcgtatcgtcgtggagcactgatgctaagttgctaacaagttacaggctaacagctgaattctcctgcagtgttggtaggacttgctgtttcttctctctgcaagctggccgtgcttaacaactagcacactcgtcaacgcacacaaaaatgtttttcatattttgatcgatcgtggtacagccggcgatcagttattcagactggtgatcagttatcactaattcaccatccaaagcatatgagcctctgaaaatggagtgttgcagcgattatattctcgtcgttgtctttcagaggaaacaaaaatctctcaccatgcatggctcctacaagctagctagcttcgtgatctagtaactggatatggtaggtggcaagaaaacaaaagaatctagcgattcatcatctactcatcatgccaagactgatccctttcaccttttccattaaacccttaattatggtgttcgagaccgggtcaaaaataaattaacatcctgcagatcacggcttgatcagccgccacttggacgcgaggatcgtactaacctcgtcgcgcactaacgcgaaagcggctttgcgacatgtgagatctcccccaatgtggcgagacgccattggcctgaccgtcctgtaagcctgaaacagccactcttttttgctccctgtgcttcacagctaatccctagcccagcgtcgatcgagcaagcaagaaacgcgtatcccgatttgtccccaatgttttcaccaactcccgcccgtttttataccctcgcaatcctccgtttcggtcgagtttagtacacatcttcctctaatataagccagtttgtttttttttacgatccgtactagacggtgcgaaattctattggtagagcaagccagtgtacgtataagtacgtgcatgttgatgagctgatc

SEQ ID NO: 37216 - DNA, 1867 bp, Oryza sativa
aatcccatatggatttaacacatcaggtttctcttattgcttttggtacggttacaaaacttccgcgataaactaagtggtaaacgtgatacatatcgtggttaaaaaactgaaaagattaccgtgtatggtaattgtgatagccacgtgataaccgtaccggttttgttaaatccttctgtacattttaccgtgtatcggatctgcaaaatcgaagcgggcaaatttttacacgctttgcttcagcttcgaactgaaccacacaacttttttacaataaccttcactaatgtgatttgttgttcgtgtttccagacgattaaactactgctccgacgagctttcggcgcggcttccgcggccgccgtggcgacgattcgacgcgatgcgattcgattctgcatctggcctgcagatttcgctcgtgtagccttctgcacgagtcaagtacagttgactgctacacgtggagagttggaggggaatagatactgtctgcctgcctccattcttttacttcgaaaacgaggctcgagcagccgagctctagtccagtccagctgtgccttttgattctccttgcctgttctccttgtcccctgcctgattattccacccagtaatggaaattaaccgtgtgcacaattttaattcactctgttcaacgaggtcaatcaatcttcaggagagtcgtcagaggcttcaatttttttcgaaggtaatcgaacatgaatgcagaggtctcgaactcgaaccaaattggcggcaccaagcaaatgcatcgaatcaatgcagcctgggcgagcaactgccgacggaacagaagcacgacggacgctttgatggtatggtcgccactagctgctgcctcctcctccattggcagatgggagacggctcaggacaccggtctcgcgattgcagcctcgtttgggcaggctaaacttgatataaccatccgtacgaagcgcaggtctcgacgaatttgagttaggccgctcaatttgcattagtaaactcggtcgagttgcaacagcagcagcaaacagctgtaaccagagttgcctcatgtgctcaacccgcagcagtaggatacgatgaaaaattgggggttttttctttttcctgcggtactgatgtactgtagcctgcataacctgcagtctgcatgcagcgcgagctgcacgtaaatgtgccggccggctcacagtttcgccgcggcttctggtcgtcgtcgtcgttgcggcagccgatacaggagggcgtttccagagatgaacctacagctgtgtgcgtgttgagtccccgcgttggtagaagcagaaccaaaactgcatctttattgttgcctgttaccacttcgtggaagctgctaatgagggcatgtaactatggttgtccgactcttaaaacttgtaatgtcgacggttttattccttattgaaaatattacttgcggttcgaaattttggctctatagaacagttgcggatctagaatttataggataggtattcagaattttaaaatagcttttccaagatataacgatacagattgatatgttgacggtacgatacactattttcatattactatgacttgtgcgcatatatgataaaatatatagacttgtgcacctcttatcttgtgttagaaaaataactacatcatatctaaggaaactttaagtttataggaatgattttgaatttaaggtttaattaaatttttggtgtaggagtatatagagactatgtgatgaaaaagggtttcaaggagaaggtcttgttttaaaaatgggactaatataaattagaggtttggaacttagaagtaacatgtaatatggacatcttggatctta

SEQ ID NO: 37217 - DNA, 1065 bp, Oryza sativa
  unsure (1)..(1065): unsure at all n locations
nnnnnnnnnnnnnnnnnnnnnnnnnnnnnnnnnnnnnnnnnnnnnnnnnnnnnnnnaatccggtactgcgtggtacgagtcgggaccgggtcaccggtccaaggcccccaaacaaattcaccgatccgatccgtcgtcgtttctgccgagttttaccgccgccgctgctgctgtaatttggcgaaggccacacgagttcacgccgcgatcacccagacacgggacaccaccctggttgcgacagaaacaggggagcctttcacatcttacgtggtcagtcctagagaaacagagtagcgtacagtacaaccactgcattgtaccgactacttcttttatactgtatccgccctctagagattttttttattttgttgtactgtttgactattcgttttattttaaaaaaaataaaattattatctattttatttgtaacttcctttattattcaaaatactttatacataactttttgttttttatatttataaaaaaaattttaataagatgagtggtcaaacaagtaaaatgttaaaaatctcttatattaagagatagaggaagtattcttttgactgagaaattgtaccgatcgagtatttacgttactactactactagtacgcatcaccaagtgatcgctttcgatctctctgtttttcttacggaattcaaccttgttcggtcgtcggatcgatcttattaacttcttaccagcatgtgttcgtgcacatcagttttcacccagcaaacactcgtgtacgagtagagacacggaacggtccttattattacacgcattgaccgcctatccagttccctcgagtactagtactacagacagtgccaacctactctattggattagtaattccaagctactgcccctgtcatttcgtattacaagttgttttattttttaaaaaaaatattgtttatgtttaactaaatttataaaaaaattagcaacatatataatattgaattagttaatataacactaagtatattttgataatatatttattttgtgtaaaaatgttattatatatttcaataaac

SEQ ID NO: 37218 - DNA, 897 bp, Oryza sativa
  unsure (1)..(897): unsure at all n locations
ttaaagggcaggtaagtaatctcctaatattgtttaggggtaattttggcatgggatgtttncttcttttcttatcgtatcaggtccgaactccgttgcacgcagtcacctcgctattcctcccccggcctcgccggcttgtccgccccctccgtcgccatccgtattccccgccgacggcgaacttgttcgttccttagtcgcatcgtccgtctgggagcggacgagtgtggtggcgtccgagcgagcgacaatcttgagcaagagttctggcggtagtaaaaactccgacctgggcttcaggggtagcgtcacgcacgcacgcaatgtcatttgcttggcggcggcgtctcggctcattcgtcttcttgccgtttccgatcactgtgttgtttcatagattacatggatcgattaagatcttgcacgaccaactccgacgaggatgacatggtgatcgatctatggatcggaaaacaataataccccttcacgaattatttttcctggacaaaaacacccctccacatttctacttccactaattctggtaggagtagaactaaatcttaactctacaattaaatatgatagagggcctagattactttctactccgagtagaaagcaccggagtaggactcaaaactgtttagctgacttgactccagcttcaagagagagaagaggtgtagcttgagcagtgccaaacagacctgaagattaacaatatgttgttatatttccagaacgatatgagttcaatgatttatcgatttcagagacgacgaaaatgatactaggatggaacaaggatctcatcaagcaagccgaccggcacagagggagcacgcctctccacgtcgcggcgtcatgggggcaccacgacgtcatcag

SEQ ID NO: 37219 - DNA, 530 bp, Oryza sativa
aaaaaattgtggattcttgtagtgaatatattttccacaagtttattctttagaacgtgaaagtattctttagttatgcttctgcgaatttataattcatacatcagtttcttttagagcaatatatatcaagttaaggctacagagattcttataattgaacccataacctaacttctatttcactcttttcttctagacaaatatctcactcgtaagcttaatgatgtcaacacggggagaatttgcttaatatcgtgtccttttcctacaacaataaaattgatagttgacctgccaacaccccataccccaccgcccaccctacaagcaatgaggtacatgcagcagaaatgaaaaagaaatcatattgactcaatggttctccaaactatcatataacaactacacacatcaagaatctcaatggaaaaaataattctatattggtcgacaactaatctaaagtagtgaaaagattaatcttatacaacactagattgcgccacgtcatcagctcaatatgcaac

SEQ ID NO: 37220 - DNA, 576 bp, Oryza sativa
tccagaatacaagagactagttgtggaaatcaaggagaaaatgaaagcgagcgtattggctatcatgaacgaatcaaaagcatacctcccaacaagtgttggtgtgccaccgtttgagtggtcatctgctctgtaacctccgggcaatgcgaaagttgcaccgaacgtcacagttgctattagaactgagccaatggccattgtttccgttgcgtcctttagcttttctaattctttgctttcactatctgattttaggttgtgagtgtctttgtgtttttctctaaagtgatcgtggcggcaactgtcattcatagcaccagcttgtgtcaatacaaagcgtaccatttcttcggtgctctgaaaaataaggaaactaatcaattttgttaggaagtgaaatcagtattcaattatcgtttatctcgaaagtagtacttctaaaagaagaatttaaattacctgattattatgtagccctggaggaatttgatcatgtgatatatctctaggagtttggccttttacatttactacatttagttgcacttgccgattgccaaatagcgaacaaaa

SEQ ID NO: 37221 - DNA, 1174 bp, Oryza sativa
attgcccccctatcggcattggctagaactactccatcggcttgttagctgatcagctatttgatctgttgtttacatatcttgtcagtttcatgatcaaacagactctctcgtccacatctcatcaatttttggacctacactggagctaagcagatctcccatgtcgttgttgttgttgacttagttcgcgccaacagttctgacataattggccgagtgcaactagtcgcgtttgccaaaatcaacctctatttgtttcatactgctgcttaggagagccgcatgcaaaaatcaattttcgcaaacagggctcttaacagactcgcatgcaaaaataagtctattttcacatatggacctcttagtggcctgtctacaagtctaaccgtgctcccctttccctctcaccatcttaaagaaataaaaatctaagtcacctcccctctcatttcctcttctactctctccctcaccttaaaaaaaactctctccctcaccttcccctcccaagcggtgggcgggagtggccggcggcagcgcgcgcgcgacgagagccagcaacgatgacggacagtgagggtggtagtgaaggtggccctgcccttgtgggcggcgatacatccagaggccggccggtcggccagtttgggggggggggcctcagcggtgttggatccgacggtggggagggctgcagcgacagagctcagatcccatggtccctccacccataacgacgatgacgacaacaaggacagcgatggaggctttgagcaatgacgacggtggtggcggctgcgagcttctagggctaggattttggtattgtcgtttccttttcgcagacggacgatttaactgtctgcctttagccgcaatgcaaaagtttgatttttctcataccttttcgtgcatacggctagagaaactgcatgcgaaaataagttttgaccatacgcaaaaatcagtttcgtagtaatggatggccgggcgcggaagggaagtggggaatgcttgatatctttttcgctggtcgtttcatggagcacgtgatgcacgtggccatgtgggagagaagagaggggcaaagagaagaaagggggaaggaagaagagggagggggcgcgaactggcaaagccagcaagccaggcgataggggcatgcaagtgg

SEQ ID NO: 37222 - DNA, 2498 bp, Oryza sativa
  unsure (1)..(2498): unsure at all n locations
aacatggaagacgcaacgacgacgatggttgtggtgatgccgtcgatcaacaacaacgacaaagtcgacgaacaagacgcggtgctgccgccaccggttgcggttgcaggtggcggtccccaacagcagccgctaaccatgcatccccggctgttaatggctgcgcgcaacggcgatcacaaggcgcttatgaggtgcagcggcggccaccacatcacatcatccatatgcacgagggagctcctgcaccacctagcgctcatgtagttgatgaagaaggtcgacaagaagtttcagtggaagacgatgcagatggtcatcagcgttcaaagtgcactgatggagtccctgcagcgccgcaagcatctgcggccgatgttgaagaagactctgttcatcatgaaaacatcagcaagctaatctcaggtatagcattcatctggattaattatctgggctaagagttttcagcaatttatttttcccctgcctctctagtgtacaatacaggtcaaaacaatttgacgaggttaaatatatataggtataacaatttgattcatacctatagctaccaacanaacaattcaaattcaactttatttcacaatccatttggatactatatatatacctagagtcaaaatatgactaaacacatacagatttagttcaaacttgtttgaactagtttgccaagaagttaatgctcgtactttaacatttcatactcatttgaattgagtatatactcaatttcaatcttggtgctcgggcaccatggtgccccagttaattttaatatatatatatatatcctatatatacaagtttttcgtgtacaccaactagcaaatatcacgaaaattctaaaaaaaattcggcatttactcctaatagtattacacatatatacaaggaaaaagtccaaaatacacctctaaactgtagatagaagtccgtatatcactttgaactgtaaaaccgttcatattacccctaaggtggttttgtatatatatagtggttttatctaatttgtatataacttggatgagtttgatcatgtgacatacacattaaacatatatatatataacccttcacttaaatctttctttgtaattacttgttagctctcatttataaataagtaccaacataataaaagcatggtatcattgtataagtataaattaatgacttataattgatgatatgcaaacatgctatattagttatttaaaattgttcgtttaagcttgtaaaatatgcaaaaccactatccaaaacaacccttaggggtaatatgaacgggtttgaaaagtccagcgggttaaatatccagtttaaaggttaagatgctagctgcactttcctccaaagtttatggggggtatttggactttttcattcaaatttattatattttagccaaaaaaatggtgaaaaatctaacggttttaaagataaaaaatgttagaattttgtgtttttttgttatggctaaaatataatgaatctgaagataagatttcacacgttggtgtaatactattagaagtatgtgtccaatttttttttaaaaaaaattctatgatatttgttagttggtgtgtacggaaagcttgtgtacatatgatatattcctatatatacacttacgtttcccaaaactgtataaagtctgaaaacagacgttatgcacgcaggtttcgtacctccggctctgggagcgccaattctagatgaagtgactacctacgatggagactccgcgctgcatgtggtggcagcctgtgctgacaccgaggactatttgaagtgtgcaagaatgatatacaacaaggcgagtcgcctattggatgcgatcaacagcgaaatggacactcctctgcactgtgcggttagagcaagtttaatagtatacccaactattagctccaatttatctatagctaatataatagctcattaatacaatagttacatactacactattaatatttggtcctacttattatacacacactgtgtcttggagtctgtgctacagctggctataaatctgtagcccgctattcttctctctcatcatttaactgcttaaaatatatttacagctggcttatagcttgctattatacatgctcttagggctgggaacattggtatggcttcttgcctcatcgagttggcggcaggcgagcagaattatcatcacggtgcacggtggaaggtcaaggatcttctccgaaggatgaataaacatggggagacggtcttacaccgcggcgatccgcaacggtaataaaatgttattggagaagctgatgtcggagggatccagaactagtatgcgtcccaaggatggcacatcaccactagaccttgccattgcattaaggcgttgggaccttgtgttcgaatcggagttgcttgttgcaagttttaagaagttctcttatttcggcccgtgtggacaaaatgtcttcca

SEQ ID NO: 37223 - DNA, 476 bp, Oryza sativa
agagcagaggcctgaacggccgcatcgaggccggccagaccgtggcggcgtacggcggcgccggcatcatcgtgatgaacagagcagccgaggggtacaccaccttcgccgacgcgcacgtgctcccggcgtcgcacgtcagcttcgacgccgggaccaaaatcgcggcgtacgtgaactccacggacaacccgacggcgagcatcgcgttcaaggggacggtgattggctcgtccccgtcgccggccgtcaccttcttctcgtcgcgtgggccaagcaaggccagcccgggcatcctgaagccggacatcaccgggcccggcatgaacatcctcgccgcgtgggcgccgagcgagtcgcacacggagttctccgacggcgtcggcctctccttcttcgtcgagtccggcacgtccatgtcgacgccttacctgagcggcattgccgctctcctcaagagccttcacccggactgg

SEQ ID NO: 37224 - DNA, 751 bp, Oryza sativa
gcggcgatccgttccacagctcgtatggtgtcttcccaccaatacttttggatgacgacctgttcaggagataaacagctgtgtgactgccttcccccaaaacatacctggcagccctttggctttgagcatgctccgcgccgacccgaccaccgattggttgcaacgttccacgacgccattttgttgcggcgagtagggcgccgtcgtctcgcgtcggactcccagctcggcgcagtaatccgcgaagtggtggaccaggaactctccccccctatccgtgcgaagagcacgtagcttcttgccgctcttgcgttcagccgcggcttggatgcgcttgatggctgccgccgccccatccttggaggggagcagtgacaaccacatgaaacggctgtaatcatcgacgagaaggagaaagtaccggttgccgctcggagttggtggcgagatcgggccgcagaggtcgccgtggagtagttggagcggctccagggagcgctgttgagcctgctgtgggaacggcgtccgacggtgcttgccggcgaggcaagcctcgcaaagctggtcaacttgcgacacagccggaagaccgcgcactagctgctctctgcccatttgccgcagcgcagtgaagttaatgtggccgaaccttgcatgccacttccatgcttcgtcgccgatgcgtgccgtaaggcagaccgggcgcgcgagctcgacgtcgaggacgtagagacgtccaggattgcgg

SEQ ID NO: 37225 - DNA, 1200 bp, Oryza sativa
ccttcctacttaagcactaaaaattatggaaccagatccgatgatgtaatgcagtacatgcaacacaaaggagaatgcttaattcgctgatcacttgggagcatccaaagccttcatcgaagcggcatgcttaacggcgaactcgaccaatttatcggcgtcaggcatggcgtccaccacggccggatgcgcgcagaagcgatccgcccaagcagacaggtttggaaccttcgcctcgtcaaggagctcgacgccggcgaacttctccaccgccttaatccatccgaggaacgacccaagagcgatgtccaggtagccgattttgtcgtcgccgaagtatttcttcccttggctgcacttgacaaatgcctcctccagatgcttcagagcggtggacatttcaaccacggttcctctccggccacggttcctctcaacacgcgagtcccccgaggaaactgcacacaaattatccaagatgagagcaaaatcatccggctaaaaaggattaaaaagaagaaaaattcagatgaatttgcagtttgaggacgcgcgagactgtgtctgtacttaccttgtcgtcgatgtactgtgcccagaaccgctcgacggcgcggcagtatgggtcacggggcagtatggccggggcgccatcggaggccggccagacctcgtcgatgtactcgacgatgatgagagactcggcgaggggcttgccgtggtggagcagcacggggatcttcttgtggaccgggttggaccggagcagcagctcgctcttcttccccctcgtctcctgcaacagctcgtactcctccacgcccttcagcttcagcgctaccacgacgcgcatcacgaacgggctcgtccaactgccgagcacgcgcaccgccgccgcgggctcggctgaaccgctcgtcgacgacgaggacatttttactcgatgtggccaagaaacagaagctgctggtttactcgagttcagtgagcagactgaagctgatgtgtagttgtgcactagtttagtttatatggaccgcttttttcttactacctccgttccattataagtgcagttatggtttttcgcgcctaactttaaccgtccgtcttatttgaaaattttttttaaaaaaattaaaaaacataagtcacgagtaaaatactatttatattttatcatctcataacaataaaaat

SEQ ID NO: 37226 - DNA, 1230 bp, Oryza sativa
  unsure (1)..(1230): unsure at all n locations
tgacactgtatcaagacgcacatgtgcctgatggttgtctcccggatttctgtcttgatcacggaatgcgctatcagcacgggcagtgttggcgtgatatctacgatgctatatgccaagcacggcggttgatttacattgtgggatggtcagtgttccacacaatccacctcatcagggaaggagttgagaagatgccatcacttggggaactgttgaagatgaagtcacaggaaggggtgagggtgttgcttcttgtgtgggacgatccaacatcaaggagtattcttggaattaagacggtatgagttattcattgagttcaaaattgctttgttcatgacttttacaccgcacacgagaacatgattttgtgtccaaactccaaactgcaaatttataaattgaagtgctgcaatgtttatggaaaaattgggaaacattggcacttgaagattgtctaatcctcaatacacaaatacaaaaaggcatcagaaagggcatttttacaactgctgttatcacattaaagaatttacaaaacatccggttgcatcaatataacattgagaggatcttcatcaagctcatctatttcctccaaatttttctgtaatagtttggtagcttgtcctttaggtgcatgtaccttatctttggtcccatgtttcatgatgctggaaagtttgaagtagattatgctgcttatccacttgtaggatggtttcatgggcacacgagatgaggagacccgcagatttttcaagcactcttcagttcaagtattgctttgcccacgatctgctgggaaacggcacagctgggtgaaacagcaggtattgtgatgccacacaaacttatccattatgatattccatttttgtttgtcacctaaattactacaattgattgcaccaagtgagtggtttcaaactttttatatgtctactcttcatgcttggaagttatgctgtacttcacaatcgctgttccttatacctgatcaggaagagaaatttgatattcacataatgcacacatatatttgttgttggattcttttgtataatggcatttatcaagcaatcttgtattgtattaattcttttagtaccatgtatttatcatatgatggtattgaaattcaggaaacaggaaccatttttactcatcatnnnnnnnnnnnnnnnnnnnnnnnnnnnnnnnnnnnnnnnnnnnnnnnnnnnnnnn

SEQ ID NO: 37227 - DNA, 2965 bp, Oryza sativa
gggctccccagcgtccccgccgacacgatcacctcgttcttgtcgccgtcgcggaggtacacccggtgctgcaccccaagcgggtccgagaacaccaccccgtacgccaccgggtacggcaccccgtctgcacgccatggcaaaagctcgccgtcgtgaggtcaagcttcttcggcgcacagcacattttccattttcatcgtagctgtgtaccttggcttttgaagaggatacgggagacggtggcgtagaggaggacggtgaggccgcgggggcgggcgtggcggagaaagtcggcggcggtgtggcgctggccggagttgtcgaagatggtgccgccgatcttggtgccggtgacgtggtcgaaggtgaagccgttgtcgggcgtgacgccgacctcgagcagcgcgtcgcggagcgccgcctgccacgggggcacgtcggggcggaacaccagcgagcgctccacccaccggtacgacgagttcaccagccgcgcgtcccacccggaggcgcgcacgtactcgttgctcgcccgcgtgtagaacccggcgttgaggcagctaccgccgccgagcacccgcgcccgggcgttcaccacgccgtcctccgagatgaacagatgcgccggtgacgccggcgacgtgtcggccagcgcgtccgtgaagtgctgctcgctctacatgttggcgtacggcagaccgccgcgctccagcagcagcacgcgcgagtgctccgacagcgtcgccgccagcgggcaccccgccgtgcctccgcggatgacgatgtagttgtagctgacaaccagtggtgcgtcctgcgcgtgccgcacgagccgtaggttctccagttgctttgcacaacgccatcgcacgccatgaacacgacggcgacgcaacacgcatcaacgcaaagatacaacgcaacgtttacgcaccttgctcttccgagagcgcggcgaggcagagcgagaggagcgcgacgacggcggcggcaagcaccggcgccgacgagctcgcgcggccaagtgctgccattttcgccgggcaaattcgctaactttcacattcccctgggacgaaacgttcggtctgtttatatatccggagttagctcaatggtagatcaagagtagatgtcttgaataatcttgcagattgctttgcactgcaaagaagatcttcgagcagctttgtaaattgtggagccctgagaagaatataacatgcatgcagaagtgatgagctgatgaaacattgatcaatgatctgatgtggttgtgagcaagcaagcaggagagtttacttgccaatcttgcgattgtttcgaacgtgctttgatatttttgccattttaaaatcataatttagtcgttgctgagttatttttctgttacgagacagtcggggcaggctggatttcaatggtttcttcttgatttattaagtcgtaaaagaagcgtaattttaatgagttgggtcagctcttgggcaagattatgacggtgcttaccatgtatgcatctcaactaaatctgataaagccccattgaaacggtccatttgtacaaaaaaatattaaaatattaggtgatttaattttagagtaaattttactatagacgaacttttattagcgatgtttatcaatgttctcactttataccggttattattcttacccatcctcaactcttttatccatatataacttgtcatataccgatgaatggttttacatatatatgtgagagtttattgatgagtaggagccaatgtaatcgagattgttcatgctcgagaagagagatgggtggtatgtggtccaaagtgaagcatctgtaacaaaaggtggtccaaatgaatttgctcttaactttaaattaacttcttggcccattgcagttgtattgcccaatggtaaagttgtaagttttaagacggttggtttctttttttgtgttttactcctcctccttctttcttcgtcttcggattgctatacgccagtctagtaaaaaaaatatccatttccctaaaccacattcgattgaaaattaagaggaaaatcttacaaatatctaacctttatatctacctcacaatttctgctctctgcctctccaacaatgttgattatgtccagagacattgacagtggtctgaccagttagagagagcataggttcctccgcttagagtgaggctaaggagatagcggcctgatggtggacggtggcattgggaaggcaacgagatgacagtgacgccgtcgtagctacgaggacaatggatagtggttatggcgagagaatcccgatcatgtaattaggtgatggtgagttgctcgagacggaagatgagaatagggtcaggcacctcgctagattggttaggtggtggtggtcatgaattcagcgacaagaccattagagacgaggaagacaacagcgtaaggacataagaaatggtgatggcacatgagaagccatctcaaggaggatgatggcaatagggatggcgatggaggtgcttgtcggcgagcatcaccagcgttgagggagatgccattgaggctaaatggtggtggtgcagagggcatgattggttcagcgtagcacagggtgaggttaggaggagcgatgtggaagtggtggctagggcttgactatttgtttgtattggagggtggagataaaatgtagattttagatgacagatcttgcgattgagaatttgaaaaatctggtgggggattttcttactaatattacttggggttatttggttagttgcttcactttgtaatgccacattttgattatggcgtagttttctaggtaaatgtttgcttcgcccccacacctttttagccttaggacatagtatatgttatactactccctccgttcaaaatatattttagtccaatttatagtattgggttgagtttagtgtcatagaaa

SEQ ID NO: 37228 - DNA, 15001 bp, Oryza sativa
ccgcacttttatcaacacgccacaattacggcaagcttgcttacgcatctaacaaacatcagtctcagttttttcttttaccaaccactgcatcagttcacttcaggtaaccaactgacaactagcctctagtataacggaatgaacaaagcacacacacaccaggcaaggttgcctgcctaactactaccactacactactagccacttactagccagtagccactcgcagcgtcctctgttccagtacgtgtggttctggttcatcatcgtcaaacgaagcaaacgacgacgaaacaaactcccggatacggcgcccttctttggtcagaatctttcaaacttcaaagcaagaaaaaacacaaacaaacaagaaccatctctgcattccgccatacattcgcgtcgatcggtgtccactgtacaggttgatcgatctctcgatcgatcagagatagatcaacgcgttgatcgatcagcaagttcagttcagttgcggcggccggggcgcggcgtgatcttgatgacgaggccggggaagacgtcgtcggggtcgtggacgtgcgggttctgctccaggatgtacgggtcgccgcacctgtcgctgatgctgtgcagcgtctccccttcctccaccacgtatatctcctcgcacggccgcgccgtcttcagccgcgccccgcgcaccaccaccacctcctcctccttctccaccgaccccaccagcagcagcgccaccacgcccagcgccaagcaccacgccaccgcctccgccgccgccctcctcctcctcctactctctcccgccattgccatgcagctagttgttcttgcctcttctctgctttggttttggttggtgcttgagtagccgggtagagagtaggggtggtttatatagggtgagacatggaagcaggtgagattcagagagatggctccggtgttagcacttggcatgggggagaggatcaactggagaaatggatgctgatgtgttgctgtgtgctataagtgctcactgatgagtgctgaggcctgacagaaattgtattttttttcttctttgacatttttaaaacctgatgaatagttgatgatttctggtgcagagaattgattggtgagttatgggttcagcgtatctgttgctgccatcttgttatatactactagaagtatcttaatttttatacgtacaggtgtattcaggaatcaggatagtatctttcatcggttcaaattatccagaaaaagtatctatcatggtccacaagtaaacatatgcatcatttgacatacacaggacaagggcataaaaacatggcattaggtaattgaattacctggctcacgtgcaataatccgcatttgtgatctggtgattacctttacctttggaaagatctttaaacgtgtaacagcggaagacagagcagcagcagtacactgcaccagtacagacacctcacaacgacaaccgattcaacgaagcgcacacatgctcccgattggttgcgagtgcgtcgacggaaagcgccgcaacgcgcacacacacagacgcaacagcaacgcaatcacgcaacgtgattccatgtcatccaaacattcgtgaacctaaactcgttgtcgtcgaggagaaaaagcccttgaagatggtagtttatctcaacaggcaggagcagaattggcacgatcgatgcccaaaaagtcctacaaagcagcttcttttttgtgagctggtgctgtcctttgtggccatggaaacaagggcgacgtagtggtgtgattttgttattgctcacggtcactagcccgccttctaaatcttcgcgtttgggatcatgtgaacatccgtgagctggacgacgaactagtttactgccacttttgtacccatcggacgaaaaaattactacaattggcagtaagttgttgcctccgtctcagctccaaacccagataattctgaaaaacacctaattagcaattttctctgaaaagcttgctttttgattcattttatagatttcataactataattttctatatttaaaatgaaaaactaaatcattgaaagagtttctgattctgaaaaaaaaattacagctgcctgaagctcccaggcctaaactccaagcagcacggtgcgcccgtcagatcgccagtaaaatcctgtgacgccgtgcagcgcacatgtactacacgagttgtactgtactgtaccgacatgcgcgcggccgggccacgtaccgagttcccggctcgattcgcacatccgcccgcctgccacctgcgtcaacgacacggccacccgcccacctgcagtcgggcaggtgtcgcgcgcccgcccgcgcgcgcccttccacgtacgtacgcgtggcagtgcaacgatcacgtctcgtctttccgcttgatttggaccgaggcaccgaggcccccctcgcgcatgccatatctcgtctcgcgtcggcgacctccgatccaccgagcgcgcgcgcgcgcatgcgcccgcatgggcggggagtggcacgccatggcacgggtgcgcgacaacgacgacgacgaccccggggcggcggccggcaaagtcgtttcatccatgcatgcggatgatggaatgtatcgatcgatatttgcgcttttgatctgcacgatcgatggaggagtacgtgcgtgcgtagagcagataaataacagactataaaccaactataaacacattttgatttcgagtaaataaaaaaaaaaagaagagcagcgggctatatatttatagtcagctgtagcacgaattctaagatacaagtgcgtataacatgtgagattagatattaattgtgtagaatatgtttataggtaaatattatataaattgactattaagttaattataaatgatttaaagtcagcagttggctatactattaaactcgtacgcacgcaacgcatatgcttgggcggctttcggaattcggaaatcggaatcgcttttgcacttttttgccagtgtatgaacgttccgcgcgcgggtgatcgatagatgttgctgtcgtgcaccatttgctctccatgcagcgtgaaaatggaaaggaaaggatgggggagggtgatgactgatgagaggggggagatagtgggttaggccggaggcacgtacaacgcctatgtatgattcttttaattatgtcatatatgatatcttttgtcatttgtcaccttttgtatcatatcatacaacgcatggtcgattgttagtcagggtgtatgtatccctctctgtcttcctatatcttccttttcgcgaatgggaaatttctgatgagaaaagggaagaggtatggtttggtgtgtaatgtttgctgacaccgttgacatagtgacggtatggtacagcacggagcttaaaacgcaatttattcaccatagtacatggcctacaataatttcgacttatataaaaatgtcattatatatctaaatatcattcaacgaaaggtcattatctaaaaaagatctttcaacgaaaaatggagtaaaaaaatttagacggaatatggagtaaaaaaagtacactaggaaagttaattacaaaaccatattggtgttaattagaatataatctctctctgtcccaaaataagtgtagttttacattattcatgtgtaatatttgaccattaatcttatttaaaattttttattagtattatttttgttgttgttagatgataaaacatgaatggtactttatgtgattaattttttttatttttttaataagacggacgatcaaatgttggacatggatacccacgcctacatttttttaaggatgaatgtagtaactataatataattacaatataggtacattgtacctttaatataagtcaagataaacaatcaacacgtctggttgctcagttggtaagccttctctttgaaacacactttactctttttcttcttagaggcagtagcatatggatctcaaacacattgtgacatttttttaataaaaaaacagtaaactgcacgaccaagccctagacttgctcactcgtattatataggtcctaaactcttcaaatacatttctacatcatgaacttggtaattaaaatgtgacattagatcctaagttgccacggcacctgcgggatcttatgtggtgacatgatcatgacatgccacatggccattgcctctttctcctttttttcctttttcttcctctttcttccgttctttcattcatgtttcatatatggtggaaaagaaaaagatgaaaaaaaggaaaaggtagagaagaaaaaaaataaaaaggaaaatttgttattgtaatgttcatgtggcatgtcacgtaggatccctgagatattgttgtaattatagattagaatgacacactttaatattttcgaatattaaaaaaaatactttaagagttaaggatctgagtaacatggatgaatagatttatggatcaaccatgtaatttactcgtaaaataatataggggtagaattatagcgaatccgtttgactttatagatagcaacatactccatcagtctcgtaaaaatcaatttaggattaaacaagatatatctttttactttttatactaggatatgccctatgttggtttctatgaggcggagtacgtacaccgttccgctggccggtaggcaaaacgcgcgtgacacaagcaagtggtactctaactttctgtactggcaacgggtatggtttgggccagcggtcagcctagtgtgtgatcgtgctgggcttgtagcgtttaacatttcattcagggccaggttggcaaactacaatgacccggaggcccacatgaacacaacggagggggcgtatcagagaagaaggcccgagacacaccatttattttgggtgggctgcatcaggcattcatcagaattgcagcctctaaaaacaagaattccaagtgaatagcacaatatcttcttctcgaacagaaaagtgaattatatattgtgccttctcaaccgtttccctgtgacgacgtactaaaaccaaatggaaatgtcaagtgcaataattagggactatacagtacggagacacgcatacggcttccaaaaaacttccaaactcttaagtcagagagctgacaaatttgccttcgggacccattgatcactagtgagcattaaatttcatttctataacaatagtatcttgtaattttttcaattgatccctcaagtactcctccactactaactacttactaaggtgcattagacaatcgcgacaaaacattcctttaatcaactttccctttctttctcaacatagttaatgttatcaagttcgaatgctaaaactaccaatgatgcatctttactggaaaaatttagataaaactctagaataaaaggtgacctgatgggtctgctgacgttgatctgttacatgaacataaacttatccaattatctcagttcaatgtcagcaattaagtgacacatgacccaatcattttcatcaaccgatctaccaccactactactaccaccttcgcaataacggcaatgacaccccggctagatcgatcggacggcgggcgacaacttggtggtgcacatagggcgcaacagtcgccgtccgatctgatatataggtaaccagtgtcaaaacttttggctaaagtagcagtagtagtagatcatggccaatggggccaattgccaaccaatctgatgattctgtactttggtagtcttggctccttctatatttttaagagagagatgaaatggatgtttcgcggctattctgtgagttctaaaattcaatgagggggaggggggattctacacgattgagatagagatgggaaatggatgtttagcatctattcctttgagttctagaagcatgtatttttgaactgatgtttaggattaacttttctttatcttacaaatgtactatgagccttcattggcttgaatgttgtatcataaagtacaaaccatgaactcagcgtactatcatcaatcaataatgaacctggctgatttctcagcttgccaataacccattgaattattgagaatggttgaatatagtgtttcgtcaacaaatacgctgtcctagttaggcttgcctaaattctctacattttctagccatcctatcctggttgtctgccctatgaaaccactctctacagtattggattcttcacaagaacaggcttgggtcaagaacagactcgatagaaatcataattttcaagtcaaaaaagaatagtaaaattcataaaaccacatattctctagcagaactactacgcaactacagatttaacataaatttatcatgcaattacatatttttatagaggaatatgacaaatttgccaattatgacaaaacaacataagttagagtttagattctttaacactatggttttgctgaacctaataaacaatataggtttgtgataaatttttttattaaatatgtagttttacagtactatgtagttctataaaaaaagttgaaaactaaacatatagttctgcgatacaccacttaagatgtagttttgcctgtcgcaatagtttggctaaaatacatgtacttttacataatttacccaaaacaaaaaattaagtgtagtactacaaccgtacaagcgaatgatccaattcaagcaaatttggggtgcttttctgcttgtttccccccaactctccagtctccacacaaaataatgcccctgatcgttttgtttatctttaggccttttagcagctcaccctcctcacctcccacgagcctcctcgcggcgcacaaaaacaaacccagacacacaaacaggcgcacacatccccatagcccccaaaaaccaaaaaaaagaggagcaaaaaaagaagagaagaagagaaaaaaaaaatcccacgccgcgttggctcgcgatcccctcctcccccctcccctgtcgatttgctccccggtggtggccgcccacgacgaacccccgcgccgcgcgcgattcgatcgctccttccggattctgctcccggactcggatctcctcctcctcgtcgagctcctcccgccactgcccgtgtaggtctacctgagtttggggggcggagggggggaggggagggggaggtgatggggattggccgggcgcgctgggtggcgctgcttgtcggcctcgcggcagcggccgtggtggcgacgttgggtgcgtccgagggcgacgccgatccgctctacaggtatgtagggctcgtgactccgtggattctttgtccagtgttgcgacatctcttcaaagatttggtgatttggcgaggcttgtgggggtgtgtgtgtgttttacgtttggttcgaggagctgattgcgtgtgcaatggaatcagcgagggtgtgtggcggtagtcgttcttaggcatttgctcgaacacctggtgctcgttggctgtagagcgcaagatttggtttggcctcaaagcatgattcgcccccctgaatactggtattttggtcattgatttcttatgaagagattgcaccaaggaagctaaactttttagaagtaactcccaatgtgtgtgtgctcttttgattatctaacctatatccatgatcatgcgtgagaaacaaagctttgtagggtatttcatgaccaaagctgggagatgtgacctcctgatgaagtcctgtgatttatacatacaaccttagtatttgaatccgtacataaaaaaactgtttagttctctgttctataaacatgttgggatgttgaaggttgaactgatgagcaatgacaagctaactgcctgatttgtccccaacttgtacagagcctgtgttgacgaatgcgaaaagacgggttccctccgagagacctccgtgaggcactgccaagttccaactgatgaccatcctgctgataaatcatggtacgcacatgaaccattgtacttgcagtggaaagaatggaactgcaagagtgaatgcagataccactgtatgatggagagggaaagtgaaagggagcaacttggattagggtcagttaagtatcatggcaaatggcctatgaagcgtgcatctgtgtttcaggtaatcaatcaatcatgtactaattaattgcttagcttttttataaacttgatctgtctaggcattcctttttcagttctaccttgtgtccttcacctatcactaattgcttttttttttcccttcttgcaggagcctatttctgctgctctttccgcgctctctctccttgtacaatttaatgggtggctatcttttttcctcctgctttcttacaagctgcctcttaggcctgaaactcaaatgacatactatgaatacactggcctatggcacatttatggtcttctggccatgaatgcatggttttggcgtgccatctatcacagttggtaagcccaatacattgatgaaaagtatgattccagtatatgtgtttgatcataattagttgaacttgattcttccattgcttgcagtgatacagtttggacagaaaagttgtattattcatcatttgctgcttttattgggtactcccttatcttggcaatattgcgaactctaaatctgaaggatgaagcttccagagtgatggtggcagctccaattctggcattcacaacaactcatattttgtatctcaatttctatgaacttgataaaggtaaattttagctggacatgatattgaacttttgaaaccattttacttattataggtttttcatgatgaatgcatcattcctgagtcatgacttcctgcagataattgaaatactgtcttgccaatcgatctgtatattttgtagtagtgactagtattgcttgtaaaacttaagcagtagtgaagttctgagtaggtatcatgttgctctatttaaacctgttactgtactaatgtcgaacctgcactctacatttctacactcagattatgtaataaactattgaggatctacctaactgttagaaaatatttgtgtgtcaatatttcagtaggtatgtgttaaaatgatattgcgtaaccttttagaaagtttacatctatgtatgctgatggttccttttttttttcttttcttttgcaggcctaaacacaaaggtttgcactgctgctagccttgctcagttcctcctatgggcagtatgggctgtcatgacaaaacatccttcatgttttaagatcttgtttgtcattattggaaacgtattctcaatagtcttggaaacctatgacataccaccacgttggggatatgttgatggccgtgtattttgtgttgctatttctattcccctcacatatctctggtggaaatttgccaaggaagacgctgagatgcgcacttcaacaatcatcaagaaaacaaggtagtgttcagcacaagtgaatagcacaaggatttgagcctatgtgaaatcttatgctcgagattcagtcttaccttgtaaaaatttgatcgttcatgttctttctaggcagcttgtgaattatgtttttttccatccctttttgcctcagctcagaggtttagggttaatgcttagggtgtgactagtcactttatattcattttcttgtaatcccgacagtgtaacacggtatgcttgtagctgtggtaatgtaacagaggaacgtagattcgaagctttctgaatgtatcattgtgatctgcatgcctaatgatcaactctagttcatccccaagcatgtgatgcttgtgctttgttggtccctactttgcttttttctctttttccttggggatgttgttcatatctctgtcacccaagagaacatttcatgaatgccttttcccctttacacccgacacgatgaagactgctgaaaagagaatttcgttacccgggttaagtgcagtctaattggccttaggttgatgacctgtagagtgtacatttacatccaaacagaacagtaatcttcttgtttccattgccactctgacaaaactatatacagatgcatctgctttattccactgcccctaactcactacccccctatatcaaccttcactgaatctgttctatctcacgtttacattacactcgatttgacaactttgacatccaaacaaagaactacttcggcaacgcaatcaggtcactcaccagctcgtgcaacagctcgtccatcgccatggccgccaccaccacgccggcctcgcgctcctcctcgccggcgtgcatccaccgccggctccgctccatctccgccatgacatcctcgccgtggtacagcacgtcgttcaacgtccacggtgttcccgtgccctcaagccaggccttggcaagtctcatcgtttcgccgttctctcgccgtctcctctctcgtaacagactggtcggtgcatgcaactcaatatttctggagctgcacttcgcctcgacgaagaagtcgaggaggagcctctcggtgacgtcatccaccacgccgaccgacacggtgtccgccagtaggtctaggaggctgtcctcgtcgtcgtcgggatctttttgggagacgccgtcgttccgatgatcgtcgtgtcgtggcggcgccgccgctacgtcgtcggtaatgcactggtgctgtactgggacgatgccggcaaggcggtcggactccgaggcggcgaagcgtgcctcgagatccacgccgctgagctccgccatgctcccgagccgtcggatcttgggctgcagttgcatctttctccctgatccacggtaaacggtaaaaatatactaatgagttatacttcaagtaagtcgtaggaggctagaagcagcaagtacttgttgaccccatacaatttttaatatagagtttgtatatacaaatataaaaaggtaaaagggatagagttactagtagctagtaactttacttaagcatagagttcttttacatggcttagggatagagtttagtagcagaaattatttattttgagaactattagaaagtatttaaaacctcatttcaaaaagaaagaaagtgtttaaaacatttagggcttgttcggatcgtaggataggaattcagctcacatggaaaatagatgatcgaaaacatagaaatacaggagatagaatcgttcggagtaaaagattatgatgtgacatgcactctatttattaggaattttttcaagaaatctcacctcacctcatactaagaatcttatgaaattagcttgtaagattacaatccttaggaattttgtgggatccattcttatgaaatgaatgatgcatatagaaaaaaaatccaaggaatttaattcctacaatcatcttatgaaaaacctctaaatcgaatgagcccttagtgaatagtatttcccaaaaataatgtggaaaccctataatcctaacaagcccttaattaaccaatcccaaatccagtaaatttcgagagtcaaatatgctcaatcaaccaagataaaaaaaaaagctgagaaaaccactggcctagtatgtgccttttgtggccatctccgacagtcactggtcgggtgggcccagtaggatctttacacgatccgggatttccgcctttcccgggggcccgtatgaacagtacaaaaatcggaacatcttcttttgtccatgccccgtttcgtgtccgagcaagagacagaaacagagcagattccggttcggcactagcactaggcgacgaacacctcggacccgtcccgacccatctcatctgaagatttgacaccattgtgtagactacacaacactactatcacacagttaactcgacacgttatgcattttatagtacgtaattgtcctttggttttaggataaactttggtttgtgacagattcttcagaaaaaggatgagtgtacgtgttcagttcaatcagtttgcttactctggagctgggcgaggctgtcgctgaaagagaacgagcacgcgccggcggcgaccctctcgtcctcgtcgacggcggcggcgtcgtcgtcgtcttcgtcgaaggggaagtccatgacgcccaccggactgagctgctccttgtcgtcagcctcctcctcctcatcctcctccttggatcccctcttcatcacctgcatcacaccgtacaccagcaatcatccaccaattttgtctcaaccacacaaccccattttgtcatctcgtccatttctaatccacgacctttcgccacggcagcgtcagtccaagcgacgcgtctgtagcggcgtacggcacgacacatcgtccggctttcccggacgtcggctatagtgctaagctaacttgtcgtttcagcgataacgatgctactatcagcatcaccgctgaaacgacgagttggtttaattttagttggggcattaaaccatgtggccgtcgtgtgcacatgcagagagcggaagctacgcgaggtgagggtagagcgtgccatgcacaggacactggccccgctgcatcatgcttccggacaagcccgcactaactgtgcaacggcccgctttgcatttacgctttgcaaccactgccccttctggtccactgagccacagagctactgctcatgcatgcacagcaccagcgagccaaccacaccacagaggcctctaatctctacgaataattaattagtggtatcatctgcaatgctacttctatccttgctgatcaatggccgtaaaatcagtagccaggtacaaccctactgattgatcgatcaatgcatggatggacaggtcatttcgaccgatctcgatcgatcaatcaccacaattggagcagcagctagcacagggcagtagtagtactacgtattatcgcacatggtacacgaattactactgtactactctacaccctgtgtacataggtccatgtttggctgtatacgctcatcaatgcaggagtcagtagctagggctcccctttggatactcgtaacatgaacaagtcaggagattatccgaacaatcgagcaatccatgtgttggtgaataatggatcgctgctaccgaatgaatgtgcttcggttgtggcatttaatcgccgtgggtggggtctccgcttcgatcgttaattggtggctaatcccacttcgccctggagtttacgcaaattttggggcactaatgcaactaaacccaagctaccagcagctgaattaacgcccaattattgattcctcatcaaggttagtgagtgagtgagtgagtgattgagtaggagagaagtgaggttgatggaatggttgattacctcgtggtcggctccggtggtggagggctcgccggcggcgtggaggctgtcgtcggagctggctgacgagatttctgagtagtcggagtgggagcgcgacttcctcccgcctgtggaattgctggactcggacgtctcggagtcggagctggagctgcagcagctggccacggcgggggcggtggagctcgccgtcgccggcggcgccgcggcggcggcggcggcttcctcgtcttcttcctcgcgccgcctccagaagcctcccctgagccgccgggacaggctcttcgagaggctggacagcttgggccgccgcattgcggacgacgaccggtcggcgacgaggcggtgccgcattggcggcgccgccgcctcagccgcgccgccggcgacgcagaggcggcgagggtagcagcggaagccagcggcgctgcaggactcgcagtccagctccaggaggtccttgagcctcagcggcttactccctcccgccattgccgccatcccagactcggatccgatgacagaacgagcaatgcaatgcaatgcaacgcagagacggagacgcgagaggtagcaagcgcgcggtagcttctccgggcgagtaaagaaatgtgcgtggggtttttgatgtttttggagcttgtttggatcgacgcgagagcacgtacaggtgagctgcgggttgtcggttgggagatgcagcgagcagcgggcagcgacggtggtggcggtgggcggagcggctgagctggggagagtgggagaaggaggaggagagagatcgcctgctaaatacacgctcggctcagcgcggcggatttggtttgccccgaggccgaggttatcgtggcgtttctacctgctactagtactcactccatgggaggcgcggtggctacgatgtaggagtacgagctataggagtttttatggtttggtcgctgcctagctttgtgaccaaacgggagtaggagtagcttggaatgacgaaaccggagtgagctttgtgaccaaattaaagcagtaatccctcagtttcatattataataagagcccctttgattcgaggataggaaaaatacaagacgtgaaatagtatgtttctcaaatcctacaggaatcaacaggaaagataataggagctatttgatcgtgctatgagaaaaacaaaggaaagttcacgctattttttctatgaaatgtgaagcatatgaatacaatcctatagaacttttgtttcttttctatgaatcaaagcaacatgtaggaaacaaatctataggaatttgaatcctataaaaatcgtttgccaattatatgaatcaaaggttcctaaatcgttttgattttttgttaaacttttttggtttgatcaagtttattgaaatatataataacatttttacacaaaataaatatattatcaaaatatacttagtgttatattaactaattcaatattatatatgttgctaatttttttataaatttagttaaacataaacaatattttttttaaaaaataaaacaacttgtaatacgaaatgacaggggcagtagcttggaattactaatccaatagagtaggttggcactgtctgtagtactagtactcgagggaactggataggcggtcaatgcgtgtaataataaggac

SEQ ID NO: 37229 - DNA, 956 bp, Oryza sativa
aaagttgaaggtgaaaaacaaagttaaaggtgaaaatggattttgagcaaagttgtagggcaaaattgaacttaaccctatggatttttagacttctctataattgacttgatgtgaaaaacaactcatgaaattaatgaatttccctgatatcttgtttcgcaagtagtagcgactagcgagtatgacatcactacaacgtgaactacgggagcagggattgttctcaacatgcaagatcctggtgctaccaaggttattccaacttccaaaacccggtttgacttaacaatttaaatttgaattatattatattaacccctaattagctggaaattttcctacacgttagaggatggcccattaaaacttaggtaaatatatgtagcctaatgtgcaatccactcaaataaatattattgaacctaatctaaaagttatctctcgtttcttgcatgatactataaactgaaaaaacaattagcaaaatagattaatatgaaatatatcaccctataaacatgtaacctcaaatccgatttctacgagctgtaacaaaaataacaagtataactgacaatgtacactaactattttcagtttaatttgttatgtttgttgtaagttgtagaagtcgaatttgactttggatatttgtggagcgatatatttcatattaatctatattatagatttttttaaaaaataattattatttaggtgatatgtaaaaatgagacaacgtccggtcgagagataaaaatccatctccaaactaatcaacataccaatatggacgtaacacgttgtagaatacccagttggcaacttcagcgacacatggagaaacatacacggtgcggcaacatgaactgatgaaacacggttgcagaaacaataagaggtacaggcgtacagacaaaaaatgcgaaaatatcaaagcacacgataatcaa

SEQ ID NO: 37230 - DNA, 1052 bp, Oryza sativa
tagcttggtctctgaatatggtttctttgtttatttcatgtgtaggtgactcgatgcctcgggagagtatttgcggtgatggaccgggagtcggcttggggataagacgacgtccgtggtggtcaaagatcatgcgggatacttaggctagagttgatgcacgtggttggtgaagattatatatggcatacgatagaggtattgtgtgcgtatgggatgcggagtcgaatttggaaggagtccaaattttggtatgattggttatgtaaagtttgtttcttgtactagagggtttcctaaggcgtttaggactcctagtatgagtttagttcgtggctttaggctgcttacctcgggtataaatagagggggagcgtgaggcttcctggtattgcttttgagagcaattgagttgagttttgagttagggtttcaagtttagtcgaaatttttgtaaggagtgctgttggtgcactttgtaaacacagagagaatcaataaagtcgtcatccactttaagaattcttcgatttgtgtttcaccgggtttcggtggtctaaccggcgacccaccggcggttagaacgacggcatcgcggcggtcagaccggcaggtgcaaggcggtcagaccggtgtcggcaacaggcgacaggagctgatctcggcggtcagactggggggatccgatcttgagtcgaccgacggcaaccaggcggtcagaccggcaggacaatctcggtcacaccgcgatccgtcgaattagagggtaacttttattcccgctaaaagttttcggtttttgggtataccaaccattcacccccccctctggttggcttagttattgtgattcgatcctacactaaaggcaaaaatcagatatgtttccaacggatggcttagatttcggccgagttagggtttcagccgcccttgggcctaaaaaacgcctggaagggctagtgtgtgaggagcccctttgagttcctttggtggctcctgtgctttgtgcgtgagagaatgcctttagggctttggcctttgggcgagtt

SEQ ID NO: 37231 - DNA, 195 bp, Oryza sativa
agtcactcattcctactcctctcaacatatatgaaggatatttttcttgtgtcaagattataccacacataccttgtcacttcaatgccaaggaagaagtggaggtctcccagatcctttagtgcaaacttttgacaattccttttagaaggatagtagttccatttgcagatgaattagtcacaataatatcat

SEQ ID NO: 37232 - DNA, 657 bp, Oryza sativa
ttagagatagaattgagatatcaggtaggcaaatatatcaaccaaaccagagagatccaaagagatcgaagcgatgcagccgtgaagaataccaatgtagtcgatagattcaccagggccgacggaacataggacttaccccttcgccggagatcgaactgaaccgatgtagccccacgtcaggtgccaaattccgccgattgataagtaaaacctcagaaaagggggtggcgatacgccgagagtagttgtattgatctgtgagataaattacaatgacctcgggtgtacatatttatagccatgggtagatactagtctttgtaggacaagaaagaaactttcctaaagataaaaagaaaacataaagtccttataggacactaaacacactttcctaaagataaaagtaaactaacaaactatttctaattaatagataacttaccatgccgcatccttcttgaactcggtcacttctagataagttttcttaatagattaatttccttaaccgaatatagcacgaatctgactattggcgatgtgataattctcttaggggcttaccaaatttcaccgttaacaggtgcatatctcggcgaggaaagtgagatacaccacttgaatgataatgacatgcacaatcgagcctct

SEQ ID NO: 37233 - DNA, 776 bp, Oryza sativa
caactccttgagctaaatttagtagttggagctctaaaaaaagcccatagtaagcaaaatgagcttcataattccatataaacacatgcatatcagcagcagtctcctcactgaaccaagaaggacactaaagcagtagtctagtctcccggccaagcaagaaccaaaaagcaattaagatcgaactcgagcaaacatgtcgtcgactaacaacagttcaggcgagccgccgccggcggtgcgcgtgctgggcggttgggcgagccccttcacgaaccgcgtggtggtggcgctgaagctgaagggcgtggagcacgagatgttgcaggagacggtggggaagaagagcgagctgctgctccggtccaacccggtgcacaagaagttccccgtgctgctccaccacagcaagcccctccccgagtctctcgtcatcgtcgagtacatcgacgaggtctggccggcctccaatggcggcgccccggccattcttcctcgcgacccccacggccgcgccgtcgagcggttctgggcacggtacgtcgatgacaaggtaagggcatgtcttgcgtaatttttttttgtctctgaacattttcttcttgtttcttggagaatttttgctcttgctttgatgatatttttgcagattctaccagggctttgggttttgagaggatcggtggccggagacaaggaccaaaccgaaggtgaaatgtccacgactttacagcgtctggaggaaggatttgtcaagtgcacccaagggaaggaat

SEQ ID NO: 37234 - DNA, 1655 bp, Oryza sativa
tgtatatattaacgtgtgatatatcactacacatatatacaagttcaaacttaacttctacatttcgcaacgaaaaaaataaattggctgagaatatacgttaactagttgtatttaatttgttttctttgttgcgagctgtagaagttgaattgatcgtgtttttggagtgatatatcatatgttaaaacaacgaggggacgacatcccctcgagagggatcaaaatagtttctgtttcccctactcaggtcaatgtgtgtgcgcacaattatataacggtgtgttctcacgtcagagttgggcgcactaacacaataagccctcacacattttgagcagacatcatatccaaacttactaaaccatttcggctacgatcgagaaagtgcaagcgacggctggcacctggttctggttgtggtgatccatggaggcaaatgctcctgctgtactgcccatggacgccaaactgatggtggccacagcccatggcgactgccagcagctgaaggatgtcgtgaacaaggaggatgctgccatgatggtgctggtgatggcgtcaagcaacggcacgccggcttccgccgcggcggcaagtcctccggtggccatgcatccgctgctgcacgcctcagcttcctccggggattggaagggtgtgaattttcttctcaacagggaagaagcatatgcagattcatctgttcagcccagtaaaaagtttctgaagtccctagaagcatgcatccccggcaactgcaccaacggaaggtgccgacctcgccgcaagcttttaatgacatacaagaaggtgcaaacatgccattgttgttgtctcccgagtcgcttctggagggtgtcaccatcgagggagacactgcgctccatgtggtggccacacatggggatggccacaactacttgaaatgtgttgacacaatctgtgccaagggcaagcacctcctgtttaagccaaacaataaggatgatacacccttgcactgtgctgccagggctgggaatcacgaaatggtcaataagcttattggtctagctattggacctagtagaagggaggaaagtgttgacagcatagcgaataacctgatccttaaaagtgataatctttctacagagacattcttgagcgatgatgtccgtgttgcaaataatcttacagtcggagatagtattagcataagtgaagacaatgtccacaggggagtggaatatctcagaatggaaaatgacagtaatgaaacggccttgcatgcggcaattcgcattggtcatagtcctatagtaacggagctattgacatatgattctgaattggcgctatttccgcaagaaggcacatcaccattgtacctagctatcttgctgaagcaatttgacatcgcgcggacattataccagatgagtagacaaaatattctctcatattctgggccaagtggacaaaatgcattgcatgttgcagttctccgaagcagaggtaatcgacaagttttagatgcccattctatttggttactatgttggctcttttttacttgatgatttggccaatgacacaaacctccgatggacaatcatcattatttttaaactgcatatttataaaaattattacaactataacatatgaaa

SEQ ID NO: 37235 - DNA, 632 bp, Oryza sativa
cgatcctcacaagtgttgacggccgttaagtgcaaactttaaccgtaatctcctacataaaggatatcaaatatactatcaaaacttagtggtaggagtttactactaaccacttacactagttttggtaaatatatgtatgcgggtcatttaaggagaaaatacacccgccagacgacaaaaatgaacctccgactaatcatgtacgagtacaaagattggagggcccaaaagtcagtcgaaaccgagtaaagtggggcaagccatccttactgccataagagcccaccagtaagactcctggataaagcagaaaccagaaggaggggctcaggggtcagccgaactaccactagcccctcttaccttggctttccacgtgtaggtcctagatggctcaccaatggcgattatgcccggttctcggcctggataactttcacaaccgccatatggaggctataaaaggaggaggcctcacacacttcaacacacaactcttgagctcaagtagagtacaactcacttgtagtttcaattttagtatgttggcgagtaagggaagctccagaaggagtgccccgaaatatcatagtttcttcgagaattttacaaaggatacagaggagtgt

SEQ ID NO: 37236 - DNA, 503 bp, Oryza sativa
  unsure (1)..(503): unsure at all n locations
ggcgaattcgagctcggtacccaactccgttgcacgcagtcacctcgctattcctcccccggcctcgccgccttgtccgccccctccgtcgccatccgtattccccgccgtcgccgccttgtccgcttcctcagtcgcatcgtccgtctgggagcggacgagtgtggtggcgtccgagcgagcgacaatcttgagcaagagttctggcggtagtaaaaactccgacctgggcttcggcggtagcgtcacgcacgcacgcaatgtcatttgcttggcggcggcgtctcggctcattcgtcttcttgccgtttccgatcactgtgttgtttcatagattacatggatcgattaagatcttgcacgaccaactccgacgaggatgacatggtgatcgatctatggatcggaaaacaataataccccttcacgaattatttttcctggacaaaaannnnnnnnnnnnnnnnnnnnnnnnnnnnnnnnnnnnnnnnnnnnnnnnnnnn

SEQ ID NO: 37237 - DNA, 946 bp, Oryza sativa
  unsure (1)..(946): unsure at all n locations
nnnnnnnnnnnnnnnnnnnnnnnnnnnnnnnnnnnnnnnnnnnnnnnnnnnnnnnnnnnnnnatattaaaagtttatatctctagatatttactaaataaacatgtttggtagaaatttttttaataacttacctgagactcaatctgaacattttcatttcccccgctgtcagtgacagatgttctttcgcacgttcttttgtagcagacttcatttttgggccgtagctggatcgatataaagtgcaagtatatcagacatgtgaagggttagaacaatataaactatgaattatttttttgtaaagtacctttaattttccaaactgtgttgcctggtaatagttcctttcgctgatgtccagctgatatctttcctttattgtatcacgatcatataatgcaattcgaggaaatatattatgctccaagtttagatcacctccaaagtccacgttatccaaataatggacctttgcatgaaaaattttattagtgtactcactatcattatataattataacatttagtgtatgtactgcattgggaaaaagtctatatacctgcaaataaatagagcaaccagtgatataaccacatttagtgccatcagcgtgcttcttttgaacagttgccgctgcgtccaatatctcgttcaacacatacccagaccaattgaactttgctatttcattggggtcaagtagtgcaaaaaaatatcttggacatttattgtccatatttgattgtggcgcaagaaatttcatcataacaagcattaggaatgctgttttgaaactttctttctcagcctttgacatttgccctctatggtgtttatctaatacatcctccaatacctccttgttaacgtccttaaaactagcaactttcattctttcagcaattaacctcttgacatgagaaacaaactcaacattggg

SEQ ID NO: 37238 - DNA, 14288 bp, Oryza sativa
  unsure (1)..(14288): unsure at all n locations
nnnnnnnnnnnnnnnnnnnnnnnnnnnnnnnnnnnnnnnnnnnnnnnnnnnnnnnnncatcagcgtgcttcttttgaacagttgccgctgcgtccaatatctcgttcaacacatacccagaccaattgaactttgctatttcattggggtcaagtagtgcagaaaaatatcttggacatttattgtccatatttgattgtggcgcaagaaatttcatcataacaagcattaggaatgctgttttgaaactttctttctcagcctttgacatttgccctctatggtgtttatctaatacatcctccaatacctccttgttaacgtccttaaaactagcaactttcattctttcagcaattaacctcttgacatgagaaacaaactcaacattgggtgcttgcagctcctcccctacgcaaggaatcccaagcaccttcttaacatcctcaggagacagtggcaaaacctcaccactttctagttcgatagccgaacgtgttggggatacccgtgacaaaagccagtagctgaagtcacgatggtttgttatgaggggcatatgcagcagcccctcaaaacccatctcagctaccagctctttcttttcagcactaaatctctgtatgataggtgtgatggaagatggtacacaacgcgaaaccggtgccacgaatttaacacgaacagccttcttccttgtaggtggagtgacaaagtcatcatcatcatgaatggaacgacgcttcacatttcttctcacgctcgcacactttggaagccgcggcatgctattaaaaactaccattattaaaacaagcaatatgattctcttcgggtcatatacttcaatttaaaattaattaaatctatatttacaaagattataattgagatgtccacgtaaaagagacattgctgctgtttcactacctacctaaattttattcactggatgcaattaaagatattcgaacgggcatgttatatacctaaaacaatctaaattcaactgcatttcaacaaaaaatctataaatttaggttccaggtgattcatcatgtgctcagtttagtagataaaaagaagaggaatggcaaatcatctatacataacagggactgcatgtgaatgtaagatgtgtgagtgataaacactgagatccatacctttcaggtaatgcagctcgctggtgaataatgtctgttccgaagctcacgaacaaccagcgacggcagcgaaaaggcacttggacatcaggcgctgtaatggcttgacaaaaatggttgaggagttctggtttccagcaagaggcttgtggacgaacgtcgtcggtgacgaaaaccacggacgtcggccctcttcacggcatggcgagcaatcccggcgaggtaactcggtgaagacgatgtggatagctagctcttggaccgtgaaacagtgtggaaaagaaaaatcaaaaaaaggaatacagtagccggttatatgtgcatcttgaaaatggaatgtaatcttgaaaatagatggcaataatcgcaattagtggaatggcgtcatttttcaaaaacgaatcgtgattcaaaaggtaagtatctgcatgcaaacgttgtatatatggaaatgtgatatagaaaatggaaagtgctaatcataatgtgtatgcatgattagagggcgcaaatttgtaaatacatgcacagtaaaaatggaaatacctgcatgcatgttctaaggaaagtatatgcatgcaactcttatcgggttagacccgttaatgtgtgatagcatcctctagtgtgttgcacggatcttaaagcatttggacggtggatggctatggagcccgggcaccatggtgcccctaacaaatttactatatatatatatatatatatatatataaaactggatataacacattctattgatacgaatcggaacatcccatattagattggtttttttatcacaagaaggaagtaggtggaagtggaacacactgctcctagtactacaattacactggtcctgcccggtgacttgaagtcaatgaggtcaagtgaactcttacaacaagggggccggggggaaaaatggaatcagaaagcagcgatatatctccagcctgaaactaaactttgctccaaagacgcttaccaaataaaaatccacatggcgatacgtctcatgaggcggcttggactgcccctcctccccgtcctcctgacgatcgctgctgcgtcaagcagcgatgaggcatcgctgcttgctttcaaggcggggctcaccgggagtaattcaagcgcgctcgcctcatggaacagcagcggcgccagcttctgcaactgggagggcgtcacctgcagtcgccggaggccgacgcgggtggcgtcgctgagcctgccatccagcaatctcgccggcacgctctccccagccatcgggaacctcaccttcccgcgaaggctaaacctgagctccaacggcctctacggcgagatccccaccagcattggtcgcctccgacgcctgcaatggctcaacctgagctacaactccttctctggtgcgttccctgtcaacctcacctcctgcatcagtctgaaaatcctggacctcgactataaccagctgggcgggattatcccggtggagctaggaaacacgttgacacagcttcagatgcttctactgaccaacaatagcatcatcggaccgatcccgccctcgctagccaacctatcattgctccaggacctatacttggactacaaccacctggagggcctgatcccaccatgcctcggcaacttcccagttctgcatgagcttagcttggaagcaaacatgctcaccggcgaattcccccactctctatggaatctgtcggcactgagggtgatcggagtagggctcaacatgctacaagggagcattcctgccaacattggtgacaagtttcctgccatgcgcttctttggattgcatgagaatcgttttcatggggccataccatcttctctgtccaatctttcaaggctcacagatttgtacctcgcagataacaacttcactggatttgtgcctcccaccttggggatgttgcattctcttaagtatctatacatcggaacaaaccagcttgaggcagataacggaaagggttcggaatttgtaacttctctagcaaactgcagccagctgcaagaattgatgctctctcacaacttctttggtgggcagctgccaagatcgattgtgaatctgtcaatgacgttacagatgctcgatttagagaataacagcttctctgggaccatccctcacgacattagcaatttgattggcttgagattactcgacctggggttcaatcccatatctggagtaattccagaaagtattgggaagctaacaaacttggttgaccttgccctatacaacactggtctgtcaggcctcataccgtcaaccattggaaatcttaccaaactgaataggctgcttgcattccacaccaatttggaagggccaattccagcaaccattgggaggctaaaaaatctgtttaatctggatttgtcattcaatcgcctaaacggttcaattcccagggaaattctagagctgccttctctagcttggatcttggacctgtcatacaactccctctctggacaccttccatcagaagttggtactttagctaacctaaaccagttaattctgtcaggaaaccagctttctggccaaataccaaacagtataggaaattgtgaagtgttggaattcctcttgctagataataactcattcggaggagacatgcctcaatctttgaccaatctgaaagggctcaacgtactaaacctaaccgtgaacaagttatctggtaggatccccaatgccattagtaacattggcaatctgcaatacctgtgtctagcacataacaatttttcaggaccaataccagcagccctacaaaattttacactattgaagcaattagatgtgtcgttcaacaatttgcaaggggaagtaccagttaaaggtgttttcagaaacctgaccttttcatcggttgtggggaatgataacttgtgcggtggaataccccagcttcacttgcctccatgtcccattcttgatgtaagcaagaacaagaaccagcatctaaagtctcttgcaatagccctgccaacaacaggtgcaatgttggtgttggtttcagttattgttcttattctgttacacaacaggaagctcaaacgaagacaaaacagacaagcaacatcactggttattgaggaacagtatcaaagggtttcatattatgcattgtcaagaggaagtaatgatttttcagaagccaacctgctcggcaaaggaagatatggttctgtttatagatgtactttagacaatgaggatgcactagtggccgtaaaagtgttcgaccttcaacaattaggatcttcaaagagctttgaggctgaatgtgaggctttgagaagagtacgccaccgctgcctcataaagatcatcacttgttgctcgagtattgatccacagggtcaggagttcaaggcactggttttggagttcatgcctaatggtagcttggatggttggattcatcccaaatcgagcaaatgcagtcctagcaacacactcagcttttcacagagactcaacattgttattgatatctttgaagcaatggattatctccataaccactgtcagccatcaatcatccattgtgatatgaagccaagcaatattctccttgcagaagacatgaatgctaaggttggagattttggcatatcaaaaatcctccccaaaagcataactaaaattcatctaaattcaaaaagctcaattggaatcagaggttctattggctatattgctccaggtagctaaaaaaaattgtaattctgtccttatttccttcatttccctcctcttctaatagatagaagtagaattaggggtattcgtatttttttttgtcttgaaggtacacttaaagtttaactgtgtgtgttgcaaatattgcagagtacggtgaaggttctgctgcctccaaactaggtgacatttacagcttaggcataatattgcttgagatgtttacgggaacaagccctactgatgacatgttcaaggattcgcttaatctgcacgaatttgctaccgctgcttttcctgacagagccctggaaatagctgatcaaacaatctggctgcatgaaacaaattatacagatgctacagatgcaagcatgacaagaggaattattcaacagagtttggtgtctctctttgggctcggcatatcctgctcaaagcaacaacccagagagcgaatggtgttagcagatgccgtgtcaaagatccatgcgatcagagatgaatatttcaagtcccgggtggttgggcaacgagcaatagagcactagagctaaatgctagataatatacatatgtagtgtcaatcattttgcctggaataatcggaggtaaacaaggtcccagatttttttttttagagaaggtcaaaagacccggcttctattgaaagccataacaaggacccagttagccgttgtaaaatacatacgaggaatttgatcaaatttctcgatatgtacacagagaatgtaatcggtttgttaaataatattgaactgctgtagtttttacttcagaaaaacacatgaaaccatatatggtactagcagatttcaacacattcctatgcaaccatgaaccatatttactagcaaaatttccatctatctgatatagataccgatgcagctatgaggcaccaaagttctcaggctcccacacagacataggatcaactaacatagatgttgcttggttcagcattgcaaacagaaacgttagtgttaatcaaatgcactggaatcagagcaggcttgtaccttgatttatttggtttgggtggatgcgctatttgattacacgatggttgtggtgctggtcctgcagaaatcaccaatgaagaataggaggagatggcggtgcacacagtggggtggatctccagccccccgctctggtcctccgtagcctgatgacctctgcaggttaggatctctatcacacgcagcggcggctgcgctggtggctagctccggcaggttggcagcgccgcttcatggtcatggaacagcagcgccaacagcttctgcagctgggagggcgtcacgtgcagtcaccggcggaggccgacgtccgtggtggcgctggacctgccgtccagcgatctcgccggcacgctctcaccagccatcggaaacctaccttcctccggcggctcaacctgagctccaacgatctccacagcgagatcccccagagcgtcagccggctccggcgactccgggtgctcgacatggaccacaacgccttctccggcgagttccccaccaacctcaccacctgcgtcagattgacaaccgtgtacctccaatacaaccagctcggcgaccgcattcccggtgagcttggcaacacgctgacacggctcccacgctcgcgctggcgaacaacaccttcatagggtcaattcctgcgtcgctagccaacctgtcgccgcttcaggcattgccatcaacggcaaccacctggaggggatgatcccgccaggcatcggcagcatcgcaggtttaaggtatcttctcttcaacagaaactacctctccggcaaactcccggtgtcgctgtataatctgtcatcactgatcatgctcacggtggatataaacatgttcaatggcaccattccttctaacatcggaaacatgctcaatggggtgttttcaggaacttgacttatgcatcaattgctggggatgacaagttgtgcagcggaatgcctcagcttcacttggctccatgcccaatccttgatgtaagaaagaaaaagaatcggtggcctaagtctcttacactggctctaacaacaacgggagcagtcttggtattagtttcagttgttgtgcttctattgtttactccaccggaagctcaaatgaagacaaaatagccgagcgacatccctaattattgatgaacaatatcagagcttcgtaccatgcattatcaagaggaagtaatgaattctcagaggctaacctgcttggcaaaggaagattatggttctgttaatagatgtgctttagaagatgagggtgcaagtgtaaccacggctgtgaaaatgttcaaccttcaaatgtcaggatcttcaaggagctttgaggctgaatgtgaggctttgagaagagtacgccatcgttgtctcataaagatcatcacttgttgttcgagtattgaccaacagggtcaagagttcaaggcactggtgtttgagttcatgcccaatggtagcttggatggctgaaatcatcccaagtcaagcaatctcactagcaatacactcagccttccgcagagactcagcattgctgttgatatcttggatgcactggattatcttcacaaccactgtcagccaccaatcgtccattgtgacctgaaaccaagtaatattcttcttgcagaagacaagagtgcaaaagttggagatttaggtatatcaaaaatcctcccaaacagcacaactaaaactcttcaaaattcaaaaagctcaattggaatcagaggctccattggctatattgcaccaggtagttaaaagttttatttttgtatttattcccacaagtcctcccacctcctccctcatgggtggggtcggattgtgcactttgtatatcttacatgctaatggtacagttagaaactaattttgactgcatatcttgtagaatatggggagggttctgcagtaaccagagcgggtgatacttacagtttaggaatattgttgctcgagatgttcaccggaagaagccctatgatgacattttcagggattcaatggatttgcacaagtttattgcagcttcttttcttgatagagccttagacagctgatcagacaatctggctgcatgaagaagcaaatgagacagatgtgacaaatgcaagcacaaaaagaagaattattcaacagtgtttagtggctgttcttaggcttggcatatcctgctcaaagcaacaacccagagaccgagtgctcttagcagatgctgtatcagagattcatgccatcagagatgaatatctcaggtcttggatggttggcattgaactaaatgttggataagacatgtatgtagtgtcaattaattgtactagaaataatcgttggaatacaaggctgcatgatttatatttatcaaataaagctcagatgcatgtcattgcaaagacgtatacagaatgtcaatgtaatcatgctgatcaaataatactgaagagctgaccatatggcttcttacacacgaaaccatggtagcaacttccaacagaaacttctacgcatccatgatccataataaaaaaaatataaccaactactcctacagtcctacctgatagggatacccttgcaaccataagaaaacaaagttccacgattcccacccacataaacatagcatcaacataggttgcatctaaatagatctaacactgaataccaaatcaataataattcatgttgtctgaaaagaaaagaacaagtgctcaaaccaataaccagatagaaccaagggatttgctctcaaaatatgggcatgttattccaaccactgcaaattcataatagcaactgaaattattccatgagtaaaaattatgatacatccatattaatccttatgctgtcataaaaattagagttatttgacagcgaatgtattatggaacaagcccaaccgaaattcaggacaatattccacgtagaaccttggatgtaacttattcacctccaacttcgctggagggagaatcacctaactggagagtgaatcaaaggacaagacacattattacaataagtagaatcaacaagagtttggtctaatcttaacacatatgccttaaggcaatgcatatcttgaatagagcaatagcctgactgaaaactttggtataagatgcatacctaacagttagctcataagctagcagcactcagaaattcagaacggaatgagaaaacatgcgggcacaacataatcttaaaaatcaataattgtaatgtgatgtttcagttaccatttccttgtcgctatatttctttgaaaatcagtacctgacaaaagctgaagaaaaacttacttgtcgaagttctaatctcagaataaaacagcaatggaggacagattatatcatgtactagtgcaccaaacaatgtgtacaaactttttgtttcaaatgcagacagcacgaaactaaatttcttgtcaggctaaaaacaatttggtattgtcccaaagtgtgtgcttctaaaatctctaaacaatacatgaggcacacgcaaaagaggcacacgcaaaagagcagtacctaacaccaatgtacatgctgcagaaatcaaattccaatgacatgaaaagaaatttacgagacaaaatactagcaaccatgtaattccacaacattaaacgaaggcatcaccaacactggcacaaggtaaattcttatcaatgatggcacaagagaaagcacacattcgcatgttataaaagcatggttacttatgcccgatccgtgaagcaagtgtttcccaaaagcaacccaaagccattcttcttacagccaatgactaccaaaccaacaatttaacatccatttccaatcttggatatcacttaaacaatataccacataaacatataaaaactactattactactaggactagatgcaggcgtacagcctaggaggaagtgaacttggtaacggccttggtgccctcggagacggcgtgcttggcgagctcgccggggaggacgaggcggacggcggtctggatctcccgggaggtgatggtgggcttcttgttgtagcgcgcgagcttggcggactctccggcgagcttctcgaagatatcattgatgaaggagttcatgatggacatggccttggaggagatgccgatgtcggggtggacctgcttgagcaccttgaagatgtagatcttgtaggtctcgacgctcttcttcgccttcttccgccccgccttcttcccctcgccgctgcccttctcgcccttgccggcggggaggcgcttctccgccttgggcttcttccccgccggggccttctcggccttctccgccgcgggctcctcctccgcgggcttcttcgccgccggcttcttctccgccttgggcgccatggatgccgccctcttcttctcggggagaggagaggaaagggaagcggtgggatttgcgagattgcggcgtggggaaaggaggagacggggggagatgattttgtagaggaggggatgtgcaacctgattggtggaaagcacgcggcgcggatcgatgacgtggagggatgtacgacgttggatgccggggtcgacgggttggtgggatgccgaaaaatgtgagcgggaacgggaggagttaaggcggtttccggcgcgcgtcggtgggcgaatttttagagtttgagctttccttcggcgtacgcctacagcccagtccagcccaatttagttgtcaggcttcttggcgggctgtctttgtttatgggctaattgggcctatttctttgctctgaaagccactccacgacttgttaggctacgtattcggtaatctgcccacgtcaacatcccagtgagacgacaacgacgtcgtcgtcttcaagcaggcagctagcctaaacccatctccatctgcaagtaggcttatgtaacagtgcgttgatcatgcaagccttccgtcgatcgcctagccgcctaaatcgccgtgttctgaaagtcaattctctccgactcaacgaaaatactaacaacatgcacctggccgcgttgaccgttcgaaatgtatatattccctcgttcacgaaatacttttcattgtggattttttttaatacgcaaggggcgtatttttttcattaagagaaataaaagttatttataaggataaaaggaaaacaagcagggaccgataaaggacattatgaaaaactagaggaatatctcgtgctaaatttggctaccacgacctcgtaaagaccaaacagcggggatcccttaataagccgacttccaaagcatggtctccttcgccattgctttcgccacttcggtccaagacctttgttgatttagaacggtcttgttgatttagcactgttttagcttgatttagcactgttttagctttgacagtagtagttttattaactaaatgttaatgctaagatgagcaaaagcagctcgtggtaaactggtaatgatgatttttttaaaaatatttgtaattttttagggaaaaaaaaacaagtgaccaaagcaatattagtagtatgaatgatgtatcaggacaagtactattccgtccataaataatggatgtaagatatgcatctagatatggttgtccagatacatatcctgaacggaaggtatttagaacaaacaaacaaagggagtactatattataaagtcaaacgaagtgttccagaaatggaaaaaaggaattaaaagaatgcaatcaacaaactgtcatcatctccaaatttgcttcaaagaccatctatactctccatataatacggacagccattggtactaagatatagcactaccactctcacaaaccaatcaagaaacacaatacgtcccatgacgatcatgatgagcctgaggcttgaattatccctcgtcctcatcctgacgccgatcgttgcagccgtcgctggtggtggcagcagcagcagcagcgatgaggccacgttgcttgccttcaaggcagcgttcagggggagcagctcaagtgcgctcgcctcctggaacagcagcaccagtttctgcagctgggagggcgtcacgtgcgaccgtcggacgccggcgcgggtggcggcgctgacgctgccctccggcaatctcgccggcgggctccctccggtcatcgggaacctcagcttcttgcagagcctaaacttgagctcaaacgagctgtatggagaaattcccccgagccttggccgcctccggcgtctagagatcctggacattggaggcaactcgttttccggtgagctccctgccaatctgagttcctgcatcagcatgaagaatctgggcctcgcctttaaccagcttggcggccgcatcccggtggagctgggcaacacattgacacaactccagaagctgcagctgcaaaacaacagcttcactgggccaattccggcatcgctagcgaacctgtcattgcttcagtatctgtacatggacaacaacaacctggagggcctgatcccgctggacctcggcaaagctgcagctctacgtgaatttagttttcagcagaacagtctctccggcatatttccgtcctctctgtggaacctgtcaacactgacggtgcttgcagcaaatgacaacatgctacaaggaagcattcctgccaacatcggtgacaagttccctggcatacaatactttggattggcggataaccaattcagtggagtaataccttcttctctcttcaatctttcatcactcacaattgtgctcctttatggtaatagattcagtggatttgtgcctcctactgtgggaaggttgaaatctcttcggcgattatacttgtatggcaaccgacttgaggcaaataacaagaagggttgggaatttatcacttcactaaccaactgcagtcagctgcaacagcttgttatctcagacaactctttcagcgggcaacttccaaactctgttgtcaacttgtcgaccacactccataagctctacttagataataatagcatctctgggagcatacctgaggacattggcaatttgattggcttggacacgctggatctggggttcacttccttatctggagtgattccagcgagcatcgggaagctatcaaatttggttgaagttgccctgtacaacaccagcttgtcaggcctcataccatcatcaattggaaatcttacaaatttgaaataggctctacgcatactacaccaatttggaagggccaatccctgcaagccttgggaagctaaaaacgttatttgttctggacttatcgaccaaccgtcttaatgggtcaatcccaaaggaaatcttggagcttccttcactctcttggtacttggacttgtcatacaattctctctctggaccccttccaatagaagttgctaccttggctaacctaaaccagttgatactgtcgggaaaccagttgtctggtcaaatacctgacagtataggaaattgtcaggtgctggaatcgctactgctagataaaaactcatttgaaggcggcatacctcaatctttgaccaacctgaaagggctcaacatcctgaacctaaccatgaataagttatctggtaggatccccgataccattggtaggattggcaatctgcaacaactatttctagcacagaacaatttttcaggacccatcccagcaactctgcaaaatttgacaatgttgtggaaattagatgtgtcattcaataatttgcaaggagaagtaccagatgagggagttttcaagaaccttacgtacgcatcggttgcagggaacgacaacttgtgtggtggaatacctcagcttcacttggctccatgtcccattattgatgcaagcaaaaacaacaaacggtggcataagtctcttaaaatcgccctgccaataacaggatcaatcttgctgttagtttcagctactgttctaattcagttctgcaggaagcttaaacggagacaaaatagtcgagcaacaatcccaggtactgatgaacactatcatagagtttcatattatgcattagccagaggaagtaatgaattttcagaagctaatttgcttggcaaaggaagttatggttccgtctatagatgtactttagaagatgaaggtgcaattgtggctgtaaaagtgttcaaccttcgacaatcaggatctgccaagagttttgaggttgaatgtgaggctttgagaagagtacgacatcgttgtcttataaagatcatcacctgttgctcaagtatcaatccacagggtcacgagttcaaggcattagtttttgagtacatgcccaatggaag

SEQ ID NO: 37239 - DNA, 659 bp, Oryza sativa
aattcgcctaaatatcaaatgaaagagaagcgcttgctagcgcagtggcagaggtatgcggattcaaccccgaagtcccgtgttcgactctagtgcacgctcgcatttcttcttaattaattgacaccaagttcctctttagtgtccagcgtttctccttggtgtcttgtgtgtgtttttttttcaagcaaaaaacctttccaaccacatgaatttgcacagttgtattattcaactacactctgttgcaccatagtattcaaggtcctatagcaactagcaggtaacaaaaaaatgaagcagtaaacttaccaccactgccttttccctgactctgtttcttgtcagagatcatcttagtggatcgcaggcggcgacggaagccaaagaactgaagaatgctccatcggcgcccatggagttccttcccataaaacgcggagtcctgatggtgcaacagctgggccatttggtgttagcccgtcaacaaaggtaggaggagtggttccttataagcaccacctttgcagaataaggaacaattcctcaacttttctttaaacctgtcatgaacagactgaccaccgattaacaacttagcgaataacacgcataatatcatttcaagtacaaataaattattgcctgaatagcaaact

SEQ ID NO: 37240 - DNA, 730 bp, Oryza sativa
  unsure (1)..(730): unsure at all n locations
gagttgttcagcagttgtaaaattctgcctggctagatattgttctacatatgtgcagctattgcccatgaatttgcttagcttgtatgcatgattttagttgcataacaggctgcattttgaggcaccatatcaggtgttaagagtatacaatgaaactaccgaagcacatgcagcttgaaataatggaattcaagtcaatcttgccactcactgaccttggccatgaaagactgtcaattttgctgtcagtgtaaaccttcactgaacatttgtccaactggagaacattatacaaatagatagttctataagataccacagcttttagtgttctatgattcacctccgaataatgagtaggtagttcgatcctttcgattcatatcttcctagtaaacggggatccagagcaataggtcgaatttctatataaagaagacttgtaaacaaaaggacttattgctctttttcggttttccgcttcacctattgttcttatcaattcattttcctccttccttctttcaataagaactatttgaaatgaaacaaattcctcttcattctgttacagaaacagggaattataaccagcttcaactgtctacatacttcaataaagttcagcctaattcaattgctttgtcactcttagttgacgannnnnnnnnnnnnnnnnnnnnnnnnnnnnnnnnnnnnnnnnnnnnnnnnnnnnnnnnnnnnnnnn

SEQ ID NO: 37241 - DNA, 993 bp, Oryza sativa
gggggtctagggtttcatgcacgaacgccgaggcggaggaggagcagcagggtggaggtggggggtggggggtggtgagtggtggtggtgcgagaggaggaagaagaggtagtcgttggaggggaagaggcggaggtgggggatgctttatcttcttcctcctttccgcgctcttttgctgtggactcggtgcacaactccacttcgccacttcatcaaagcggctcactactacagtgtacgtaatactccctctgtcctaaatgaaactaaaactgtatgtaatattttctattataatatagagtctattatgatacattatacttgaaaacgtcccatccaattttatattctaatattttagaataggtagtaatgatttttcgaggttttgacacgaataacgtttccgttccgtgtcgaaacctcgaaaaatttgtaagatggttttcgcctaagcaccggatcctgatccatgtggatataacggtttttgtcaatttttttataacttttcgtttaattttggtcaaattgactgtttcagatttgaaccattctaaatttcagtcataacactatcaaaacctcgaatttttgcggttttcaattggtttttatcgaaaacatgaatcctaatgtctacacttctgttcacttcagttcgattttagtgaaaagcctccttggggacaaaaataaattttgaaggaccttcgtatacaggaattacactgatctatgcagaaaccatttgaaaaaaaaaatgtatttcaaagaaaccccgagtatttcgcaaccaacctttttggcatattttttctttaaacatgcactatattcagattcaacgatgcaatcgtaatttcattacaatcataccctacatatcagttttctgaacgttattatcattttttttctaaacccattttgacaattgggtatagatcgaccaaatgtaaggccccgtttgaaacacgtgaactg

SEQ ID NO: 37242 - DNA, 688 bp, Oryza sativa
ccctaagaagccatatggtcagctcttcagtattatttgatcagcatgattacattgacattctgtatacgtctttgcaatgacatgcatctgagctttatttgataaatataaatcatgcagccttgtattccaacgattatttctagtacaattaattgacactacatacatgtcttatccaacatttagttcaatgccaaccatccaagacctgagatattcatctctgatggcatgaatctctgatacagcatctgctaagagcactcggtctctgggttgttgctttgagcaggatatgccaagcctaagaacagccactaaacactgttgaataattcttctttttgtgcttgcatttgtcacatctgtctcatttgcttcttcatgcagccagattgtctgatcagctgtctaaggctctatcaagaaaagaagctgcaataaacttgtgcaaatccattgaatccctgaaaatgtcatcatagggcttcttccggtgaacatctcgagcaacaatattcctaaactgtaagtatcacccgctctggttactgcagaaccctccccatattctacaagatatgcagtcaaaattagtttctaactgtaccattagcatgtaagatatacaaagtgcacaatccgaccccacccatgagggaggaggtgggaggacttgtgg

SEQ ID NO: 37243 - DNA, 233 bp, Oryza sativa
aaccgaaaaagagcaataagtccttttgtttacaagtcttctttatatagaaattcgacctattgctctggatccccgtttactaggaagatatgaatcgtaaggatcgaactacctactcattattcggaggtgaatcatagaacactaaaagctgtggtatcttatagaactatctatttgtataatggtctccaattggacaaatgtccagtgaaggtttacactgacag

SEQ ID NO: 37244 - DNA, 707 bp, Oryza sativa
  unsure (1)..(707): unsure at all n locations
nnnnnnnnnnnnnnnnnnnnnnnnnnnnnnnnnnnnnnnnnnnnnnnnnnnnnnnnnnnnnnatttaaaaataatattattttaaaggaaaatcacagaaatattgctcgattggtggaagtcacaaaaatagaaccctattgaattatagttgctcaataggtgacttgtcgaactgggggaggccgacaggcttagctggcgtgagaaaaatccaagtcatgtaaacactttatagtttacatgaatctggtggctctgcatggtggaaattgtagcttgtcgtcccaccgaagaacagcaaagattcgtcgtcccacagctgatcgatactccctcgtcgggagtaggcgaccttccaaaaataatgcaggccctatgccaattcaaaaaagtgacgtggtggagcggtctgctagcacactcggattaaatgcactcatggattaaaatgctactacctccatcctaaatgtagctatttcttgcacagtgccttgtcccaaaataaaactatttgcccacctacctcctcatctcaaccaatcacaaccattatgtttcatctactttctcttctcaaccaatcacacactttctataattattctcacctactttccgtatacctgtgacaacctcaataatacttacattttggcacggaggaagtatctaacctacctgattcagcatgtgtcaagcca

SEQ ID NO: 37245 - DNA, 687 bp, Oryza sativa
tgcgttggtgcctagttccgccaggttgcaagccccgcttcatggtcatggaacagcagcgccaacagcttttcaagctggaagggcgtcacgtgcagtcaccgccgaagacaaacgtccgtggtggcgctgtacatgccgtccagcgatctcgccggcacgctctcaccagccatcggaaacctaccttcctccggcggctcaacttgagctccaccgatctccccagcgagatcccccagagcgtcagccggctccggcgactccgggtgctcgacatggaccacaacgccttctccggcgagttccccaccaacctcaccacttgcgtcagattgacaaccgtgtacctccaatacaaccagctcggcgaccgcattcccggtgagcttggcaacacgctgacacggctcccacgctcgcgctggcgaacaacaccttcatagggtcaattcctgcgtcgctagccaacctgtcgccgcttcaggcattgccatcaacggcaaccacctggaggggatgatcccgccaggcatcggcagcatcgcaggtttaaggtatcttctcttcaacagaaactacctctccggcaaactcccggtgtcgctgtataatctgtcatcactgatcatgctcacggtggatataaacatgttcaatggcaccattccttctaacatcggaaac

SEQ ID NO: 37246 - DNA, 557 bp, Oryza sativa
attatctttccttttgagatcatatatacattactcaaaagtgaaaacttaaaaccaccaagacattagctcattcagaggaacatatagcaaggagtaaaaggtaaaaggcacattcactgaggtactggttaaacaaattccttaaacgttactggaaatggaaaacatgacttcttgtgaacatgattgagtttgtacttatattggttatgaaaatcaacctattgcatgttctaaacatataaggttgtaagaattaatatatacccatctgtggaaaagaagtgcaaatatgttcgctgcaaaagactggctccagagttgcactatcaagtcaagtatacgcctcccactttcaggtactttaacaaaatggttagcaagaatctcatagaagcacaaccgggtatcttctcgctcatctactggagcaataccatcattcgtttttcccgtgcttaaaatacatctgttaaaaagaaataagtatgtaacatagcaaaaacacttgtaacaagattgagtagtattatgacccaaacattgatcataaa

SEQ ID NO: 37247 - DNA, 1054 bp, Oryza sativa
  unsure (1)..(1054): unsure at all n locations
nnnnnnnnnnnnnnnnnnnnnnnnnnnnnnnnnnnnnnnnnnnnnnnnnnnnnnnnnnnnnnnnnaaacattggagatgcccttaggcttaaaaaatttgtcacgcgaattagctctcatttatgtaattagttttataagtagtctatatttaatacttcaaattcatccgatatgacagggactagtttagtccctgatccaaacaccaccaaaatccttgtctcttccctcaactcagtcaccgatgttgatgcggtggcctcttctgtggggcccctgttcagatcacaaccgtcttctgattcgcttcaaagcccctgcaaagctagcccctgtcgagatgcttcttttgagctgtgctggcaggcggagcatgtgcccccatccggtgcacatgttccgatgtgggatgaggctacgcgctgggatggcgtcgaggctagggatggcaatcgggcgtgacgggcacgggtagtgcctacccatacccatgcccgtgagattatttgtgcccgtgggtatacccattactacatgacgggtaaggatggttgcctattcccattgcccgcgggcgccttatgcccgcgggcgtgcctgtttacccgccacaacaaaagcagtggaacaaaaagtctacaagcttctaagttcgaatcgaacttaaaacatcaaatattctccgcctcggtgtcgggtctctcctctggcggcgatagagtaaggggagagaaataataaggggaataaaagggaaaccgtagaaaacaaagaacgtggcttatatattctagtggattttgctcctagcctacatgtaagttagatttcgcgggtaaacgggcaaagcgggcatgggtagtgattacctatacccatgcccatttacccatcgggcataacttttgacccaataagatacccacgggtattaaatggagaacaaacccaaccctaatagggtttttacccacaggtaaacgggcaaatgggcacaattgccattcctaatcaaagctgaggcttccaagggagatgcggtctgggccgg

SEQ ID NO: 37248 - DNA, 510 bp, Oryza sativa
  unsure (1)..(510): unsure at all n locations
nnnnnnnnnnnnnnnnnnnnnnnnnnnnnnnnnnnnnnnnnnnnnnnnnnnnnnntttccaaaagcaacccaaagccattcttcttacagccaatgactaccaaaccaacaatttaacatccatttccaatcttggatatcacttaaacaatataccacataaacatataaaaactactattactactaggactagatgcaggcgtacagcctaggaggaagtgaacttggtaacggccttggtgccctcggagacggcgtgcttggcgagctcgccggggaggacaaggcggacggcggtctggatctcccgggaggtgatggtgggcttcttgttgtagcgcgcgagcttggcggactctcccgcgagcttctcgaagatatcattgatgaaggagttcatgatggacatggccttggaggagatgccgatgtcggggtggacctgcttgaacaccttgaagatgtagatcttggagggctcgacgttttttttggctttttccgccc

SEQ ID NO: 37249 - DNA, 857 bp, Oryza sativa
gatgcaccgttttttgatgaacgagctctggttctgtgcgaccaaggagttcagaatgggggctagccggcgggagaggatcttcgtaaatagtttcgcaacgctatgcaccagactgatggggtgaaaatccttcaatttcctggcgtcttgtgttttaggcaacaacgtgaggagagccgtgttcacctttccaaaactggacccgtccatgcgatggagctgctgcaacgctgccataacatcctcgcagatgatcaactagcaggtttggtagaattgtcctgtgaaaccatccggccccggcgctttgtcacgcgatgtatcttttacagcaacccacacttcctcatctgagaacggggcttccaactggggtagaggtttccccctctcgactagaaaatcaaggatgagagcaaaggatcttgaaggagaggagtcgagcaaatgcaagaaccagcacggccttctcgtcaggtgaggttgctacctgaccgttgtgttctagttgttggatgaagttgcgccgtcgatgggacgtcgcatgctggtgaaagaagcgtgtacatgttggcatcaccttcctgcagccacgaaatccgagagtgctgacgggccatcgttcgctccaaggaggccagcgcaaggtatttcaactttaagctcttgtgaaagtatctctccgaaggggacagggcaaacattcctctactctatcaaatctgccaatcagttctcttgccatttccatttgcaatttcatatttccgacctttttgtcgctccaactccttagttttttggccgttgttttcagcttgctgtcaagcctgctgatcgggtcggcaatgtgg

SEQ ID NO: 37250 - DNA, 897 bp, Oryza sativa
gatgtgagctttggggtttccccaaatgattacgttcctcactacagaagcagcctctgtgttccttgctgcaatgatgacatgggctcctctcatcgcaaagactcgcgaggtctccagaccaatgccactcgctcctcctgtaagacaacagaatttacagatttccgtaaatttgcgaggatagatgtttatgaacagtttgcagtaactagctactgtgagtctgacacaacatgaaatttactcacaagaatacaagattgatgtttggtgaaaactgaattctatgacagattggttatggatgcactagaagactatgattaatgcttttatgagcaagtttaattgacaagacctaacacagaaaaagttactattatataatgggaaaatgtttatagtttaagaccacacagttccaagctcaaactcttattttccacacaaaaagaaaggaatatccaacatctccacatcaggaaagagagggtaaaaatcctcagcccattgtcagaatggaagaactgctatgcccttccgatgaattgattttccttcacacttctgtatatcaatctatgtttttgtttttttagtattatctaaaatacctgattgaattatgaattctctgtagtcaagaaagttccagaaatctaaaccacaaccacaagattgagcaggaaacagacaaactttcatcaaaacataataaactcttctggtccacaaaaaagctacttatgcataaatttctcatatacaattttttgaagagcgtagtattattttgatattatattaatcataacacaaaaggtggctgctttcataatcccaactctaagccacccttaccaccatccaaaacacacccaaaaaggaaaagag

SEQ ID NO: 37251 - DNA, 696 bp, Oryza sativa
cggagtaccatccgaagaagacggcccagttgtagacggagaggtagagccgccgcaccgccgacccgacgcccgtcatcgccgagcactcagcagcagctagcaaggaggaggaggaaccgaggaacgcgaggcctggacaaagatggacaaggacagtggcttggctttaatgggcgcgtggactgaatctactacgctgttgattactgctcgcattcgcatcagcagatcagatcagaggatgcaatcgcaatcagtaggctgcttgctccgatttgagaattccggtggatgggaggctggccaaccgaccaaccactgatcaaactgaattcgcaatgaatcggagtggatgtgggggtggcggtggcagttatggcagctgcagctgactgagcggctctcccgccaatatcatccatgtgatctgctgcaaattcagttcagtactgcaactttcaattttatcttcagaagagttcagacacgcaggttcagtaaaaaaaaatctctcatttctctctctgttctcaatcacaagtattatgctgttaacctgatggcctgtcaaaagaaaagaaattgtgtgtctgtgtgtgtatatcagcatctacaactaccagaattaatcagtgatacataggaagcacatcaagaaacagaataaagatgataattttgttcagctgttac

SEQ ID NO: 37252 - DNA, 678 bp, Oryza sativa
tcttttatatttttgtaagacgtgggtctgtatgtcaacaattgtcgtttatgtaccctggctggtcctggataggaatttaatcacattcagctaaaaaattctggttaaaaatttctgggtgtgacaccctagccctcgatccccgtcgtccgccggcgctccggcttgccggcggcggctccctatcgggcaaatcttcttcacgtcctcctcatccggatcagcagcgggattcacagcaagtcagtgtgattcgtccatcacgcgtgagtgtatcgctcattccagccgctcgtcacgcggttcctccgctcagccgttgttgctgctcttccactactgctgccgctgtgtgctgctggtgctaattcaggagacaatacatcaagtcttgcaagcaagtctctgtccagtcaatttgtcaaattttcttctgctggtcttgatggcaacatccgacccctttcttggaggtggagctttgctctccacggacattaagctaaatggtcaaaattatcaagaatgggaactttcagctcgtatgcttttgaggtcgattggtcaagcatctcacctcacagatgatcctcctgatgagaaaacggatgcaactaaaattaaggcgtggaaaacagcagatgatcgtgttatgggattcatattcatgagtgt

SEQ ID NO: 37253 - DNA, 1943 bp, Oryza sativa
  unsure (1)..(1943): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacaaaagctaattaaatgatttttttaatgattgaactgtattggactttttaatgtcccctgcaactcataaagtaaaaatacttgatctggctacctttatgtaaatttaattcagacacttacagtgacaggtcactgaagctccaaaatcaaaggctctaaactaaacatcgtattttttttcaaattatagaaaactaatgtatgtatgtaagttttctgctactaaacggaaatctcaccatccaggattgtatatttcactggactagcaggatcatctgggaaggtcatgtcaagaacagacattggactatcagtttcttgttcacagcttagatttatctcagcttcaatttcttgactgggacgaggaacacaaaaagtaccttctcttgacttcagaacatcggatgaatgaatttgtttgtcatctgaagttgttgtatgttcttctgaaatccttccgtcttctgaaactttagtagtatgcatacctgcttctgttgacaaattagtatggtcatcgtcacaagttgttccatgttcttctgggacatcaatttcttctgattttgaatgaacagtacacatattatcttcagttgatgagtgaacctgatcgtcatcacaagttgctacatgcccctgtgaaatatcaatcacttctgaaagtaaagggggagtacatatattagcttcagttgacacagaaacaccacactttttgtcaacgatgtactcttcgattaacacagtattttcagagccatcagcatccttatgaccagagatctcatccatagcagcatccacatctccatccacaataattctctctggaacatatggtgccaaggcatgttctgggatcacgagattttcagcagtcataaccaaactctgcaacccagtcatcacagcaggcgcatccaaagaatgatccctagtagattttgaacttgtcagcgtcctcttcgactggttgcttgaaatagaatccagcaagtgagaatatttctccaatgattcagtgagggaacgtgaacgccgaaaaccttggtttacaggtctttttgcagcagttacagtataagatttcaaaccatccctgtcatatgtggcggaggctgaccgggaaagtccttctttaattacatcttcagatgccttatgtccataagggaccttatgaagaactccatccattgaaatgctacggtggctcctttgtttcacatgaatgtcacctctctttagaagcgaagaacttgtatcattatcgcaaccatcctgggtgttgaatgtagcattttggatatttgtatctgtggaatttggcataatactttgtgaagaaccatcaccattggaagcagattcaccatcaagaacatactcattgctttccaggtaatgtattgaaagggtacggagtagcttcggtgcaacaggaagcatcttttctttatggccttcctttccatacagcttttttagaatcaaggagcccaaacttcccttaccagaactcttttttgaagacttgtttttctttgttgtctgtaataggagaaatgaaaacaacgtgataagccaactccaatatgaaataaatattgactatatgtgggggttttttttacgtaactatatgtggttttggaggagacaagtactacctccgtttcaggttat

SEQ ID NO: 37254 - DNA, 7114 bp, Oryza sativa
ccacattcatatagatgttaatgaatctaggcacatgctagaaagtcttataacctgaaacggaggaagtaatacttatggaaatttcctatgtggattatgtaatgtcgtggaaatttcctatacgtatattatgcttataaataatttctgatccaaaaaagttctagaaatattgtaataaactactgaaactagatgctcatagtatgcactgtagtctgaagaagtttaaggaattttttttagataatggattttcattaatccggcctctatatccacgagggatatacacaaccaagaagtttaagaaattataaccaaaatgtaaaaaaaagaagtgtttgaatgcttgcttgaacaggatgaagcaacttgtatgtacctcagtgtgtttgtcatcgtccatgacactagtgtcttcatctttcagtggaacatatgaacctcggcgtctacttcctacaattattttttcatctaatgcaaattataatcgtgcaaggagaataatttataataaaaatcataatcaaagcagaacactgttttggtaagttttacataacaaggaattaagtatctactgtactaccactaagagtcaaatagtaaatttcacactgttttagtaatattgctcatgagaaggcccctggggtattccggctagcaccacaaggtagtgggctagccggtccgggttcgagcctcactcctcttaataatttcttatatgagagcccctcctctcatatccaatgggttttttatggtaatatttctcataagttacataattcgcctaaatatcaaatggaagagaagcgcttgctagcgcagtggcagaggtatgcggattcaaccccgaagtcccgtgttcgactctagtgcacgctcgcatttcttcttaattaattgacaccaagttcctctttagtgtccagcgtttctccttggtgtcttgtgtgtgtttttttttcaagcaaaaaacctttccaaccacatgaatttgcacagttgtattattcaactacactctgttgcaccatagtattcaaggtcctatagcaactagcaggtaacaaaaaaatgaagcagtaaacttaccaccactgccttttccctgactctgtttcttgtcagagatcatcttagtggatcgcaggcggcgacggaagccaaagaactgaagaatgctccatcggcgcccatggagttccttcccataaaacgcggagtcctgatggtgcaacagctgggccatttggtgttagcccgtcaacaaaggtaggaggagtggttccttataagcaccacctttgcagaataaggaacaattcctcaacttttctttaaacctgtcatgaacagactgaccaccgattaacaacttagcgaataacacgcataatatcatttcaagtacaaataaattattgcctgaatagcaaactggaactctggaaaagtgcagccaaacaaatttaatacagaaaaaagatgttctccaaccaagtatccataaaatcggctagccaaaggcagatgttaatcatgaggaaacacataaaccataatcaatgaacaaagctaatagaaaacaagttgagaaggccctttgctgcctttcagacaaagaaacagaaatgatgctgacacaagcacctctttctgaaaacatgcagacaaacacccaccaacagcaactaaaccatttcttaagacaccaattaaaccatatatccatacatatccttgttagttagaatttcaattcctaatcaataattaggtgacaagaaaatgaaatcttcacaggggcaggcacttcagtgaagaaaaacactgattcccacggacaacgtatttaaaccgtgtggaaatgtttccacactgcgcaaaataaagaagacaaaggaagcttctaaggaaacatggtgaacaagcacagggaaatctcacatactataaagcaacagacattgttttcagtattttattgagaaaataagaaaagaaaatgaccatggacaggtaattaaaatttcaaattaaacagaatcacataggagaacctacgtagggcgtggggttcagataaatctttttggaaacaaactttacggattaatccgacgaaaaggaataaatccaaggccggatgaatccggaggaaactgcatgtacggattaacggaggaaagaaatcaatcaaggccggatggggcaaagagtgagattggcatcacaaaaccattcgcaaatcatcaaaacggacgtcgttaaacactcccttttactaatccaaacaaaacgatgaacaaaccatctccttttctcccccaaacaaaaaaaaaaagaaaaaaaaacaaagaaaccaaacagaaacgtatgcgagagaccacctgagatccgagatgaagcctcacaaaccctccagctccagcttatccaaaaaaaaaccgaaacataaaccgactcacgcctttccacaaacagattaaacgcacgccgctgccatcaagaacccacaaaaccggccgcaaagaaacctccttttatttctgcaaacgaaccttcgatttcagatgacgcctgcagccgacgcaacccagaaaaaaagggatttggtgtccgattcgagggtttggtggtgcttttgccgcaaggagggagttggtgaaatggaaagttggaggaaacgcgaattccccgaataagaacgggaggaggaagaggaaaggatcgcaagtgcgaggaatgggaaatttgagggggttttctgataaattccggtccgtagctgcctgcctgaatggcgggtgctggtagttgaaaacttccattctcttttggcagttatcagtttgatctcctctctttttcttttttcttttaataagaaaaaaagtatttttgttttatggtaagctggttatttttttcgagtacaagttggacgcgcacacgcagatacaccacacgcgtgtccacacacactcagagttgagtttgtggtttatctggttattattgtccatatgtaaaattaatagcacgcagattttcactgagcttttttggtattggaatatttcattaatggatgaagatatacatgtgtttgtatttttcttgcttaaaaatatttttttcttttctgatatgtttataaaaatacatgatttttttcttctttcattggcaaggttttaataaaatggctggaattgcatctctttcctatcgtgatcgagttgcagctgagaattcacatatgaatgaactggcaaaaggttacaggaaaagatgagatggctgtccttgtcagatattaagtgcaccagcaattttataaattatagaatcaatgcaaagtatggagacagtacatagaaccgcgttttcgtccagcatggtcattattgcctgaactttttaagtatttttggcttttgtttcgaaagcctccaaatcctccttaattctgtactcctttttgccagaccaacctcaaacacactgtgtgcttgtttgtattgtggtggaccctaggaaaaaaaagttggtatgaatttgaccactccatggatctcttttgtgtgtgtgaaattgtgaagttgtcctcttcatggatattttgtaagatctcagtgaatatttgagagaagaataatcgtggtcaggagttttttaagcagccacataagtgtccgtggactgatagtcattagtgtgtttgctatgtttaccaaaaatacattgtaaaatttagattgtatcctagctattcaaacattgcaaaggccaagagcgattttaaaatggttgtatttgtatcaccttggtataattatcttgatattaataaaagattcatttattgaaaagatgtatttgtgatatctatgaattttctcttggtctatgttgacctgctcaatgctcagggtagtacatgcagctccaatcaaacttggcatgccatcttcagtggaaatcatatcattttattccttttgctagttatctttgacgtatggaacttctccatcgtataaatagagagaaaataaaaaaaagacctgcaaaaggaaaataattttagatgaaaacataagtgataggaaagagtaaagatgtgcgaccttgtgctgacttgttctagccttctaggccagtagttataacaacagagtattactagtacacatcgcatcgctaatcaagatatcaaaatcaagaccagccttttcttccaccacatgttcattgttaatgaaagtgactggcttaatctttacttaattactgcctccagaatgctatcgcccatgattgcttctagtcatcactaggattgctgcgctgcaatgccatgaagaattgtctcactttatcatgactaatttgagacctgcatgctgcatcatcttcagagtaaaaatacttaaatcttttgagcactaactacaaagtcaactaccaactttggagtaaaaagtcaactttggatttgctgaatacatgatagattccaagcctcgtttgaaatatggatttttttcctcttttttttccctgattgttgcatgaatttgataaattcaggtaaaattccttagttacaaacagatctcccagttgataattctgctgctaaattcgtgtgctcacagatctccatcaaatgcaattgaccagctgtcatgtagcgaccaaatggctgtaaatttgttgagatgaaactgactatttttattcaaatggtgcagaaaaatctaccaaaacaagttggaattgaccggatgattctatctggaagcattgcaattgactggttaccagttgctagtactacctactgtgctctgcaacttgtggcttgtactagctgaccatgcaactacagatcatcggcgacaacaagacaccatattgatttagtttacttaatttttgaacaaaatagagcatacgaaagtgatggtcagcatgaactcttgtggtcaaaccggctactgggactgtaggtcttcgtacatttcatatgaaacatacggcctctttaaaatatttgcaggtcactgaacgaatctcggatgagatcgtagtacttgattggccgagctccagctcacagttcgattacacaacttcatttcgacaaaaatgaggtcagaacatgattttgagaaggaattgtttgagttgttactatgaacttggattctgctgctcattattctttggccaaattacagtagtcatagtctcatggagactaacggtcagagtaaaacaaaatgcggtcagtctttttgcaagaaaaaaaaaggtgatctgcaagaagtccacataggagaattttgtacaggattccttaggcccagtttggaacatgggattttttaggaatttgcttaggattagatccaaacactcatgtttcatcaccacatattttacagttacatgtgttttcaattccgtaatttttccactttacgctctttcttgttcctatgtttttcctgttcatgtgttctccgttcctttgttccaaacatgtccttaaaaacacgtccagaacagtgataactgatgacaaactcacgagtaaagttcttggtacaaaatatgcatgtgagtatgtgactgtcacccagggaagcaagaaaaaggaaacagcaccaatgtacaccacgaagctagtatatactttgtaatcaaatcgacgacttctggtaaggtttttcagaggacaacaggcaacaatgtcaagcatgaaaatggcaggcttcagctgagaaggacagaataggacagcaattccaggcgtcaaaatgaaattatgatcgcattactactgcttggacaaatggacaagaagtcaataagctgatatcagatgaaacttgtattgtatttaaccattacaacagggccaatgcaaactcaaagagaagttcaacaatagctaagagggattccattgtggactagatattttagatcatagaatagaagtggtacactgaaggcttcaacttccgaacactgagaccagaccaaagattcaatcccatgtggccatcgtgctgacaccaactccttacaggaatggtggaagaatcacccatcgccgaggatacttcggcctcccttccttgccatcgaacaactgcaaaataagaaatatcagtaaatctgtgcaatgataacattgttcagcacttcagcgcaggagaaaaaagaaaccgtgcttgccttctttagacggcggtgctttccaagtgcccagttggtcatgatactcgctgccacaacaaggaagatgtaacctgccacagtctgtgtggcaatgttgaacccaagccattggtagatctcagtggtatagtttgcgcatgtcactatgttgaacaggaagccacgaggaatctgatagccaccgttaccactcggacttctgaggttcctcagcaggatatggcaataaaagtttgcaatttggcagagaatcccaaatccaaacccaatcttcatctgcaattcactcacaggggtgtaaagcgggtggttgcagtagtaagcaatgtaagctccaaaggtccagtagtaggcacagttcctgaagacatttgatacaggagaagtcgcgtggctgaagcggtgaacaaagaacgtctccatgatcctcttgaagtagtggaaacaccaatagtacatggcgtaagtctggacaggatgcatgacccgctctccctcgtatccgaaatatttgtagacaggcaagtaatagaacatggggtagataagaagaggacccaagtattcaaagaagaacagcgtgctgtagaagacctgtgggcctaaatccttaaagaccactgtcagggatccaaaagccttttcgcagtattctgataggctggcctttgcactaaggacactgggcttccctcattttcagggttggataggaagggtgatccgctgccaagcagggtaataattgttaggggcatggtgtaaaaccaagaggttagcaactcataggtcacattgaaagcatgcattttaagagaagcaaggtataataaaa

SEQ ID NO: 37255 - DNA, 6552 bp, Oryza sativa
  unsure (1)..(6552): unsure at all n locations
nnnnnnnnnnnnnnnnnnnnnnnnnnnnnnnnnnnnnnnnnnnnnnnnnnnnnnnnnnnnnnnnnntagtacatggcgtaagtctggacaggatgcatgacccgctctccctcgtatccgaaatatttgtagacaggcaagtaatagaacatggggtagataagaagaggacccaagtattcaaagaagaacagcgtgctgtagaagacctgtgggcctaaatccttaaagaccactgtcagggatccagaacccttttcgcagtattctgataggctggcctttgcactaaggacaactggctttcctgattttccaggttggatagggagggtgagccgctgcctagcagggtaatacttcttagctgcatggtgtaaaaccaagaggttagcaactcatagaacacattgaaagcatgcattctaagagaagcaaggtataataaaatagtttttttttaaacatcccgctagcccattcatgattcacccaaagtaatcaaactgagttttctgtatatgtaagatcaaagattatgatctacattagcaactaatgctgcaatctttcagttagaataagattagtttgcatttgcaatcttgcactggtcagtaatcactagatgtacttggattccacactttggttcatctattacggtgcatgtttggtgtactaacatgcacttgagggcagtgataggaaataaaactacttaggaagattttaaacagtacttataaccatatatcatgatgtatcttctcgctctactacatctctaccacattgcaggacctcttctttactcttgagggtccaacatgaataataaattccttgtgaacatcacctcaggataacattatggcaacttaatagactaacatgcaaatgcgccagtctggcacaagcaagaagatggtgcttataattgtgacaataaataccataatgacatagaatagaggttcttgatagccagcttagctaaagtttgataaattcaagcagtaaattacgttgtctgtcattgataatgctacatcagcataggttgtgagttaaaacggacactaggtggtgacttaagagtgactgacaggagcacacaaaatgacaggggaattagcttcctgattcaaggctcaaaaaggaagaaccatcagcagacagggctgaaatagaaatggttttacagaaataagacaactagttgctcgaatcagcatgaccccttcatcagggtaaggcacagcaccaaatatcatgaaacactcaagataggctttatcacaagcaaatttgaacatgatacagaaaacaaatgcagaccagtaaaaacacttccaatttcttcaacaatagcatattatactcaatgcttgtgccgtacatatgacagagacagtcttagtaaaaagtgtgaacttttagtattacatttgttgtttatttcagtaaaccatgtgtgcatatttcaaattaggcagttttcaacataacgaatattagctggctacagtatatcaactaactatcgccctttgtttatgaaagattggaagctattttcaacatacaggtcttcctaaaatcattttggcatacagtcaatagtatattgccaagttagttcaaccacgtttcctgtttccatcattccatgtaatctatcctttttaagatttctttcactctgcaaaggtaaacgaatattaaaaagtgcacacacaaagcttgtgagcgagtagaggttgatagccaactccatcctacctaagcagatcctaacaacctgtaggctgcagcaaccaaaagaatccttgccagtactggcaaagtggcaagctctagtcaaccaatcaaaatgaaccaagggcgaacacaattattatatcgatgtactgttttcatgttccaagcactaggttcggtacgaacataatattcagtcagttgtttaccttttcagcttataaatactagcctaaatatcaattattatctgcaactcccaaaccaacatggtccatgtactgatatacaccataaatcagacttctctgatggctaacactcgcaagtttgagtcaaagcatcaacagtaccccggggtgaaacgctcttggattaatggaagtgcagaaaatcctttctttaactctcttttaatgaattaaataagtgcaacagtgattactcctgatgaccatactaattaactcccaaaatgtcagatttggacatactggccaaactcaatcgacgcttccaaaatttagaactgtaggatgtattaaaaaaggcagtcgtagtctaactacataaaaaaacatatttgccttaaaaaggcctttagcttgaattgaatgcaaacccactcatatgcatatattcctatctttttcaacatgtaaatacgaccaaacccttccaaagaatgagaagataacgaagtgcaggagagccactacaagtactactcctttaacacatcaacaaacacaaccataaaacgggaaattttgacgggatcattgcacttactcttggcatagatggcatcctgcagatccgcgaccttagcctgcaaaagaaaagaaaacaagaacccacgaatcaaacctcaacctcaaacctttccacgagatcttaaccccccccccccacccaagaaccaaaactccaaaccctcccccctacaaggctgcaacaccaaaacccataatccgcaccaaatttctcaatcaagaacctgacgagctcaaaaaaaaaaaacggaacgaatggagacgacataccgagtccttgagctcgacgccgcccctgaccacctcccggccgctccgggacacgacggacaccttcatcccgccgcccaccgcgagagagagagagagagctcgcgctgcggccgccgctgctgctgctgctgctcgtgcggtggagacgaggtggggatcggggagtggccggaggaggtgtatttgatcccgcgggggcaagaaggtgtggggcccacgggccgctgggccgttggacccaccggagttatgcgacgtatccggccctcttgattgtatggacccggtccatggacccccaaaagtaaaattcagtgtgcaaaaacacaccgtttgatcaccgattgctttcggttttgtcgaaatttggggttttgcgtatctagatcgtgctagtcatgactgagatttgcgtaaatctcttgttttctttaacagatttggatatcttcctgatcacaatagcatgatcgttcgtttagtctaaattgattgttcaatcacaagttcacaactaggcatatattcttccacatggatacatgtgctgaccaaaatgtgcaaagagtgtggcacgcattcctgaagcacacgctctttgtaccatcggtgagactctgtaattacctcctccacgcctagttcacactaaagtttgaaaatttggttgaaattggtacgatgtgatagaaaagttatgtgtatgaaagatttgatgtgatgacaagttgaaagtttgtaaaaaaaaaactttggaactaagcaagacctaaaaaagaacaacataaaagcaggaacttcgtgcaggaaatgctactaggaattaggaattaggatcaccattcttatcataatacaccatcatttgtgttgatcatctgcttaagaacttgcaataacactctgaaagcagtggttactagtaattgatagggccagtcatgtcagtaaaaaaacttgaggtggtgtatggacatggttcttcagagaaagatgtcggtacgatgcatggaggctgcgtcagggaaggagttaaggattgcagttgggaggtaggtcgcccaacgggcaccaacgccgcctgcaaaatcttccgtgctgtctgaaactctgaatctgtgatgcaaaaaattccctgaatagcgagacatttttttcttgtgaattgtgagatttcggaatgccagcaatggccgatccatcacgatcagttcggatcaagaatccatcaatggagactgttaccagtaggaaggtggagtacataactatcagcattcagcagatgctcgtgtggaaaattcagggttcattttacctgcatcataaataacaataattcatgtttatttgagatagttaaaattgatggattaaataaatagtttgatctttttatggctctcctacaaaatcaatcagatatttaacaagttattatgcgaaaatttatatattattttccacgaacacattgttgagaagctggtctagaataagaagagggtaagacgaaaattagtcattctcgtatgcttatttgattgttagccaactattggctccaattcatttatagctaatctaatagccaattaatataatagttagctataaaaatatactacatcattaatattcagtcctacctctcattcacatataacgtcttagagtccgtgttgcagctggctacaaatatgtaacccgctttcttctctctcttctcttttcttctcgatatgaggttatagatggcttatagcatgctattgtacctgctctaatgtgcaatgcatctccatgaatatttgtttgtatttaagtccttgtgtaatgctcaactcctgccaacaaatcttacaaagttttacatcaaggaccttggagtaaaacaatatattatatatacacccttgggcccacctgtcaacctctcaccctatattaagtaaggaaaaaaaaacctcctcttccctccacccgtccgcatcccaaattcccagcaccagcagcgcccgccgccgccgccgccgtcgccgtgccgagctctcctcctccgccagatccgcactagcggctcggttattctctccggcacgagagacgagggttccccggcgagcgagcgagggccggcgatggcggagccggagcagccggagttcgcgcgcgagcggcacgtgctgtttctggaggctatggcgtcggagctccccgcggactacgcctcgcaggaggtcaaccacctcaccctcgcctacttcgccgtcgccggcctatctctccttcgtgagctcgacagtgtaagatccccgctctccgcctgatctgccctagcggttatcctctcgatccgtttcctgaattacgcgtaaattcgtttttttttagttatttgttgaactctagtctagactagatgtgcccgtgtgcaaagcttggatctttactttaccttgtgtggtcgctttgcttgcatttagtggaagcaaagttgcatctgtaggaataaaatcaatcagcagatttggtgcacttatggtaccatgaagtattttgaaacctcaaggatggctattggtagtatattcagagataaattagttgctgtatccataatgggagttgcaattgatctttattgtgacaaacacagggatccaaagtttgtggatagcagaatgccaagtgtggaagggtcttttcaatttttttttttttggaattcctgtaaagaacaactactagctgcaaggtttaagcactttagcccataagtggtcactgaccagtaaccagtctactcaaagcagttagagattattgcggttaggcaatttgcatctgtccggcaactagatcacaatatcacataactacattcgctttcgatttctagccaaactaagaggaaaggggcccatgtgatgtttctgtagcaacgaattggtccacgtcccttaattcggtctaaattccattcgtctttgtcttgtccatgggcagttgccttaatgctctgcacagttaggagccgcctagttggttatgatttaagttcatcatacttgatgccttgctcatgtaaacaacaaaaacatgatagcctcctgatatctccattctcaaattactagtaacttctaaaaaaacttatagcctcatgcaaatatttttttaccagtcttatcatgaaaattgtacctgtatgtattatgtattaaaacaagtaaccatgcctggttgctagctgaaatatttattgtgggaatttaagttcactttgtgccttgactgagttgactcttcaggaagaagtaatatactgagttgactgagtagtaatttgatgagttgtgtacttgtttgcccttttatactttctttaggttaacaaggatcaaatagccaaatggattttgtcttttcaagtacatcctaagacagacaatgaattagataatggtgagttttcctcagtacttatgtaataaagctctcaagatagctaattcatatttttcagatgcaatatattcattatatgacaatttatatgtttttaggacaattttatggattctgtggctctagaacaactcagtttccctcaactaacatgaaggtagatgtggctaattctcaagtcaacccttttttttttcacacatatcaatttgtcatttaatttttacattctgacagtttgaaatatgaattcatgcccttcctcagg

SEQ ID NO: 37256 - DNA, 16396 bp, Oryza sativa
  unsure (1)..(16396): unsure at all n locations
nnnnnnnnnnnnnnnnnnnnnnnnnnnnnnnnnnnnnnnnatgtaaacaacaaaaacatgatagcctcctgatatctccattctcaaattactagtaacttctaaaaaaacttatagcctcatgcaaatatttttttaccagtcttatcatgaaaattgtacctgtatgtattatgtattaaaacaagtaaccatgcctggttgctagctgaaatatttattgtgggaatttaagttcactttgtgccttgactgagttgactcttcaggaagaagtaatatactgagttgactgagtagtaatttgatgagttgtgtacttgtttgcccttttatactttctttaggttaacaaggatcaaatagccaaatggattttgtcttttcaagtacatcctaagacagacaatgaattagataatggtgagttttcctcagtacttatgtaataaagctctcaagatagctaattcatatttttcagatgcaatatattcattatatgacaatttatatgtttttaggacaattttatggattctgtggctctagaacaactcagtttccctcaactaacatgaaggtagatgtggctaattctcaagtcaacccttttttttttcacacatatcaatttgtcatttaatttttacattctgacagtttgaaatatgaattcatgcccttcctcaggacccttgccacaatggtagtcatcttgcaagcacttattctgcccttgctatcctgaagattgtaggttatgatttagcaaacattgataacaaggttcttttgtcctcaatgagaaacctccaacagccagatggaaggtatgcattttagttttggtctccatgctaattattcttgtaattatcctccaaaaatatctatgcatttacatctgctacctgtgtttagttttaactgtaccaccaaaagagtttcagccaactcacattctgtcttaagatttcataataccccatagttggcccacctccttgattattttttgtatgtgttgattgctacctttccatttgcatatgttttctctgcatgaatttagtcatgccatgtcgttcgacaaacttgatattggtaaatacctcctttctggtatatctctgtattgttggtcagtcttcaagcttgttcaatcagaatgttaattaatgtgctgtgatcctaactgcatgcatgtgatagaggtgtttgtgcatgtgcaatgcaatcttgcttgcctgtgagcatttcattgatttcactaagatggcttccatggttccattctgcaaacaactaaactccacgcaccgcttaaatgcattatcttattggccaacttgagaagcattttttttttagcttcatgcctactcatattggtgcggaaacagacctacgctttgtatactgtgcaggtgggttgcactgtcatttatatttagtatgctttcaattttatctttgtttgaaataacttgacacacttgtgttgtcttctcagctgcaatctgctcgatgctaaaagattggacaggaatggacaaggaaaaggccaagcaatacattcttagttgccaggttggcttacaacaattcctgatgcacttggttttgagacaccagtgttttgcaccatgctatttaaaatccttaattcttgtttctaccacatgcagtcatacgatggtggctttggcttggttcctggttcagaatctcatggtacagcttcttttaacctttgatgtgcttcttgtcctactgagtttgtcatttcatgtggcagttttcttcagagtttcagaatgcaataattcagctaaatttttgttttatttttttggagtcggttatgggtactcattgtttgtctttgtgttagtgagtcaggtggagggacattctgtgctgttgcagctttgtgcctgatgggtttcattcaagttgatttggcatcaaatttacaagaaccatcatcaattgatgtacgcttgctcctggagtggtgtcttcaggttaaattctgctcaaccatatatatctgctattaccatcaaaatctgccctttgatgtgatttataggactaacatatatttccaaaactggacagacactatatgcagtacaccaacccgttttaaatgtttctaatttagtagatatatgcatcaaccattcaattttcatttattcatgatggagaagtgcagcttgctcaatgacaccacaccatccagttgtttttaaaatctcccttatgtagagtaaaaaaaatgtgaatcataaacggatttagttagaaatgattaataaggactaggacgactttactagtagggaatcttaactgttttcactattatcatatagagacaagcggcagacggaggttttcaaggaagaaggaacaaatccagtgacacatgctatgcattttggtaaatacaccattcagagttatatatactaattgcctgacaatcaaatagcaaacttgggtaatctgtcttgctgccaatcaacactctgcaggattggaggtgtcctaaagatcatcggtgcataccgcttcattgatcatggtgctttgcgaagttttttgctctattgccaatcacctgtaatgacttcctctctaatcagcttaatttctcacattgatcaagttgcatctttactgatcatgtatgcccttgtttaccattgcaacagtatggaggttttacaaagtttttgtacgatcaattcccggatatctaccattcttactatggacttgccgctctttccttgctggaagaggaagggctggagccactctgcaccgaactggggatcctctctgctgcattgtagcttggaattgattgttcatcttctgtattcagtcaagttatggtgttctttaaagtccattcttgtaatctaatacaacatacagctgaaaagaatgcaagtaatctatagagttcgtttgtttgtttgggtaggcaggtcatgcaacattgtcttggataatatgattgtgaagtacagaggagcattctgtaaaggctatttcattttcagttagtcgaactaactgatattctgatagacagttgagttggctgagcagttctatcacttggaaagctattgaaaacaactcatgtaacagctgaacaaaattatcatctttattctgtttcttgatgtgcttcctatgtatcactgattaattctggtagttgtagatgctgatatacacacacagacacacaatttcttttcttttgacaggccatcaggttaacagcataatacttgtgattgagaacagagagagaaatgagagatttttttttactgaacctgcgtgtctgaactcttctgaagataaaattgaaagttgcagtactgaactgaatttgcagcagatcacatggatgatattggcgggagagccggctcagtcagctgcagctgccataactgccaccgccacccccacatccactccgattcattgcgaattcagtttgatcagtggttggtcggttggccagcctcccatccaccggaattctcaaatcggagcaagcagcctactgattgcgattgcatcctctgatctgatctgctgatgcgaatgcgagcagtaatcaacagcgtagtagattcagtccacgcgcccattaaagccaagccactgtccttgtccatctttgtccaggcctcgcgttcctcggttcctcctcctccttgctagctgctgctgagtgctcggcgatgacgggcgtcgggtcggcggtgcggcggctctacctctccgtctacaactgggccgtcttcttcggatggtactccgccgcctcgcgccgccgccgcctgctggtgtttggatctctcgttttcttggcttgatttgggggggtttcttggatcttgcagggcgcaggtgctgtactacgcggtcacgacgctgctggagagcggccatgaggccgtctacgccgccgtcgagcggccgctgcagttcgcgcagaccgccgccttcttggaggtctggtttttctgctagtctgtgcgctctgacttatttctgaattttaatcgagtaaaactgtactccctccgtccaaaaaaaaaaaagacatacctgggtttccgtgtccaacgttcgactgtgtcagtcttatatgaaattttttataattagtatttttattgttgttcgataataaaacatgattaatacttatgcgtgacttattttttaaatttttttcataatttttttaaataagacggacggtcaaacgttggacacgaaaatccagggtttgtctttttttttttaatggagggagtaggttttagctcgagcttgtataatttgggcagctctgacttcattttgaattttccgtctacccaattagggttgctacctgttgagcaatggcacagagggaaaaaaaaattaatccccttttgcgttctaaaaatcaaccaaacatttagcctgagagaaatattaccagtgttatagcaaaatatactgcaattaattcaacttcattgttatgtttctgctgcctgatggtggggatcctctcccccgataattctgctaaaaagaaaagaaaaatttctgctgccctagcagtactttgtgttatattccttgtagttccctagataaggaagcatttatattctttgcacggagcggctgaacgagtccgcggtgaacatagaatgaacgaacattccatgtttatttcatttctttgtttttttcgccgggatggcgaagaatgccgaccgatgtatatttcatttctttgcaaattgtgttttgtgaggtactgagcatttttgtgtttgtttggcgatggcgttgctggtggctcagattcttcatgggcttgtaggtaagaagttgttcttctcttctacttatgttattttcactatcctggtcatcatttggaattgtacggttcctatctatagcgtgcagcacgcaaactccatggaaatagagtaatagactttctcgttagaaagcatgccaaagacatatttcaatttacaggaagtgtcctgttagattagagaaacaattgtaccttataaattcacttttatgacacttctcatttttatcacctgtataacatgctgactttgttttaaaggtttggtgaggtctccagtctctgcaactcttccacaaattggatcaaggttgtttcttacctggggcatcctgtggagctttccagaggtatcatcgactatcactaataagtgttgacatgctacgttcatgctacttctcctaagcatttactgtttcgccgagacattgaaacatgacataattttgggtttaaagcattgtctaaatagaaaatacggatcatataatttgatttttatatgagggctggacactaggtagtttgtctgttttatgtctggttgtggatcaagtaaataatggtgatgattgtacaagttactaaatggcataactactggtactgatatgcaaatgcagtgtctttacttttgcatccctagttttctgttagttgtatgcttgtagtgtagcttaacacatggtttcatgacatatatattgattgatccctttgtacatttgtcttgcagacacattcacatatccttgttacttccttggtcataagctggtccatcactgaggtatattttgaagactcacttcttaaagagacacgacattttccaaattataattttgatttctcctgggctaagcttattcacaccaatatttaaaatattgtgcatttgatagcataacgtgatggaaatatttgtggttccttgtagatcattagatattccttctttggcatgaaggagacattcggatttgccccttcctggctcttatggctgaggttagtaaagaagatacatcattatttagcataaatttagagagaatgcttttctttttctttcataacttcttttcttaaacctggtgctgattttgtacaggtatagcacctttatggtattgtatcctactggtatcagcagtgaggtcggtttaatctacattgccttgccttacatgaaggtaacaagaatgaacttcagaaatgaagatctccatgttgttcaggctcattgcataatgcgtaatgcgtatttaactgctcctttcctgtgactgctatgcaggcaacagagaaatattgccttaggatgcccaacaaatggaacttctcctttgatttctcctatgcatccattctttctctcgccgtctacgtgcccggtatcccctcctgccttgcagtcgtcctttattcagtgattgaaattatttttataattgcaattgttgtttcttagtaactgggatttgataggttctgacaagaacactgcgttgcaggatcgcctcacatgttcacctacatgcttgcccaacggaagaaggcattggcaaaggctaaggctgcataatggtgatgctcaagagctttcttgaatttgtcacttgtggcttaaggatctgcctaaatagctcacatttgctactcttttagtagaagtctgtagatgaggacatgttggaaagaactactattacactgcccatcatttgttgtaactgtagtcttctaccaagaattctagattttacctggttaaattattgaatgattgatccaaaatttaccagcttgtttcaaattgcactctttttgcgtttgctgttagcctgttatgctgtatgttgcacactttgcactgcgtgctatagagaattggcatatttgcatatttactggtttgcaattatgagtcccattgtttcacttatgcttataaataaattgattttgtgattttctcttcacagcttattttacaacatttgcttttgaatcactaagagcacgaatataaaagtttttatgcataattatttttaaattgctaataagcggttcgagtaaacataaacataaaggcaaacgataaggccgtatgatttgaagtagttagctaaatttcttttgaaaaaaaaggagccaaatttcaaccttacaaaaaccatcgaaaacgctatgaaaaatcccccaaaaaataatttcatgcgcagttgattaacccgccgccgcacacgcctcccccgtactatccgacgcttctcttcagtaatctgtagtccatggccatgtcgtcctcgagcaggtcgtggcgctgctgtggctttgaatccatctgatgggatccgaggcgcagcgagtggcgtggatgggggcagttcgggatcggggacgcgacgccgacgcggatctgggtaagtcccctgcagcgaatctcgcaaaatctgcgtgcgaaaatgtggctgatggcatggatcatgcgcggattcagttggtctcgggtagtttcccggtgtgttcagattcagatcatgcgcagatattacccctgttacatcagctgccttgtttccagttcgttgaggcaatttgtggcactaactcaacacatgagcttgttgaaacagtattatcaattggaattcggagagttgctgatctctccctctccctgttcctcgtagctacattcttgctatccacgatggctgattgctattggttgttgatgttaactggacctcgatgcatacattacatgtttttgagatgcgtcagtcatgctctttgaggaatctatacacgtgttacctgttcttaggaataaagtaaagatacttcttttctgaagcctgataaaaaaaacatgacctttgaatcaagcttgtgatctcttggataacaaactctttctaccacctagttatgatttattaatatgacatggcttacatttacacaggtgaagatgaaaagagaaaaaagggaaaatgaagcagctgatgtatctgtcttcttcccttctttgttgtggcgaaatgtgttgatcacatggatgaattggttgggtggcggacagttgcagtagcaatgactgtcactttgtgctgccaactatttatttatccgatttgatcccccgatctgatgcttattaatcaattggaacagtggttagccttattcccttaatcccatccatgtctgaggaagctgctgcctgtcaatcaggactctaatattttagtgcttctgatgctatgatagtgtgatttgcatgcacatcggatttgttgattagattatcctggtcaaagccattagccatgacgttaaagccaaacccatctcctcgacgtcttcctcctccatctcgcagctctgcaatggcagcggatggttcagtgctccggaggctctacttctctgtctacaactgggttgtcttcatcggatggtcacttctagcatctttgtctgctggtatttcttggattggacactcagggtgttgttctgatcagggttctttggttttggatcatgcagggctcaggtgtcattgtccatgatcttggcgttgttggatgacgggcatgaggccgtctatgctgctatcgagcggcatctgctgtttgcacagactgctgccatcatggaggtctggttttcctcacttttagctttattatcattgcaaaactgtgaatgcagctctgcaatttatttatttcattccacatggagattgagaggtgctaaacttttttgtgttttgctgcttggctggtgatggtattgctggtagtgcagattcttcattccattctaggtacgaagtcccccccccccttttttctttgtaaaaaaaaaagagaagaagtcattttcttcttcctaatatgttctttttgttatccttgtcaactgtgaattgtagttacctgctaggtatggctgtcttgttcaaactttatgttaacagactttctggctaaccctcaatctggaatgtagaaaatactaatgtagttcctgttagattgaactatttcctacaacaatattgcttatcactgtattatgaattgttgaaaaggattggtgaggtctccagtgtcttctactcttccacaaattactggaaggttgttcattacctggggcatcttgtggagctttcctgaggtaatatcagaccttactcaagttatttgatagtttttgtcttgaaaataagttttggattagaaaacacttgctaaaatgaaaaaaaaaagtatgttaggtaatgtttctgctattagaactaattttatactttcatttatgatcataatgactctgagtaagcactggacaaacctaagttgcagaaattgcacgagtaattgatgccattacatcgtgaaggataagatagttctcttccgttctgcaccccaagttttctattttctgtatttaaacttctaatcaagtaaccattgtttgtagacaatattggtgagttactgtgtgcatttgttttgcagacgcattctcatattcttgttacccccttgatcataagctggtccatcaccgaggtatgtgttgcccccaaaactagtcaccaaattactcgcttggtagaccatgaatttcagatgcaattttattataagatgataaacaacaattcttctttttgaaatgacagtagttaaacaacaactctgcttcttgaaatgacggtagttattgaagttgttgccttagtcgaacatagattatgatttttttttcttcatttcagagcataacttcgtggaaaatttactataattccttgcaggtcatcagatattccttctttggcataaaggaatcatttggatttacaccttcctggctcttatggcttaggttggttctagttgtaaacatatcacaatatgtattagcataagcttcgaaaaattgctcattatcttattagtaaattatcttaaaaaaaattgcttcactgttttcatactgatttcttcgcaggtacagcacctttatagtatgctatcctgttggtatggttagtgaggttggcctaatctatattgccttccctttcatgaaggtaacctgaataacttagaaaggaagagctctacctccatttgataagtgacaacaatcttgtttaaatgctcttttgttttggatgatcaatgtcaggcatctgagaaatactgcattgggatgcccaacaaatggaatttctccttcgactacttctatttctctacttttttgatggctttgtacgttccaggtagtattccatgcaattgtacttcatttattaattgatgctacgatcatgtactaggtttttttcaataggattttctgaaaggaaactaagtaagatttgatggcatactaccttgtttcatttcatgaatgcagtatttccatacttgttgcgccatatggttgcccagcggaagaaagccttgtcaaaggcaaaaaccacataactactcaagagttattttttgctgggtcggccaaaggttagccgaccaatttcattaagattttgggggaaaatacagtaaaatgttacaacggcattacaatgccacggtagccagggaaggaccccaaccaaccaagaacgagaaatgaaagcagggctaaaccccgcggacagtcatggcgattactcgcgaaatttgatttctgatttctgatcacaaccatggctcaggatgctaccatttctggaacaaagaagcaaaggttactagaatggaaatgctaaaatacaattatacaaggattatcttttcccttggtaaattagaatgtatgcaagtaccattctcatggcttgctaatggtgtgttgtaccaaatatgggcgtttccatctgtaaataaaattgtactccatagtccatatggatgctgaaaaatgatatttagatgttctgcttttcaaggatgaagaaggctactgtcaccatttgatttaccatattggatgtgatgaaatggggccagatcaatgaatggagacaactgcatccgatcattcttgattattattttttagatgagtcattcttgatttcttccttactcttatccatcgatccatccaactgctgaaatgtgtatcattttcacagattgtctaagccatatagtactagttggctgttgaatgataatggccttccgatgtatagcagcagaagcaaaggaggatcatatatgttgtctgaagattcatccccactcttaatgaaattggtcggccagcctttggccgacctggcaaaaaaacaaattgtctgaagaactgtagatctgttcttggagcattttggcccctgtgctctcacaataaagaagtatgcagacaatgtcatttagtatatttttatcgtaaatgttcctctagttgtgcactcaaaatactaggtgaaatcattagacaaatcatttttttaaaaagaaaatagtataatacaaaaagaaaaattgctcaagtgaccggcagcatcaggcctaaaatatcaccatagcgagattttcttccgtccttctttctggtaccggtcttcatccagctgttgattgctgaggggtacgatgggcatgaggcgctttcgcgtgtggtccgctatccatctctatctcgctatcccttctctatcccgtgcgctaacccttctgcatctcacgctaggtggggccgccgcacgacacgggagaaaaactcaaggaggagggcgaccccatccaccgcaccggttgcaggcacgcagcaaggccgaccccatctgcaatcatctcggaagcactgccgctgcatgagtcgtcaccgtggtcgtaggtgtcatcgccgcaaagggaaaaacaacaggggaagacgtcggggtcgagactcaaggctaatagatgcggcgcagccaaaaaatggatgccgccgccgccgtcgtattttccgccacgcgccgccgtcgggaacaagcctagggttttgctactctgcggcccttccccaactcgactaaaccttcctccgatccaaacatccttgcaaacgcgaaaatacgattatacccttccaccgttgctaactagagctacccaccccacgaccaagctaggacctcgaggtaccatgcaatcgtgaccattcgatcgggcatcaccaacggacaggattttagtacctcacagtactagtaccttgcggtacaaaaagaaggaccgaagcaatgctcttaaaagaagattaacttatgttacatcatgcctagccacaatggtcaacaattaccttagattacaaaaggtaaattagagagtgtcatcctcgctctagcttttacctagagcctagcctcctcgcgaatagccacgatgagcaatgtccagtccttgcctttccggttgaaaactctattgttaccagcatattgctcgtgtattgtaatggaattttaattaaagaaaattatcattaacatgttattaccatctcttaatttgtttaatttgttgtacatatttattactcacatatggactttttttaagctcacaatattttttttccttcccacaaaaaataaagagttgatgggagtagtcgatatgtgaccctctaaccccacatgtcatttatttttcttaaaaaaagttagagttggtagtggggtggtggcagaaccaccaccatcactattcctttttataaggagtatagatgctcctttcataacattcaagctagaagcgactaggatgaccaacatgtcgtatcctctcgggaaacaatcttctcccttgtggcgaaccatcccaagtcgaatgttggcttgttgggctgtgttatatcttctgagttgcacacctgcattgagtgctataaaatgacatatttactggtttgcaattaaggtgaactaaaattcttgtgaaaaaaacaagagcctcaatcctaaaaaaaaatcatccaaacggctatgagaaacccccaaacaacagtgcacggcacagaatcaccagtctgatcttgttgtctccataaaaaaaaattaaaaatatacatttttttcacttgattttatggaaatatacatgtttaaaatgaattagcagaaatataccattatcacagtggggtggtgcgaatttgccacgagttcacgtgatgagtgtgcaaactcgtaacgtgtttgtgatgtcatcacgagttcgtgcggtgagtacgcaaccttgtaggattaattaacttatcattatttttgtttaattaccattattagcaattaattaacaattattccatcaattaattcaccagaccgcattctctttttttttgctattattttcaaacatgtatatttattatgtaaaactggtgtgaaaaaaaagtatatatatatttttaaaaaaattggcggtttccatggccggcgaccgccaccacatctcctgctcctctcatgaagcaggtcgaggggcctcccatcggatctgggtaagcccgcgtctcgaatcttgcagaatctgcgtgcaacatgcgggtgatatgcacacaaatcttgcgttgatcttagttgaagatctcttcgttctcagtgtgttcttttgggtggtcagatcatgcacaaatttatatgtcctgaattcctgatggtgtggtagtagtgcgatttgactgcacgtcgactggtggatggatgagatattgagattatcctggtcaaagccattagccatgaatccatcatgttaaaagccaagcaccatctcgaagtcttcttcctcctccatctctcgcagctctgcaatggcagcggatggttcaatggtgcggaggctctacctctctatctacaattgggtcgccttcatcggatggtcagttcaactgcctactgtttgttgagtttctggatggatatcgattttttattttgagtttcatatattgatatagcaggagaaaaatacaaatctatagtcaggaaagaaaaacaaccacaccacgcgtctacaataacacactgccgcgagagtgaaaacattgccctctagcatctttgtttgctggccatttcatgggctggacagccagggtgttgttttttatcggggttctgaatttgatttggatcaatgcagggctcaggtgttgtgctacatgaccttggcattgctggataagggacatgaggccgtctatgctgccatcgagcgacctctgctgttcacgcagactgctgccatcttggaggtcctggtttttcctagttctttacctttatttatcagggagaattggagattgagaggtgtgctaaaatttttttgtgttctgttgtttgcctgatgatgttgttgctggtggtacagattcttcattccattgtaggtgagaaatctttttttcttttccttcgttgaaaagagacttgttttttcccccttctctgaatgttgttttttgtcatctttgccaactgagaagtgtagtttcctgcttggtatgtctgtcctgtgcaaactttatggaaacaggcttccaacccttaatctggattgtagagcatactgatatgttcaatgcctagatgacaaaacttcaacatgggctaccgcattctattattattatttttaaaattgtactacaaaagaaagggactaaaaaggatttctgattgagcctaaaaggctaattaccatctggtagctcttcattgttaggcggcctaaggtttactaccttgatgttgtgttttagttgttcatgctgaattagatcgtggtagatggtaagttctggtatgtgcacgataaaagatatgctgtaattttggtgaatgtgtctactttcacatttgtgcagtataatatgtagctcagcttacctctagcctccttttcaatcatttgagatcattatgatacaagcaataatctagaatttgaataaaatcaagagaagcctcaactttgagaagatcatattgttagcttcttcctaggagagaaaggaaatgtcctattagacacaattatttaccccaaaaaatattgcttatcactgtaatctgaattgttgaaaagggttggtgaggtctccagtgtcttctactctcccacaaattactggaaggttgttcattacctggggcatcttgtggagcttccctgaggtaatatcaggaccttactccaagttattagatagtttttatcttaaaaacaagtcctggactagaaagcacttcttaaaataataaaacatactatcttttcaggttataagactttctagcactgcccacatgtgtctagattcattaacatctatatgaatgtgggcaatatgtctagattcattaacatctatatgaatgtgggcaatgctagaaagttttataatatgaaaagggggaagtagatgttaggtgatgttgcagctattagaaatatccatactttcatttatgatcataatcctctgagtaagcattggacaaaccaaagcggcagaaatggcataagtaataaagctgatgcaactacatcgtggaaaaggataaaacagtgctctttccttctgcgtcctactttcctacttcctatattttaacttctataatcaagtaattgttttgtttatgaacaatatcggtgaatcactgtccacatatgttttgcagacacagtcttatatttttgttacctccttgctcatatgctggtgcatcattgaggtatatgttactccctaaaacttttcaccaaattactcgcttggaagacgatgagtttcagatgaaattttattataagatgataaggaataattctgcttcttgaaatgacagtagttgttgaagttcctgaaagaaaatcccaagcttttggaagttcctgtgttgagcttagttgaacaagtattatgaaattttcttcacttcagagaatgaagtgaattactgattccttgcaggttaccagatattctttctatggcatgaaggagtcatttggatttacaccttcctggctcttatggcttaggttggttctggttgtaaacaaaccatactaatatgtagcataaacttcaaatgaaactcattatctgatcattgaattctcttaaaagtaattcttattattttcgtactgatttcttcgcaggtacagcaccttcatagcatgctttcctgttggtgtggttagtgagatttgcctagcctacactgttcttcctttcatgaaggtaactttgaataacttagaaaggaagagctccggttgcatttgataacaatcttgttcaaatgctcttttcttttgcatgagcaatatcaggcgtctgagaaatactgccttaggatgcccaaca

SEQ ID NO: 37257 - DNA, 1506 bp, Oryza sativa
cattgaattctcttaaaagtaattcttattattttcgtactgatttcttcgcaggtacagcaccttcatagcatgctttcctgttggtgtggttagtgagatttgcctagcctacactgttcttcctttcatgaaggtaactttgaataacttagaaaggaagagctccggttgcatttgataacaatcttgttcaaatgctcttttcttttgcatgagcaatatcaggcgtctgagaaatactgccttaggatgcccaacaaatggaatttctccttcaactacttctatgccaatgtctttttcatggctttttatgtcccaggtagtattttatttcctgcaattgtacttcatttagtaattgatgatataatcaagtatcttttttttttaaaaaaaaactaggatttgacggcacactgccttgctgtttcatttcatgaatgcagtggttccatacttgtttcaccatatgatcgcccagcggaagaaggccttgtcaaaggcaaaaaccacataactcttacagtgatagataaatttggggaatttactgtgtactattgacttagggtcaaggactacatataatgtatacaagagatgaaaagacacatataccctttaacacccccactcaaatgcaatgtgtatacaacaatacatttggaaggtacaactaaactaaaaccaaaatataagcttaaagatattgtcgaagcatgtaagtcttgatgattaagtaggaaagatgcatcccctcctcaatgaagtggacctcgaggctttcacaaactgttcttcagcccttggtaccatgaagccttcacaaattgttcttcggctcttcaaagatttggagtaggttgagacaatccagctccggtgggagctgctgttgttgttggtgatgatataaaagactcatacacttagacaaattgaagatatgaaattgacttggatagatttgacggataacagaagacttgaactgaactgaaggacagatatatactatagcagcaacaacctttttctccaaacagcaagcaaaagcaacaagtaggagatggcagcaaaagtggtaggcgaagatgacctcacacttagaggctgtagcgcccgttccgtcgtggcgcctagcggaaaaattatctcttaaaaaccctaattgcgaaattgtttccttgcttgttgtctagtgtccatgccatctcagatctcaaatccccgatctatcgtcgagttcaatcccgaatccaaatccttccaaatcaaatccctccacaaaagtctattttgcctcccccggggtcgatgggccgaatctctctcggcccacctcccccctccctcccggcgctctctctctctctctccctctctctctccctcctcctccgctctgcccgcgcgcgtgcgcgtgaccgctcgcgccgagcgcgctcccttcccctcgctctgcccgcgcgtgcgcgagcgccccctccccctcgctct

SEQ ID NO: 37258 - DNA, 7324 bp, Oryza sativa
cgggcgctcgtctccttcctcttccccggcccgaggccggagagattactcccgagccgtcggcctctcgtcacagcgcccctcctcatctcggtagtgcctcccttcgttctccctcctcgctccatctctcccccttagttttcggtagtagcacgagtagcctccccgtagcaagccggcgccgccccgaccattgccgccgctcgccgtgtgctcgccgccgtcgccgcccgtgctccgtagcacccgctcgtcgccggcctcgctcggcgtagctccgctcaatccgacgctagcaacggattcccgtagccgcgtagatgctctcaccaccgggaattggcccctcgtgacctcgtcgccgttttccccttttgctctccgccggttaccgcccccgcaatccgccgccgacggactccctccggcgaatccaagccgttggctcgctccctctcattctccctcgtcatcccggtgtacgccccgtcacccctcatcgtcgcaagacgccccggagaaaccgccgccgcccgccgtccattcgcggccggcgccttcgtcttcctcccgccagcccgcgtggcagccacgtaggcgccacgtcggcgccagctcggccaaaatcgggtcgggccgaccccggtcagcccctcccatgcgcgcgttccaccgcgagccgtgaggctgcgcgtgggcccgccgcatccattccaccgcgaaccacgcgcgtgcaccacatcccttccccgcccacgcgcgtgcgccgcgtgctcgctccgcacggtgaaccgtgtcaccgacaagcggctcccacctgggaccacgcgtggtgagcccggtccaccggccctttccctcctcccctcccccgcgcgcgcgcttgggccgccttgggccggtccgctccatttcccttgggccgcgccctagccgcccgaggaaaagtctattttccctccctcttttcttttcttttcttttttttcaaaaaggatttaattaaatccttttcctttagaccaaaaatccaataatcttagaaattcaatatcttcccaaccgtaaatccgtttgactccgttcaacttccaaaattcatcaaatctcgagatctatctaatggcatgcttagaggtcattaatagggctttattttcgccgtttgttgagttgtcccgtttcgcgtgtagtttcggagcccgaagacccgcagtgcgaggatttcgaggatcaagctccagatctcgagcaaggcaagccacctttgaacatcttgagcctatatttgaaatttaattatgttacttgaaaaatattatgcattgataggatcgcacttaatctgttgtcccgtctgcaaggcagattggcggacctacctaatttgttgcatttgatccttccttgttaattgttatgtcatgtccccttgtaaccatctagttgcgtctcgatattcgtgcatcctgtgcaagtatcgacggacgcctccaaacttaaaatctgaataacaacttgggtaaaacttgggttttacaaaagacttggaaaacccgacacctgggtcggtgcttgcgaactaaatgaatttccaaaaccgcggaccggggaacgtaccgggtgtacggtttcccgctcttgcacttaaggaccgtttccttggaatttcatccaaacataagacaagtacgaccacatgggtggaatgggacacccctggctgagtaactagcttatcaagggagccttgatgccgagagacatgtggattcgccggggtggtgtcggggaggacccctgggcttcctggcacagtatggtctgggacctaacctgttggtctgggacccctctcgtcggcatatgataaacctgtgttggctttggaaatgccttgtcatgaaagcttggaggtctcccgacgtggctaatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagtcttgtttgactcttgcttgtgaaattgctgttgtggaaaggggttcgatgtttgaaagatctgcagctgatgggatcagctaggcccgggtggccgtttgaaagttgttggcccgggtggccgtttgaaaagttgttggccgggtgccaaccttgtttcaattctaaagactgatacattgcacatactccgaccggacgagacgcactgtctcatccgtgtcgtttgagaagcactcacttagttgttttcagaaaagagttcaaataaaatcaattgcaaaaacaacagcctttccttgaaacctatattaaacacttatttcccatggcttgctgagtactcccgtactcacccttgctctatataaataatccctcccccagttgctgaagaagatgaagcggaacctgctaatgaggagttcttccaggagcaagccgactacgatgagttttagggtttctgcctagttcccaagtcgcgcctgtgttgtttggtccaagtcctggcttccgtttcccttttgtaatgcagttgtgagctcgggatctgtccgcagcccaacatgactgtacctctactctataataaagagacctctattgctgtgatgatccgtcttcctgtgataccagcactgtttcctgggactggtatcgattaacaggttaatttggagcgtcacgggctagttccggtcggtactagttcggggcgtgacagaggccttggggaccaactatggtgatggccatgaccaatcactggcttggtaagacggtcttgcaaccaatgactgaggagcacatgagacggcgctagaggcactgccaccagcactggtactagaaggaccagcagcagtgatatccaagaaaacaggagcactagccgtcgcacgaggacgggggaccgctgcacgcctagctcgataatcagccaacttctctggatgaagatagaagcaatcatcggaaatatgtccaaccttcttgcaatgagagcaaatacgatcacttttggcgatggaactgaattcagggatcccgcccataggagctccaacacgctgaggtgctgccatgacattgtgagtaaccacaggagtaggagtagtgtccaaggaacaaagacgtgtctcctcagcgattagatctgcaagagcctccgccatagtaggacgtgtaggacgtccaagcaactgaactcgaatggactcaaattgagaggaaagtctcatgacaaattgatacactagattttcttgatcatgcttctctctcgccttgcattgtgcacaacctgaagcaccttttggagtctgtgcctcaagctgtccagacaaccgagtaaaggcattataaaattcttcaatggactgatcttgttgttgtaagttgtgcaaattctgcagcaaggaaaaacgcaaagctccgctttcttgagtgtacctctgtttgaggtagtcccacatctctttagcggttgagtgatccctgaaactcatccgaataggcacctctacactcatgaatatgaatcccataacacgatcatctgctgttttccacgccttaattttagttgcatccgttttctcatcaggaggatcatctgtgaggtgagatgcttgaccaatcgacctcaaaagcatacgagctgaaagttcccattcttgataattttgaccatttagcttaatgtccgtggagagcaaagctccacctccaagaaaggggtcggatgttgccatcaagaccagcagaagaaaatttgacaaattgactggacagagacttgcttgcaagacttgatgtattgtctcctgaattagcaccagcagcacacagcggcagcagtagtggaagagcagcaacaacggctgagcggaggaaccgcgtgacgagcggctgcaatgagcgatacactcacgcgtgatggacgaatcacactgacttgctgtgaatcccgctgctgatccggatgaggaggacgtgaagaagatttgcccgatagggagccgccgccggcaagccggagcgccggcggacgacggggatcgagggctagggtgtcacacccagaaattctcgaaccagaatttctaagctgaatgtgcattaaatccctatccaggaccagccagggtacataaacgacaattgttgacatacagacccacgtcttacaaaaatataaaagattacaaatgcagcgggaaagataaaagcgagctaaaccgggaagcttgacttcagcagcgggcaactccactccacaggcaaaccttgacggcagcgacgaaaccaacctctctgagacggctccaactgagaagaacttcaactctggtatgggggaaaagagagcaagactgagtactacccactgtactcagcaagtcataccggaagatgaggtatgatgcaggatataaccaaaggaagctaggggttcttttgcataaagcaggcatttcaaagcagtagttgaaagcagtaaaacagttgtagtaattaatcaatattaaccaatcactgtccaacgctacaccacgttgcaacaggcccaaccaaccacctgaactacaccagttcattaagctaaactaggggtgagactaatcacggtgaatctggttgatcgcccataactgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaagatttcacccccacccctcaaaaggcagtgggcggtcccctcttgcgccgcggtgaatccggcagctggacaaccgaacacctcggccgacccaactccatcacgcctaccctcgccaccggtgcctaggaaagggtcgagctatacttcagatcaagcagttacctactcccgcttgtggtaagcacggtaagtctcccagggtttcccgtgaaccggtccttaactgccatgggtgcgaccagcaaaaccatacactcacagcccgccattcagaatattttaattaactgacacccttgcggtggcaccaatctaaagttatgccaatagtcagagtctatgtaataatgtgatccccatttgtgtcctagttgaactaagcatggctaagcatttcctaagccaacatctagtcattttgatacccaagttatcaatggcataaggtaaccaatatgtggctgaggaataggacccatcccacattacattgtaaaagaatgcaacatttaatagaaatgcgggatattggtaaattgggtacaatatgatcaaacgtattgcatgacttgccttgctctcgaactgatgagacctcagcaacgtcttcgagaaaccacggatcgacgaaacggccgaaacctacgcgacaaacaaagcacacaagcaaaacatgctataagactactgaaacaggaaacaaaaccatttttaatggattctttgcatttttcttgatttactgagacttgaatggacttaaacggagctcggatgaattacttatgaattttagaagataaactgtgtttttactaataaagaaaaagtccttaattaattattgcgcaataatacccagggctgacgtcatccaaggggggggggggggcggcgccgacaggcggggcccacgggtcagcggctcaaaggggagaggaagggggcgccggcatgtgggccccacgggcagtggctcaaggtggccggtctaccgtggaccgggaccacgcgggtggtccacggccggtccacgggaccgacggtccagatcggccgggaggccgatcggacggcacagcggcggctaggcacggctcggctcggcttcaaaaccggccggccggccatggcaaccggcggcgacgcgcacggtcgccggcgacggcaatcggcggcgcgggaagcgacggcggacggggtacaggacggcggcatcgaccgaaggcgatggcaagcgcgtggagagaggcggcgcaaacgagaaagaggggaagagggaggaggaggggatcctcaccggcgagtatggcggccggagcggaggatgaaggtggcggcgacgacctggcgatgaggaggggcggacgggcggcggcggcacctacggagggagttgagaaggattaggagtagagagagtgaccacggcggccaccattgttggccggagacgaaggagaatggatagctcaccggtgtgcgaggagaaccgggctccggtggggtttagcggaaaccgagcggcggccgaggtggctcacgcggcggcaatgctaatggcggcggcggcttggcgcggcggcggctctagcggctgcggcgcgcgactggaggtggcggcaagcggcggctctagtggcgagcggcgcggcggcggtaggaggcacgggagagcgcggcgaaaaggggaaaagggagagggagatacggggaagctttataggggctcgagaggggcggacatggccgggaaaccccctcgatttggccggtgacgtgggggagagagagagagtgggggggattcaaatcgaatcccgcccatttgcgggcgcgcgtgcgggcgggaatggcggggagggcggcgacgtggggacgcggagtgggggcgcggcgtggagcggagaaggcggcggcgcggacggtttcggcggcggttgccgtcgtggggcgggcggctggaggaaggggacgacacctgtcagcgtcccggagagaggggaaagggaaacgggccggcccaaaggaaggaggctgaacgcgggagggagtgggccgacggcccaatagagaaaaaagaaggaaaagaaaaagaaaaagaagaaaggatttttcctgggatttaaaattgcactttggtgatttttaattggttaaaattatttccaaggctctgaaaattccactaaaaatcttattaatgcattggagcatggggaactcaagaaaaattccaccacgctatttccgattattaattgcatttattaactagggatttagctctaggttaattaagataatttcttcgggcaatttatttaaccaatttttaaagcaagaaaagggggaaacttcagggtgtgacatagggttcagcccatgagctctgataccagtgatagataaatttgggga

SEQ ID NO: 37259 - DNA, 9568 bp, Oryza sativa
  unsure (1)..(9568): unsure at all n locations
nnnnnnnnnnnnnnnnnnnnnnnnnnnnnnnnncaataactactcaagagctatggaatctgatttcttatcgaagctacggctcaggttgctaccatttcctgaataaagaagtaaaggttactactagaatggaaatgctaaaatacacggattatcttttcccttggtaaaaaagaatgacttgctaatggtgtgttgtaccaaacataagcttttttttttcccatctgaaggaaaaatatgtactcccggccggagaaaaaaaattgtactactctatatcaatgccgaaaaatgatgtttagatgttcggcttttcaaggatgaagaagaagtgtcaccatttgatttacattgatgtgcagtaactgtcagtgaaaggagccaattgcgtctgatcattcttgatttcttcctactcttatccatggacccatccgattgctcaaatgtgtaaagcctttttttttttttttttttttttttttccgcagattgttaagccatagttggctgttgaatgagaatggccttccaatgtatagacagggtttaccttttcgtttttaaagtgaaaattgttcctcgctagtttactgaaaaccgatccaaaattggtaaaaatcaatgactttcggtcaacacggtacggctgatgtcgatagcagataagggcagtgaagcatatcttttgtttgaaaaactgttggagcattgtgccccctatgctctcataagtaatactaataaagtatttcctccgtctttaaatatattaatctaatagtactacattagacacaactattgttaatgggtctactctagtaccgtgatgctcaattttaggatggaaggagtatgcaaacaatgccacttttatttttatcatagcatacatgttctatttgtgcactcaaaatacccggtgaagtaattttcttaaaagaacacctttttgaaaagaaaataataaatactccgtacaaaagaaacctagggcctgttcacttagatgctattttcaaccttaccaaattttagtaaagttacaaaaaaaaaatggttacatttagtttgctaccaaattttggtaactacataagaaatcctgccaaaattttggtaagttgccaaaattttagcaacaatgccaaattttggtaaggttttttttgacatcaaagtaaacaagcccctaattaccctacctatcgtcagcattaggcccaaatacggcagtagcattcctggcccatacagaatttaggcccataacttgggcttccagtcgcacgcggcccacagcccatattggtgtggagtcaaatttgtcatctgtgccgcacatctgtgatcgaacgtctcgtggagcccattgtcggtattactgacaggtgggccatggcgcggtggggcccacacgtcagcctcatgggttggcagacccgccgccgccgccgccgccgatcgccgtcgcaatcccctcctcttctccgtctctggcttcccgagccagtatcctccatggcgcgccggcgagagactctcgctcgcgcagccgtgctgcccccaccccctccctcctcctatcctgttcgagccaatggctccgtagtccatccatggctaccgacgcccggagtggattgtggcgggaggacgaggagctcttgcccgtagtctccggccgacgagttcgaaacgcattcggaggccaggccactggcgaggatggccgcggccggcggctccgatgtggtggggtaagagggtaccgttcttactactgaatcttcagttggttcgtctactgaatctagttaattcgtggaggtttttagagggaaatatttattccagtacagtgcaagcatgaacatgcagatgaaggctccgtgaatcaatttctgcatgaaattagtggatctgtgttgttttcggtgtgtttctccggctggggatgaaggccttctgtcccgtttgttgaactcattgtcgacatttggcaattgtcctatcacttgaaaaattgtcgatggtgctcctcttcctaattctcataactgataactgtgttgatgttaacaggccatcgatgtgtatccagtataagctgttcagctgtttgagttagctcttaggcatctatacatgtctttcacgcataaagcatacttatgaaatggcttacatgtacaggtgaagaagaacaggaaaagaacgaagctgaatgagaaagagaagttgtatacttgtaatcacgtgctatcttttcgctgttgcaatgaaatttcctgatcacatgttcacatgaatcatatcggcagtttggcaggcagtttcagtggcaataagttcaactgtgtgctgctcaaccatttccttttcgaacaaatctatatatgttttatctgttcttgagaatatagtaaaggaacttcttttctgaagactgattaaaaaaacatgacctttgaatcaagcttgtggcctctcagataacgaacttttcctgccacctagttatgagtataatatggcttacatttacacaggtgaaaatgaaaatgagaaaagaaaaggcacaataagaaacaacggctgatgatttattatgttctgcccttctttgttgtgacaaagtatcttgatcacaaggacggaattggcagggtagctggcagttgcagtagcattaactgccaactgtgtgctgctaatcttatttgatccaaattatatggttattaatcaaatcccatagccccataatccccaaccatgcccgaagaagctgctgtaagatgctcaaacttgtattttggtgcttctgatgctgtgatagtgtgatgcttgtacatcgattggtggagtagagtatcctggtcaaagccattagcaatctcgatgtcttcctccatctcacatatctctgcaatggcaggggatggcgtcagtcttgcggaggctctacctctctgtctacaactggattgtcttcatcggatggtcagttctattgcctgctgtttgttgagttgtgcatgaatatcgatctcacttccagcatctttgtttgctggtcaattcttggattgtacagggtgttgttttgatcaaggctctttgatttggatcttgcagggttcaggtgtcgtggtccatgatattggcattgttggagaagagatatgaggccgtctacgctgctgtagagcagcatctgctgttcgcgcagactgctgccatcatggaggtttgttttttctcttgttgcctttatagtagtaaaactgtaaatttggatgcagctgtacaacttttttgtttcattgctcatggagattgagaggtgctaaactttttttgttttgctgtttgcctggtgatggtgatactggtagtgcagattcttcattccattgtaggtgagatatcctttctctttataaagaaaataagtcttattttcttcccaatacattgtctttttttttgcagaaaaacatataatatgtcgatgacaaaacttcaacatggggtaccacattaaatttcatttttgactttttactgcaaacgaagggattaaaaatgatatgtgattgagcctaaaagatacataagaatctgggggctcttcagagtggaaattgttaatcatgcaaacactttaggtctaagggttaccttgatgttgttttttggtttttcataatgaattagatcgtggtagatggtaattactggtatgtgcacaacaaaagatatgctgtagttttgatgaatgtatatagactttcatattttttttattaaaacatgcataatttaaaaataatattattttaaaggaaaatcacagaaatattgctcgattggtggaagtcacaaaaatagaaccctattgaattatagttgctcaataggtgacttgtcgaactgggggaggccgacaggcttagctggcgtgagaaaaatccaagtcatgtaaacactttatagtttacatgaatctggtggctctgcatggtggaaattgtagcttgtcgtcccaccgaagaacagcaaagattcgtcgtcccacagctgatcgatactccctcgtcgggagtaggcgaccttccaaaaataatgcaggccctatgccaattcaaaaaagtgacgtggtggagcggtctgctagcacactcggattaaatgcactcatggattaaaatgctactacctccatcctaaatgtagctatttcttgcacagtgccttgtcccaaaataaaactatttccccacctacctcctcatctcaaccaatcacaaccattatgtttcatctactttctcttctcaaccaatcacacactttctataattattctcacctactttcgttatacctgtgacaacctcaataatacttacattttggcacggaggaagtatctagcctacctgattcaagcatgtgtcaggccatccccaacccagaaactattaagtagtttccatacttaccatgtcatatagatactatgtatagaaactatatatccaatagatggtgtcttcaaattaaattctcatccaatcatcgctcttctctctccttttatccacctatcctcttgttttcattcttgattcttgtgtagagatggttttttgcatgagaaatggtttcttcatctttttacctctttcctcattaactctcttgccacatcaaatttttgcttatgtgacaatgtatttaggtcctgattgtttcagcttaagattattgtaatctagattattgaaccatattactataagctgaattataataagccgccatagaataagctgcgagctgtttgtttccctggattataagttgttttttagttgttagccacccaataatctaaaaaagcacctttagagtggattactagattatagtaatatggcttatagattgtaataatctatcataatgagctatatgtttgttttagcttattcctaataatccagattataataatcctaagctgaatcaaacatggccttaatgctatggacacgatatgacatggagggttggggatggcctcagggagttgaaactagctgcatacacggtttaaatgcacaggccctcatgtggaccaatcggcttcccagtggacgacaggcctccatgcatgtgccatgtagacctgcggttgccgatatgttttgtggtggccaggtcagtctgcagctgatcgataggtggcgtggcaggtcctgtcgttttgtagctggttgatgggactatgtggagttaggctgacagactttccggtccacatgtgtctgatatgggcttgtcggcctcccctagaaggtccctatcaaacaacccaagaccgtcatgcttctatttctatgatttttgacaactgaacaatatttctacgattttccattaaaataatgatatatatttttaaacattctaactttcacatttgtgtggtgtaatatgtagcctctagcctctttttcaatcatttgaaatcattatgatagtagcaatagtctggaatttgaatacatctagagaagtttcaatgttgagaaaatcatcttgttagcttcttcctaaggagagaaaggaagtgtcctgttagactcaattagttcccccccaaaaaatattttcttattactgtaaccttaattgttgagaagggttggtgaggtctccagtgtcttctactcttccacaaattactgcaaggttgttcatgatctggggcatcttgcggagcttccctgaggtaatatcaggaccttactcccaagttattagatagtttctatcttcaaaacaagttctggattagaaagcacttcttaaaatgacaaaacatactatatgttaggtaatgtttcagctattagaacatatcccatactttcgtaatgactctgagtaggcattggtcaaaccaaagcggcagaaattgcataagtaatgaagctgatgcaatcacattgtggagaaggataaaatagtgtcctttccttccgcagcatcctagtttcctatttcctgtattttaacttctcatcaagtaattgttttgtttataaacaatatcggtgaatcactgtccacatgttttgcagatacacactcatatttttgttacctccttgctcataagctggtgcatcactgaggtatgttactccctaaaacttttgaccaaattactcacttggaagaccatgaattttggatgcaattttattataattctgcttcttaaaatgatagtagttgttttcctgaaagaaaatgccaagctttgaaagttcctgttttgagcttagctgaacaaagattatgaaaatttcttcactacagagcatgactttgtagaaaaaaaaacttattccttgcaggttaccagatattctttcaatggcatgaaggagtcatttggatttacaccttcctggctcttatggcttaggttggttctagctgtaaacagatcataatatgtagcgcaaacttcaaatgaaactcattatctgtgaattctcttaaaaataagtacttattattttcatactgatttctttgcaggtacagcaccttcatagtatgctttcctattggtatggttagtgaggttggcctagtctacattgttgttcctttcatgaaggtaatttgaataacttagtagaaaggaagagctccgcctccatttgataacaatcttgtttagaaactattttcttttggatgagcaatatcaggcatctgagaaatactgccttaggatgcccaacaaatggaatttctccatcaaatacttctatgcctctgtctttttcatggctttgtatgccccaggtagtatttcccttcaattatacttcatttagtaattgattatataacctagtagtttttcttaaagaaagttagctgtaggattttctgaaaggaaatcaagtaggatttgctaactcactgtcagtgccttgttgtttcatttggatgagtgcagtatacccgcacttgttccactatttgatcgtccagcggaagaaggccttggcaaaatcaaaaaccacataactactcaagagctatctaatctggtttctgctcgcagctacagctcaggttgctaccacttcttgaacaaagaagtaaaaatgtattagaatggaaatgccgaactacacagactatcttttcccttggtaaataaaaatggacatgagtactattttcatgatttgttaatggtgtgttgtaccaaactttggcttttccatatgtaaataaaattgcactccatatcgatgccaaaaaatgatgtgtagattttctgcttttcaaggatgaagaaggttgctatcaccatttgattcatattggtgccctgtaactgtttctggatattatttcatgaaagtaggggtggatcagtgaaaggagccaattgcatctgacattgtcacactgatatcgtggatcatccaaatgctgaaatgtttaagcctttacagattgtcaaagaaacactacctctgtttcaggttataagactttctagcattacccacatttacatagatgttaataaatctaaacacacatatatctctctctctctctctatatatatatatatataagcaatgctagaaagtcttataatatgaaacggacgaagtagttggttgttgtcaaactaggatttgacggcacactgccttgctgtttcatttcgtgaatgcagtggttccatacttgtttcaccatatgatatgatcgcgcagcggaagaaggccttgtcaaaggcaaaaaccacataactactcaagagctatggaatctgatttcttatcgaagctacggctcaggttgctaccatttcctgaataaagaagtaaaggttactactagaatggaaatgctaaaatacacggattatcttttcccttggtaaagaaaagaatgacttgctaatggtgtgttgtaccaaacataagcatttttcctatctgaagaaaaaaattgtactccatatcaatgccgaaaaatgatgcttagatgatgccaaaaaattgtactccatgtacaggtgaagaagaacagggaaaaaacgaagctgaatgagaaagagaagttgtatacttgtaatcacgtgctatcttttcgctgttgcaatgaaatttcctgatcacatattcacatgaatcatatcggcagtttggcgagcagttgcagtgggaataggctgtgtttgttcacactgaaattggaagtttgattgaaattgggacgatgtgtcatgtgacggaaaagttagaagtttatgtgtgtagaaaagttttgatgtgatggaaaagttgaaagtttggaaaaaaaaactttggaactaaacagggcctaagttcaaccgtgcgctgctcaaccatctgtccagttcaatctccattgaatgccaaatcaatttgaactgtggctacaaattgattgctacaatcccaatccgagcaagtcattaccaagatgttgaaatctatctccactgcaatgccaaatcaattttctgatcacatattcacatgaatcatattggcagtttggcgagcagttgcagtggcaataagttcaactgtgcgctgctcaaccatctgtccagttaaatctccactgaatgccaaatcaatttgaactgtggctacaaattgattgctacaatcccaatccgagcaagtcactaccaagatgttgaattctatctccactgcaatgccaaatcaatttggacagtgactaacttgactccaatcccgatccgagctagtcactatcaagatgctgatagtatttaagagcttctgatgcgtgtacatcaattggctgaggaatctgggattctagtcaactgttaaagcctcaattggttcacgttaaagctaagctcattttggcgtgttgtggtaaacttatttggcatacgagagcgccgtcaaagttaagttttttatgtagttggcggagaaaggccgttgtctgacggctgacaacctgagtaagcgcggatgattgcaccagcgagtttgctcactttgcatgagcagcgatgaggactgtgagcatctttttgtttcctgccctatgatcaagggttgggctggaattggcttccaactgccggctgaaacgcggcaaggacttcggaccagctacaagggcgctttcgacactctggtgttgcttgtctgctggatagttttgaaggagggaaacgcacatgttttccataatcagagccaagctctagctcagctcccaactacaacttatctagagccggagctgtgccaaacagtccagattctctatttttaggagcggagttggcagagctgctccacaaaattgtactatgggggtggagctgggtttttgctgctctacaactctactccaccccaaaagacccactaccctttaaaatttcagtgtatttacaccaaaatgccattgaact

SEQ ID NO: 37260 - DNA, 3320 bp, Oryza sativa
aatacagagctccctcgaactatggactcatcgagctaaaggaattaccaagtctaagattgagtcttggtgtcaactcctacaattagatccttaatatgtaaatgccacttgtaatttttgtaatttattttctcctcctttctatttgttctttttcttttttaactttgtaccacctcatttctatagatgaaatggctataaagtagagccagctctaccttcttccgtcaaaaagaaagaacatgacctttgaatcaagcttgttaacgaacttttcctgccacctagttatgagtataatatggcttacatttacaccggtgaaaatgaaaatgagaaaagaaaaggcacaatgagaaacaacagatgatatcctatctttctatatatatatatatatatagagttagtacccactaagaaacatttactcctataaagaaagacatgcaagtagccacatcatcaataattttaagctattggatcgcattagtatagagttatcaaccgttggatcaagaagctagctactcatccatctaatttaatcattgattattcatccattcacctccctttagctcataatcgcgcgtgacattgttatccagtgtgcacatccaaatcctcaaagataatactactctttttcaaaaaaaaaatacaactccaattattatataagatgtgagctttgttttgttataaacaattggataacatacaataattagatatcattaatccaaactcatttttgaaacatgcttgagatgaagcagataagtgctacacaaccttattgtgacgatatccaaattgtacatgaaaataactttcatatatcataacaatacacaatgatgtttcaaaaaataaaacatgaattgtattgttataacagaagctatataaaaagccgcattataatctattttgtatatacacagagttacatctaatcatttaaagcattgatttgtgcggggtgccaactagtatttattatgttctgttcttgtttgttgtgacgaaggccctatttggctaatgggatagggaaataatttcccacccactaaaagacatctttaaatcttaaccattcattctccctcttctatttaatactaacccttcattcatttctcaatctcaatcccaccccacatttcccattatccaaacacacccgaaatgttttgatcacatggacgaaattggcggggtagctggcagttttagtagcattaactgccaactgtccgctgctaatctgatttgatccaaattatgtggttattaatcaaatcccatagccccataaatacataatccccaaccggtaagatgctcaaacttgtatcttggtgcttctgatgttgcgatagtgtgatgcttgtacatcttggaggagtagagtatcccggtcaaagccatcagccatctcgacgttttcttccatctcgcatatttcctgcaatggcagggaatgcgtcaggggtgcggaggctctacctctctctctacaactggattgtcttcatcggatggtaacttgttgacgccatgtttagttccaaaatatttttttaaactttcagtttttctatcacatcaaaactttcctacacaaacaaacttttaattttttcgtcacatcgttccaatttcaaccaaactttcaattttgatgtgaactaaacacagcctgacttatgcatgaatatcgatctcacttctactccatccgttagttttgactttttttagtcaaacatttttaagtttgatcaagcttagagaaaaatatagtaacattttcaacacaaaacaaacatactattaaaatatattcaatattgtatttaatgaaactaatttagtgtgatagatgttactaaatttttatataaacttggtcaaatctaaaaaaaagtttgactagaaaaaaaagataaaataacggagggagtaacatctttgtttgctggccaattcttttggattgtacagggtgttgttttgatcaaggctctttgatttggatcatgcagggttcaggtgtcgtggttcatgatattggcattgctgaagaacggatatgaggccgtgtatgctgccgtagagcagcatctgctgttcgcgcagactgctgcaatcatggaggtttgtttctttttttctcttgttgcctttattgtagtaaaactgtaaatttgaatgcagttgtacaaccattttgtttcattgctcatggagattgagaggtgctaaactttttatgttctgctgtttgcctggtgatggtgatgctggtagcgcagattcttcattccattgtaggtgagatatactttgtctctttataaagaaaataagtcttattttctttccaatacgttgtattttcaacaaggggtaccacattaaatttcattttgaaccttttactgcaaaaagaagggattaaaaatgatacgtgattgagcctaaaagcctaataagaatctgggggctcttcatggtggaaattgttagtcatgcaaacacattaggcctaagggctaccttgatattgtttcttagtttttcatactgaattagatcgtggtagatggtagtttctggtgtgtgcacaacaaaagatatgctgttcagaatatacatttatcaaaactacagcatatctgaaactgaaagtatatacatttttcatactgaattagatagtggtagatggtaatttctggtatctgcacaacgtagggtatgcgcacaataaaattctatactttcacatttgtgcagtgtaatatgtatcctctagcctctttttcattcacttgaaatcattatgataccaacaatagcctggaaacattacatatccatctcagagcagcgtcaaaaaaattgacagtacaacgcccgcgtcactcgccctagggcgacacgggcggcgacaccgcgcgcgccgccacaaacttctcctcctcccctccgcctcgccgccgcccgagcagccgccggcaaagccgtgcggcggcaaggatggcggcggcggggccttctccctctctcgagaagcgcggctggggcaccggcgggacccgagcgaagcggacggcggcgacagtgtccggcgccatctgggccaaatgcggcggatccggctccgccggaggtggatctggccctgtcgcggccagatcgggaggggcatgccgctcctggcaggaggcggcgtgggaggcggcgaccgcgaccgttggtgggggggacgacggatccggccactctggcggcag

SEQ ID NO: 37261 - DNA, 704 bp, Oryza sativa
  unsure (1)..(704): unsure at all n locations
nnnnnnnnnnnnnnnnnnnnnnnnnnnnnnnnnnnnnnnnnnnnnnnnnnnnnnnnnnnnnnnnnnacagaaatattgctcgattggtggaagtcacaaaaatagaaccctattgaattatagttgctcaataggtgacttgtcgaactgggggaggccgacaggcttagctggcgtgagaaaaatccaagtcatgtaaacactttatagtttacatgaatctggtggctctgcatggtggaaattgtagcttgtcgtcccaccgaagaacagcaaagattcgtcgtcccacagctgatcgatactccctcgtcgggagtaggcgaccttccaaaaataatgcaggccctatgccaattcaaaaaagtgacgtggtggagcggtctgctagcacactcggattaaatgcactcatggattaaaatgctactacctccatcctaaatgtagctatttcttgcacagtgccttgtcccaaaataaaactatttccccacctaccttcttatctcaaccaatcacaaccattatgtttcatctactttctcttctcaaccaatcacacactttctataattattctcacctactttcgttatacctgtgacaacctcaataatacttacattttggcacggaggaagtttctaacctacctgattcaagcatgtgttaggccattcccaacccacaaactattaagt

SEQ ID NO: 37262 - DNA, 1224 bp, Oryza sativa
  unsure (1)..(1224): unsure at all n locations
nnnnnnnnnnnnnnnnnnnnnnnnnnnnnnnnnnnnnnnnnnnnnnnnnnnnnnctcaattcccttcggatatgtatggaggtgagcaaccgatgacaagttcacaatgcgaccttcaatacctgtggacttcgcggttgctttcatattatcaagaaggaggttggtcaacagaaagtgacctgattgagcataacacatcagacagatatcagtatcatccaagcactttttgcatgtttaaagtaaatagttgatagtggtagagagtgaataccaagatgattggtcgcgaactgcatctcaacaccatcttcagacaatccaaacggacagaacatcacaccggcattatttctgcatgacggaaaaaaaaagaatatatgagaccccttaattaactgaaatttaagcagaaccaaaggatctttgcatgttaaaaaaaggcaagtgtgctaagagtttgaagggagttacatcaggatgttcagaggaaggttcatcgagttgaactgatctgcaaaagctctaacagacttaagggagctgaggtcaagcttcagaacatcgatgtgagcttttgggttttcctcaatgattttcttcctcactacagatgcagcctctgtgttccttgctgcgatgatgacatgggctcctctcatcgcaaagactcgcgaggtctccagaccaatgccactcgctcctcctgtaagacaacagaatttacagatttccgtaaatttgcgaggatagatgtttatgaacagtttgcagtaactagctactgtgagtctgacacaacatgaaatttactcacaagaatacaagattgatgtttggtgaaaactgaattctatgacagattggttatggatgcactagaagactatgattaatgcttttatgagcaagtttaattgacaagacctaacacagaaaaagttactattatataatgggaaaatgtttatagtttaagaccacacagttccaagctcaaactcttattttccacacaaaaagaaaggaatatccaacatctccacatcaggaaagagagggtaaaaatcctcagcccattgtcagaatggaagaactgctatgccctttccgatgaattgaatttcctttcacattttcgtataaccatttatgtnnnnnnnnnnnnnnnnnnnnnnnnnnnnnnnnnnnnnnnnnnnnnnnnnnnnnnnnnnnnnnnnn

SEQ ID NO: 37263 - DNA, 26541 bp, Oryza sativa
  unsure (1)..(26541): unsure at all n locations
nnnnnnnnnnnnnnnnnnnnnnnnnnnnnnnnnnnnnnnnnnnnnnnnnnnnnnnnnnnnnntgggaaaatgtttatagtttaagaccacacagttccaagctcaaactcttattttccacacaaaaagaaaggaatatccaacatctccacatcaggaaagagagggtaaaaatcctcagcccattgtcagaatggaagaactgctatgcccttccgatgaattgattttccttcacacttctgtatatcaatctatgtttttgtttttttagtattatctaaaatacctgattgaattatgaattctctgtagtcaagaaagttccagaaatctaaaccacaaccacaagattgagcaggaaacagacaaactttcatcaaaacataataaactcttctggtccacaaaaaagctacttatgcataaatttctcatatacaattttttgaagagcgtagtattattttgatattatattaatcataacacaaaaggtggctgctttcataatcccaactctaagccacccttaccaccatccaaaacacacccaaaaaggaaaagagagaacaatttgagagagagagagagagagagagagagagagatgcagagactgcctatggtgagttggtgacgggtagagaattggagattattcacacgagtttctcacaaatctaacaaaaacatggcaagaaactaaccaaaaccattaaaaataaactgcattgatgttttcaagaacaggtttttgctggccacaacaacacattgcagagaaataaattccaagattcggaggtacggaagcaggcagctctgtctcttacctgtgacgatgacggtgaggccggtggcgtcgacgccggcggtgacctgctccgccgtggacccggagccgaacccgctcgcgccggccttcccggtgatgagcgacaagatgcccatctcaaaccacgccgccaagaaacccccaaactcacgatccaacactgcaccccccaaccccaaaacccaaacaagaacacgcaaagaagctcagccaccgcaacgcaactgaattcgaccccccccccccccccccccaacaagaagtcgccgaaaagaacacgccaagaagcactcaccctcggcggacagatcgacgagttgttcaatgcgcgggcgcgggaggcgggagcgaggcggaaggggaggaggaggtggttatttatggttgggggcgccggggcaaagttggtcgtggaggtagaatcgatccaggaaggattaggaagaaaacgagacagaaaggaatttggaatcgtcacagaaagaatcgaatcgacctggattcatccaaattttaagagaattttatacgtttgggttttgtaatttactgctagtccggtatatgaatatgaatatctcaaaaatgtccaaatgctacaccaaattggttcacaaagaggtctggttggtgtgtagcagcgcttcgtattcgattaaaattcaggggaagtaatttgctgtagattatgaactacgtagcgtgtcactgtcccgttgggtcccgttgtatacatgatgcattgatgcagtgctcctaatcacttcctgatttgccatctgtcactcgtataatctcgtactccctctgtctcagctatgatttttcgtgtccaactttaatcgtttatcccatttaatttttttttaaaaacaaaaacataagttatacataaagtactatttatgttttatcatctcataacaataaaaatactaattacaaaaaaaaataaataagacggacgatcaaagttgagcacagaaacttatagttgcacttaaaatgggacggagggagtatgttactgccagtgctagcaaccgtggcatactcgactctgtttgggacagttctagatttaagatttttctttaactaagtattcataactctagaaatctatacatctaaaattatgattatattgataatatttagatgaattgttgtttgtattttatgagaaatataaaattttaaatctcactatagtttatcttacaaactctaaatttagcaagtatctagaatcaacaccttgcttgcctgtgtttatatgagaggttgattttctttctttttactagtattttacaaattaggctttaattattttacagcccatagttggtccgatgtgttactggaaattattttggtcactcgtctgcggtagcaaatggggccggcctactttgtataaccattggtccattgttgtctgatcatctgatgatgctgcatttgttgaagattaggtcgatgatgaccgaccggccggccggcatgaacgaacttgagatctcaattcatcatcctctgccaatttcgctaatctctttagttaatgtattaacccaaaagaattaagcttaattgataggagtagttaatatcttttgatctgtgtgaaacagtgaaagagatatggggttaacattaaccaacatatagttaattttgactatacaaaaaaatatattatactgagtagtgagcactgacacaaatcactccattgtgcaatataatactgacacatcttttttaaatggactgacacacaaacccctccaagataatagctcgagtcagctcgtgtgtaaattaccgaggtaattaaaaaaaaggctatgcataatgcatgcagattaaaaaaaagttactgaccattacaggattttgtggtacattattgaaggagcatgcaggaccagattatttgctgtaacagcaaggaatctgatggccatgctggtcctgatcacacagtgacattagattccatctcatttctacaatcttttgccccttttttttcccatttcatcatggagagttttcttcagatttttcagtaaggtaccagtgatccagactgccagtggatgcatggttggaagggagccaagcatcatggcgcagcgcagacacgggctcacccggtagtccccatttcatgcccactggtcctgaaatgcttatggacgatggattagggacgaaattgagttgatatgtcaatttagttcctttcaaatatgtcaatttagaaaagctttcaaaaaaaatatcgatgaagaaagttctcgaagaaatcataatgctcagaagcttggaaaatgtgtccataataataataaattaataatccgtaggcagcacaccaaactgttctcatcctattgctatggttgtatttagttcctttcaaactttcaaaaattcttccatcagattaaatttttggacacatgcatagagcattaaatgtggacgaaaaaaaccaattgcacagtttgcatgtaaattgcgagacaaaacttttgagcctaattacgccatgatttgccaatgtagtgctacagtaaacatttgctaatgatggattaattatgcttaataaattcgtctcgcagtttacagacggaatctcgtttaatacttcaaatgtgtatctatatacttaaaaaaatttggcttaggaactaaacacagcctatgtgcatgttttttcaggttcagagtttcagatacgtacaaggtttagagtaggaaaatattcgtcatccccaaccctccatgtcatatagtttctatagcattaaatatattgtcacgtaagtaaaaatcttatgtgacaagagagttaacgaggataccatatctacacaagaactaagaataaaaacaaagggatatgtggataaaaagagagaggagagagatgattggatgggaatttaatttaaagacatcatccattaaatacatagtgtcataatatctatatataacatgaaaaatatataaactaatagatagtttttgggttgggatggcctcacgagctcctcgtgaatggcatggggcatgggcaaacctatacgtatctccttgaccttgccaagaaacatgaatgattcattgattcagtgctagattgagctaaatatataatgtgacatgatgccatgtgaggagcttcatcatctgccatctgatgcacgggtgttgcaagcgatgtgaggacttgtctggtaataatagctcttgaggtgtccgagttgttgcttgattgctggcttgctgctgctgctgctatttgggactgttcaagaatgtggttggagcaattcaatgatgaggcatttgctgttcttgtttgttgccaaaccctgtcaaagtgtcaataaccaacacacaaaccagaaacaggggctcacctaggttagatcctacttctacttttttttatgtcattcggctatctttattgatacgaaaatatagttacatcactcaccagcatgctcataataaagctaggggattcctaccactacagtttatgccaacggcttctcatcgtttgcctttgataagccgtgagaaaaataaacgaagcaaaaaaaattatatgtaaaacttttacataggcgttcttacaaatttagaagctaatgatgaaaaataaactgcgataagaaaacctcaaaatcatctctaaaattaagtgctaaagttaaaatttagctgccgctgataaactggcaagccagatttaaatttgactgttgcaatcaagaaagtacactttggccgggaaaaggggaaaagaaaagaaaggacactttgaactatgctatgagtaagcttatctcaggctcttaattagctagatctgaagctgcactaaatggctgcaagaattgggtgaataatatgtttacaagtactagcgaacttaatctgcattctagctagtacaccaactcaaaagtctgaagaattttctgctgaaaggagaagttgctataaaattctgcatgcttggattgcccagtttggtttctgactttctctaccagatcatttaatttaatggctaatagttcatgagtaatttcaaggacagtcttgttgagtacgtgtaattagatagcgatcatatcatctacattattgataggtactgtttgtatctgaaaccaacaaaaagaagcaaccttatcatcaaaatggaataaaggggataaaattaggtacagtctcgtccaaaatttaaatgaactgaaaaattagttgacgatcctgactccacacttcaaaaaaattgatttgtgataatagactgtaatgattttggaagggtaaatcaatccttaaacttcactgaaaataatgcagtccgggtatgcatttagtgtgtggcagcacagttaggttggattggagcatttgagcctgaagatgaggcattgggcccatgagaatttatgctcaattccagtatctagtgtagcaggtaaagagaattaaatgtttctaaatgaaaacataatcatcattcacttttactgtttataacttcatggttaacggttattatcaggtgaaaaacgctgaccatatatcagacagcaagcatgtcgatgcatgcgaatatgaagagtactgaactgaaaatttgtagttacaaacaaagaggcaagagggagtgaaaacagaacagggacgaaacagtgttccgccttcaacttatgaatcatagccaaatttaaattttagaattaatttagatgtttcatcattttctattttctggccttaatttttgtggaagtacaaaaactttaccctaaaatcaattttggttgcttcatttatttttctcagcttataagccgtagcccaaacaattagaatattttccagagaaaggccaaaagcatagttgtattattggtctcttgtgcatttgccaaaaaaacaaacaaacaaaacaaaacagagacaatcatctatttatgtgcagtacagactacagataaacagttcactcttgctcatggcagctacagtgcagaggtcctaagcaattcattgcctggacccttagttgtattacaacacaaggtacaaactgcacattagccatttgctgctcaactacctcaacagaccatgcactgcattgcaaaagggactctatggagactcttcctaaaatctcggccattgattattgacatatactaaatctgaacaatgtaatttcctatctgaaaagtctgatgaaatttgcaggcttccctttcttttctcttgcattactttttttttctcactccatcccccgtgtaaacagcataacaaacagacaaatttatacagcaaatgttatttgaacaaacataagagctaccaggctacccttgaaaacaaaaaagaaaaggaaaacaaaaacaacacaagatgctattgctagcctttgatttggctgccatttcttcagtccctatgcatcctttggtggttgggccgtctcatgttctcccagcttgagacaattaggttgaggatgtagtagtagacagtcttgacgcaagtcataataaagttccagcaagaggaaggccagtaccacggatagagaagccgaaagaacaggcttatcacatgccttggatatcggccaacctgtagcgcgacataagtcaaaattattatataactcaacaagtattcacattaatttcaaatagaatagtcatggcaaccctctgtgaaaatggatcaagatggttcatgagatatccatgtcttgctgcttattgatgaaaagggaagagaagaagagaaaacaacatatgatcctcaaagagaattgcatattcactaaatatatgcatgggattccatcagcaggaaatcatcggtgaccataaccgcagggcatcaacacagtaagtccagtataacagcatcacagtgatcatcagcacacatgcttgaaataaatcgattgtgatggtacatcgcggaggtaatatttgagaatttcaaactaaccatcgaagcgagtgttcaaataagttaaggtaagaaaatggtactcacaggaaaaagcagatccagtgtattccaggctgcatgccttactgctcgtgtagggtaggtaggacctccaggagaagtgaagctgtaaaggcaagccttcagtctagtgcttgtactcatcctcaattccaatcctggatgattttttttttcagaatgaagaatttacatttcagtggagaaacagatgcaaaaagtcttggattacttttggaatgtgtctgaaatctgaataactataccttgaaggatggtcaagcgggagaggtaatgcagaagcacaggttcaacttttagtttctggagctgaaaaacaaagaacacacgatttagtttgaggtgaagttttagcatgtcatgagaacaccgaagatacttcacttagagaacaacctgatcagtgagttcaattacatagtaatctgcagggccaccaaccaagaaagaatttggaaaagtaggaaaatgctcaaggaaacttgcaagcaagtgatctgcacatgcaaacttggatcacttcaatagcaaacaattgggaccaagaacgtggagaaaaataacataccttgatcatagaacagcataaatctcgagaggaggaggaaaagacctctaccagcctgttcaaaacatcaaattaatgacaacaaatactatcgtacatgcttattaggaaaactcatagcagagttcaatgtcaatagggagtgacctgtactgatatcttactcagttgatctgggactaaagcaacctcttcaaggagatactgtttaataaagcaagcatgttttgattttactaaaacacatacatcacagtttcaacgaaatttgagcaactgaaaccaaatatatccttacattatataatgagagaaagtgtcttgtattggtttggatgtcaatcctgtcaaaaagtaattccatcagatctatggaagtttcaggcaagaaaaaaaggaacatcagtgcaataatccctctgttagcagaaatattttgcagtaataactttctcagtcaacagatcaaatttatgggtgccatcataccaaaaaacattagtagctccttggacaagagcagagctgtatctcagtgatacttccttcccatcaagagggacttcgaataactgcaaatgatgaactagtaattcaccaaactgaaatagagatgaaggctaatacaatccggagcattcttgtatgcaagatcgaataagcgaattacagctagcatttacagaattctgtacttagcttgtttaactagctatttgcagtaaatggtggccagaacaatgggcagtataagcttgatgctgggatacaaattccccagtaagattatctttccttttgagatcatatatacattactcaaaagtgaaaacttaaaaccaccaagacattagctcattcagaggaacatatagcaaggagtaaaaggtaaaaggcacattcactgaggtactggttaaacaaattccttaaacgttactggaaatggaaaacatgacttcttgtgaacatgattgagtttgtacttatattggttatgaaaatcaacctattgcatgttctaaacatataaggttgtaagaattaatatatacccatctgtggaaaagaagtgcaaatatgttcgctgcaaaagactggctccagagttgcactatcaagtcaagtatacgcctcccactttcaggtactttaacaaaatggttagcaagaatctcatagaagcacaaccgggtatcttctcgctcatctactggagcaataccatcatcgttcgtgcttaaaatcacatctgttaaaaagaaataagtatgtaacatagcaaaaacacttgtaacaagattgagtagtattatgacccaaacattgatcataaaaggaagtaaggacagagcatgtgcagaaaataagtgatatactaatgtaacaacaaagttcttactgtcagaagaatccaagcaaccaaaactcaatactctgaatctaaaagaaaaaatggattgaatttctattaaagtatagccttattgttatgcacaattaagtcaaatatcatgttttcctgtgatgcaggtgtgcacagtaacgatggtgtatgcagtacttccctagttagcaagtgcatgccaaaacagccaacttttttagacacttcaatctacagatgcatataaaataaacaattaagatggattcctagaataaaaatgaagtaatgccaatcttggtaaacgatttttgaaaagcaaaatatagtgaaagtgacaagggaaagaactagtttttaactcttggctgacatcaatgaattgttagttctccgccaaaaacgttaaacaagggaatggatataaaccatagtacaaaggaaggcaatgcttttgccttccttcaaaaaaaaaaaaatagtacaaaggttcaaactctaggtaaaactaccacaaacttggtgccaatctcatgattactgtccacaaatacacacatgacgaaaaagcattagtttgattaacatctgaagctatgaaagaaatggcacctcgagcgcggtcatccaccttcaatgcgatgtcagcaaacaactgctgcagcagctgaagacgttgcgaattggagttgagagcctacacgcaagcaacaaccagtgaaacagtgccacctgccctatccaaaccactcaaattatcagtatcgtttcgagatcatataaagtaatctttaattcggtagagaatttgagaaaagaaaacgggagaaccaatttcgattctgtaactgcggtaattgccatcgacttagcgccattcgaaaaggggaaattctgggattacgaaacaggcccaaatttctctaactgatacgtggaaaacaaatcaaaatcgtatattcttcaacactgaaaactcccaacagaacaacagtctcgaaaaaaaccattgattcagaaaaaacaaatccaaacaaaaaaaaacaccttcctcactccaaaccgaaattaatcgcaaagaacccaaaaaggtggccaagaaatgctcaataatcaacagaaacaggccaggacaccaccagcacgaatcaacccaaccctcccggaaatcaatgaaagaacgagacgatgaggggggggggggggggggggcaggaaccggaatgcggaaaggaaggggcaggatataaccttttgcagcttgcgctcgatctccagggagagcgcctcgaggtggtcggcggctcgggcccgcatctctcgccgtcgccgtcgccggcggggggcgctcgccgtggacgctgggtcgagtagcgtcgcttcgcttctccaacgattcgtctcgtcgttgttctctttgctcctctcccctcttctgactcgtggtagggcggtccaatcagagccgtacacgtggcgggccggcgacgctggcgagtaaccgcgagttcagcggtggtggcaggataggcatcaccgtgattttgatattgcaaatggatgagaagagatgattctgattctggtcgcatttgatcggcttttccaacgaaataattttgccaaatatttttttttggactgttttgtgtaggccgtgtttagtttctctttattcccaactttttatcatatcatatcacattaaaaatttacatatacttgtaaatttttaactttttttccaaactctcaactttctttaaactttcaactttttttagaaactaaacaaacctgtaaagtttgtcaaatttttgtgttccaaacatgtgtctgattatcaggttgtactccacaatagtctgtctgtctgcgtgtttcagacatgcactgtaagcattttttttcttaatattaacagtgaattgattgtgtgattctttgctttcaatagaagcagggctgcaaagccttttctctaaaaaaaaatttgattgtgtgaaatgattgccgatttcttcttatcccacgctattgcgtgccgtctgctgtgctccaccattttcgccgcgtagctgacgtgtaccaacctttatcttggctcgaggacagcacgacagctgcatgcagcgacacgtggaaaaagcctactccacgggatcttctgcaccagctcggatcggtcactcttcactcaattcaaatcatacaatttttttgcagaatttttcatataaacatgttcactttttcacatgaatcttgtgagaattttcggtggtttaaaaggaggcctaataggcgccgtgacacgtcatgcatgcgtcatcacatcccggcaggtctcccgtctttcctcgggtcgctgacggcggtgagcatcccgtggaagacattctcgtcgccggcggcggcgaccggcgtcagcaagtcctgcacgatgaactggcagacggcgccggagtccgtgctcgtcagccggtggcccctccgccgcaggaactccctcgcctcgccgctgagctcgaacacctcgccgtcgaccaccgtcacgttctcgtacaccacctcatttggcaccagctacatatacataccaccatagtgtaattaattaattgctccttccgtttttatcatattataagttatttttattttttttaattatattattttgaagtttaacaaaatttatataaaaaatagcagtacttttaattaaaaaaatatattactccatccgtttcagattataaaacttttttactttgatcaaaattaaattattttaaggttgactaagtttatagacaaataaagtaatatttataatatcaaattagtttcattaaattaataattaaatatattttcataataaatttgtcttgagttgaaaatgttattattttttctataacttagttaaatttgatacaatttgactttaagtagagttaaaatatcttgtaacctgaaacggagggagtattaaaatatatttaatgaacctaatttgatattgtagatgcattaaatttttttgtaaaattggttaaacctaaataaatttaattaaaaaatctaagcagcttatactctgtttagggagtactggttaatcaaagagattaggtctaatcgattaactgatgcttgccttgtggtagaccctgggattcaggacggcggcgagcgggtgcatgccgacgatgaagtggttcacgaacacctggaccaccgtcgctatgatgaacggcccgccgctgccgccgacgacgccggcgagctgtccgtcctgcacaaagccacaaacagtaatggtggtcgtcagcaccggcgacggtgagctcgatcagcgtgacagcgtcgtcagccaaattgttagtaactacatgccttgagaatgatcgtcggcgtcatggaggagagcggccgtttgcccggagcgatgaagttcgccggcgccggcgggaggttgtccggcggcggcgtcccctccgccggcacggagaagtcgtccatctggttgttcaccacgatgcccgtcgacggcgacagcaggtgcgccccgaagaggtggttctccgtggtcgtcatcgccaccgcgttccggtcgccgtcgacgacgcacaggtggctcgtcccgtggtcatccagctggctccatctgatgatcaagatgtaatatcatcaatccaaatgtttcctggtatgatctctgcaagaacaagaacgtgtacattttctgagatcagttgtactttgggaagtagtagctgggagggaacgtggtgttgtcgacgatcctctgccggagtttgtcggcgaacgccggcgagagcatctccgagacgttgccggtgatgttgacgtagtcagggtcgccgagatccatccggatggccagcatgtgcttgaacgcctcgatgaaccggtgcaagccaagaaatcctttcaagaactcgagtgatttgtatccgctcaagatgttcaaaatctggaattaatcatattcaagtttggtttggatggatcgaggaatgaacagatgatcagaatttaactgggacgaatttggatactgaccagagccaccccgacgccgccgctggacggcggcggcatgccgaggaaggtgtagcccatggcgtcggagcgcatggcgtcgctcacctcgaccttgtacgccctcaggtcgtccaccttcgcgatgccgccggcgcgccgcacgtcggcgacgaacctctcgccgacggcgccgtcgtagaacgcctcgacgccgccgctggcgatggcctcgagcgtgtcggcgagcgccgggttgcggcacacctcgccggcggcgaggatcctcccctccggcgccagcacggggcggaggcccgggtccgcgagcacgtcgcgctccgtcttcttgagcgcgatctcgaggtacggcaccaccgtgaagccgtcgcgcgccagcttgatcgccggcgcgaagaggtccttccacggcagcctgccgtagcgggaccacgcggcgtggaggccggcgagctcgccggggatgcccatggcgagcgcgcccttgtacttggaggtcgggttgcccgcgtacatgtcctgtcagacacaaaaaccaccatttcagcttgtcatgtttgggaattcaaatgtaacaaattcatatatattttgaattttgattcgagcatcctttttcggatgcctctcacttcgatcgaattaagaacataatctacctttatttggaccagcaaactcagctagcagcaagtttacacaattgagaaacgtccagaggttttccggctagctctacaaggtggtaggctaaataacctagattcgaagcctcaccccttttaattatttgatattagatcattccctaatattcgcgtcttttttcttagcaagtttacacaagcaaattcagtgtaaccataagaactgcccaaataatggcaaattcagatgctctcagattttgcttcataatgctatcgatagaattagcacttgcaacgcgcgcatggtgcattatcaaaaaatgttttgcttcataaacacttgcaaatgtgctatcgacaaaatgcgttgttattgtggaactgatctgttcagttcttttaatgcaaattctcacttgaaagaaatttcctaatggacaatttcagctctggttcacacaaatcccccaaggtgttgctatctctgtttcaaattactgttccaggtttgttctaagttaaacatgtttatccttaaccattaatttttaagaatccgtgaaagttaacaaataacaatatatgaattctatattataaaaatattcttatggtgaatccaaaaatataaatttttgatgtttagctacacaactttatataaatttatagtcaatgattaaagtgtttaacttagaacaaatttaaaatgacaaataatttgaaacgggaagagtatatagttaatgttatgcaagttgttgtaccgaattacaccaattttacaagatcatacatcatgagcacaactattttctttaagtaatttcagatattttttcccaaatctattggtttcctatccttttagctatggttttcaaaagaagaaaaaacatcatacatggtttcctcgtaaaactacagctttgtattagtaacatgatcattgctatatatcaaaggtgctatgtccctccaaggctccaaaagtccaaataatgacagggaccatagaaagtactaaacaatggagttgatgaaccatattataacaaactatacacaaatggcgaccttatactgttatatataccgaaaacatttcccggagatatgctagttctaatgggcgatcgatcaccctacctacctagtagcgatcaggtagccccctccacctggtttccttttttggcaccgcattattttcctattttaataaatttatgcatctaaagtttatacatctcaagtttacacatctaaagtttagagaccaaaagtttataagtcaaaagtttatatatccgattcaaatttgaatttgaattcaaatattttttatatatatagtatttctatacatataaagtttatatacctaaagtttatagaactaaagtttataagtcaaaaatttatatatctgattcaaatttgaatttaaattcaaatatttttcatatatagtatttctatacatttaaagtttatacacctaaagtttatagacctaaagtttatatacccgattcaaatttgaatttgaattcaaatattttctatatatatagtatttatatacatataaagtttatacacctaaagtttatagatccaaagtttataagtcaaaagtttacatgcccaattcaaatttgaatttaaattcaatttatatatatatatatatatatatatatatatatatatatatatatagagagagagagagagagagtatttctatacataaattgttctaacttttgttttttaaaaaaaattgtgtggtgtactttggtagaaagagaagaaagggaggaggaagggggggagaggagggaggagtacatagtataggagagaggcaggggggtgatcgctgggcggatggaggagcgatcacccgcctaataggaattaccaacgcgtgaaacatgtgagaagaagaaaattataaatctagatcgaatctggacaaatttcatcttttttattcagtgtgaacaactgaacccatattttattatcttaaagaaactgaactcattttcccaaactggcaactgcagtatggtaatcgcgaagtgcagaaaaactataaagaccaccttgaagcaaccaatgaattagcccatgctgattgcacgtgtgaaatagagagtcttacagaaatggacattttctgaagcgatctacaatatttcaataatataatcaatgtccatttctgaatagttctgaagactgaagcagagttgtagcttgaataattctgaattacaaaatcacagcttgattaaaaaaagagtaaagtgtattagcgattcttaaacttgtagggttgtgttatataggttcctaaactctcaaaatgcatattcaggtcctagaatttatcaaagtgtatcatataggtcccaaatcggcacatcccctctaagatcctacgtgatgctgatgtggcatgccacatggacgtgacgtgtcattttcattttcttttcttcttttctttttctttttctttttcttcgttttcttctcattcttctttttttcctttcttctgctcgggtcacagagaaaggagaagaaagggaaaaaaagagaagaaaaaaaagaaaagttttaaatgtgacccatttgtcagtcaaaatgatgtcacgtcattccgtgtgacatatcacgtcaacgccatgtaagatcctgaaggggttgtggcgatttgaggcctaaatgacaccctgtaataagttctgtaatttggatatgcattttaagagtttagggacttagatgacacacaactacaaatttaacatacactttactctaaaaaaaaaaaggactacctactaagcgacctacaatgtgttgtttttgtttaatgtggttttaggatcatggaccacggggtagtcgacaatgcacatcgcacgcttgtacagtggcatgcctctccatgaatggaatggaatttgcaatgagccaaaaaaaaaaatcaaagtcaaatgccaatcatgtttctagatatggtgacttacatgctgttgctaaactaaatgaagcggggttcaatttaggttgtgttattttgtgcaagtcaccaacttcttatttatcgtttttaaaaaaatatataaaaaaattgctttacaaaatcatactaatcatttttaagctctttatagctaatacataataaattataggctaaaatgtttcatcgttttgcgtgtcatacctccaaacacagccttaatagctgtcaaatgccatcacaaaataaacaagttacggagacaacctttctaaatgaaaaaaacaatagctctattcagaaaaagaaataatgcagtggctactgaggcgaagaagaaagaaaagaaggaagaagatgaaaacatgagagaacgattctaactttgtaaaattttagtgatattcagctgatattatgaatagtaatattttttaaaaaaaattggtaaacttgtaataacatgatccaattaacccctttttgaaagttgcaatgtagacatttcgaattcttttttcaaaatttactgatagggatacttcgaattgctgatgtgaaatttttcttgctgttcttttacagccccgtcttttcacttatgcttatcaaccaaaatttaaaatttcaaccttaaatttagagttgattttggagttttctcatcaaagtttattttacagcatttgcttttagatcactaagaacacgtatataaaagttttattcataaattatttttcgtttgtaaatataccgtttcacttattccggatggggccgttagttggtgagcagaatcacgtgcctatcatttgcgtaggcaggtgtggcccaccagacagtgacatgcgccagaccaccgaatcgctttaaatccctaatattataagagcaggtatagatatattttaattttaatgaaataaaaggtgaaaaaaaagagcagcgggttatagatctgtagccagctgcagtacagactccaagagatagtgggtgtatgataggtgagaccgtatattaatagtatataaagaaactattgtataaattggctattagactataatataatatatacatatacatatatatatatatatacatacatacatatatatatatatatacatacatatatatatatatatatatatatatatatatatatatatatatatatatatatatatatatatatatatatatatatatatatatattggagctagtagtgagctgtactattcaacttgctctaacggaggtctcgttgccggccacgtggcgcgtggccacacacgtcatccgctcaaaatttccgggaaaaagttttttttttttgtttttactgcgtgctctagttggtgacgagtagtaacgggtaacgcactcaccggcgtggccgcggccggcgcggtctcgcgggcgtcgaaggctacggcgtcgccggaggcggcgtccctggcgacgatgaacgcgccgccgccgacgccgctcgacatcgggtgcaccacgccgaggcagagcgttgccgccacggtcgcgtccaccgtgtgcccgccggcgcgcagcgccgcggcgcccaccttcgagcaccgcccgttgtccgttgccaccgcgcccaccccggcctccacctcgtgcgggctcagtctcacacccccgccgccgccggacaccaccctgctccgatcatcgccgcccgagctcaggtgcagcacgacgcacgccgccagggcgagcagcgccgcggcggcgatggcgagcgcggtgcacggacggcggcgccgactgtccggagaagaaaccgcgccgccgccgaggagagggttctctaggccgcctcgcgcggccatggccgccggatcgccggagattgtagtggcgatcggcaggtaggtcgtcaggaaggggagggattcttggatggcgagagcttgtcacactgtgcgtttgttggcttgtcaatgagacgcttgatttttataatgatcgtgtgtctaactgggcaatgattctacagatcctattgtacttgatattttcactattttcttaattatactcccttcgtacaaaaagaaaatatataacagttatagagcgggacacatcggtagggctgtcaaaaaagctcgagactcgcgagctgctcgagctcggcttgtcctaggctcgattcgagctcagctcgagctcctgacgagccgagccctagcctctctataagctcgcgagctttgtcgagccgagcttgagcttccaacgagcttagtaatatatgatttttgttattatttaataaattaggagatcaaatatgttatttgtatggcttatattgacatcatatatttattttattcttttttcctcttatattaatatgatgaactaaaaattaattatatttttaaagattatctttcaaatatatgttgttttacttaaaaatcaagctcggcagtcgagctcgagccgagcctatcagaaagcttgaacattttataggctcggctcgagcttgtatcgagctcgagcctaggcagacaagctcgctcgagctcggctcgttgacaaccctacacatcggtattaaaaaagtgagtggatattgaggaaaagttatgattcgtgaggagaaaaaaatataggtagagataaaatggagaatactccattttgggacaagttgagaagtgatagaaatagctttagagctaatcaaatgacttgtgacttgtgatttggttaagatgggagaataggtggaaaatagttttattttaggataagtttaagtgatagaaatagttttattttagaacagagagatctaatcaaatgaaaattcagaatttgaatgtttgacgcaattgtactgattcaatggcgtgattctaactcatcaaaagcaataacccatcagatttttttttaaaataatatttcgatttagtgctacttgttgttgggatatcactttccaaattaagccgcaggaattacctttttcttgtaagtaaagaagaaacagagtacacagcagattgacaggtctacagatgtgtatactattgtcagatttatgagatcacaaaatttaaattctgacagttgatcttcttaagagtgacaaaatatcagataattttttttgcaagaaagaaatagagaaaataatctgcacctgcaaagaatattatggtgtggacagtgtggcaagcagtggactgcgtagccgcagcggcagcttgatcacagaatcagctgggaaaacaaccattggcagaatcaggagctctgatctttcagagttgtgacaaactgattttttttaaaaaaaaattgatcacgtcattataaattttgcaattttacaatttggcattactatttgcctatatacatgttgaaattgaaaaatatgacactaacattgaaaactgaaatatcccttggctgtatttttcaatttttgggaccaaaatacccaatcttctccgttcatcctctcatgtacctccagtcatcttctccaccaaaccacccatggctgccccgtgctcgagcgccacagccggccgttccactgctgtacaaattttgaagaatttccatataaacttgttcagctttcacatgaatcgtgtaagaatttcggctgtctaaacgggggcctaatcgatgccgtggcgcgccatgcatgcgccatcacattccggcaggtctgccgcctttcctcgggtcgctgacggcggtgagcatcccgtggaagacgttcccgccgccgtgctgccgacggtcggcggccgagccgaccggcgccagcaagtcctgcacgatgaactggcagacggcgccggagcccgtgctcctcagccggtggcccctccgccgcaggaactccctcgcctcgccgctgagctcgatcacctcgccgccgaccaccgtctcgttctcgtacaccaccacgttcggcaccagctgcattatatataccaccgaccagacagtaattatgagattgatttttgtgcatgtccgttcgaaaagttataaaaaaatttaaaagaatttgtcaagatagatcaatatacaatatatcttttcacaaatatgtgaattaaaattcgacatatacaattcgaaaaaaataaaaataattaccataatgtgttctatttatagtcaaatttgttatttttttttaattgtataagttaaatttgaatttgtattatttgtgaggtgacatattatataacgatctatttctactaatttttttaaatttttttgataactttttaaagcgacatgtaaaagtgagagatatcctaattgagtttcccagtaattaattaattgctgtttattaatcgacgagattaaggtaattaattgatgcatgcgtgcttgccttgtggtagactctgggatgctggacggcggcgagcgggtgcatgccgacgatgaaatggttcacgaacacctgggccgccgtcgcgatgatgttcgtcccgccactgccgccgactactccggcgagctgtccgttctgcacagatagcactgcagtggtcagcatcggcgagctcgtcagcgtcagcgaaatggttagtagttactactatatgcttgcctttagtatgatcgtcggcgtcatggaggagagaggccgttttcccggagcgatgaagttcgccggcgccggcgggaggtggtccggcgtccgctccgccggcacggagaagtcgtccatctcgttgttcagcacgatgcccgtcgacggcgacagcacgtgcgccccgaagtaagagttcaccgtcgtcgtcatcgccaccgcgttccggtcgccgtcgacgacgcagaggtggctcgtcccgtggtcattcagctggctccatctgatcacacaaaaaccaaaatctcatcactaaaactgctctagctaacttctgaaagaaacgttcatttctgagatgagaattactttgggaagtagtaactgggagggaacgtagtgttgtcgacgatccgctgccggattttgtcggcgaacgccggcgagagcatctgggagacgttgccggcgacgttgacgtagtcagggtcgccgagagccatcctgatggccagcatgtgcttcagcgcctcgatgaaccggtgcacgccaagaaaccctttcaagaactcgagcgatttgtatccatccaagatgttcaaaacctgcgattaatcatgtcaagtttgatatggatcgatcgagggatgaacaaataatcgaaattgactgggaatttgatactgaccagagccattccgactgtgccgctggaaggcggcggcatgccgaggaaagtgtatcccatggcgtcggcgcgcatggcgtcgctcacctcgaccttgtacgccctcaggtcgtccaccgtcgcgatgcccccggcgcgccgcacgtcggcgacgaacctctcgccgatggcgccgccgtagaacgcctcgacgccgccgctggcgacggcctcaagcgtgtccgcgagcgccgggttgcggcacacctcgccggcggcgaggatcctcccctgcggcgcgaacacggcgcggaggcccgggtcggcgagcacgtcccgctccgcctccttgagcgcgccggcgacgggcggcaccaccgtgaagccgtcccgcgctagcttgatcgccggcgcgaagaggtccttccacggcagcctgccgtagcgggaccacgcggcgtggaggccggcgagctcgccggggacgcccatggcgagcgcgcccttgtacttggaggtcgggttgcccgcgtacatgtcctgtcagacacaaaaaccaccatttcagcatgtcattttgggaaatcaaatgtaacaatttcctatttttgaattttggctcgaacatcctttttgagtgcctctcagtttgatcgaattaagaacataatttatcttaaattttgagttttaatgctgaaatttggagtccatggtcatgcgaattttcaccaacttcagatggagatttacaaatagaattgaataaaatgtatttctccttttactactatattggagtgttagacttttgtctaatcatagttagcttctatgagctcaatgttgagtgaacaatatttgtaataattggttgtagcatcttttgaagtaacgaccagatgttattttcattatctaaaaaaatatgtatgagcataattaaaatttaattttccactttttaattatgctcttcacaaaaaacatcatacttgaaaatagaaaggtctaaggttgcatttgtatgtgtaacttgcttgagcttttcacctgtacgtaaaactgagaagaggaattagagtataattaattaagtattaattattaaaaaaagtagagagttgattttttttattttttaagaaactttgatgtataaagttttcaaaaaacacattgtttagcctgtttagcagttcaggaaatgcaccaacgaaaaataagaaagttgttgtatagagttgctcaaaagaacgcaacataaataatgaagatgaaccataccatactaaactatttgtatgaaattgtggcgatggaatctacactgttacaccataaacatttccctacatgccaaccaactcgtgaagcatgtgaggagatgaaaatgacaaatctagatcgagtctgaacaaattctgtcttttttattcaacccgaacaactgaacctgtattttattattatctaaaaaatctgaacctttcttcccaactggcaaccgcaatggggtaactggtaggagtatcgcaaagtgcagaaaaaaaaaagaccaatgttgaagcaaccaaatcaattagaccatgctgattgcccatgtgaaacacagtgtcttacagaaaatgaccatttttttgggatcagatcacggatcatgctgtagttgataatgcaatgcacattgcacacttgcacagaggcatgcctctcagtgaaatgaatttgcaatgagctaaaaaaaactcaaagtcaaatgctgattatgtcttctagctatggtgacgttttacacgagacatgccgttcgctaaacaaaatgaaacaatgtggtgtaatacggaaatattagggagggtcagcttagataccgagtgaaccatagttaatcaggagtaaaaaagataagtacagtggtttttgtgcaaactgcaatataaagccattcggaaaagaacaggattgctgattggacttggagaggaacgtcaggtgcctatcatttgcgtaagcaagcgtggcccaccagacagtgacctgtacccaaccagcgcatcgcactaggccgtgggccccacatgtcatgcactcaggattgcagtaaaaaaagttttgctttttctttttttttttaatttttactgcggcgctctagttggtgacgaggagtaacgtactcaccggcgtggccgcggccggcgcggtctcgcgggcgtaaaagattacggcgtcgccgaaggcggcgtccctggtgacgatgaacgcgccgccgccgacgccgctggacatcgggtgcaccacgccgagccagagcgccgccgccacggccgcgtccgccgcgtgcccgccggcgcacagcgccgcggcgcccacctccgagcacctcccgtcgtccgccgccaccgcgcccaccccggcctccacctcgtgcgggctcagccccacgcccccgccgccgccgccggacaccaccctgctccgatcaccgccttgctccgctccccccgagctcaggagcagcagcacgacgcacgccacggcgagcagcgccacggcgatggcgagcgcggtccacgggcggcggcgccgactgccctgagaagaaaccgggccgccgccgaggagggggttctccaggccgccgcgcgcggccatggctgggtagctgccgccggatagccggagatcctggtggggattccaaggtaggacagagaggggagggatttcttggatagcgacttggcgagagcttgtcgcactgtggtgttgggtggcttgtgtgcttgagacacttggatatttatatttagtgactgtctgtccagctggccaatgattctatagagcttgttctaacttggattgtttctagtactatatttttaacgactcaaagctggagtagtaattacttatcagatggaaattcagaagttgaatgcttgacgcaactgtactgattggatggcaagagtaattctaacacattagagtgaatctggacataccttacgttcagattggtttattttagaacggagggactatggataaaaaaaaatttgaactctgaccattaatctgcttgagtgtcaaaacatcaagttctcaaatgtgtactactagtattatttttgttgcaaggaagaaacagagaaaagaatatgcagatgcaaagaatattgtggcgtggtgtgtgtgagatggtgcagcaaccattggcagaatcaggaaaacagattctttcagagttgtgacggactgatatttattacgtttatttatgcttagaaaacccagcatctgaatatctgataagcaccttggatctccgtctggctatcactattttagcctttaatttcatttccctattttttaataaatgaaacttttattgatctcaaacagttctccgcaaaaaaatattaaaggctaaaatatactacccattacaaaatatagcaacttttagctataaatatacctcatcccacaatataataatttttagctacgaattagacatgccatttgagcggagcgaccaaccaacttggcgaggcgagtgagacgaccagagtcggtgtaatcgcgtctcagcaatttgtcgctgtcaagtgtcaactactccggtccaggggcatgacttgttggtaatccatgcgtctcagcttctctttgctgcaccttctgtcattttctaattaaacggttgatatgtgttattccttaatttatgggttagttattactaacatagtacggagtactccgtaagtagtactagtatttatggtttttgcgaattgcaagcagatttctggatttttcacattttggtccttttaaaaaacttatttcgcaaatagacccctaaaaaaacttattctaaaaatggtcctttttaggcgccagaatagctggctcccccccccccggccgaaattttttatttttgttttatttgtttgatatttttttcacgcttagggacacacaaaaaccaaccatagaaaaattgaactcaaatggacgtaatatgtgacctgtagaatttttccactcctctcctctctctccaaaccagtgcaaaggagagatgtgcaacttttttatttttatttttattttttgatatttttttcacacttaggaactcacaggaatcaaccatgtaaaaaataaactcaaacggacgaaatatgtggcatgtggaattttccaaagttctaccgaaaaacttctcctcgaaaacacaatcttacaagcggaatttggaggttttaatatcgccgaacccggcaaagcggggagaatcggatgtaatattttctgtagatgtccgtgcatatattatttgcctgattccgagttcgtatgagaaagttacgcctattttaatagatgacatattttgtccgtttcgattgagttttggaaaattctacaagtcacatattttgtccgtttgagtttattttttatacggttggttcctatgttctcctaagtgtgaaaaaaa

SEQ ID NO: 37264 - DNA, 4671 bp, Oryza sativa
atcgtgatcctaagtgtgaaaaaacatccgaaaaaataaaataaaaatgacaccgttgcaactccatacagagaaacaggaatggaggcggcggcgccagcatggctggcgccctcctcctgccacgtcggttcgcgtgcaccacggtggcaggaggacggcgccagcctctctggcgccgtcccgttggatgacggcgccagccactctggcgcccaaaaaaggaccatttctgggataagttttttcaggggtctatttgcgaaataagttttttaaaaggaccaaaatgtgaaaaatccagagcagatttccagtgaacgacaccatggtttttgtaacttttttttccttctgcatatatacgtaggttacacgaaggatttgcgacacagaactcaaattctgcgtgaaaattgcgtgccaaacttctagtttttgtttgttcctttctgtatcagactatgttcgttttgggcttgttaccaagctgggtaatgattaatgaaagttgcctgttgtcaaaattaaaaaaaatgcgtgccaaagcaacggtgtggaattgatcaatcgtgcacacaaagtttgcctcaaatgtgaaaagtgcaaacaaagtatggcacagacatctcaggcacaataattgtagccagcagattcgacaagctgcagttgagctaatgatatattgtctccaaccaaaccaaacacctcttcatcgaattattaggatttggccttattagtataattgctcagaatcacagaaattggctcaaagatttaaagtagacgtaagttcagcaatgtatttttttttcctcaccttttctaggcgactggattgttctaacttctgcaatatactccgcaaagaatgttattaggttacaagagggaaataaatgcatgtagagcatgaattatgcaattcctgcgtgagtttggtacccacattgcagagtagcacaagaataatttgtgtactactcttatgttgtagcacatactcaagccatgcctatcctctcaaacctattgtagtgtactgaactattttcatcttgctgtgtgccagcaaaacacctgtaccactggaatgtttcgtgtctgtcctgcacctgaagattagccttcccaactgatcatcaaaattgtgtccgagatcaactacacaaccgtactggccaactgaattaacctgtatttgtaaatgtacatgacattaacaccaattgatcaaggacatatgataagatagagtataaacctttcttttttgccacttaaaaaacatgaactccagaattcaaataagctagtgagcttctttataaaaaggtgtttgtgtgttcatagtacttaccagtaatgacaaaaatgaaatccaatcaggttctgtcacacctactgaaccatgcgcttcctctttgatcttttgcccttctttccggagtaatttggaagtttcttgttgctactggaattgtatctttcctcaggtcctccctgctgtccgttttacatcagtaattgaaatttgttatgattcacacggactattttaaggggaatagtgattttctaagatgactagcttgaactgtctactacacagtgctccagcaggacaaatgaatggtaaaaaaagattgagtacctcttcagtagtctcatcatccgactcttcatcctctgatgttgaggctgaaagatctgaatctcctgcagcaagcgctttgttgccttttctcttgctctcctcttctttcagctgtttaaatctattcaagatatttttgtaaaaatcaaaaccagaatataatagggttaaaagccatgtgaggttcaaaagcacctttcaccaggttgggctggttgagcactcgtacgttttgctcgtcctgcagtaattatcccactacccccctgattgacaacaggctttgctcctcccagtttccgtaaccaaacttgctgggctgtgctgaggatattatttgtgaacctgatagcaaacatggagtcaatacacatattggatttgatcaattgcaagaagttaatgagcagtggaggagtcccacaatctctatgaggcatagcactatagcatggaacatgactgaaacactcatacaactaatagcaaatgcacataccaataaatggacaaccctgacggcactgacaaagagaaccaccctatcataaatggaagaaatttcaaaacaagcagtgtgttcttctgcgatggatcatcagtctgcagaaaaaaaggatcaaattgccagccactcatagcttgtatagtggcaatatgacagatgatatagtaatttagagcaccgctcgtctgctcacctggggtggcttcatgatttccatagagacaaactgagaagcaacaagtagcacaggcaacacaagataacatatcgtgtcatgccagcctaatggaggatggccatcctgcacaattcatttaagttgtaagtatgatttaccatctcaatattatgcaagtacatgagtaatatgctgttttactatcatgtctctacaggactataaattggtatgccacgccatttatttcaaccagagttctaaataataggcaacaaaatgcgaggtgcaaatagctaagcttcttgttgcttgattgcttaaatgactatgggcagaaacgtgacactaatctaacttgacgggtatgtcaaagtcaaataaggggggaaaatgaggttaaattcgctcaagtgcactataaacctgattttcctagatcagcaatgaaattgttgatatatgttaacgtgtgatcaattttattaccacaaaaggcaagagccaagaaatgccagcaccactttgccgagcagcaattgttgtagggcctcccaaagatggaatccagaaaaatccttctgtcagtaatcccttcagagaaatataagccacttagaacaaaatcctcttaatgaagcaaatattaggaagcaggatttgagttttacctcgtttgctacatttgaaagggcttggtagaggccaatccagacaggtattgttgccaaagttggaaaacatcctggaagagaaaccataatatcaaaacactatatcacaaaagcaatctcacttaaaactttaaaaagccaacaattggttttgcaagcacatgatggcaatagatgcattatgtcgagaaatagaaaatatgatcaactaataaataacaaactcatacaaaaaagatgcaatggaacaattcaactatcaaagttaataggctaaagaatggagaagtaagcgacctgccagagggttgactccagcttgcttgtataaccgagcagtctcaagctgtatcctttcctaataagagttatgtaggagtgatagatcagaaatgcccaaagatatgtgcttgaaaatataaaacacaacagtgaaataagaacattttttgggaagatagttctaccttctatcgttaaaatatgcaaaacatatatccagaaacaaacctcagtgttcctactttaatatccatggcgtgcgtaaaagataaacaaaacaaacctgatttcctgcatatctctgttgaattgctttgatctgtggctgtaaattctgcatagccagagttgattcgacctaaaaaaagagaggaaaaacagcacaactctcaacccaccatatccatgttactcattaattaaaaaatagaccagattttatcatttacctgttgtttcgttaaaggtaatgttgcagccttcacaataacagtgagaagaatgatggcgaatccataagagtacggcacatgaacagctgacaggccatccttcagcacctgtatggtgatactcacatagtatcagcattccggagccgatgaatgctatgcaataaaatcctaacagttcttgaattgtaacatttcatatcaaaacctgtggataggaaaatgctaaacaatgcacgcctggtcataactagatataagttacttaaaaataaccatgccgggttgccgtctgctcaatgtttagtaagtttcagagcatggaggcgtcataattaagtgcatgcacatctactcctgcactctccacgaacttacatgactccaaatctccaattccccaaccaattcaccagaccaacttttgcaactcagggatatatccattaaccaatcttagcaatcctgaacctgaactcctaaagtgacttggattcctataggtttgggagaagacggcggcgcttaccttaagcacgacctccaaggcctcggagatgaacccgaaccaccccccgttcttctgcgccaccgacgccgccgcttcaccgccaccaccaccgccaccccctcctcctcccgccgccgcgtccgccgcgacgacagcggcgtcggcgagcgtgtagagcgccgcctcggcgcgctccagcgcggcgtggaggtcgagccccgcgatcgagtcgagcccgtggaggctcgccctcaccctgcacgccgacgcgcggcggcccccgtgcctccgcagcgaaggcagcgtcagcataggcagcctcgcggcggcggcgcggggctgcagcgaggggagcagcgacgaggagaggagcgccttggccatcgcggggggtgcgggaggg

SEQ ID NO: 37265 - DNA, 3126 bp, Oryza sativa
atttttgcggttttcaattggtttttatcgaaaacatgaatcctaatgtctacacttctgttcacttcagttcgattttagtgaaaagcctccttggggacaaaaataaattttgaaggaccttcgtatacaggaattacactgatctatgcagaaaccatttgaaaaaaaaaatgtatttcaaagaaaccccgagtatttcgcaaccaacctttttggcatattttttctttaaacatgcactatattcagattcaacgatgcaatcgtaatttcattacaatcataccctacatatcagttttctgaacgttattatcattttttttctaaacccattttgacaattgggtatagatcgaccaaatgtaaggccccgtttgaaacacgtgaactgtttccctgattcttgtgaatattttgtgtttcaaactttcagaatgtgaaatacaaactgaattgtgcagcattgaacaaagaccgcaccggtaatagtactactttgacagcacggtaacagatggtcaatgtctgctagtaacagcctggtttctgaatgatcggcccgggtgagaagagattgtttgcctgaagaaaatcgagtgtggtcaagggactatctgaagaattcgcgaacattgtatcagtgaaaaattattcaccattcgtcagaaagaaagaaaagcacacgacaaacaatgaaacaaacatcactggggttcagactttcagaacagaagctgtgattgtttcacgaccacacacaaccatcggtctcaagcacattacgctcctttctccatggctacacaaactacagaactcgtgagaagcaggccacggtagcatggctcattgctggccacacgcaagcccgaaaatatcatttgctacagtccaggtgaaaaaaagatctttgcttcaccatagcatccaggaaaggtgcaatttactgtagcaaaaaaaaaaaaaacagaaattttgatcacttcaattcaggattcagcaaacgggttcaccaaacggaattcgcataggagcatatcgatcatgaagttagtacagcaatgggatcgagtttttggtttcagttgaaagcgatccagccagtagtattgtagtacagcacattgaaatgattaagacagcgattacaaacaattgctgaaattgacaacacagttccgaacttctagtcgtaagtagctgtcgacattattatggagtaatgaaccgttgaacttgatcatcagatatatatacagaattttaactttgccatgttccatagaaatcaagatctccaatatagtggtgctagtgtaaaaagtacaggggagaatcaacaaagtggtaacttttttgcctaaatcaccaacactactgagaaaggaatttcagctaaatgtttagcagcaaaatatccatggcatcacttgttactttcctgcatatcatggcatgacacaggaagatctaaagactaaactgttttctgttctatgataaaagaagatcgttttcaccaaggtgtgggggcctcatgcaaacctggacttcatgctcttcgggtccaactcggtgcttggggaccatgatttccagtccagtgccagtctcgtcataatacgcttcgagctttgcatcttctggaatccttgtagccaaaggtatctctctcacaaattctccaggagggcagtgctcagggaaaggatcagtcaacttgaatgtcctgtcatgtctcttaacaaagggcattcgagcagtgctcacacacgatatcttcacaatgccatgtgtcaatgtgttcctccaagagaccttgacactgtgaggatcagagaagagcatgctcaccatgattaagtagccttcatcgtcctcatatattgtcttggcagccgtaacaggtccacttgcatgttttgctacaccagtgaactcatgcatccatgacggctcacctgtgtgaacttctatctcttgctctctgtcagaacaagaattatttgccatcacgcaatcctcatctgcaccatgagcaaagaagtccttccgtcgcttggcgcattttggtgaaaggtccatcccatcgtctgatgatggtggcgtagaaaggttaagacctgaaccattcagtgcctttttgtgactgtgagagccatgtgtaatctttgatgacagtggcagtggcctatcaagttcgaaatcagtgcttggaagattcctccatgattcaaagtcacttgcttcaggaggaattgagaaattaagttctcttcctgtaagttccgcccaccttttcatttcagcttcaggaacagctgacagatttggtgaactcacaatctctatcccatgaaggcattgtgggttggacagccctcgatagtgctttcgttgcatgcggtgtgaccttgcaaagcccttatctgcactgaatggaaaggatggctcaccatgcttggaatgcccattcatgaagctccggagctgcatcttcccgagggcattgtcaggccgttccttaaaaacccacatgtacatgttctccatgtcatgctgcaccaggaagacatcaaggcgaagatcagacttctcaaagcccgaaacgctcccagaagagtcccgtgtcaccttgcccttcggcttttccacaagtgcaggtttgaagtagtgattgaagaagaaccatgcaccccaaatgctgtcccccctcttggcacacttcctcgcaccgacgccaaccgcagtgttgccattgccagtcaactttggaagcgtgagcgcaacctcagactcataagtctgcgtgccgagaccgacatcaagcatgtcgaactggtcgataccccacgacggcggatgcggcggcggtggtggtgaggggtctgcagaaaggggcaggttaatgtccggtggtcctggatgcgcagattcacgccgcggaatgatgaacaattccctgtcaccaccgccaccaccaccaccaccaccgggaccggtgctggcgccaccttcaccggcaccggaggagtcacccgaggccgcgtgcgacccggcgggatccatggaaagccgggtgcagggatggctgttggtgttctccatggacagggtggt

SEQ ID NO: 37266 - DNA, 9103 bp, Oryza sativa
  unsure (1)..(9103): unsure at all n locations
ctcttcgcttccacctcttgctcctcctctatctactgcctcttcacctcttgccccatgggaggagaactccatgggagcatcaaggatttcgcatagccttgccccataaaagatggagttttcaacccaccaaatccacccacagatcaagatttgcgatgggggatccttcctttggagcaaaattaagatcttcggagccaatccagcgctgcaagcctagaaaaatccagagacaaaaaaaaagaaaagcaatttatcagacttactaccaaattaacagcatgttgatgcacacatacctcgaaatacagatcaagtaaaaaaaaacacttcctttcgctaaaaaggccactcgatttccccacaatacctcactaaatttcgtcacgaaaacaacaatattttctccaatcaagccgtaccacacctcgaaaatcccattaaacacacaaagaatcctcgctggaaggtggaaacgaagacaaacgaggaagaaagaaagaagaaagagcagctgcccttgctctgatctaacctttgggggaggaagcagcaaggttctagaaggccccttgtcccttcggtgaggagctctcctgaaggttctggaggcttcgcctcgccggagcttctcgccggaagcgaggaggagaggggagagaaggggaggaggggaacaatggaggaagagagagaggagagaggagggcccaaagaaaagcgaaaacaggggtcgcgggtgtcaacgggttacggatccaaaagtcgtttgcgggtcgcagaatgcaaccgtgtccagtaattttagagatattggggtagtgtattggatccagggagttaactttagtccctatatttagacactaatttaaagtattaaatatagattacttacaaaactaattatataaatgaaagctaattcgtgagacaaatattttaagcctaattaatccataattagagattgtttaatgtagcatcacataagctaatcatggattaattaggctcaatagattcgtctcgcgaattagtccaagattatggatgtgttttattaatagtctacgtttaatatttataattagtgtccaaatatccgatgtgataggacttaaaagttttagtgccatctatacagggtctgaactactcccttcttccctaaatctctaaatgttcgacgccgttgacttttttaaacatgtttggccgtttggccgttcgtcttacttaaaaacttttgtgaaatgtgtaaaactatatgtatacataaaagtacatttaacaataaatcaaatgatagaaaaataattaataattacttaatttttttaaataagacgaacggtcaaacatttttaaaaaagtacggcgtcaaacattttaggatggagaaagtatatgccacttttagatgaactatttgccactgtaaccacatgttatagacacatgtggacccacatgtcattgagataggtgtggcaaatagttaattgctaaatctaaaagtggcaaataattaaaagccccgtaattttagcttcccttgggaaggggtttgtatgtaggtgtacttatgttttcgacgaaaaccgatcaaaattcgtgaaattttgatgtttcaacgttgaacgaaagaagatactaattgaaatgccaaaatggtctttcgagaattcaagtttgaaatagtggattcgacccaaattacttgaaatttgtcggaaaccgtaataccgttaggatttggatccgacgctcaatcagagaggtaaaccttgcttgagataatatttgtttgtttggaaacttttttgggaggaggggagcattggggggtttggtttactccacattatttttcttgacgtttaggctacaatggagacccacgatttagcttggttggtgagcaaattcaggtgccagaagctctccttctaatgaactttctttaaaaaaacaattggttggtgcaattatcttgagaggatctttaaaacacatgaattttataatatttttataggatttagctcaaatcatacacaagtcctgtaaaatcactccattcaaaagccaagttttacaatccggtgctatggactcactcaacccacaaaaccgcactcatttagacccacaattgagttaacaatagacaaaaccatagtattaatttgtacaaactcacactattttaaaatcgccacttagctagatctgccgccagtttctaggctaacattggaatagaactcgagtaaataataaataataaacagatcattacgtttccaaagggtcgtttgcaacaacgtattgagcatcgactagaaagattattctaagcatggagcattaggaaattacgatgaaatgcgaccaaagcaagaagccaaattatccgacgactacttgccgtttggaacggccaaggttgcaattattactagtattcttttctttcttttttttttcttaagacaggttgcaattattcaagagaagattccctcgtcaagtggtcaatcagatcccttttgttttcccatttcaaaggtttagccgtacatgcaatgaagcaaaaaacgatagatattggtctcttactacttcacacatatactctccgttccttaatataagagattttgacattttgcctgtttgactattcatcttatttaaaaaaaattgaaattattatttattttatttgtgatttatttttttatccaaagtactttaagcacaccttttcattttttatatttgtataattttttttaataagacgagtagttaaacgttacaagaaaatagtgaatatcccttatattagggggatagaggtagtatatattctagatattcttctaaaaattcaattcttctctaatgctaagaggatggttggaggtgccgtttccattgtcggaagaagggaccgaggggctgacagagtggtggagataagtctggctagttcttcgaacgggctacagggacgccttcgacttgttgtatatgcttgtttgccgggtgatttagaaagaaaggaacaccaggatcttcgagcacaaaaactacacggcagcacaagtttaaagggctatccgagaggaagtcctggtttagagagaagactgttttcaaacaacgggagtaaagcttcaggaaggtttttttttttttttcgttttcgcttgaggcttttggctctcagctgatcgatccgtctccactgtttaaatttgagttcttctctatctccatttcacatttgtttagcgactgcatacatacttagttacataggatttttgtcaagcacaaaaatagacaattagacagtttaaaaagataacagaagataccatgaatcaatcaaaatatcacacaaatggtgataacacttagagactcaaacaaagaaaaggtaaaacaaacaaacaaataaacaaaatactccagtataattcaccagtcagcatgtcacgcgtaaagtgtaaacagaacagaagataagtatagtgataatagctgttaggatgatgcacacatactgccagttgagaaagcatgtggcatcaatgtaattatggtgccactaactagatggcgaggacaatctggaaaggcaacacggagctgatgagagaaaagtacaccaggcgaaaaagaaaagcatcactttggcaacttttcagcaactggatggactgatgaaagggagaggtggaagaaaggcacagcttaccaactgcagagggcaaaatctaggtatggagagatgcaattggcttattggctccctttcaactgatcttcctctcacttcatgtcatcctttttcagatgagaacagtaactacacatcgacctaaagcaaatgacggtactagtatccttctgggttcttgacaagcacaacatcgaaatataaaagatcacccagagtttaagtacaagaccagtacattttatgttaggaacggagaagctagtcattggtacaacatactattagcaagccattagctgcatccagaaacaacactagataatggataatcggatctacaaagctcatgagcatattatgcaatttttgcttttgagaaggccttcttcctttgggccacaatatagcagaacatcagaacatcaggccatggaaatcctgcagtcattcaaatagaacaacaacatggtgtcttcaatcttatcaaattttatgttatatacgctagtatatattataattattagtgtgttatactatacaagctaatttttaggctattaggtgtatgaacaatttttttttacccctgtcatttcgaatatacaagttcaaaaagctaggcccacaatttagaagttcaaaaagctgaacccgccatttagaagttcgggaagcatgcacattcatccatttatccgtttaagtgttaagcagaaaagaacagggccatctgcatactcgtattatataaaaacataaggggcattatttgcatacttctttattgtgagagaacagggggcacaatgccccgataacagatctattgtgtcccaataacagatctacattcttcagacaagatatgatgcttcattgcttttgctgctatacatcggaaggccaatctcatgcaacaaccaactatatctttgacaatctgcaaaggcttaaacattttagcatttggatgattcacgatatcaatgtgacaatgtcagatgcaattggctcctttcattgatccacccctactttcatgaaataatattcagaaacagttacagggcaccaacatgaatcaaatggtgatagtaaccttcttcatccttgaaaagcagaaaatctacacatcattttttggcatcgatacggagtgcaattttatttacatatggaaaagccaaagtttggtacaacacaccattaattagcaaatcatgaaaatggtactcgtgtacatttttatttaccaagggaaaagatagtccatgtatttcggcatttccattctaatacacttttacttatttgctgaagaaacggtagcaacctgagctgtagctgcgagcagaaatcagattagatagctcttcagtagttatgtggttttgcttttgccaaggccttcttccgcagggcgatcaagtagcgaaacaagactggatatactgcactcatccaaatgaaacaacactgcagtgtgttaacaaatcctacttgttttcctttataaaattcctacaactaccttttcttaaaaaaaaaaactaggttatagcatcgattactaaatgaagtacaatcccatggaaatactacctgtggcaaacgaagccatgaaaaagagattggcatagaagtagttgaaggagaaactccatttgtcggatttctcagatgcctgatattgttgagcctgatattgctcatgcaaaagaaaagagcatttaaacaagattcattatgaaatggaggcgttgatcttcctttctaagttattcaagttaccttcatctccatgaaaggaagagcaatgtagattaggacaacctcacaaaccataccaacaggaaagcatactatgaaggtgctgtacctgcaaagaaatcagtacggaagtaacagcaacatatttttaagagaattcgctgatcagataacgagtttcatttgaagtttatgctacatattatgatttgtttacgactagaaccaacctaagccaaaagagccaggaaggtgtaaatccaaatgactccttcatgccatggaaagaatatctggtaacctgcaaggaattaataattcacttcactctccgaagtgaagaaaatttcataatatttgttcaactaagctcaacacaggaactttcaaagttttttttgggaatacgcaaggagcacattttttccattaagagaaataaaggttatttacaatgaaatgaagagcagcaggggactgaaacaggactcaaagtacaaaatcaaaggtttatctctcacggtctgttttggctaccgaagtcccttctgaggatcagagcagggatggctgaattcgcttggcgccagagtgccgtctctgccgccattcccttcacgatgtccacccaggtcctttgttgctgattgaaaacccggccgttgcattctttccaaatcgtccatgccactagcgtgaccaccgtgtcaaaaccccgacgcaatggctctcgaatgatcattcggctgctgcatagccattggtgaaatgagagttcatttactgacagacactcaggatgtccaattgcccccaacgtccaccaccatagctattagctgcctggactccagacaaccaacaagaagaagcgccgactgttttctctgatgaagcttctttgcagattggcgaacaagcatgaaattgtcatggatgcaccgttttttgatgaacgagctctggttctgtgcgaccaaggagttcagaatgggggctagccggcgggagaggatcttcgtaaatagtttcgcaacgctatgcaccagactgatggggtgaaaatccttcaatttcctggcgtcttgtgttttaggcaacaacgtgaggagagccgtgttcacctttccaaaactggacccgtccatgcgatggagctgctgcaacgctgccataacatcctcgcagatgatcaactagcaggtttggtagaattgtcctgtgaaaccatccggccccggcgctttgtcacgcgatgtatcttttacagcaacccacacttcctcatctgagaacggggcttccaactggggtagaggtttccccctctcgactagaaaatcaaggatgagagcaaaggatcttgaaggagaggagtcgagcaaatgcaagaaccagcacggccttctcgtcaggtgaggttgctacctgaccgttgtgttctagttgttggatgaagttgcgccgtcgatgggacgtcgcatgctggtgaaagaagcgtgtacatgttggcatcaccttcctgcagccacgaaatccgagagtgctgacgggccatcgttcgctccaaggaggccagcgcaaggtatttcaactttaagctcttgtgaaagtatctctccgaaggggacagggcaaacattcctctactctatcaaatctgccaatcagttctcttgccatttccatttgcaatttcatatttccgacctttttgtcgctccaactccttagttttttggccgttgttctcagcttgctgtcaagcctgctgatcgggtcggcaatgtggcaaggcaatgaccaggcatcttgtataacctcatggaatttaatccttcaagcgtgcaccaaaaactctcaaagtggaaccgacctcctctagggtgcgaaagggaaggtggatagaaaaagcgggcaatgatccgagaccgtggacgggagagctttaaggaagcattggggaaatacatcctcctagtcggttgtgtagaacaccctgtcaaggcgttccagcgttgggttcaaccaaccattcgaccaggtgaaggagcgaccattcgggtgaagctcatggagagatagatcattgatggccctgcgaaaatgacccatcaaacgcctgtttaagtttgcattgctcttgtcctgatcttggtaaatcaggttaaagtctccgaccaccacccacggtcccgaatggctgcttcggattgatcgtaactctagtaggaaccgcagtttgtcggcctcgagttaccagtaaggaaatagagtgcgagctaccatcaataaaagaaagatgtgcagtaagggagaattctcccatcgtggggctgtcacaactgacgaccgagctgtcccacgcaaatagagaaagtctgatagattagcacttaggaattaattgtgtagcatcaagttcagacacacgaccgaacaacgagcatctacaatcaccgaccgaacagcatcccggtgtgcgcggtcgtttaaacccatgcacattccagacaaggaagttgaagttgaaactcgtcatgggacgcgattgatgcgacctgacaacgaagctctcaagcggcctgcaccacggacgccggcgccatcagcgcgctagctggcctgcgggccccggcaagctgatgtctaagagatggtcgatactgagctcattgtcaaagatctccgtatactgctggagtgcattattggtcggctgtggaggaagaggcggtacatcgtctgcatcaacctcaagctttttcgccaaaaccacctggcaccttgacattaatattgttggagctccatggagtgcttgaaccacctgccgctcactccggcgaggcgtgaagggggtagcaggcatgaccgatgcaggcggcgttggcagcggcgggagaagtggggcagggatcgccttctaatcttggtgcgcctagagaaggtgatcaatggatccggttgcggagagcccggcggggttggcgtcgcagcgacttgatcagggggcgcctcggtggttggcacgtgaacaccaccatgctgggccggctccagtgcgacttgtcatccgagcaggccgcctccaaccgctggcccaaaggaaggaacgaccacttcatgctgggctggttcagaggcctcagccgcttggtccagtagggtgttgggctgtcccgagcccaaatcatcctggactggtgaactgggcctgactgggctaggcacaaccactggagaaaggcgatctggcccggcccagaccgcatctcccttggaagccttagcctcgactagggatggcaattgtgcccatttgcccgtttacctgtgggtaaaaaccctattagggttgggtttgttctccattttatacccgtgggtatcttattgggtcaaaagttatgcccgatgggtaaatgggcatgggtataggtaatcactacccatgcccgctttgcccgtttacccgcgaaatctaacttacatgtaggctaggagcaaaatccactagaatatannnnnnnnnnnnnnnnnnnnnnnnnnnnnnnnnnnnnn

SEQ ID NO: 37267 - DNA, 2029 bp, Oryza sativa
aagcttgtagactttttgttccactgcttttgttgtgcgggtaaacaggcacgcccgcgggcataaggcgcccgcgggcaatgggaataggcaaccatccttacccgtcatgtagtaatgggtatacccacgggcacaaataatctcacgggcatgggtatgggtaggcactacccgtgcccgtcacgcccgattgccatccctagcctcgacgccatcccagcgcgtagcctcatcccacatcggaacatgtgcaccggatgggggcacatgctccgcctgccagcacagctcaaaagaagcatctcgacaggggctagctttgcaggggctttgaagcgaatcagaagacggttgtgatctgaacaggggccccacagaagaggccaccgcatcaacatcggtgactgagttgagggaagagacaaggattttggtggtgtttggatcagggactaaactagtccctgtcatatcggatgaatttgaagtattaaatatagactacttataaaactaattacataaatgagagctaattcgcgtgacaaattttttaagcctaagggcatctccaatgtttataatcataagtagcattaaggtgggtcccactattcttatggttattaccacaatgtttgaagtaagagtaaactttaagatgggtcccacaatgtactattctagtacttcttttatcagccatgcaaatttttcatcctcacattcattttaccctattattttattgcttgtggtcaagccataagcttaaagctttcttttgcatttaatgccttatggctttgtttcacaatgtatatggtcactataaaaccttatggcctcttcttatagccacattgtggctgccctaattaatccataattagcgtatgtttactgtagcatcacataggctaattatggattaattaggctcaatagattcgtctcgcgaattagtctagggttatagaataggtttttattaatagtctacgttaaatatttataattagtgtccaaacatctgatgtgataggactaacaagttttagtcccatctaaacagggtctttgtctcccaaactctctcctctgtcgggggaagggacagctgcacaggaggcagctgacgcgaccaggaattttctttcaagaatttcaacaactactgtcatttcaagaagcagaactataataaaattgcatccgaaattcatgatcttccaagtgagtaatttggtgaaaggttttagggagtagcgtatacctcagtgatgcaccagcatatgatcaaggaggtaacaaggatatgagagtgtgtctgcaaaacatgtggacagtgattcaccgatattgtttataaacaaaacaatcctctgattgattagaagataaaatacatggaataggaaactaggatgcagaagaaaagagcactattttgtccttatccatgatgtaattaattgcaacagcttcattacttaagcaatttcagcagcttcggtttatccaatgcctactagagccattatgaccataaatgaaagtatgggatatgctcttatagctgcaacattacctaacatcaatgttttgtcattctaagaagtgctttctaatccagaacttgtttttaagatataaaccttcttataacttggagtaaggtcctgatattacctcagggaagctccacaagatgccccagatcatgaacaaccttccagtaacttgtagaacagtagaaggcactggagacctcaccaaacctttttaacaactcagatacagtaataagcaataatttttttgggggaaataattgagtctaacaggacacttcctttctctctttaggaagaagttaacaagacgattttctcaaaactgaaacttctcttgatttatttaaattccaggctattgtttttgaaacgagccacacaagacagtgcgagtttcatgtattgataaagcaggagaaaaatacaatctatagtcctagaagaccaca

SEQ ID NO: 37268 - DNA, 841 bp, Oryza sativa
agtttcatgtattgataaagcaggagaaaaatacaatctatagtcctagaagaccacagacaaaaaaagaaaatacaaccacaccgcgcgtctacaacaaaacccactgcatgagcaaaactgaaggtcttcgagacgacaccttcaagaagggtacgacaccaaaagtgccgctgtcgcctgtcccggagggccaggacaaggttttcacctgaagaaagtaattgggagagacaagaaaagcggcaacaccccaagaggaaaaaacggcacccacaggcgtcgttgttgccggctcgaaggcagagctttcgcccaaaatttgtctctcccaagaactgaactcctacacgctccgcagccaccaccagcgaaaaccttcgacgcatggccaccgcaccggcaccacgccgccagtcaatcgccatggggaagctcgaacctcgacacacaccggctccatccacgcagttgggttggatggggagagggtgagagagaagaatggatgccctctcccccacactagcccgcacgacgtggccaacttttgccgacaaagtcgccgtcgcaagaggacatatgtctaggaaggtgcacgtcgagaggaccgcggctccccctgacagagtaaccgccggctccgccacgaatccgttgtccatgtcacctcggaccaccagaccgttacaccggcgccatgccaccctccgcaccgtgctgttgacccctccgccacagtgcacccgccgtccaaaatgacgcggcactagaacgtacaccgaagcacgatgctctcgccccaaatccggtggaggggatcggatcttgcccggcggaa

SEQ ID NO: 37269 - DNA, 621 bp, Oryza sativa
  unsure (1)..(621): unsure at all n locations
annnnnnnnnnnnnnnnnnnnnnnnnnnnnnnnnnnnnnnnnnnnntccagtatctagtgtagcaggtaaagagaattaaatgtttctaaatgaaaacataatcatcattcacttttactgtttataacttcatggttaacggctattatcaggtgaaaaacgctgaccatatatcagacagcaagcatgtcgatgcatgcgaatatgaagagtactgaactgaaaatttgtagttacaaacaaagaggcaagagggagtgaaaacagaacagggacgaaacagtgttccgccttcaacttatgaatcatagccaaatttaaattttagaattaatttagatgtttcatcattttctattttctggccttaatttttgtggaagtacaaaaactttaccctaaaatcaattttggttgcttcatttatttttctcagcttataagccgtagcccaaacaattagaatattttccagagaaaggccaaaagcatagctgtattattggtctcttgtgcatttgccaaaaaaacaaacaaacaaaacaaaacagagacaatcatctatttatgtgcagtacagactacaaataaacagttcactcttgctcatggcagctaca

SEQ ID NO: 37270 - DNA, 1590 bp, Oryza sativa
  unsure (1)..(1590): unsure at all n locations
nnnnnnnnnnnnnnnnnnnnnnnnnnnnnnnnnnnnnnnnnnnnnnnnnnnnnnnnnnnnnnnnnnnnnnnnctgtagtgaggaagaaaatcattgaggaaaacccaaaagctcacatcgatgttctgaagcttgacctcagctcccttaagtctgttagagcttttgcagatcagttcaactcgatgaaccttcctctgaacatcctgatgtaactcccttcaaactcttagcacacttgcctttttttaacatgcaaagatcctttggttctgcttaaatttcagttaattaaggggtctcatatattctttttttttccgtcatgcagaaataatgccggtgtgatgttctgtccgtttggattgtctgaagatggtgttgagatgcagttcgcgaccaatcatcttggtattcactctctaccactatcaactatttactttaaacatgcaaaaagtgcttggatgatactgatatctgtctgatgtgttatgctcaatcaggtcactttctgttgaccaacctccttcttgataatatgaaagcaaccgcgaagtccacaggtattgaaggtcgtattgtgaacttgtcatcggttgctcacctccatacatatccgaagggaattgagtttgataaactcaacgatgagaaaacgtatgtgctgagtgttttcatgttgtttttctgttggaaaatttatgtggattagagattgaaataagaattttgtattggcagatacgatgacaagatggcttatggacaatctaagctggcaaacatacttcacgcgaaagagctctctagacggctgaaggtattttcttccctcattctcacctttatttgtgatgtctttattcagattaacagagctgaaaactctatgcatttcccatttttctataaaacacatttaattttgtctattttccatcactaattcaccaatacatgtttgatctgtgccattgatgaaacaggaagaaggagcgaacatcactattaactgtgttcatcctggattgatcatgaccaatttgatgaggcactcctttttccttatgagtacgtatatgcaagttctctctttctgagtcattgttctagagtttttgctatggaccttcaggcttcgattgaaaagagaatgctgtttcctttccttaatgttctgaaaaaaacactttgttttcacttgcaggggtgcttcaatttgccacctacatcttgtggaagagcgtaccccaggtttggaacccaatatcttctctgttcttctttctgtccgaattctctgcagcaatgctgaaagacaaattgaattgtcttgaaattcaaattcatctgaaacaacacacttaacaaatgtttcttttttcagggagcagctaccacttgctatgtaggactgaaccctcagctcaagggagtgaccggacaatactttgctgactgcaatgtggagaaaactagcagatttgcgaggaatgacgcgctggcgaagcaactctgggaattcagcgaaaagctgatcaagtcttcttcaaaatgagagcccaaagcaggatcatcagcagaaaa

SEQ ID NO: 37271 - DNA, 15344 bp, Oryza sativa
  unsure (1)..(15344): unsure at all n locations
nnnnnnnnnnnnnnnnnnnnnnnnnnnnnnnnnnnnnnnnnnnnnnnnnnnnnnnnnnnnnaccaatttgatgaggcactcctttttccttatgagtacgtatatgcaagttctctctttctgagtcattgttctagagtttttgctatggaccttcaggcttcgattgaaaagagaatgctgtttcctttccttaatgttctgaaaaaaacactttgttttcacttgcaggggtgcttcaatttgccacctacatcttgtggaagagcgtaccccaggtttggaacccaatatcttctctgttcttctttctgtccgaattctctgcagcaatgctgaaagacaaattgaattgtcttgaaattcaaattcatctgaaacaacacacttaacaaatgtttcttttttcagggagcagctaccacttgctatgtaggactgaaccctcagctcaagggagtgaccggacaatactttgctgactgcaatgtggagaaaactagcagatttgcgaggaatgacgcgctggcgaagcaactctgggaattcagcgaaaagctgatcaagtcttcttcaaaatgagagcccaaagcaggatcatcagcagaaaaaagaagtgttctgatactgtttggtttaatggcatactagtatgtgatgattgataaatatgtgtagcagcagtagtattaggaacctgaagtattctgaacccttttctaatgtttccttcggtcatggctgagaatgagatcaacctgtgtactcttgttaatatatttgccaaatacatgagttgttcagcagttgtgaaattctgcctggctagatattgttctacatatgtgcagctattgcccatgaatttgcttagcttgtatgcatgattttagttgcataacaggctgcattttgaggcaccatatcaggtgttaagagtatacaatgaaactaccgaagcacatgcagcttgaaataatggaattcaagtcaatcttgccactcactgaccttggccatgaaagactgtcaattttgctgtcagtgtaaaccttcactgaacatttgtccaactggagaacattatacaaatagatagttctataagataccacagcttttagtgttctatgattcacctccgaataatgagtaggtagttcgatcctttcgattcatatcttcctagtaaacggggatccagagcaataggtcgaatttctatataaagaagacttgtaaacaaaaggacttattgctctttttcggttttccgcttcacctattgttcttatcaattcattttcctccttccttctttcaataagaactatttgaaatgaaacaaattcctcttcattctgttacagaaacagggaattataaccagcttcaactgtctacatacttcaataaagttcagcctaattcaattgctttgtcactcttagttgacgatgatattgatcagagccattaatatttaagatcaagaactccaagattctaatatgcatagcaagcatggcgtctaagtgtcacaaaattacagcatcactcagtcacaccattgtagcttcgtcgctgtcgtcttcgtcgtcgtcgtcctcccacacgccgacggccttggtgaaccagagagcggtggacaccaccgcggcggcgaacacgggcggcacgagcacgtcgagggtgaccctgccgaacagcgcggcgggcacgcaggcggcgtcccacggcggcccgtcgagcggcaggacgatgccgcccgggcagccggccgtcgacgacgccagcggcgcggcgcccggcgtgacagcccagacgaaggcgagctccggcgcgaacgcggccacggacaccgcggcggtggcgacggccgtccaggtggccgcgtagaagagcaccgggtggcgcgcgagaatgccggagacggagagggaggggaacgccatggcagagatcgaggtggatccatggatatatacaaggaggcagctcagctcaatggcttttgggttgagaggatttggcgggagagcaggtgagcggtgacacttcagctcagttcgtcaagtgaagtggagtgctcagtatatttcaaactattcgaggcttcgagctgctccactcagctcacctgctcttaaaactgaattatatagatgtaattttaaaaagtgtaatttatttcaatgcaagattagctgctactacctgctacgctctttgaaatgcgaaattaattgtttttttctataacaaataaattgttgagttaatcaatctttccatcacgactaagggggtgtttagaagagaggggctaagttcctcaaagtgggggtactcttactaatttaagtttgtattttggttggttcagatttgcagcatgctgaaacgttaaaagctgtttggttagttctgtacttctgttgcaggttatatcaggcctctatatctgttgctatctgggccggactgtatgattgctccgaatattttgggcctcaatgtaggccggacacgcacattgtgggcctcgcttgtgtccatcacaagcccagccttacatgacgggcccgcacgtcggccacaacccattcaacacatagtgggctttcaagtcggcccaatagcttcgcttaacttagttattagtagcccatttagtcatcgaccggagagagagagagagcgctctggtacccgttccctccgccgctctcgtgctcatctccggtacgatgccgccgccgcgggcgtccgccatcctctccgccgcctgcaggtccagcaggacgctcttcggtaggcaccacctgcaccgactccccttcttcttttttttttctttttctgcctgcaggtcgactcttccgatttttttcatcatctcttgatgagtccatcacaccgcgcactgtttcattatctgaatttgaatgcatatactgaagtggaacgaggtttcgttctctgaatttaagtgcggggtactaatttaaactttgttcatgcgtagttattaggaggctcggcttccttggttcctgcacgccaactgttcgtcagaatgcctcagtggagcttcccggggcaggcttatatccacgctttcaccagagcattctcccaattcactgcgttgttggatctctacggctttgtcattctaccgctttggatggttccaaggatgtccatgtcagcgaaatcgttaaaatcctcaagtctagagatggcgacagtgagctcgccgaagttctcaatcaatttgcagacgagatggatgaggatgttgtgctaaaggtgctccagaagcagaggtccaattggaaagtcgcactatctttcttcaaatgggcagctggtctgccccagtataaccatgggtcaagggcctacacggagatgcttgacattcttgggaggatgaagaaggtcaggctcatgagacaactgtttgatgagattcctgtggagagccgccagtcagtggtcacaaacaggatgtttgctgtcctgttaaaccggtatgcaggcgcgcacaaggtgcaggaggcgatagatatgttctacaagaggaaggattatgggtttgagcttgacttggttggattccagatacttttgatgtctctctgtcggtacaagcatgttgaggaagcagaggccctctttctccaaaagaaagatgagttccctcctgtcataaagagctggaacatcattcttaatggttggtgtgtcaagggaagcttggcagacgctaaaagggtttggaatgagataattgcgtctaagcttaagcctgacctgttcacctatggtacattcataaattcgcttacaaaatctggcaaacttagtactgcagtaaaactatttacaagcatgtgggagaaagggatcaatcctgatgtggcaatttgtaattgtatcatcgatcaattgtgcttcaagaaaaggattccagaagcacttgagatttttggtgagatgaatgatcgtggttgtcaggccgatgttgctacctacaacactttgataaaacacttctgtaagattaatcggatggagaaagtctatgagcttttggatgacatggaggttaagggcgtctctccaaacaatatgacatactcctacattctgaagacgacagagaaacccaaagatgttatttcattgatgcagagaatggagaagtctggttgcagactggactctgatacatataacttaatattgaacctttatgtcagttgggattatgagaaaggggttcagctagtatgggatgaaatggagaggaatggatcaggcccggatcaacgatcatttactataatggttcatggactccattcccacgataaactggatgaggctttgcattattatagaacgatggagtcgagagggatgacaccagaaccaaggacgaagctattggtaaaagcaatacgtatgaagaaagatgaacctgctacagaagaacctcttaccaggaagaatctaaaattggatccaatttcaagactattccatgttcgtaaatagttcatcaatagattatactccagttgggggcttaggtttatgggctgaccaaatctagcctaagaatgtccagctagcccaggtttatgcagctgtgaagatgtcaatttgttggatattctaggagtttcatggctgaatgtgaggcattgagtagggtgtgccgctgttacttaataaagatagtcactttttgctcaagcattgacttccaaggtcaatgattcaacagcactggcctagcagtcttaagtatatgcctcatggtaaattgggtaattgcatcagaaatgtgtcaagactccaggcaataccctctgtctagctcagagacagggcattactgttgacgccacagatgcactggagtatctttaccaccactgtcagctaccaatcatccactgtgatctgaagccaagcaacattattgttcagtggacatgagcacacatgttggggattcagcgtgtcaaaaattctttctgaaaatacaagcaaaactttgcaatcagttcaattggaattagatgttccatcagttatgttgatccaagtaacagagatccatgcgttggtctcattatttttagatctttcttgatacatggatgtggtatcctgacatactccccccttttcttgtcaccttgtttgcatcaggttttatagtcaaactggtaaacctcaaaattgaagggaaaaaaaattaactgaaataacgttttggactgttactgaattaactgatgattgtgcaaattgtagctgctctttaggattttgttcatttgatgtgcaggaacctaaacaatggaaggtatattatacactgctaatttacaaacatctgccgcagcacaatctattactctacatagcagcaaataattcggacctaatggcgtcatcaagcatcagcacaactactaagagaggtgactttttcaaagtatgctattactctacatagcatgtaaagtatatctttttcttctttttcatagtccaattttcagactggagtactggacctcgataggttcttttgtgtgtgtgtgtgtgtgttttgggggggggggggggggggttgagattaatttggcatctgaaaatttgcctagttgcgttcgcaccaaggatgacgggacgctcttattgtcacagtcgaaaagagctgaggaaatcatcaactgatttacctcaccatatcacaactaaagttagccaaatttgattaagttaggcatctgtttggtttgtgccacacttatggcaagattcatttatcataatgtgggtcatatgtcattggcacgtaaaagtgtggtaggcttgctttcctatggctgaagtgtggcttcaattttgttggccacatgttaagcatatgttagctaaatgaagtatggcaagttttgacaatgtgggtatgccaaccaaacccctaaatcctgatgtttatgaatattatgcacatgaaaatatgttctcattaggattttagcgagttaagaaagggccattgtctttccttttttttttttgagcttatgctaggaggcgtatttggccgatgtgcactgtgccactgtcgtgtaatcgaaaataaggccccctttgaattggaggaaaaataaaggaattgaaatcctacactattcatgtcgttgattcgtcggaataagaaaaggaaaaacgtaggaaacttttctattcctacaattctagagcaaaaatgtaggaaagttaacatccactttgacctcttggaaaactttccttgagtctatctctctcgtctgattcctgctcttgcggtctaatcaaacggtcattcctatatttttcctgtgttttgcaatcctctgttttacactttcattcctatcaaaatcttgtgtttttcctattcctccgttttttcaatcctgcgattcaaaaggccataaaaaagagaagaaaatggcattcttccctacccaatcccaacaagcgaagctcaataatttcccaatcccaaccaacgaagctcaataatttgctggtgaaatggactaataagaaattttcgccgtgtttagttccaaagttttttttaaaacttctaacttttccatcacatcaaagctttcctacacacacaaccttccaatgtttccgtcacatcatttcaatttcaaccaaactttcaattttagtgtgaactaaacacacccactattatggacacattactattaggaacacgacagttcggaggaaaggatggtagatgaggctgtgtttatttcagcgcaaagtttggattttggttgaaattgaagataatgtgactgaaaagttatgtgtgtatgataggttgatgtgatagaaaaggactgaagtttggatccaaaatttggatctaaacacagcctgagtcactggatctggacttggatatcatatcaccgatatgatctcgctgctgcgtgccagcgcggtcgatcgcgtgaggaaaacggcaggaaaagctgcgttccccttgaccggctagacagataaacgttcttcgcctgagcagaagatcgcgtcaactcgttcaccggcgatggagatggaggacgacggagaggagaagtgttcggtgaagcggcggcgacggggagcaagtgagcaactttgttgctcagcctgtcagataatgggccatatctcgtgcttgcctcgaatagtttgggcctttacacgggcccaaatgtatctctcttggttgtagcccgttgcaaatcatgggctgcgcgctaaccttcttgtgggcctccttctggtattgtgggcccaccaaaatgctaatccaccgcaaggtccattcactgttggacagatcgctcacgcgcgcgcttccgccggggtctcgtgctcacctccgggcaccgcctcgccgccgccgccggaatgcgccgtcactggaagccgtgctcagctccgacgcgtacgatgcccaatcctgtatactttttcttcttcgagactcccgtcgctgtagccacaacaattctccagagactcggagttctcagtctgcgcccgttacctgttcgacagaactcctccgaggagcttactgtccctggccctttgactaaggtgagcatccaattggttaatctccataaattttccacgccacggaccttttcaagtttgtacatatgtggaaagacatggccgtgcctgctgtaattctcgatttctcgttgttcccaggaggctcggtgttgttcgtttttgtgctcgtcaactgtagttgtccatgctttcacggaagctctacacaagctgaatctaatcctggatcaccacaagacttttacctttcctcgtgtgtctggaactccgcatacaagcgtggaaaagggtggccgtacaactgtacaaggtaacactctggactgccaacctaatggattctctgttggaatcagtcaggaagaaattatcaggaatttggtcgaacagagaaggggtgaggacataattggagcgagctaagtcatgtgtgagggccgagggcgacagcgacgagagcttggatgcgtccaagctttccatatccttccagtactatgttacagtaagtatctagttgggaaatgatgtggaaaggaatggcgggaacagtcaaaaaggtaacatgcactgctccaagtcgacatggtatcttaccactcctgtctctctccctgtgagcgcggagaccgctaaacaagtcaagattttgactcggtgtcctcgccgtctcgccaatggcactctgggatcatggcgtcgtggggttaaaatacggtgctctggggcactgcttgtcactccacttgtgtaccttgcaagtttgcaaccaccatggcgatggctcttgctagcttcctgctgctgctgctgtccgtcttcatgtccatcttcttgcacttcatggcagtgcgaggagcagacggagaagacgccgcagcgttgctcgctttcaaggccgtggcggtgggcaacggtggtggcaacggcgtgcttgcgtcgtggaacggcagcgccgggccgtgcagctgggagggcgtggcgtgtggccggcacgggcgggtggtggcgcttagcctgcccggccatgatctctcggggaccctgtcgccggccgtcggcaacctgacgtcgttgcggaaacttgacctgagttacaactggctgcacggtggcatccccgcgagcctcggtcagctgcaccgcctcagggaactcgacctaagcttcaacaccttctccggcgaggtccccagcaatctgacatcctgcaccagcttggaatacctggccctcggcagcaacaagctcgccgggcacataccttcggagctcggcaacacgctgacacagctccaggtgctaggcctcgacaacaacagcttcgtcggccattggccagcttcactggccaatctgacgtccctgggatacctcagcctcaggatgaacagtctcgagggcacaatacctcctgaattcggcagcaacatgccgcgcctttacttcctcgacatctgctccaacaacctgagtggtgcactcccgtcttccctgtacaatctgtcgtcgctaatggggtttgatgcaggaaacaacaagctggatggaagcattgctactgatatcgatgaaaagtttcctcatttacagtctttcgcagtgttcaacaaccagttcagcggggaaattccctcctcgttctccaatctcactaacctcacgagtctgcagctatcaatgaacggatttagtgggtttgtgccacataatctagggaggttgaatgctctgcagaatctgcaactaggtgttaatatgcttgaagcaggggacataaaggggtgggaatttgttgagtcattgacaaactgcagtaagctagagattttagttctcagtaacaacaatttcactgggcagttccctatttcgatcgcaaacctctcgaagactctccaaaaactttacttgggtggcagtaggatttctggaagcatcccctctgatttcggtaatttggttggtctaagatcattatacctgtttagtactgacatatcaggtgtaattccagagagcattgggaagctggaaaacttgactacgctatacctgaataacaatagcttgtctggccatgtaccgtcttctgtaggaaaccttaccaatctgatgaagctattcatgcaaggcaacaacttggaaggaccaatcccagcgaatcttggtaagctgaaaagcctgaatgttcttgatttatcaagaaatcacttcaatggttcgattccaaaggaaatattggagctgccttccatttcacagtacttgaatttatcatacaactccctctctggaccccttccttctgaagttgggagtttgactagcctcaacgagttgattctgtcaggaaaccaattgtctggccagataccaagtagtataaaaaattgcatagtgctcactgtacttttattggacagtaactcgttccaaggaactatacctgtgtttctgggggacattaaggggctccgtgtacttaacctaaccatgaacaagttttctggtgtgattcctgatgcccttggtagcatccacaacctgcaagagttgtatctagcgtataacaacttgtctgggcctatcccagcagtgctgcagaatttgacatcgttatcaatgctggatctatccttcaatgatctgcaaggtgaagtgccaaaagaaggtatttttaagaacttatcttacttgtctttagctggaaacagtgagctttgtgggggaatatctcatcttaacttacctccatgctccatgcatgctgttagaaagagaagcaaagggtggttaaggtctcttaaaatagctctggcatcaatagctgtggtcttgttcttagctctagttatggtgattattatgttaattcgtcgtagaaagcctgtacataggaagaagggccagtccctaaccccagttgtggaggaacaatttgaaagagtttcttaccaggaattgtcaaatggaaccaagggattttcacagaacagtttgcttggaaaaggaagctatggtgtagtctataaatgcactttgtttgatgaggaaattgttgtcgctgtaaaggtgtttaaccttgaacggtctggatctactagaagttttctggcagaatgcgacgcactgagaagtgtgcgccaccgttgtctcctaaagatcatcacttgctgttcaagcataaataaccaaggtcaagatttcaaggcactagtttttgagtttatgcccaatggcagcttaaatggttggcttcatccaaaatctgatatgcccattgctgacaatactttgagcctaactcaaaggctggacattgctgttgatattgtggatgctctggaatatcttcatatccactgccagccgccgatcgttcattgtgatctcaagccaagcaacatccttcttgcagaagacatgagtgcccgagttggagatttcggcatatcaagaatcctaactgaaagcgcgagcaaaacacagcaaaattcaagcaacacaatcggaataagaggttccattggctatgttgctccaggtaactgaattgttatgctttgtttctttgctttttacctcctagttcttacacaaatttaacattccggtgaatctaatgaactccaaaatatttgtagagtatggggaaggctctgcggtctcaactcttggcgatgtttatagtctgggcatattgctgcttgagatgtttacaggaatgagcccaacagacgatatgttcagagattccttggacctgcacagtttctcagaggctgctcatcctgacagaatcctggagatagccgatccgacgctctgggtgcatgtagacgccgaggatagcatcacaagaagcagaatgcaagagtgtttgatttcagtcattggcctcggcttgtcctgctcaaagcatcaacccaaagagcgaatgccaatacaagatgcagccctgaagatgcatgcgatcagagacgacgcttacctgatgttttctggctctctttcagtggacatggaagaggagacgaaacaaattagcagcgatttgaagcaacagtgagtaactaggcctgaagagtgtacaagaataagatatgcttgctggggaaaatgttttaacagctcagctgccgatggcgacttgccagaattccgagaaacaaaagctgagacgctgaagatgtagcattttccttcgtggttcatatcagtcagtctttatttgcgtcagttcatatggctatatgtaatgtaagctaatagaacgttcagtaactgccgatgtgtacatacaaccaatacggcaatactactatgtggagaactgtcagaaagatttttgactgttcatccttttcgtacaaaatgaaaattcaaatcatacctgtaatcacacatgaaaatcagattatgagattgcgccacgtttttgtgggacggaaagaacaggtttcgagctgttttaccaattaccaaaccataacaacacttgaagaatttatcaatcaaaaactttcctgcatatggtccatgcatttcaattcatatgctggtgcttatattactcattattttaccactgcataacatgtgtaatcatcctgtagatgtagaccctcctccacataggccaccaagctggagcagaaagaactccaccaagtccatctcgtacggcacaggcggcagatccatctcgcggccaattcgcaggggcaggaagcagtccatggccctgtcgatcaccttcttgtcgaggtcgacgacgaacacggcgccgctgctcctgtacatcatggccaccgatcccatgtccaagccatgcatcagcggcacgcagtatgggtaaggcgccggcaatgtcatccacatcacgtcgcggcgccacgccgccgcatcgtcgtcgccatcgccgcgtcgctgctgcttccagattctgacgtgcatggggaacacgcaggcgatggtgagctcgccgtccccgccgacgcagagcagcgtggccgtcgcgccgccggcgcggacggggagattcgtcatggagacgcgcggcgtggctgcggccggcacgcccacctccacgctgagcttgtacaggcggtcgcctcgggtggcgctcgcgacgtcgtcggtgcacagccagtgcgccgcgccgcggtgaacgacggcggatggcgtcgatctgcccgccagcgagaagcggaggagatccaggaactcggcgggcgcggcccagccgccggcggcggagtacgagttgacgtacatggtgatgctgttcgcgtgcttggtggtgacgagcagctgcgagaacgtgaagcggcctgacgatgccggctgctgcggcttcccagcgaggtcgtgggagacgacgatggcgtagctggtgaccttgtagggaccaaggtcagagtactcctccaggcgcgggaccacgtggcgctcgccggtgacggggttggagaggaagaggaggcgggtgatgggaagccgcatcaggaggacgccgcggcgcgccgccagtggctggacggagttggaggagccggaggaggcgagggggcggaacggcgagctcggtacaccggcaggaagccgaatgtcgagaccttgatgcgctgcaggtggaagaagaagccgaggaggtcgccggcgcgctggccgccccagaggtcgaggaggaaggcgcggtcggtgaagcggcgcagccagcggcggcatgtggcggcgagcatgaagaggctcttgacgctggccacgcgggagaggacctggaggaggacgtcctccggcaatgccgcgatgatgccgccgtcgtccgccatgggtgtgcgcacgtacgtacgtgcaaaggcgttagatgatctcccgcgattgcatctagtagatgagaaagtcttttctgaatatgaatcgtagcgtagtggggagtgtgtgtgggtgggggtggttggggggtggggggttcgacgaagcatgccgaaacatggctggatgttgggcctaggaaatgaaaattgggccgtttctggagacgacgcgtagatgggccagtggcttaatgggtttcgcgctaaatacctaccgccatcaccaaatatcgagctgcgaagttcaatattagggctgttttggattgagaccctaccaaaattttttaatagtaaacgtgctagtttagattgaagccaaacaattgatagcgcctacgctcaatttggctatattctaaaatcttcttcactctcatactaaattttagctttatattggtattaaaccaaacatagactagctaactttaccctaccaaaaaattggtagtgctaaaagttgtctagattttagcactaccaattaattggtagggtagagaaccaaataggcccttaataaagtagaaaaaaattataaaattataaccctgggatatcgtaactagaaaaacgaagaaaaaataaccaccacccacccaccaacacacaaacccaagagaaaactatcactagatcggccgtcgctaagccaacgaagaaactacagccaaggttgtccaaaagatcataacccaattctaacaaccgacactaaacctcactctagccatatctttagaatcgaggaagatgggtgagggagaaaaatgaaacctcttcctcctatacccttcgacatggccaactttcatattctgcgtgagccttataaaatcccgcatttccggcggacggtcacgctcacctcatcaggttgtgcgtaagcaacgagcaaacgaccagaccataaatcagggtggataatgcacaatgccatattgttaatgaacaaaaattgctgaacaaaggatcagacagtcaaaaaaaaaaggaaaaaaaaaaggtgacaccaattaccaaaccttaataacacttgaagaatttatcaatgataataatatgctgttgtccttaaatcaaaacttacttttttttcccgcacatacccctattctacaattaaccctcgtttttctactgcataacatgagtaattttcgcggggccataaacatgtgtaatcaatcaatcaattaattaattgattatcctgtagatcacctctgctgcatagagccatagaccaccaagctggagcagaaagaactccaccaagtccatctcgtacggcacaggcggccgatccagtgaatggtccattcgcaggggcagcaagcagtccatggccttctccatcaccttcttgtcgaggtcgaggacgaacacagcgccggtgctactgtacatcatggccaccgatcccctgcgtcccaatccatgcgccatcgtgtaacttttggggtagttggacacctccgttggcatccaaatcacgtcgcggcgccacgccgccgcaccgtcgccatcgccatcgccgcgtcgctgctgcttccagactctgacgtgcatgatgaacacgcagacgatggtgagctcgccgtctccgccgacgcagagcagcggcgtcggcgtgccgccgtcgaggacggggagcttcgtcatggagacgcgcggcgtggccgtggctgtgccgcccacctccacgctgagctcttgtacaggtagtcgtctcgggtggcgctcgcgacgtggtcggtgcacagccagtgcgcc

SEQ ID NO: 37272 - DNA, 9437 bp, Oryza sativa
gtgcttggtggtgacgaacagctgcgagaacatgaagcggcctgaagatggcggctgctgcttcccggcgaggtcgtcggagaagatgatggcgcagctggtgacggcgaaggaaccaaggttggaggggcccttcagatgcgggagaacgtggtgctcgctggtgatagggttgaagaggccgaggaggtggctggtcgcctctgaccagtcgttggagggggaaagccgcatcaggaggatgccgcggcgcgccgtcaggggctcgccgtcgtagctggaggggatgggggcgaagcggcggcgccggcaggaagccgaatgtcgaggccgagttgcgttgccggtggaagaagaagccgaggaggtcgccggcgcgctggccgccccagaggtcgcggaggaaggcgcgatcggtgaagcggcggcatgttgcggccagcatgaagaggctcttgacgttgcccacgcgggagaggacctggaggaggacgtcctccggcaatgccgccatgatgtcgttgtccgccatgggtgtgtgcacgtacgtacgtgcaaaggcctccgcgattgcatctagtagatgtattgcattgtataggagggtgaaatctggtgattaaaaatcaaaattctcatcttaatctcaccatcaattctctcgtgtaaactcccaatcctcttccctcgagttgcaaaacaagctgtgaaggtcgccgctgcaggccgaaacgcggctggatgttgggcctgtacagctgtactggatatcaactcttggtgatatctatacttctatagtctcggaatattactgcttgagatgtttacaggaaagagtccaacggatgacgtgttcagagattcattagatctgaataagtttaccaaggatgctcttccagacataacttcggagatagcagactcaacaatctggctgcatgtagaaccacgggataacattatacagagcagaatccaggagtgtctcgtttctgtcttcatgttaggcatatcctgcacaaagcaacagcctcaagagcgagcatcaataagagatgtagcagtagagatgcatgcactaagagatgtatacctcatgtttgccaattagcttgcataggtattactagaacagaaggaaaagcctccactgagacaccgaaaacagctacaatagccaagctcattggaaataatcctgaaataactttagtcacatgtagtgtttcagttagcaattgttctcacttctgagagctatatttctttgccagagtatcagaatcatacaatttaatgtaaaattcacctaattgtttccttcgtgcttaatttcattgtttccttcttcctgcttgattgaaatggtagagctcctactgtactggttccttcccaaaattcaccttacattgttagttcaaagtacaaaagcgccaacttccactagtaccaactagcaaacagcaagaatctatccaattcaagcaattgtgtttgtgtccacacataaaacgcatgagtaaaagtgtagaacaccaaacaagccaggagcagcattattcctgaagtgagttgccatgtcctcagttgatacgtatgcataccagaacatcaattttgttccagaaaatttcacagtatcgtagtaatctcaaacagaatgaacaccacaaacaagaaatcgagcaatcacaaaacaggaagcacatagaagtctagaagagcatcgttaatatctcagataaataagcaacagtttaccaaaagcagggccacaaccgccaactacacactaatgagacatccatttctaccactaccagatagtagacagaactaaatactaccaatagatggaatctaagcggaggtgaacttggtcacagccttggtgccctcggagacggcgtgcttggcgagctcgccggggaggacgaggcggacggaggtctggatctcccgtgaggtgatggtgggcttcttgttgtagcgcgcgagcttggcggactccccggcgagcttctcgaagatgtcgttgatgaaggagttcatgatggacatggccttggaggagatgccgatgtcggggtggacctgcttgagcaccttgaagatgtagatcttgtaggtctcgacgctcttcttcgccttcttccgccccgccttcttcccctcgccgctgctcttctcggccttgccggcggggagacgcttctccgccttgggcttcttccccgccagggccttctcggccttctccgccgcgggctcctcctccgcgggcttcttcgccgccggcttcttctccgccttgggcgccatggatgccgctctcttcttctcggggaagggaaaggggagacgaaaatttgggggaattcggttgcgagttgtggagttgaaggggaggcggcggcgatggtattaaaggaggggagaggtgggcgctgattggcggagggggtgcgccgcggatcgatgacgtggaggagcatgtggcgcacgattggtgttgttttcctatggacggctgagatgcgtttcggcgcggaaagtgtacgcgggaacgggaggagtaggcggtttccgtcgcgcgcgcggggattacgagttttcatggttgggcagttgggctttctttcgtagagtttagctcatggcccagtaaaagtcgcaggcttggaaactgggctattcccgattcgaggcccacgagagtggcctgtttacttgtttctgggctaatcgagctactactatttctttttgctctaaagtctatacaaacatgttaatgtcttagcgtatgacctcatcaaccgtccggccttccacggtgaatcgctaaaatggtataacacctgttgtttgtcaatagcattatcacagcataaagcaattgaaccagtcgcatgaacctctatttctttttttcccaaattagatggagtcacacctctagaatcatgtgatggtcaatttttgtgatgagcaattattaaatgcgagtgtttattgaaaatatagtaattaatattttctgtcagtgaacagtgcagcactgagtggccggtcagaccagacaatgggcggcggtcaaaccgagaggtgtccgggcaattattcccttaatctctccccttcctatcagactgagggtgcttcattttttacatgttgagggtagggttaaatactaattttggctacaaatgttgcagagtacggggaaggttctgtagtcacgaaggtgggtgatacttacagcttaggtatattattgcttgagatgttcacccgaatgacattttcagggattcaatggatctgcacaagtttgttgtagcttgtgttcttgaccgacccctagacggattcggttccagtgcagtggccactgtcaagttaagcagtcacaagagtatcattggatttaaaacggatggcctagatgcctctttagtactgtagcaaattagtgtagcgttttttaatgaaaaaatgtgcagctctaattttactgtatctcacaatttaaaccattggatcaataaataaagggttgggattgtgtaactgcactagatctcaattccccctagaatagctgatccaacaatctagctgcatgaagaagaaaatgtacagctctaattttactgtagctcacaatttggaccattggatcaataaataaagggctgggattgatctcaattccccctagaatagctgatccaacaatctggctgcaagaagaagaaaatgattcagatgttaaacacacaagcataaaaacaataattattcaacagtgcttggtgtctgtttttaggctcggcacatcgtgctcaaagcaacaaccagagaacgaatagtgttatcagaagctgtatcagagatgaatatctcaggtcttggatgcttggccatgaagaacatagcactgtgagctaagcgttgcgcaagatacatatgtagtgttcatgattgtaccaggaataattggaggaatacaaggttgcttagttgatactattcattattttatcttaaataaagcttagatgcacgtcattgtagtggtttatgcttagaagctgtcacttaagaaggtatttctgccgataaataaagatcttcaacagagtttgggccgaggttaccgccacctcgcggtagcacgataaccgcgataattgtctaaaatcgtacagaaatcacattcaaaaattcgaattcaaaactcggcagtttcgcggtttcaccgcggttaccgcacggtttaccgtgataaccgcgatatttgcacggttattgcggtctgtatagttgaaatcatgtaaatgaaaaataaatagggaaaaaataaaaaatacggttgaatatgtgtagaaaactagaaattgagaataattgaaagaatatgtaggatacttaaggcccaatattgtcttccttttttcaatttgtaaactattttttattttaccctcaaatttgaatttagtttactctattttttaaaaaatcttcaccattggcaattataaatcaagaactacatccatgtttttttttcattttttctccaaaagtttgaatttggtcaaaatccatccaaatcaatcgccaatttcccctaccgtaccccgcggtaagcgtgataatcagcgcaataagtgaaaccctgctcttcagacatgcccctgataattgataaataaaacttatgtgagcttaagtggtgttcttttatcctgaatatgaaaatgaagatttaagttttttacgcaaaacgatgtggtattaacgtatgattgattgagttttaattattacaaacttgaaaaatagattaatgtgatattttaaagcaactttcatatagaaagttttcgcacgaaacgtatcgtttaacagtttaaaaaacgtgccacaaaaattttaatcttcatttaactcttatcgaagaaaagaacggaccttaattttgccaccatgtcttactcatcgtccccgtgaacccctttctttgtcgccacaatcactgcaatgcacgctacatcttgtctgtcggcaatgattctcacgggacggcatatgctggcacttgactgaccacttgcatttgatggaatatatatatatatatatatatataggacgcccagataggactccatggtgcccgggcaccactgacatctgccgttggatcacattctcatctagttgatcggtacatgtatatttgattaacgggttcacccgttaagtacatttgatttggaaattgacagcgtgtgcatgcatgcaaaatatttagtaacgtctttaatacctaggtttggtaattgacagcgtgtgcatgcatgcaaaatatttaggagtattaatttagcgtatttaatacctttccatcaacagttcacggccgttatttggtttctaaatatttgtcaccataatcatggatttgcggtttatttggcaacaaatataatgcggtttattagggtatatgaaaatctaagtatacttctacgatgtagtatatatggaaatgttatcctgctgttattttgaaaataattatataaggaaaccgaggtaccctaagtacaccatggacgatgtaattggaatataagtatatatggaggctaagtatatggtatgcttatgtacacctagctaaattagtgcgttttgcaatttccagattcagaaaatgtttactcatttatgtaatgtaatggctatgtatacacgggttattttttctatatacttagctaacttgttaagtatacaaagttttaaattacgttaatttaattatattatgaatccaagcgtatataaatttacaatttgtgtacacggtatatgttaattgattgtcatcttatattgttgtaaatagaaataccatggtttctaagtatatctatatttcaaatctgtgtactgtagattattagaatttaaaactcgcctacctaggctgacagtacattatttcctaattaaatttggaagcaagtatattttaagtcgttacgtccggatgtaaaatttaatataaataaatccaagtatatttttgtaccatggattttaagtatatctaaaattaaaatttaatataaataaatccaagtatatttttgtaccatggattttaagtatatctaaaatttaaatgtgtgtactgtgtattattatttccaccatgtttttccatatgtgccgatttagattaaattcaatttctttccacagtgttttagatgcgcttttagaagtttaatatgctgaattgaaagagtagatctcttaagtgaagtctgaaaggaaacaaaatatcggtgaattggctcatccacatatcataggagtttagcataatataaatgaaacatatgctaattaaagtaaaaacgatctataaatatagatgtaactagtttattattacagtacgattgtgattcataaatgtaaaaacaccgaatggctgcttatttgaccgatggctggcaaccatatcacaccatcagagagttgattttcggctggtacttgcatgttgcctcatgtttgctattcagacggtgggcgagtcacatttctcatcactaggatgagaatttatcatcactatgacgagaaatgatcaacttaggagcctccacctccctcttgacatctttacggtctgtatctatctcctacgaaaaaaaaacaagtggaaaatgttaagagcaggagtgacaaatccagaactggagctgaacgtgaaccaaaaatatattaaaataaattacctgtgaatcattgggcttcgtttcatcgtctattaacatctgcgccttttggagatatgcattctcctcttgaagaccatactcattgactagggccgtccaagtatcttcaaaatcacttgctgtgcgtgcatgatataagttgtgtagttctgacttcgtaccaaataatatgtgccaacggcagcgtgggtgatcatacttctgcagcgactgatcgatcttatcgctccaggcaccagtgttcatcttgtccatagctactggcaatataagtataaatttcagaatactaagaagaggtcaacatatatgagaagtacatatacgtacagataagttggagccatacctggaacagaaatgtgttgttggcgagaaccagagagagcaccagaagtgagcagagtcgtattgttctgctctttatatgttgcaattgtgtctccgttggaaggaatgaaaaaattaatatcattaccaagtataaagatcttatttatggtaatatttatagctattacgaccgataggttacataatataatttgttaccgtcaacatggatcgatccagtcagaattgggtatcaattgattaatttagtaaccaacgagtgatttcggtactaattggccatagtcaacgggatagagagagagtgaaaaaatgcacgtctgaataccacaagattaatgacataatctgtacttttacaggtgtacatgtacacataggtttatgagtgacagagcgaacacgtatacatgtatatcccacaagatgaatgacataattatgaaatagaaaacatatccgaatttaattaaaaacttgtccaagtgcaacacgcaagatatgggaatatttttacaagattgtatttaaaaacaacgatagacttgcttctatacaccaacaccacacgttgatgcatagtgaccagctaacttgcatttcgtgcacaccttgatcactttgttcttcgatgtgttctccggatttgtggggcatccagttctatagtgccccttcagatgacagttcgaacaaatgcgcttttttcggactccaccatctactggggacttcagcctggtggacctaggtcggccacgctttgcccgacgatcaggtggcagtggcaagctttgtacggcctgatgagccgcggggtcttcattttgttcacctccttgatccggtccagcaggttcatcatttgggggatcagtgtaccccatgggagattcgttggtaccggccactagtttaatctcatccagtgcgtcagttatatgtttcatagcaaggtggaaagcatcaaccgatatgtcaccttgtttggacaagtctatacatgcatggtagagcagtgtgtggcggtgtgtcctggaagaggcagcatctttgtcattcctgaagctctcaaggttgctgccagatccttctctggcactaatactccatcttcttagaatgtacttatctgggatgcttctgcagcctatgtgtgtcattacctacatgaacaatgaaaaacggaaatgataaactaaactgcttatacatcaaaactaattttttttagggtaactatggttttctacagatgtatacactggattaaagctgacagaatatgaatcgaatcaagaattaacttatcaacatatacgcttacccaaatttatggtagatgggtaaaacaatttaagaagaaagaggcatgctctagaggtaaaaaaatgtaagtacaaggaccaaaataaagctggcgtaccttgataacgtggcaacacagtatgcccatgtgctcaaacaacttgcaaacacatttgtaatcttcttcatctttgtctacctgaactttgaatgacaacttactccatgattctctcgcctcactgtcagcatgcacaaccagccatggaaaaaaaaaggaacaataagggtacttactatgtgaaacatgaaaatcaggcagcaaacatatacgtgtaggaaaataacctgtgttatttgatggtgagtagtcaatatttagatcaaatgatggaggatcgaagtccagaccagtataagtcctgtgtggaacagtgcgattcaagtcgattgattcttctttcaagttgtgagtatgaaccatcggtgtacaattggcagcagctgcactcacatcttctacatcatttcctaaagatggtgtttggttgacctctattccattctcagcatcatcgttgacagttgtgcatgtataacctttagaaacatcaacttcatcgctgattggtatggtcacgctgggcatgttcttcgaagcttctgtcaccttaactagactctctgttgccttatcaaggttgccaatgcaggaaatccaaaaacttttcaattcttgggccttctgtattaattcagcagcatgctgtgttgcatgttgatattaaaagtttatatctctagatatttactaaataaacatgtttggtagaaatttttttaataacttacctgagactcaatctgaacattttcatttcccccgctgtcagtgacagatgttctttcgcacgttcttttgtagcagac

SEQ ID NO: 37273 - DNA, 736 bp, Oryza sativa
gtctgtatctatctcctcgaaaaaaaaacaagtgaataatgttaagagcaggagtgacaaatccagaactggagctgaacgtgaaccaaaaatatattaaaataaattacctgtgaatcattgggcttcgtttcatcgtctattaacatctgcgccttttggagatatgcattctcctcttgaagaccatactcattgactagggccgtccaagtatcttcaaaatcacttgctgtgcgtgcatgatataagttgtgtagttctgacttcgtaccaaataatatgtgccaacggcagcgtgggtgatcatacttctgcagcgactgatcgatcttatcgctccaggcaccagtgttcatcttgtccatagctactggcaatataagtataaatttcagaatactaagaagaggtcaacatatatgagaagtacatatacgtacagataagttggagccatacctggaacagaaatgtgttgttggcgagaaccagagagagcaccagaagtgagcagagtcgtattgttctgctctttatatgttgcaattgtgtctccgttggaaggaatgaaaaaattaatatcattaccaagtataaagatcttatttatggtaatatttatagctattacgaccgataggttacataatataatttgttaccgtcaacatggatcgatccagtcagaattgggtatcaattgattaatttagtaaccaacgagtgatttcgg

SEQ ID NO: 37274 - DNA, 500 bp, Oryza sativa
  unsure (1)..(500): unsure at all n locations
nnnnnnnnnnnnnnnnnnnnnnnnnnnnnnnnnnnnnnnnnnnnnnnnnnnnnnnatgctctagaggtaaaaaaatgtaagtacagggaccaaaataaagctggcgtaccttgataacgtggcaacacagtatgcccatgtgctcaaacaacttgcaaacacatttgtaatcttttcatctttgtctacctgaactttgaatgacaacttactccatgattctctcgcctcactgtcagcatgcacaaccagccatggaaaaaaaaaggaccaataactcagcgtgttggagctcctatgggcgggatccctgaattcagttccatcgccaaaagtgatcgtatttgctctcattgcaagaaggttggacatatttccgatgattgcttctatcttcatccagagaagttggctgattatcgagctaggagtgcagcggtcccccgtcctcgtgcgacggctagtgctcctgttttcttggatatcactgctgctggtcc

SEQ ID NO: 37275 - DNA, 746 bp, Oryza sativa
  unsure (1)..(746): unsure at all n locations
nnnnnnnnnnnnnnnnnnnnnnnnnnnnnnnnnnnnnnnntcctacagataacttgttcacggttaggtttagtacgttgagccctttcagattggtcaaagattgaggcatgtctcctccgaatgagttattatctagcaagaggaattccaacacttcacaatttcctatactgtttggtatttggccagaaagctggtttcctgacagaattaactggtttaggttagctaaagtaccaacttctgatggaaggtgtccagagagggagttgtatgacaggtccaagatccaagctagagaaggcagctctagaatttccctgggaattgaaccgtttaggcgattgaatgacaaatccagattaaacagattttttagcctcccaatggttgctggaattggcccttccaaattggtgtggaatgcaagcagcctattcagtttggtaagatttccaatggttgacggtatgaggcctgacagaccagtgttgtatagggcaaggtcaaccaagtttgttagcttcccaatactttctggaattactccagatatgggattgaaccccaggtcgagtaatctcaagccaatcaaattgctaatgtcgtgagggatggtcccagagaagctgttattctctaaatcgagcatctgtaacgtcattgacagattcacaatcgatcttggcagctgcccacccaaagaagttgtgagagagcatcaatttttgcagttggctgca

SEQ ID NO: 37276 - DNA, 620 bp, Oryza sativa
  unsure (1)..(620): unsure at all n locations
nnnnnnnnnnnnnnnnnnnnnnnnnnnnnnnnnnnnnnnnnnnnnnnnnnnnnnnnnatgggtcctattcctcagccacatattggttaccttatgccattgataacttgggtatcaaaatgactagatgttggcttaggaaatgcttagccatgcttagttcaactaggacacaaatggggatcacattattacatagactctgactattggcataactttagattggtgccaccgcaagggtgtcagttaattaaaatattctgaatggcgggctgtgagtgtatggttttgctggtcgcacccatggcagttaaggaccggttcacgggaaaccctgggagacttaccgtgcttaccacaagcgggagtaggtaactgcttgatctgaagtatagctcgaccctttcctaggcaccggtggcgagggtaggcgtgatggagttgggtcggccgaggtgttcggttgtccagctgccggattcaccgcggcgcaagaggggaccgcccactgccttttgaggggtgggggtgaaatcttagcgtggtgtggatggttaggggagggttatgtggagggtcttgtcacgatttccccctttgcagtatcatggtgatac

SEQ ID NO: 37277 - DNA, 424 bp, Oryza sativa
  unsure (1)..(424): unsure at all n locations
nnnnnnnnnnnnnnnnnnnnnnnnnnnnnnnnnnnnnnnntttaggacaattttatggattctgtggctctagaacaactcagtttccctcaactaacatgaaggtagatgtggctaattctcaagtcaacccttttttttttcacacatatcaatttgtcatttaatttttacattctgacagtttgaaatatgaattcatgcccttcctcaggacccttgccacaatggtagtcatcttgcaagcacttattctgcccttgctatcctgaagattgtaggttatgatttagcaaacattgataacaaggttcttttgtcctcaatgagaaacctccaacagccagatggaaggtatgcattttagttttggtctccatgctaattattcttgtaattatcctccaaaaatatctatgcattt

SEQ ID NO: 37278 - DNA, 866 bp, Oryza sativa
catctgttgtttctcattgtgccttttcttttctcattttcattttcaccggtgtaaatgtaagccatattatactcataactaggtggcaggaaaagttcgttaacaagcttgattcaaaggtcatgttctttctttttgacggaagaaggtagagctggctctactttatagccatttcatctatagaaatgaggtggtacaaagttaaaaaagaaaaagaacaaatagaaaggaggagaaaataaattacaaaaattacaagtggcatttacatattaaggatctaattgtaggagttgacaccaagactcaatcttagacttggtaattcctttagctcgatgagtccatagttcgagggagctctgtatttgctgcagcaagaggtgtagcgaagtgtgaagcttgtcgaaaaccctgctgttgcgtgctttccataaggtgtatgcacaaaccgcgaaccagactggtccaataccgtgagttgacaagtttacctggtttgccttgattatttctttccataaggtgtatataaggtcatgttcttttaatcagtcctcggaaaagaagttcctttactatattctcaagaacagataaaaacatgtatagatatgttcgaaaaggaaaaagtataaagaagcagctcaatagcatgtatgaatcgaggtccagttaacatcaacaaccatcgtaagtggtaacatacatagacatgtactacttctgaagaacagttcacattaacaactccccaacatcgaactgctaatactgtttatctaattcatgtgttaagtgttaaaaaatggcttcaacttagaccttgtctggtaggactgccaaacttcaactctcaa

SEQ ID NO: 37279 - DNA, 765 bp, Oryza sativa
  unsure (1)..(765): unsure at all n locations
nnnnnnnnnnnnnnnnnnnnnnnnnnnnnnnnnnnnnnnnnnnnnnnnnnnnnnnnnnnnnncgcctccattcctgtttctctgtatggagttgcaacggtgtcatttttattttattttttcggatgttttttcacacttaggatcacgatacaaccaaccacaaaaaaaatttaaactcgaactaccacttaactaagtctgaaaatagctagcataccacttagtctactttgcaccttcactaaaattagaccataattcctttagtaaaaccctttgatcagcatgttaaacataatacactctaccactatatgaaattacttaatctaattcaaaatataaccacatgaaatgacatatataagttaaacagtacataaagatgcaattttttttatttttatttcatttttttgatatttttttcacacttaggagaacataggaaccaaccgtataaaaaataaactcaaacggacaaaatatgtgacttgtagaattttccaaaactctatcgaaacggacaaaatatgtcatctattaaaataggcgtaactttctcatacgaactcggaatcaggcaaataatatatgcagggacatctacagaaaatattacatccgattctccccgctttgccgggttcggcgatattaaaacctccaaattccgcttgtaagattgtgttttcgaggagaagtttttnnnnnnnnnnnnnnnnnnnnnnnnnnnnnnnnnnnnnnnnnnnnnnnnnnnnn

SEQ ID NO: 37280 - DNA, 62 bp, Oryza sativa
caaatttactatatatatatatatatatatatatatatatatatatatatatatatatatat

SEQ ID NO: 37281 - DNA, 681 bp, Oryza sativa
  unsure (1)..(681): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcgccgggattgctcgccatgccgtgaagagggccgacgtccgtggttttcgtcaccgacgacgttcgtccacaagcctcttgctggaaaccagaactcctcaaccatttttgtcaagccattacagcgcctgatgtccaagtgccttttcgctgccgtcgctggttgttcgtgagcttcggaacagacattattcaccagcgagctgcattacctgaaaggtatggatctcagtgtttatcactcacacatcttacattcacatgcagtccctgttatgtatagatgatttgccattcctcttctttttatctactaaactgagcacatgatgaatcacctggaacctaaatttatagatgggtaccgagctcgaattcgccctatagt

SEQ ID NO: 37282 - DNA, 741 bp, Oryza sativa
  unsure (1)..(741): unsure at all n locations
nnnnnnnnnnnnnnnnnnnnnnnnnnnnnnnnnnnnnnnnnnnnnnnnnnnnnnnnnnnnnaagaatatatgcctagttgtgagacttgtgattgaacaatcaatttagactaaacgaacgatcatgctattgtgatcaggaagatatccaaatctgttaaagaaaacaagagatttacgcaaatctcagtcatgactagcacgatctagatacgcaaaaccccaaatttcgacaaaaccgaaagcaatcggtgatcaaacggtgtgtttttgcacactgaattttacttttgggggtccatggaccgggtccatacaatcaagagggccggatacgtcgcataactccggtgggtccaacggcccagcggcccgtgggccccacaccttcttgcccccgcgggatcaaatacacctcctccggccactccccgatccccacctcgtctccaccgcacgagcagcagcagcagcagcggcggccgcagcgcgagctctctctctctctctcgcggtgggcggcgggatgaaggtgtccgtcgtgtcccggagcggccgggaggtggtcaggggcggcgtcgagctcaaggactcggtatgtcgtctccattcgttccgttttttttttttgagctcgtcaggttcttgattgagaaatttggtgcggattatgggttttggtgttgcagccttgtaggggggagggtttggagttctggttcttgggtggggggggggggt

SEQ ID NO: 37283 - DNA, 629 bp, Oryza sativa
atgaaactaccgaagcacatgcagcttgaaataatggaattcaagtcaatcttgccactcactgaccttggccatgaaagactgtcaattttgctgtcagtgtaaaccttcactgaacatttgtccaactggagaacattatacaaatagatagttctataagataccacagcttttagagttctatgattcacctccaaataatgagtaggtagttctatcctttcgattcatatcttcctacttaacggggatccatagcaataggtccaatttctatataaagaagacttgtaaacaaaaggacttattgctctttttcggttttccgcttcacctattgttcttatcaattcattttcctccttccttctttcaataagaactatttgaaatgaaacaaattcctattcattctgttacagaaacagggaattataaccagcttcaactgtctacatacttcaataaagatcaacctaattcaattgctttgtcactcttatgtgacgatgatattgatcagagccattaatatttaagatcaagaactccaagattctaatatgcataacaagcatggcgtctaagtgtcacaaaatacaacatcactcaatcacaccattgta

SEQ ID NO: 37284 - DNA, 803 bp, Oryza sativa
  unsure (1)..(803): unsure at all n locations
nnnnnnnnnnnnnnnnnnnnnnnnnnnnnnnnnnnnnnnnnnnnnnnnnnnnnnnnnnnnnnatgaattcatatttcaaactgtcagaatgtaaaaattaaatgacaaattgatatgtgtgaaaaaaaaaagggttgacttgagaattagccacatctaccttcatgttagttgagggaaactgagttgttctagagccacagaatccataaaattgtcctaaaaacatataaattgtcatataatgaatatattgcatctgaaaaatatgaattagctatcttgagagctttattacataagtactgaggaaaactcaccattatctaattcattgtctgtcttaggatgtacttgaaaagacaaaatccatttggctatttgatccttgttaacctaaagaaagtataaaagggcaaacaagtacacaactcatcaaattactactcagtcaactcagtatattacttcttcctgaagagtcaactcagtcaaggcacaaagtgaacttaaattcccacaataaatatttcagctagcaaccaggcatggttacttgttttaatacataatacatacaggtacaattttcatgataagactggtaaaaaaatatttgcatgaggctataagtttttttagaagttactagtaatttgagaatggagatatcaggaggctatcatgtttttgttgtttacatgagcaaggcatcaagtatgatgaacttaaatcataaccaactaggcggctcctaactgtgcagagcattaaggcaactgcccatggacaagacaaagacg

SEQ ID NO: 37285 - DNA, 2914 bp, Oryza sativa
ggtcataatgcagttatgctaggctgcttcttgcttatgctagtactccctccgtctctaaatgtttgacgccattgacttttttaaacatgtttgatcgttcgtcttatttaaaaaatttaagtaattattaattcttttcctatcatttgatttattgttgaatatacttttatgtatacatatagttttacatatttcgcaaaagtttttgaataagacgaatgatcaaatatatttaaaaaagtcaatagtgtcaaacatttaagtacggagggagtataatctataatttgtgcatatatgctggaagaaaagtagtgcaagcaaagcgaagatagctagctgcatgctgcagggagcagaagaccagggagttaaggaaacgcgtttcgtgtggagccaatcgccggccgcttgcttaattacaacttgacccactattgatgaacagcactggctaggatattcacacaatgatgcatgataggatcagtacaagcaagcaacagcatgatatggtacagcaatttccaacgaatttcgatccactcgatctctcaacgcgtatatatatcggccgaccggcgtcacatcgatctatcgtccaaatccaaccgtgtcgcacttaatttcctatatccgcctacgttaatccgcaatataaaataatgattaaacatgttttaggctcatttggaagaaaagaactgtttagtttttcctgaagcatttgaatcctggaaataaaattcatatgaagttatctggaataaagagcatgtccttaaaagttttctatgaacatcctaaggaataaagcattccattacaattttagactaaaacaaacatgagaaagtccaactcatggttttctcttcctgtacatgtctacaatttctttttttttttgcgtgtgtaatccaaacgactgttttgaaatactcttgtgcagttgtgcttctaatttatgtaggaatttataaggcatgtgacccgtgttctttatatttttgtgctttcaaattcgtgtgtttcaaaggactcttagtctcttgggtgcgtttgagacgaggggaaatgaattgtttacagcaacttttttagagattatttttaccaaaagcgtacttcctccgggttgataatacttgtcgtttcgataagggcacggtttccaaaaaaaactactttaaccattattttttattataatatgtacaaaagtgttaataaatatatgattttattaaagtaccttttaagactaatctatacatatagtaaccatattgaaagacaaatattttaaaaataatttataatcaaatattctaaagtttgacttcactcttatctaaaacgataagtattatcagcccagagggaatatcatttaacagcttgaaacgaacatagccacgtcgacgtgtttcaaattcctatgcttgaaagcactttcctgtaaaaccttttttttaataaaaaatacgttgtttagaaatttgaaaagcgtacgcgcgaaaaataagaggtacaagttataaaaagggataaaagaacacacatttaggctctgttcgtaattcccaactccttccgcctcgtttttcatgcgcacgcttcccaaactgctgaacagtgtgttttcttaaaaacaattatatatggaagttgcttaaaaaatcatattgatctatttttaaaaaaaaatagctaatacctaattagttatgtgctaatggaccactccatttttcgtatgcaggagatttaagttttaattagtgttcccaacccattccagctaacacagcctaatgtctctaagagtccatgtcgacattctaaatgttgaataggccgaaagaaaggggtcgagggaggaaacaattaagaacagaagaattataataatttttaggacatgatatgatggagcttgtagttaaatttaactcatttctagaacagctctcctttctgttaagacaactaatgttatcttgaccaaaactatcctggatgccacaatgtctgaacttttgcagaaaaaaaatgataggtaatcacacggaatcagccattggaacgttcttgccacgcgtttttttattttttttaaattttttttgccaacaacgacgcactatatatataaacccaagcaaccagcccaagctccaaatcaatcaaatcgcattccaccaattctccactctccatcctcctctaaaatccatttcaaattcgcgaatctgattctcttcttaatcgaatcgcgaatttcgttagctgaatcaaatcacagcattcgctagctgcacaattcttcttatcggaatccaaaaatgcaaccggcgatctcccaattccccgccgccgccgttcgcctggctggaccggcgctcccataccggcgaccaccacagaagacgacgacgtcagtgacattgaggaagccggcggcggtgaggtcgcggcggcgcgacgacgcggatcagttcttctcgggcggcggcggcggcggggtggtggacgaggggatgatcgagctgcggcggaggatccacgagatgagggcggcggagagcgggtgggagccgccggcggagtgggcggcgtgggagaaggagtggtacgggagctacgacgccgacgtgtgcgcgctggtgggcgccgtgcaggccttcctcatgagctcccgccccggcgtcggcgtcgggatcgtggcagcggtggcggtgagcgttccgaccaccgccttcgtcctcgtctccggcctcctccatgcctcccagtctctcctctccaacctccaacactagaagcttagcttccaagctaaccatggatgatcacacttgtgttctttctagtttatactaatttaattttatctaaaaaaact

SEQ ID NO: 37286 - DNA, 197 bp, Oryza sativa
gcaagcacattgagcagattcgttttaccggaccctgatggccccatgagcgcaagcagcctccccgatttcgcctccccagacgcatttgacagcaaaaacctcgcctggcatgcaacacgttataaccattacaacaatcacccagagacgcgcagaagcaagaaattccgattattgatggcactcaatgtaca

SEQ ID NO: 37287 - DNA, 25010 bp, Oryza sativa
  unsure (1)..(25010): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcatataagacaggtgaacaagggcaggcgatgatggaaagaaacaaagaaaatgccgccaagaagaagtaccatcaccacttggggtcaggaggctatagcgtcgcgatgccgaagtgggagcagatggaggctagcttgattgagaggggtatcgaaccggcaacagccaattggccggaacgattgaagttctggtactatgctcacggtggaacgctcaacccagctgatggctcactggtcttcggcgatcagatacgagaggctgcgcgacgactaacagatgcagtggaagcctcctctcagggcacgttccgaccagacagagatagggacgagctgacactcgccctgcagactccagagcatccaggacgaacacgagggaaaggggtgattccttggaagattggtttcaaggaggacatccacacgtacaggagtcggatgaggagcaagagagataccgaggcaaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcatagagcatggacgccatgcaaacacaggacgaatcgacctgtcccgttgatgacatcactcagcggacaccatgtgagctgcatattcctttcaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactcgaaggtcgaagttgagttggtggaaggcgcgtacgaggacctcgagctggattaccctggaggagacggtgagacgcatctacgagacacatgccatgccattattctatggcgcaggcggtacatcatcctccctgggcgacaagcggcgtctcgtgcaccatctcctccggctccgccatctcctcctcaggatcctgcaccgtctcctcctcatgctccgccagcaccgtctccacctcaggctccagcatcgactcctcctcaggatcctgcaccgactcctcctcgtgctcctacacctactcccccgcaagctcctcttccggcaccttcaaagtcaagggcccccccagctccaccgcctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcgaaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagaccatagaaaataatatactcccttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcatcgacctggaggcctgcaccgtcaacgtatatgactcaatggataaaaaagagtctacgtttgacaaggttttcgaacttatagacaggtaccgtcataagttcctttgttaattaaaaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatgaccacaagagagctcgatgtacgtacaaataaattcaaaatttcattacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttaacttctgagctagcagcgagtactactacgtcgaaatcgtagctagctaggacatataatggattgtaattaatacatgactacatatgtttctatatgcatgtgtacacattttctataatgtaaatatattttggtcatatatatatctatatacatatgcatttgcataacatatatatgtataaatacatatatattatgcatgtatatacatataatataatataatatatatatacatatatatatgtatgcatatatatgtattgaaacatatatatgcatggtttatatatatatatatatatatatatatatatatatatataaaccatgcaacaacagggccatgcataaaaaaataaggtcagctcgatctttagtcccggatggtgtaaccaaccgggactaaagatcgatctttactcccgattattttacccgggactaaagatagcgatctttagtcccggattggtactcccggtttggaaaccgggactaaaggggggttacgaaccgggactaccgagggtttctccaccagtgcgtatgtgttgcgaccgaagaatcttatgacggtagtgcagattaacaaagacacgggctagctcctctgtttattgttttggccgtcattactggccgtatgatggcaacacgaccgaaattgccgacacttttttaatggcaacttgctgtgagaggacttttaatttgcatattcactctgtccattaaaaaaaacaaatctaatggttttcttttcttaatggaactatgcccattttttgtgattattaggaatttctattacttactttattcttctatgtgattaaattgtacatgttgctatctcaacacatacgacaagtagtcgcttgtatatattgttagggagaaaaccgtttagcatgaaaaaaaaaaagatgatgtggataccttctttgtccggcgccccaaaatattgtagcctctttactactttactagtggtggtccttactagacaacaaactcaaactcatatcatttttatacaattcgaacctctaaaaatatattcatgggtaaagctttggaagttggacatacgacatgcaaaccgaatgttttttgcgatcccaaaataggagcatctatcacgctttaaactgagaaaactcaaacaaaactaagaatcttgcatacttcaattcacgaaaagttaagacatccaaaattaattaacttcattttttttattttgtgaccaggaagactgctgtggttaatttgagataacgcgcacatgatgcactacatggaggttcaggcacactacttaaatgcacgaaaagttaacttttggaggaaactgcaactgcaagttggcaagttattgggacccctgttggctaggaatttctgtcaacttattcttttccgtgatgaaattgggttgtaatctctcaacgcaacacgacaactggtcctgtatgcttagaaaaggatcggtttagcaggcttcactgatgtggacaacgcctttaattagtttgtccttacacattaggttaattggcaccccaaattttgtagccttgagtggtacacgtccttattatatatccaagttttcagctagctagctctactcataatgatctagtataatgcatgaggtcatgacatactccttccgtaaaaaaaaaagttctagtattcacaaaaatcaaaaaatataattctttttagataatttttaaaattgtacttttttaagaacaaagggaatgctagttaatactatcatgcttaattaatctgcttgcttatggatgtagaggatcccagcatgtaatgaactaatgatatgatgctgatatataactccaaatctatcattttaattgggtagcagagtactgtatttgcctaaatgttatactaatatgcggacagtgatgacgtgttcagcccagcaatttaacattttagcccttttacaaacattattctccaaataaatccccatacaattataactaaaaatagagctcaacattagcgtcaggtccatggcgacgaagtctaacatctcagcaccaaggggcaatacaatagtaagcaccagtatattttgtacttttctatataggacagctaatataattagaacgctttctacagagttcgatcagctaatatcaccagaacacttcaattagaaaagagaatgaaaaacagaggcatgggaagtcgatcatgccagggagagattgcataagaaagccactaagctactccctccattttagtaggttataagaagatttaattttggtcaaagtcaaactactctaagtttgactaattttataaaaaaaaaatagtaatatttttaaccaagacaaatatattatgaaaatttactcaattataaatttaataaaactatgctggtgttgtaaatattactatatttttctacagaattagtcaaacttagaataccaaagtcaaaacgtcttataacctgaaacggaggaagtacttaacatcgtatagtaaaaaaatagcacattcatatttatcaagtactataaagctgagcttcacatagctaagtggcaagactgatgacgctgagatgttgggcttccgcgtcataggtgtgactgctgaggtttagctttagtatttatgaggatctatttatagattaaattttatgaagggactaaaatgtaaaaattgttgatgttcagtcagagatgatatgttctacggagtatctacgacctggcaaccaccattggtgatgctagctaggcgacaaagcagcactttcccgggagagactgggaatctaggctatctgtactgtagctcccggccacttgctacctgccttcttgcaccttttctagcccttctgtccttttttttttgcttgtcagaattcagaaagaaagatgcactataatctatgcatatccaagtcaatcattcattgtaaaagtgtgtgtggttctatttgtaactaatcgttgcaatttcttatacaatctttagccctttcaaagaaaataaaatagaagtctgtttagagaagccttaaattctaaaaatcaactagcgagaattcggatatcctgagaaaaccaatttaagtttggcttgtagtttattttctaaattctgtaaccgagcatttttatattttaataaggcagctatcaattggttacttctcaaaacagagggctatattaattgctagccctcaattttgttgacacaaaatcgggctggcatttgctgagttcctataaatacaggcgtacgtggttgcgcagtttactgcaccagcttaagcttattagctcctgagagtgaagcccctatagctgatcgaagctatgaagaagatgtggcgcgccaacgcgagagtggtggaaaggagaggtggtcgcgaggccgaggagagagggggagtaattagcgtggtgcttgcccatggctatggcgcgagccaggcggtgtgggacaagctcgtgccctccctctccaagagccacaacctcctcctcttcgactgggacttcaccggcgcaggcgccgggaaggacgacgacgagtacacttacggcaggttcgccgacgagctcatcgcggtgatggaggagcggggcgtgggcgcgtcgggcgcggtggtggtggcgcactccatgtccgccatggccgcctgcatcgccgcccaacggagacccgacctcttcgcccacatcttcctcgtctgcgcctccccgaggttaattaattatcgatcactagatttcattcatttttgctgttccttaattaattaagcccctcaagatcaaggatgacatatatagcctaattaccgttattattattacagctatttaatttaattagttatttttaagcacaattatattagttagtcgttgtgcaacacgtgtttggttcatccagataccactcccagtagatagcagctatgctagcttttgagttttatcattgtcaactttgtgtgttaattgtcagcgtgtgtacgtccacgtcagcacactaatcgcgaccatgcagcagcagtcacgttcactgttgctcacgactcacccaacatctagaaacatcatcaattgcatagcttcattcacaggaagaaaacaaacgcctccttttcgattctttttccctagatagcgcttgtcaaatctgaccaatgaacagcaattaagatttggccggatcgaaccgggacgtcacaacaaacacttgctgctagctactctagattagatcaaagctagctctagtccggatgagatgaagcaggatcgatcaatcgtggcctcatgttagttagtccataacctgtacgtgtggctaaaaaataggaacacaagaaattatccatgtatcaatcagtcaagatgtttcagatccttgcaactaactaattaatattctattgccaaaacatgcatgatcaagcatctaattgattacttagcatttctacgatcgattgcatgcaagtacctgttgaaaattcaattgggcatgcagctgccagataggagtaagctactctgacagtacaagaaactgatgaacaaaattaaaactgaactagagaacgtatagctgatgaaaacgggtggtggatcgatcgatcaggtacataaacttggaggaggaagggtatgtaggaggctttgaggaggcggcgatccacggcatgctggcagccatggagtcggacttcgacggctgggtcaggagcttcctccccaacgccgccggctacgcgtccgccgtggagcacctcctcaagagcttcctcgccatggacccgaccgtcgcgctcaagctggccaagatgatcttcctcggcgaccagcgggaggtcctcgacggcgtgaagacgccgtgcaccatcgtccaggtgaaggccgacttcgcggcgccgcccagcgtggcggagtacatgcacctcaggatgaagggcgccgccacggccgtcgagatcatcggctccgtcgggcacttcccccagctcgtcgcgccgcagcagctgctggacatactcgccggcgtcctgcgcctccgggaggcggcggcggaggcggagcacgacgacgccggcaccgtggagattgccggtggcatcgatgttgccatataggttgtgcatcatgcatgcatgcttgtaaaaagtctgcacatatatgcgtcagagctagctgcatgtgtgctcccttgtatgtatgtttgtttgttttgttttcagagcatgcattagttgtactattatgttttcctgtgtaaacatatcatagaggttatgttacttgtacacctgcatgcatggtttgggtatgctgatggatgtaagtaccattttcaatgggacatataccttattaaaaatgtgtttaatttcctggggctgtacattaatttcttagccggctggctgaaatttttcctgaaatttaaaggacataattgatcgaagattcgtcagcgagcagcctccagccacagctacaccgccacccctcgtcccctcccccattagccaccacacgcaccgtatgtgtcccctccaccctgcctgcatattaccctcctatcttctctgattttacatcgtctcgaaccttatctacgtactgtgtaattgcaatctcttcctccttacacttttaaggtgtccttgagagaggccaggcccttagccacccgtcactggctttacccttgtaagagacaatattattacataatggtggtatacatacagggaagagcttttttattgtccttgagcctgtgcagtatcgaatcctcgccgtccgtctagcccaatccaatagctgagcctctgtaccgcgtggtactgcagaatggattgatgcggtaccatgtatgggagggtatttttgtcttttcgcatactctttcttctcctctcccctagcggtcacacctgggcggcggcatcggcatcggccgctcaccactagcgtcgtcgtggcgcgtcggctagccaccagcgcgccccgtgcagctgctagcaccacgggagccaccgccacataggccccagctgctggtcgcaaagacaaccaggaactcctcgtcaggcaggcggcgtcatcttcgtcttcgttgaggccacagcaaacatcgaacaacgagcgaggtcgcgatggaaggttttttatggacagcaactggagaggacggacagcaacacacgtgcttccaaaagcaacacatgtgaacagcaaactcgatgcgacggcgggcgcggcggcggcggcctcgatgcgacggcagccacgacagccttgatgcaacgacggtaatttctttagcccgatcatacccatttctaaaccaacggttagattatattgctacctcatggtaccttttcaaagatagtaaagatgctctatagggaaaatgttttgtactgttaatggagtgtgctgtttcttgtagatgatcaaaatagttacgagaaaatctgaaaaaaaaaacatgacaagatagattatactcggtatcatatacatattatgaccagggttggaaattccggaacaaaatttctaaaatttcggtcatttcagacccctccgatacgatattatttcagcctaaatttttaaatttttttgtgaattttggtaatatccgaaatttcagaaatttcggcatttcggtgaggaccaatcaaattagctaaaccgaaaagtttaaccctaattatgacagcacaaacaccgagatcatattctatctacacatggagagaaaataagaaaagcaaaacagatagcgaaatgcgcggtcacgcgacatgtattgatttttgttatttttgtttctttgcagttacatgtaagtttgaccatgcgtaaattaagcgagaattcagagttatattaagtttgatcatgatgtttgtggaaaataggtgatgcatgtagtcaaattttccacataattaaaccacatgaaagaaaaaaaagggtacacgccctcaaggcctttaaatccactgctgattacatgtacactcaattgtcagctgcacaaaaagtttataactcaagtacactagtacaaccttttcctctgtcccttttaattagtttagcttggccctttttattgacgttatttatctatgatatgagtagagggaggcaaccagttaatcttgtatacttacattacttttttttttcttggataattcacccagacggcgatccatggattgagagacagactgcaggaaggcagcttcatcaccaacatcgtcttcaacctcacggatgatctcctcgatgacagactccttggtgagcgtctccctgcacaagatgctccccatgtcgaacgcggcgaggcccgagtcgacgcccttcttgagcagcatggtggtgacgcgcaggacgcgctcgcacttggctggcatctcccacccatggaacctcagaatggcgatgtcctcctccgcgtccagtgaccttatgtactccaccgtctcctcgctgaatggctcccgacactgcggccagtagagccactcgaatgtgcaatcctcaaactgatcgatgtgcatgcatcatcacaaaatggaatcaggatcattagctaaatcattggccggcgtgttttgtcagtgcttacactctcaggaagacagtatccatggtcgatcggaaccagggtgaggccatggccttgttcgtctctgcaggtgaggatgttgccggcgtgcctgtcggcgttggccagcctgatgtccagcacgcagatcttgtgaacttcgtgcaccgggaacgcacgaggtcccatgtcctcgcagctgccgctgttcttcacgaacgcttgcaatgaccccaccttgaacaatggaggaccttgttcggaagctgcaggttgcttgaagctcctgtgcatgcaacggaccagcgcggttggcgcgacaccggcgaagcccacggtggcggagccatgatgtcctgcgaacgaacggcggccaccgggagggtggtcgaggatgtaagcggcgacctctctgatggcgccctcgccgacgcgtgtccccttcttgagcccctcgccggtgggcgagggtgggaggccgcgtgggttgttggccgccatgggctcctcgtccaccggcttgaacacggcgacgtgctcctgccccgacgcgttctgcatgaaatacgcccccccggtgccctccgacgacatgatcggggcgttccccttctccatcccggccagcacggcgcccaccaggttctcgatcactggcggaagcgcggccttggggttgacgatgaccggctcgatggcgaagtccctctgcaggtgcaacgtcggttgagcagcgtcggcggcggcgttgcggttgcgcgcgacgatggagacctcgaagtcccggtcgacgggcctggcggcgagcttggcggagcggtggacgagcaggtggatgacggcgccgtcggtcctgcagacgtcgtggatgaggtgggcgtcgtcgagcacctcgccctggaggacgaggctgtggtggtcgtcgtcgtgggtggagttcttggcgatctgctgcttgacgtagccgacggtgcggccgggctcgacgcggaacctgaacttgttgccgtggacggtctggacggtgatgaggcggaggtcggagatgcggatgacgaggtggaggacgttgccgtgggagacgccgtagtccatgatgcggctgtcgttccgggcgagctcccggccatcgaagacgagcttctgcttgcggacgacgaagcccttggaggtctggacgcggagcttgacggaggcgatggagtcggaggccatcacccgcatgggcatcatggagagccccggcgcggtgaggtagatgaggatagattccgcggcgcaatgcggcggccggatgccgttcacattcaggcgggtggccaggagctcctgctcctccctcgccgcgcacagggtggctccgccggcggccgtcgtcgtcatggccggccaatcaacctccgatcgatcgatgtgtgttggatggcgcgtccgtctggatgagaaacagctaatggctaatgggatgaagtgatcagtgacagactaattaacatgcatgcatggggcctggcctccgatcctgttcttggctcaggcaaccgcgcgagggggagacggcggcgccggagcgcaagaaggatcgctttgtttcctttcgtttcgtttcgttttgggaattgcgaggcacctctcttgttcatctgctctgctggggacgaccagtgccaaaattaggtgcctctggcggtttgtcgcgctcgccatggctgccatttggtaccaatttgagatgctttcgccggaattgccggggaagatggagtcctcgccgatccacccgcgccgcggaacatggactgctgcgattggttgccgtcccccagttttgcgctgcgctggacggacgacattgtgggccttctgtcgtcgggaccacatgcatttgggcccaaaatgatgccatgggccaattagctaacttttcggctggtaggcccaacgggagattgccatcatggtgtgtgtcctgaaacaacggacacgcacgcacacggcacatctcgctctcccgattcccgaatgcccagattccttgtagactgtaaactgctgctggtaattaaccgagtgtgtgtacttgtgcaagatccaggcagcaagtgatgattttcccagtgcatccttggtcgaattgaagtcgctgcagtgaagtgcggatcgatctatcgatccagtagaggacgtggcagccgccgctgttggctttcacttcaattcaattcactttgatcgatcagccaccgcgaagaagaagaagaagaagaagaagaaacaacatttaattccccagctagcaaccgccggccacctctctctcccaattatcctctcctcctctgcttcatctccaccacctccgatcgagatcgagatgctcccctcaacggcaatggcgttccatgtcttcctcatcgctgcgctgctgttgctgcctctccccgccgccttctccaaggccgtgcgcacccaatcccttctcgccaacccgctctccccggatcctatcactcaggagcagcagctcagcctcgccgcgccccgcaccaacgcctccacgctccacttccgcctcgcccaccgcgagcacttcgcgctcaacgccaccgcctccgatctgctcgcgcacctcctcgcccgggacgccgcgcgcgccgccgccctgcttgctgcacccaacaatgccacgcgcccgcgccgccgcggcggcttcgcggcgcccctgctgtccggcctcccgcaggggagcggggagtacttcgcccaggtcggggtcggcacgcccgccaccaccgcgctcatggtgctcgacaccggcagcgacgtcgtctggctccagtgcgcgccctgccgccactgctacgcgcagtccggcagggtcttcgacccgcgccgctcccgctcctacgccgcggtggactgcgtcgcgcccatctgccgccgcctcgattccgccggctgcgacaggcgccgcaactcctgcctctaccaggtagcctacggcgacggctctgtcaccgccggggacttcgcctccgagacgctcaccttcgcgcggggcgcccgcgtgcagcgggtggccatcgggtgcgaccacgacaacgaggggctcttcatcgccgcgtcgggactcctcggcctcggccgtggcaggctgtcgttcccctcccagatcgcccgcagcttcggccggagcttctcctactgcctcgtggaccggacctcgtcggtgaggccctcctccacccgctcctccaccgtaacgttcggcgccggcgcggtggcggcagcggcgggcgcgtccttcacgccgatggggaggaaccccaggatggcgacgttctactacgtgcacctcctgggcttcagcgtgggcggcgcgcgcgtgaagggcgtgtcccagtccgacctccggctgaacccgaccaccgggcgcggcggcgtcatcctggactccggcacgtcggtgacacggcttgccaggcccgtgtacgaggccgtgcgcgacgcgttccgcgcggcggcggtggggctccgtgtgtcgccgggcgggttctcgctgttcgacacgtgctacaacctgagcgggcggagggtggtgaaggtgccgacggtgtcgatgcacctggcgggcggcgcgtcggtggcgctgccgccggagaactacctgatcccggtggacacgagcgggacgttctgcttcgcgatggcgggaacggacggcggcgtctccatcatcggcaacatacagcagcaggggttccgggtggtgttcgacggcgacgcccagcgcgtaggcttcgtgccaaagagctgttaattacagtactccactacggagtattagtattactaagcaagggtgttaaaatcgaactctctttttttttttcctttttgtgaatcgattcactgcttaatttgtactatcgggtatcgttaatttgttaatcaaagcctcctatgcctttggattttggcaggagggagctgcatgtacgtaacgttgttgttgtgaattgtgatcgactgatgatcgtaggcttaatttccatcaattcaggataggactaggaccaaggctttcatctgagactcaggctagctttccctgccgttgggttggattctactgctgcatccacgcgagtgtgttcatcatgatcacggacacatggctgcctcaccggctttaatttccttttgctccagctcctttccccggccggcggacggtggcggcctcgccggcccgcagagacacagggagcgaagcgttacgttacgtcggcaacggtgaaaggcctccgatatgcatgatattgatccccagcgaggcggtgagctgccggccggccgacatgttccccttcgtcaacattaatgccccctcctttaagcaatcaccgtcaccgtcaccggctaacaaagcaagcaagcacgagctagatcaaatgagatgagatccgccattgccggcagcatgggactctgcgcttcactttacttcctactgtgcacagcccttctatatctgagctgtgccacgtactaataagttgtgtgccgatttatggaggagaaaaacatgcaaaactttgggccatgcccggttaaatctaggctgcttatatactcccttcggttttattttaattgacgctttgaacaatgacacgctctacgagatatatctttgaccttatttttctattataatatatacaacaaataaatgcatgtttacttttattataatgttttgaaagacaaatctatatatgtttttctagtttctttaaactaaatatttttaatattattgatggtcaaagttataaaagtttaacctcaaacttatccaaaacgttaattaatttagaaccagagggagtactcccccgtttataaatatttgataccgttgactttttaagcacatgtttgaccgtttatcttattcaaaaacttttgtgaaatatgtaaaactatatgtatacatataagtatatttaacaatgaatcaaatgataggaaaagaattaataattactcatttttttaatatttaaaaaagtcaacggcgtcaaatatttaaaaatggatagagtattatgttgggaataaatccactttgactctccaatataggtccaatttaattcatattcctcaatcgtgcagcatatttgcaaacaaaaataatttgtgaataaaacttttatatacatgttcttagcaatctaaaagcaaatgctgaaaaataaacttcgatgaaagaaccccaaaatcaactccaaatttaagattgaaaattcaaattttggctaataagcataagcgaaaagatgaggcaagtaatactggatatctcaatcaggtggagcttggggagccaccgattgccgggaaggaggtttgttgaccttgttgcccttgatcgactggcaaagaagatgtgcccttcctaggtctcctccttgcggatgctcacggcggcgagcttcagtgccgcctgtttcttcatccccctccttgtcggctgccacgaccctcgccatggacaatgggtggtggcctcgtcgccctagacctactggcgaggaatacccgcccaccctcggtctcctcgtggaggcttgcggcagcgggctccggcacaatctgcttcttgaacgccacaccccatggccctgctcgttgaacgctggatgccacggccctcgccataggtggggaaaggaaagaaagaaattgataagtgagagggagaaagatagaggtcgctaacatgtgggccccacatgctaacttgaccggttagactaggtcaactagccacgtcagcgaaaactaccataaatactgttggggcgattttaatagctaggtggtcaaaatatatggtatcgcaattgatggatacgaattagattgactctatagggactcaaagtgaacttattccttttactggacgcgcatgccaagggccctcttatggatgcaaagaccatatatgcaaaaaaaggtccatatttccgcacccaaagcttgggctggagcctggtgacctgccaaagggctctaactttaaatcatattggacctgggccatatagaaaccgtgcaacctcggtggacgtttcagcttattcctttctttctttcctgagtaaattccttacgattgcaaatactggctaaattaagtatcaacttattataacatcaacaatctattttagattaccgcaaaaattaacgatgaaattaccacaaaactaaaactctattactagtaccaaatactcttgtgttactaacaaatcagacccacttttcatacaggtggttatcggcgtgggtgaaacagtccatgtcatcgtgtgtactgaagtagtcccatgatagtaagagcaagtttaatactatagcccactgctagctccaaattatctatagccaatgtaatagctaattcatacaatatttagttactatactattaatatatggtctcatattcatacacacattacgtcttgtagtccgtgctgcagctggctacagatctatagcccgatgctcttctctctttttctttctctctttaaaatatgtttatagctagcttgcctgctattgtacctgctctaatacttctatgccatatgtgggctacaactcaacgagcatgggcgggaaaccaacgcggtcggctcacgaggcataattaaccaatttctttgttagagcaagtttaatagtatagtccactactagctccaaatcatctatagccaatgtaatagacaattcatacaatagttgcttattatactattaatacatggtcccacctattatacacctatcatacacccaatatgtcttggaaaccgtgctgcagctggctacagatttgtagcccgctgctcttctctctcttcttttatctctttaaaatatgtttatagctggcttatagcctgctattgtaccagctcttagggtgtatagttgctggccgcgaatagatttgggcgtttaggcggctttggctaaagtccatcaggggaaatcaaggccgcttgatcattctggcagtttgctaggtattgatgttgcatctgctttaaagtcagagttgatgtgtcgcttatggtaatcattgaggattataatagagttacagttctatgattattttatctataatcgtcgaaatatcattgcggtaaggcaatttaaaaatatgtcgataatatcgtagcaaagttataatttagtcgttaaatttgaatcgagagtcaaatgatatggccataggcggcatgcacgacacaacccgacccagtaacccacccaccgtgggctgttaccataaccaatatcatccgaggttaattgtgttgaaccgaattgagcgaccactggtggagaaaccatctttggtcggtcggccgaaattcacaatagtcccggttccactaaaaaccaggactaaagatcaaggactaaagatgatctttagtcccggttggtggctacagtggatatatttgatctttagtcccggttctaaacctgtcaggccccccgggatctttactcccggttggtgttaccaaccgggataaaaatcctaactttacttccggttggtgttatcaactggaagtaaagatctagaagatttttagtcccggttgatattaccaaccgggactaaaattcaacgcttaatatataatccttctttcctatccactcctccacaaccgcctcgcatttatcctctcagatcgatctccctctcctcctccccctccgcctcctccccttcctcctcccatctcccggccctctcctccccgtcctcccttcccatccgctcagatcgatctccctctccttctcccctcctccctctcagatcgatctccctcctcctccccctccgcctcctccccttcccctcccatcccatccccggccctctcctccccctcctcccttcccacgcagcaggcggccggctaggccgcgcacgggcccagtggcgagcggcggcaggcggcagccgctgccggcatttttttttttttacaatttgtgattcactaagatgtataattttgtgatttgttgcatgatctgagatgtataatctgtgatgtatttggtttgtgtgtaatttttttaagatttgtgatgtatttgatttgagtgtataagtaataagatttgtgatgtgaatgttttgggatgttactttgatttgaggtttgatttgggatatgtatcccacttgatttggggatatgtatcccacttgatttgggagaaaatacaggattaaactgtagctaaaaaacaatgaaaaaaagactgccgctaccctctctttattcgcagttggtgttaccaaccggaactatatctttagttctgggactaaagatccaaccgggaccggggttaccaaccgggagtataaatggtttctccaccagtggaccgtttattacagtagcttattatggccagcaacttgttatatatattactacctccatattttaatatatgacgtcgttgacttttttgtccaacgtttgacaattcgtcttattaaaaaaatatgtaattattatttattttattatgacttgattcgtcattaaatgttttttaagcatgacataaatattttcatatttgcataaaaattttgaataaaacgaatggtcaaacattggtcaaaaagttaacagtttcatatattaaaatacggagggagtagatcgatagatcgtactactatgctcacgtgtgttagcttgtcgtggcggccgcagacaagcagcgagcgccccatatataagcgtgaccactagctaatcaaaagaatgcatgcatatgcatggatacagagatgagatcatgcatgggatgaaaagaaagaaaggaggccggtacggtgctacagaagagagatccatggctgctgaccccaagatcttgaggattaaatgtccggccggccatgccatcctgccagttgatagctagattcatcagacaaattgatcagtgcagtgcagtgcagtgctagctcaactcctcatctgatcatcttggactatataccgattctttcaagctgttcgcctgccccgctttaatttggccgggcctccatccgatcgcgattcgagcacaaggctgcatcgcgatctcatttcgctatcgctttaatttgatagccactccgatccgatgatgaggacgagcttgcatagaatcaatatgatatctcagcagctgcatgttagtatgttaatttccttcgctgatatatgatcgatagatgctacttgttgcccaccggccggcagcggaagacagatccatgatccatccatcatacgccgatactattagttggtgcaggtgatggatatactccatattgcagccagccatgcaagcacaagcacggtacgacgattcatcgactcgggcatgctagcttgtatctgaattcattctcaaatctcaacagatatctctctccttactttctactaccccttaatttatgggagtagctatatttatggccccatatttttcaccaaaaaatagtcggcatgtatttacattgtaagttactaaattacatatgtaattttagtgtatttacaatgtaagtaccaaaattacatatctaagttctaaattacacatgtgtaattactgtgtaaatagagtaattacattcgttgatgaccaacacgtgtcatgcaaagcaaaaaggagtcgcgaacttaggaacaagttgttcgatcagcttatcagatgtactttgcacgaatcatgaagaagattagatggcagatcgtcaaactgactgtatttagcctagaaatatatcgacataattttagcaaagccgtaatttattagcggtctgcgtatggtttatctccttaattatactaggtgataccccacgcttcgctgcgggattcatcgatgaatatatgttaaatattgtcgaaatgatgaaggttgaaatgttgagaaaataatgtgaggaagatgatttgacacatacttgttgatctctaaaatataatattgtagatgatgtatcatgcttgcatgagatttaaataggctagaatagtaattgctagtgagtgaagatgtggcatacttgcatggaattttaaatgggctaaaatagtagtaattgctagtggatgataatgtggcatgctttgcatgttaagttttagtttctaataattgttagtgggtaccaactatatagaaagtatatagaaagtatagatttgaggtcaaaatagctacatggcccgttaactttgtggtctttaattaattaagcatgcatctaataaagtcatactccaaactatttttttcgagggcaatatatactccaaactaataaactaatactcgatcgatttatttggcaaatcaacgaggcgacaactcgatcgatccagcttcctttttttttcgaacaacgaattgaaaaaataaactatgttccctctgtcccaaaattcaaataagtttattttttatccatcctacacgtaacaatacaagttcttttcctagttgcgtttagccgctgtagtagctagtcttttcctagtttcatttttttattttgctttttataccttcccgacataagtcggtctggctgattgtattgtgtagcaaaattttttttccttctaatatattgtcgtgcaatccttttacacattcgcaaaaaacaaacaatacaaaacaaaaataactaggattgtatttagttcagcgtaaagtttgaattttggttgaaattggagatgatgtgattgaaaagttgtgtgtatgacaggttgatgtgatggaaaatgactgaagtttggatccaaattttagatctaaacataacctagaatacgcccactttatcaaatcccaattcaatcattcctctctttatctattcccaattaatacacttatctcattatttcacaaactccagtgatctcattttatgacgaagagagtatgagatcatatatcgatcagtccataaacatgaaatgttgaatttgatttctacaagttataaaaaagaaacaaattaaacagaaactaattaacatgcattcacaattatataaatttcttgattatttatatgcagcctataaaaattaaatttgaccttacatcattaactctttagaaattagtttttattgggacggagatatcggtgggtgtctcttgttcctgatggactttctaattaagtcgtactcctaccattgtcttgttcccgtgacgacccaacaacacccatcgcttactctacagatcaatgtgaagatgtgttggaattaatagatgggctaaggcccattcaaaaattaattctttagaaaatcacaaaagcccatctcatggggtggcatgcatgtggagtttagtatcaccttgcttattctaggagagggggacttccttaaaagggatgatgccctcttagccacttgaagcatgtatggtggagagaagaggggaaacacgcgcgcgctcgctcgcctcgcctggtagggcaagcgttgcggcgcgcgtgcacgacgtacgcgtcaaatggtccataaaattggctcctcacccttgcgcagatgcagcctccttttgcagttttgttttgctacaggaaaattcggatttgttttgttttggaaacattccgaaaaatccggtgcgtgaaaacggcatggagtccggataagttacgcgcgacttatccggttcggttacgcggactggagatcgtgcgggcgccctgatcaagtgacctatcctatataaactgagccgccgccttcacgcaaaacacacgaaatcaatctagggtttgcctcctcctctgtgctgcgccgtcgctcgtgggctactccatcccgctcgccagcgtgcaccggcgatcgggagggcaggtctccggaacctctgccttcgacgtcctgcaccgggagaaggtagcaataaggtttttgggaagcgcttcgcgcaactgctccctgttcgtccgcgacagctcgccttcctctccgctcgcgtgctgcgcgccttcgtcgacgctcgcaaccgcgagtagttcctgccgagcaaccggtctttccgccacctcggtacgtgttcgacatgttacgcatatttgatctgtccatgttttactgcttagtttacatatgtagatctaatgatgcgttaatgctagtatacatctgtaatgtcatgatttatttatggaatatattaaatcattatatgcctatattatcaacaattcaaaaaccttactataggcgctgtgattttactatggctggttttgccgatgcactgaggccggataaatttaccggtgtgcactttaagagatggcagatctgggtcattctgtggctgacagctatgaaatgcttctgggtgagtactggcaagtctatgggcgttcttaatgctgaccagcagaaaaaattcgatgaggccactactctctttatgggatgcattcttagcgtgcttggcgatcgtcttgtcgaggtgtatatgcatatgaccgacgctaaggaattgtgggatgcactgaatactaaatttggtgctactgatgctagcaatgatctgtatatcatggagcagtttcatgactacaagatggctaacaaccgttctgtagtcgaacaggctcatgagatacaaaccatagctaaggaactcgaactccttaagtgtgtcttacccgacaaatttgtggccgggtgcattattgcgaaactacctccatcttggagaggtttcggtactgcactcaaacacaagagacaggaatactccgttgaggggttgatagcgtttcttgatgttgaggagaaagcattgggaaaaagatgccgcgtctaagggcgatggtgggcagtccactgccaatgttgtgcacaaggcccagaacaagagcaaggggaaatacaaagctcagcagaccaccaacttcaagaagaataagaacaacaacaatcctaatcaggataagaggacttgctttgtgtgtggtcaacctggccatctggccaggaagtgtccacaacgcaaggggatgaaggcacctgcagggcagacctctaattctgctaatgtgaccattggcaacactagagatggaagcgggtatggtaatttacctactgttttttcagttaatcaatctactaattggtgggttgatacaggggccaatgtacatgtttgtgctgacatctcattgttttcttcttatcaggtcgcacggggttccatcgtcctactggggaatgggtcacatgcttctgttcatggtgttggtacggtagatatgaagtttacttcgggaaagatcgtgcagctgaagaacgtgcagcatgtcccttctatcgacaggaatcttgttagtggctcccgtctgactagagacagatttaagttggtttttgagtctaataaagtagtcatgtctaaacatggatattttattggtaaaggttatgagtgcggaggcctgttccgcttttccctttctgatttctgcaataagtctatgaaccatatttgtggcagtgtggatgatgaggctaatgtatggcactcacgtttatgtcatattaattttt

SEQ ID NO: 37288 - DNA, 2962 bp, Oryza sativa
tatggattgggagaaaaccatcactttcttacttgcgcacatgggggtgcttggcgaaagtcaatgtaccaataacgaagaagcgcaaacttggacctaagactgtggactgtgtctttctgggatatgctcaccacaacattgcctatagatttttaatagttaaatctgaggtacctgacatgcatgttggtacaattatgaagtctcgtgatgctaccttctttgagagatttttcccaatgaaggatacacatagtagttctagccaaccctctgaaataattcccaattcaatcacaccaccagaacaaactgaacatacacatgaacatgttactgaggaggatgacagtgaagctcctcgaaggagcaaaagacaaaggatggctaagtcttttggtgatgatttcactgtgtacctcgtggatgacactcctaagtcaatttcagaagcatacgcatctcctgatgcagactactggaaggaggctgtccgtagtgaaatggattccattatcgctaacgggacttgggagatgacagatcaaccatatgggtgtaaacctgtggggtgcaagtgggtgttcaagaagaagctcaggcctgacggtactattgaaaagtacaaggctcgacttattgctaagggctatactcagaaagaaggcgaagatttctttgacacttactcacctgttgctagattgaccacaattcgtgtgctactttccctagcagcctcacatgatcttctcgttcatcaaatggacgttaagacagcttttcttaatggagctggatgaggagatctatatggatcaacctgatgagtttgtagttgaaagtcaagaaggcaaagtgtgcaaattgttgaagtctttgtatggtctgaaacaagctcctaagcaatggcatgagaaatttgacaaaacattgacatctgtaggctttgcagtcaatgaggcagataaatgtgtgtactatcgccatggtgggggtgagggagttattctgtgcttgtatgttgatgacatactgatatttgggacaaaccttgaggtgataaatgaggttaaatcattcttgtctcaaaattttgatatgaaggatttgggagtagctgatgttatcttaaacattaagctaattagaggtgagaatgggattacactcttgcagtcccattatgtggagaagatcttgaatcgctttggctacattgatagtaagtcttctccaacaccttatgatcctagattgttgcttcgtaagaacaagagaattactaggaatcaactggaatactcccaaatcattggctcgctgatgtatctggctagtgcaactaggcctgatatctcatttgctgtaagcaagttgagctggtttacctctaatccgggagatgatcactggcgtgcgcttgagcgagtaatgcgctatctgaaaggtactatggaattggggcttcactattctgggtatcctgcggtactggagggatatagtgattctaactggatctctgatgtggatgagatcaaagccactagtggatatgtcttcatactgggtggtggtgctgtttcgtggaggtcttgtaaacagactattttgatgaggtcaaccatggaagcagaactgatggcactagatactgctactgttgaggtagaatggctgcgtgatctattaatggatctgcctattgttgaaaaaccggtgctggctatccttatgaactgtgacaatcaaacggtaattgtcaaagtgaatagttctaaggataatatgaaatcatctagacatgtgaaaagacgattgaagtctgtcaggaaattaagaaactccggagttataacgttggattacatccaaacagcgagaaacctggcagatcccttcatgaagggactatcacgaaatgtgatagacaatgcatcgaaggagatgggtttgagacccatgtgagttatactatggtggtaacccagtctatgtgatcggagatcccgtgaattagatcctgggaagaacaaaccattaataaactagaggagagtaccaatatatataccctctccaagtgaagatgcatatactctcgtgagctgcaaggcaggttggctatgccttaatgagttctgttggctttaattagcaaagatgttgtcctgcagagcattcttgaaggaactcacctttgtgagcttgactgttggtcgcagtctatgaagattttgggtgaatctgctaggaagcttactaaagacctaggagtatgacttatacgctccacccgtggggtagtctacagacgatctagtaccagataagactctgagtgaaacttgcttgcacaagacttgcgattcaaggcgtagtccattgttcaagttgtgagtaagtgtagcttgaagttctaggtggatgtttaaccttgattggtctccatcgaaccgctggtatataaacagtacattggaaaaggcaaatctcagtgggattttgagatttggtgggggattgttggaattaatgaatgggccttagcccactcgaagattaattctttggaaaatcacaaaagcccacctcatgggatggcatacatgtggagtttagtaccaccttgcttattctaggagagggggacctccttaaaagggaggatgccctcctagccacttgaagcatgtgtggtggagagaagaggggaaacacacgcgcgcgctcgctcgcctcgcctcgcctggcagggcaggcggcgcgcgtgcacgatgtacgcgtcgaatggtccgaaaaattggcgcgcgtgcacgacgtacgcagatgcagcctccttttgcagttttgttttgctgcaaattcggattcgtttttgttttggaaacgttccgaaaaatccggtgtgtgcaaacggcgtggagtccggataagttacgcgcgacttatccgg

SEQ ID NO: 37289 - DNA, 14370 bp, Oryza sativa
  unsure (1)..(14370): unsure at all n locations
actgcttagtttacatgtgtagatctaatgatgcgttaatgctagtatacatctgtaatgtcatgatttatttataaaatatattaaatcattatatgcctatattctcaacaacatgttcctctcctcccaccccagcgttgtcaactcgattgaatggatccatagcttcagaatctcttcaaattaagttgaaaattgacggctgcgcgcttttgcgcggtggagtgaatttcagttcaaacatgcatgggatggaagtcgctcattgaagaaaggttggaggcgcaactgccgaggcaacaataaagcacatgcaacggagttgtaataattcatcagcggaaaagctagcggcctctctcctcttcctgcaaatgaaaactaaaaaagcagccttaacgttcgtgccacaaaaggagaagagaaaaaaaaagagaaacgcatcgaattcagtggttgttacatcatctttaatttgagcgaaaccgatgccgtgctgacgccgtcagcccgtgcccatcgacggcgacggacggacggcctagctgacggagtaattagcaggcagcaacagcaagtgccatcttctttggtgtttatttaccacgctgccattgcattgccatccgatcaagtactgtacaatcactgctactgttgaagcttagtgttcagtttgaacagcaagagcaatagtataattaaagcgtgtagcagccttgacaggcaggggcaacgagctgcctgcctgcctgcctgatcaggttctgatggagcttatgacgaactcaagaggccagagagaaaaaaaaaacgactgtcactgagactgccaggtatcactcgctcgtcttgtgtttgtttcacttgcagtttggcagtgatcgagcaaaaccaacacaaagctgatcgatttattactgcttctccatggattcatcacaactcaaatacagtctctctctttcatgcaattcatcaaatggaaggatggagataggagtaagtttggtcagagtgtttggtgtagttgccagccaggctataaacaaacagtagattggtgagttggcaggggaaatgcccagttggagcacgacaggtcacacaaacttttgctgtccgtccacgtccaaacaggacacggccgtgggtccacaaagtaaggctctgtcgtgtgggcacatctgagccgtctggtgacgagacggggcccatccgtgccgcactgcagcagtggcaattctgtagatataggcccactcaaagggcagttacggaagctggagccggactgacttacccgtagtaataggagagtacatcgggtttccgtttcatgggccaatggccgtctcgtctcttcttccacgataatcgaggcatacaatcgctgccggctgaaacgccagtgaggggcattccggcgaggaggaggtggtcgtcgcgtgctagctgcggcggtggcaccgtgttcgttccctgtacttacagttgaacgacggtgtttaatttggattggtgggtgggcctcttgttatctcctcagttttgcatgtttccactcagctactaataaacaggggaggggaagcttcccgtgtttcccgacggaatgcggcgccaatttggattggaaggaagcttaatcgccatggatggagatggaaggaatcccccgaaatccggacagagacgatggcagtagcagacacagtgggtggccgcccaccattttgcccttcttccccgcgtcgccatgcatctatccgccaagcccgcagcacccatataaaagttgcaatctttctctcaatccgcagccgcagcgactcgctcggaccccctccctgaccccattcaactagccctgcaaaaaaaaaaaaagacggccttttctttcttttttgtcctgtggtttctctactccacagtcaccacaacagtggagtactagtgtttactgtttgcctgcttcgtctccgggcattaaagtccccggagctagcctagcggtgcttgtctctctctctctcattttggtgtctttgaattcaatttttcatcacctgttggttctgctggtgttcacttcatttcttgctgaaaccgaaatgcttttgaagcactaggaggctgctcgagctctcggacatggcggtggtctccggtccggacaagggccggggagcggaggcggtggttgtggtggccgtgcgggccgccgccagggacatctccaaggccgccctcgtctgggctctcacgcacgtcgtccagcacggcgacaccatcctgctcctcgccgtcatgccgccgccgcacaactctggtatacatgcccttcctcttcaacagctttgccaatttacgatgccatgcatttttatactgtatcatggagctctttggatttggtcttcatggatcaactttcactagttcaattatttcctctcgttttaatttcaggcaagaagttctggggcttcccgctctttgcagggggttgtgcgagcgcccacaggagcgtgttgactcagaattcggatgtcgctgatttgtgtaatcaaatgatgctgaaacttcgtgatttttatgatccgaacaaggtatcaaaagggagctaacactagctgctgtgtgtttttacttcaatctttcagcacaagcacctttttctctttctctttttttttttgctaaaaaaatctggttacatttttgtgtagataattacaaaacttaaggttatccctgcatctcctggtggtgtggctactgaatcaaagcgtgcccaagcaagctgggttgtgctagacaagtaatgttatcctgtactacatttcacagtttttacagtgcactgttacttttaacccctcttccgtatctgcatcattgagcaatggtcttgttactcagggagttgaaacatgaagagaaacgttgcatggaagaacttcaatgcaacattgttgctatgaagcgctctcggcccaaagttcttcgtctgaatctggtgaggtctcccccaaaagaatcaaaatcacctctcccgccacttcctgagttgagtgattcagttggtgaaaccgaaagcagtatcaacgaacagcgatgtccgattcgtgaaccggctgtgacaccaagtagcagtccagagtcagaaacagcttttggtagcactgatgttggaacatcctccgtttcaagctcagaccctggcacatctccatattctgcttcagaaacgaatagcacattcaagaaagaggcaaccaaggataacttccagcactctgatgtcaatgtatctgattctgagagtgaagcttcaactcctccagcagcatcatcccttcagccatggatggctgacattttaaaaggatctgcgtcctcaagattagcaggaaaccgtcctagaagaactcgtactcctaccgcagatgctttgctcgagaagatctcgaagctagatctcttggctgaaatcagtgcaatcagaagcaggtctgacttgaacttcagaggaaatgtgagagatgttgtttcattgtcaaggagtgcacctcctggaccaccgcctctgtgttcaatttgtcagcataaaacacctgtatttgggaaacctccacggtggttcagctacgcggaactggaacttgcaactggtggcttctcccaagcaaatttcttggctgagggtgggtttgggtctgttcacagaggtgtcctacctgatggccaggcaatagctgttaagcaatacaaacttgctagctcccaaggtgatgttgagttttgctcagaggtggaagttctaagctgtgcacagcaccggaatgttgtaatgctgattggtttctgtgtcgaagacaagaggcgtttgctagtttacgagtacatttgcaatggatcgctggattcccatctctatggtaagctaattattattctgcaaattctatgtgactgatgaatatagcttagagcaagtttaatatatagccaactactagctccaaatcatctataaccaatctaatagctcattcatacaatagttatctataaaccattaataaatggtcccacctctcatacacacacaatattagagttcgtgctacagctgaccacaaatatgtagcctgtttttcttctctctcttctcttctctcctccacatgtgtttatagctgacttgtagcctgctattggagaagagtgcattggtcctgttgcaataactctctgttgatttagcttatgtcatggccatgttggagtaaaaagcatgagtgttaccttttcaaaccatctgttactccttaggccgtaacaaagagacgttggaatgggctgcaagacagaaaattgcagtaggagctgcgagagggctgcgatatctccatgaagaatgtagggttggttgcataatccatcgtgatatgagaccaaacaacatccttgtcacacatgattttgaaccactggtatgatattccatccctatattatgttggatcttagtcgatggatatgaagatgcataataaacaagactggtcatcttctttccattgaaatgctgttctgtttcaatagatagtaaaattcagtactacatgattaattgatcatatatgcatgcatgatgctgtgaagatgtgccgtacttgtcattctaattggcatcagtggtctttagcctcaacttccttccacataatgagggtgaagtatcgtcatatcgtgtgcaggtcggagattttgggttggctagatggcagcctgatggagacatgggtgtcgaaacaagagtaattggcacatttgggtaagtgctcagccatacaatccatcaatcctgtcctttgtgaggtgtaacttgtgaaaaaggcatatctgagaccattttcggccatgtgcagttatctggcacctgaatatgcgcagagtgggcaaataaccgagaaggccgatgtgtactcatttggggttgtgttagtggaacttgtcactggacgcaaggctgttgatattaacaggccaaagggccagcagttcctcactgaatgggtgagttcgttcacctagtattgcactatttagtgctatatcatcacattagattatgttaagcttggatatttacttttctgacaagtgacaaacgctgataacctcctttttcttatagtacaatggtaagtatgttttgagcctgatggcctcagtagtgccagactgtcagtttccactttcctctgttgaattgactcatccacagttccacactttttcctgatgataagtggcatctctgaattatcattcctgttttgatccatttgcaacaggcacggcctttactggaagagtacgcgatcgacgatctgatcgacccacggctaggggaccggttcagtgaaaatgaggtcctgtgcatgctgcatgcagcaaacctgtgcatacggcgtgaccctcattcgaggcctcgcatgtcccatgttagccacacaccattcttctccacatttctcagtacctatcacctaagcttgatttacatctgtactaataatgatgtttctcctcgcatgtatgaaaaggttctacgcatactggagggcgacatggtggtggaatcaggttgcgtttctgctccatgcagtgaagctgggagcaggagccggcgaatgcttctccaacaagagcagcagagcagcccggctcagcaagattcacagatcatggttgatggtaaaccacagtcctatgtggcgaggagaattgcctgggatagagatacgcagagcttgtcccacagattctagaatctccatctgcacaagaatgcagccaattctgtgcagcctgtactgatgcaattcttttctgctctgctcaaggcctgcagtgtgtgtacagtagtagtggtggtggtggtacagtagtagtaggcttacattatcttgagctctatctaggcttgtaagtgcctgttttgtgtcatgaacgggggaaaaccatccatgggtgttttatgggagggattgttttgcttgtttggaatctcatgtgttgggaacaagatagacaagattgggtttgctattgcttgttctatggctaggatgctgatgtttttgtcaccatgtatccagtagagagcatatctgatgactgatgaggcccagcaagaacagctcccggatgcttcttttcagactccgttgcgagcaatcatccatccgttcattcagcaacgagccatcacgtcacgtcggccgatgcgaaactgaagcagtggtggccacagcgataatccggcagggactgtgggatactgttggtttttacagtacagcaactgcaagatgaagaagctgtggcgcaagtaattgcgtgcagtgacagtggtgtggtggcctcggtcggaacgagacgctgccactagctgccattctgccaatcaatcatgcctgcacacacacacaaaagatgattcctttgcttttgaccattccttggatctgcacagtaactcacaccgtgtccttttctttcccttcgattttctgctcaacttttttcaccaggtgtaaattttctttcagaataaatcaaattcccttcgagtccatttgatgattagcttggagattcatacttcgatgagctcgtcctcatttcggcccacaatgagcttctgggctggaccggacaagagaagtacaaccagtagtgggctggatgtgcattcaattcacacatggataaactgttcctctacaaccacatctgacaaaatcaaccttacagcaccacaggtgacaggtttcagattagcctctttaataaaccatgggatccattctcagctgagcaaaatctctgaaccaacgcacacacgactactcatcagaaacatggcatacactgtccactcctgtcggaaaatagaagcagcacatgagctactatgtctgacaaacacagcaatggtgatggatgggtgcacctcggatatgcacggggatacagacaggcgataaacacaacactcctatctgggaggggcgacataacaacacagtactcaactcgacgacgacacagttttcaggtgaaccaacaagacaaccgagccgctagatccgagcgttcgtttcatttcccacctagcgaggggaactgggcctgatcttcgatcaccggagcggcagcctgtctgcgaccaccgttgccattgtaaccaccatagaaacccccacgatcaccacgacccctgccacggccacgaccacggccagggttgtagtacctctctccttcagccggcttcaagaattcattgatgctcagggacttcaccaagaatggaccaaacaggagaaggacaaagacaagtcaatattgtgagccagaacagccagtgtaggcttatgattaatgagccaaaaaaatgaaataccttcttggtacgttcatccttttcatccttttctttctttttcaagtccttgtcagagccctgataataataaaagttgagcggaaatagacatgtactgaaacatgttcagaggacataacaccaagcatacaacttaccagcttgataaacacttcctcattagcctttttgacagagagctgttgcatggcctgcaactccttgtcgacttcaactttcctctcctcagccttcagtgcaagcaaagctttccgcttctcctccagcactttctcatattcctccaaagtcatctcctgtgaaatggtggtagaaaattgttatttcactatcaaacgaattgctacttgaatcgcacggagtgctaacttcaagcaattacttagaaaaccctttaataggcagagaaatgagacagtagaaacaccagaatgagcaaacacatgctatataacaggcaaccgttaggacagtagggataataggaatatccaaacatgtactagaaccaacacaagaacgcctgaatgaccaagagaatttgatcaacaaatggaaggtgccatagctgaacgttcaccatggagaaaagaacgggaaaggcccaaataatattatggatacccaaaagatctactacatagcagataggagatagcattcaatacagaaggaaaaaaaattaaacaacagaaacttcaggtaatgatattgaattatgcagaaaatcaatatatacagcagcttctagttccaactgatgcaagcaaaattgcaaactttatatttctgtatttaaagcgggcacaagtcatccaccagttttgagtgtggcagactactcacagaatatataaaaccttcccatcagtcaacttaaacatcatcttaccgaagtcctggctattttgtaacatgagtatcaaaagcaaattaactaagcagtaacgcgatacattctgacataattatattgcattggctagaaatgagcaaaagcacaaaactgaaagcaagaagagcctgcaaaaactggagaacataatgcagttctcaaaaaggcaaatttaacccacatgtaaaccagttgaatgattgaactacattgcttagaatagtacagatgacatgttttcccacactaaatgaatgacctgtagctagtttctgacgaaatcaaaaaccaaaactatatgtacccgttgtgcttaaaatgcatccacatgtttgaccattcaaaggcaccagaatgtaatacccaaaactgtatgtttaccatgccctatgcccagaaagagttatcatcacctcctaaacagtaccaaatgtgcacacatgcattaaggtattaaagcacagatcagaaatataccttatcctcaggttctttttcttcttcttcattctctggactctccttgtccttgtcgacctcagactgtggcacatcttcaggtttcttctcatcctctgcagttgcaggagcctcctcagtgttaacagcctccgcaacttccctaatcaaccatatagaagagttatattcaatcgtcggatcaatcaatcacatctacaaaataagccaacaatcgcaaaccaaattgcaaaggaccaatcttaactgtgcaaggccttcatcggtgacagttccccaattgccgcggccagacccctcacgcttcaactcatagccacggccagtgccgctgtggcgctcatacgccctgcgcggacgtccatagtcgtctccactctgcccatcactatagccaccgcggcgaccacctccacggtagggctggcgtggcccacggcccctctctgcctgtctcccctcaccgtcttcaccgcgagccaatccaccatcaccaaacccaccaccaccaccatagccaccctcaaagccgttggcatcaccctcaccgaaatctcgcctcggaccgcccctgcctcctcggccgccgcctcttccacgccctgggccaccacggccagccccatcgcgtggagcaccgtagttcctcgcttcccttactgtagatatatacataaaaaatcaaatcaaatctttgcgcctaacggaaaaacagccatggatccaacaatccggtaatttctccatcaatatgcgtacggtaatcgaatcgaatagagagcactgagaagtgagaagcgtgtcatactcaccggcttgcgcgggtggcgcgggcttggtgggcagcttggccggagcgggcgccggcgatgaggcgagcttgggcgacgcggccgccgccgcagccttcttctcggcggcggcgatgaggtgggaggggtcatcgttgtcgacgtcgacgaggagatcgaactggttcttggaccccatttctccgcgccgccacaccacttagctcctctctattcctcaatcccaaacaagaacacacagacctttcaagccaccatccccgacgaaatcgccgccatgagattgatgcaaggaaggggattagggtttggcacacaaaaccctagccgccaagagcaaagcctttggctctcgtctgcccggaggctgctgctctgctatacagtacggtcatacactaaattaattccattttcagagcacggcctcactaattatttccttttatttacgaaatgacgcatttgggcctaacagtttgcgctaattacgtccaaaattctggttaccaacaaagtgtcgtgagggtagttctgtcttatcccctttgtactggagaagtactgctctttatgggcctagtcggcttacataggcttaagtgcttattagttgggccttcggattaacgggccttcggcctaaatggacaatatgtgactgcatcatgattagcaagcttaatagcgattctgtttgttgatgcttaatcttacccatgcgtcattaagcaatgggattataagattataaaagattttttatgcatgcaccgtagattagcggcagccagcgttagtggatgaaagattagcagttagtgaccaattaggtagctgtccgaaatctccgcgcattcctgaagcaaagctgcaggacaggagagggaccctgaacctaaacaaaaacaattctatgattaaccatcttctctctgcttagtcatttatttaaccccaaattaattcggttctatcatgcatgcccgtctccatcatggactgacaggcactttaaatattgtccaaatcccttgcttcaacagtggatcaaagattcatagagagtgcatgtgtgtgttcaaagaaagataatgcaaagaattatgatggattgacctcactaaagtactatccctcctatactcagataattagtggttgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacgcgcgcgctcgctcgccttgcctggcaggcggcgcgcgtgcacgacgtacgcgtcgaatggtccgaaaaattggctcctcacccttgcgcagatgcagcctccttttgcagttttgttttgctgcaaattcggattcgtttttgttttggaaacgttccgaaaaatccagtgcgtgcaaacggcgtggagtccggataagttacgcgcgacttatccggttcggttacgcgcagtagagatcgtgcgggcgccctgatcaagcgacccttctctatataaaccgacctgccgtcttcacgcaacatgcgaaaatcaatctagggtttgcctcctactctgtactgcgccgtcgctcgtaaactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatcattatatgcccataatatcaacaatccaaaaaccttattataggcactgtgattttactatggctggttttgccgatgcactgaggccggataaattcaccggtgtgcattttaaaagatggcagatcagggtcactctgtggctgacatctatgaaatgcttctgggtgagtactggcaaacctgaaggagttcttactgctgaacagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactacaaaatggctgacaaccgttctgtagtcgaacaggctcatgagatacaaaccatggctaaggaactcgaactccttaagtgtgtcttacccgacaaatttgtggccgggtgcattattgcaaaactacctccatcttggaggagtttcggtactgcactcaaacacaagagacaggaatactccgttgaggggttgattgcgtctcttgatgttgaggagaaagcttgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctaggaagtgtccacagcgcaaggggatgaaggcacctgcagggcagacttctaagtctgctaatgtgacctttnttgggggggcccaaaaaaccaatttgggagagatggaagcgggtatggtaatttacctactgttttttcagttaatcaatctactaattggtgggttgatactggggccaatgtacatgtttgtgctgacatctcattgttttcttcttatcaggtcgcacggggttccaccgttctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgagactaatgtttggcattcacgtttatgtcatattaattttggcttgatgtctcggctttccagcatgtgtttaattcctaagttttccattgtcaaaggttctaagtgccatagttgtgtgcaatcgaagcaacctcacaagcctcacaaggctgtcgaggagagaaacttggcaccactagaactcctacattcagatctctgtgaaatgaatggggtgttgacgaagggtggaaaacgatatttcatgacattgattgatgatgctactagattttgctatgtgtacttgttgaaaacgaaagacgaggctctagactattttaaaatttataaggcagaagttgaaaatcaacttgacagaaagataaaaagacttaggtctgatcgtggtggagagtttttctcaaacgagtttgacttattctgtgtggaacatggcattatacatgagaggacgcctccctattctcccgagtctaatgggattgctgaaaggaagaaccgcacactgactgacttggtgaatgccatgttggacaccgcgggattacctaaggcatggtggggggaggcattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgagataccggacatgcatgttggtacaattatggagtctcgtgatgctaccttctttgagagctttttcccaatgaaggatacacatagtggttcgaaccaaccctctgaaataattcccagtttaatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaggctgtccgtagtgaaatggattccattatcgctaacgggacttgggaggtgacagagcgaccctatgggtgtacacctctggggtgcaagtgggtgttc

SEQ ID NO: 37290 - DNA, 692 bp, Oryza sativa
ttaaagaagacacatagatatacatctcacatatttaagatatataataaaaagtttgagaaacatatgcctgcttatgtggacgggcttttcttctcttcctagtttatcaaactagggcgatgtcaaatattattcagatgcctggcttctttacacagctgttggatatagatatatagataagtaattttacagtctttataaaaatatcacgaggtatcattttttctattataattttgttataattttggtagatagacagctcgcactgggccacttatcttatggcttcgttcggtggacggagcgagctatttatttgctcctggttcatcgcctcatcggagcctggactgcgggcgcactacgcgacggaggcggtactgcagccacctgcggccggccgtcccaacctgcatatgccaatcgccaaagaaaacgccgttagatcttggggtttgcatcgccttggcagtgtcgtctaaagcggcacatgcatatatagcagggagtatactactcccttttaaatatttgacaccgttaactttttagtatgtgtttgatcatttagcttattcaaaaaatttaagtaattatttattcttttcatatcatttgattcattgttaaatatactttcatgtacacatatagttttacatatttcacaaacttttttaaat

SEQ ID NO: 37291 - DNA, 19929 bp, Oryza sativa
  unsure (1)..(19929): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcggttaatccccgtatgggagagattgagggggattaattccacacctcaataggtgtgaaattattcatctccaaattctcctcaatccccttgtgagtgggattaaccgaactagtccttagcgggatctgtcgaggccaagccttgagctgagccacttgccaacgtcgtccatctcttcagggatggtatagtggcctagcctgcatcataagaaactttgtcaatctttgctaaaagaattctgttttgtactctgctgtgcaaatgcatgaatatgtacccattgtaggatttgaaatgcagatataagaaccccgaggatcgcagagtgtcagatgacctctcagcattcctgtaggatacaacctcatccgctgcaacaacacacagaattgagaacagactgacgcatgatgcattgactggtaatgactagttatactgtttctggagggaaggctacatgaatcgacagctttgttacctcttccatggctaagtaagataggcaaggaggcagctcttcttgcagctatgtgtgagctctccatcttgcccctcagggtcctaaaattacagtgcattagcaacactaggattcaggaacaagtgacactagtaagtagcaagtgtttgacagattaatttctgcctaggatggcaaactggcacctggagcaagggagccatccactcaagctgatgaccgcgctaagtgtgattgggtaggggatgccacttgcgaatttgccatgagcatagcacgcagctgagtagagggaagcagcagcacccatgctgaaaccaccaatcccaagcttcactgcactcgcaaagtgtggaaatcagtggaatgagtgtcacaggagtgagtggtcaccagcatacatctgaagaacatatcatagttagtgctagttttgtatatatactggctcgcatttgatcacctaattaacatatgcatttaccggtgccactaataaggatcactttgaaaaattaaaagaaaaagaatctggtaagaccataatatatgttacattgatgtggtcctggaactagtaccatcaggcggctctgacgacagcaagtttgcaatgtgcgcagctgaagcatccagtccttcaatgtcgtcacggccatccactgaagtatcctccacatcaaaccctatttcagttccatacaaaagctaataagtcagagagaaatggcagtacccctaagttttcaaacttcagagagatggtagcatagtagtcctgaatacagggtattctgccaagttccaatggagaagaagaagcttacatgcagtgcaagggaatccaccaaatgctgtgacaggctgggttgctgcggtggggcaaatccacttgatctacaccatcataagcttcaaggtgaataaaccatggtgcaacaaaaatagactgctagttgctactgaacatgataagctacactgatctggagatagaccggtggagagagaccggtgtgtgttaataggggaataaggaacggtgtgtgtatgtatctatcatctgtgtatgtgtgtctgaagtacaagcatcgacacttacatttggcaatgaaagagaatccaggagttgggaccagctgaaaacagaatgaacaaaacagagaaaaggaaacggatcagtgcagaaaagcattgtggatgcaactagtataggtattctgtttcatattctctgagaacttatgattaacacatcatatatgtataaacaacaggcgtcgtctaaaagtatcagtgaagatataagaacatctggaactacaaattggaatccatcagatcagactaaagagagaacatttacagtactggacagaatttttacagcaagttgagcaactagcctgaatttcttagcttatcttaagagaataaacaattatcttatcaacaaaaaacgtaacatgtaagtagctgagttgctgatctttttagttactggagacaatagggaaatgaatgaaaaagaacaggaaatgaacatctgccgcagagcttaacttggcaaatgtgtactgaactcttaaaagaaattgtgacacatgcatcataccaaactgaaaggcggccaagcttactttttaccttctttgctcccggagttgatactggccattaaaaactctatttaatggagccaagatactctaatttagtggcttatcataaattatgctgttctttagatgctttgtgcagacatggaataggaaattaggaatctttcataagctaccttacatttatgcaattttaatatgccattagcccacatcaattagaagtatttgacattcctctccatttctgaatggaaagtgagatgcattatctatgtccttggtggcgcagaaggttgtcaggtgtgcagaaggacaagagaaacatttactccctccgtcccaaaataagtgcagttttgcactattcacgttcaacgtttcaccgttcgtcttatttgaaaattttttatgattagtattttacttgctattagatgataaaacatgaatagtactttatgtgtgactaaatatttttaaataagacggacggtcaaatgttgggcacggatatccacggctgcacttattttgggacggaggtagtacttttgagtaaagcaatactaggaatatatgcatgcacggacacagaaaggacaacacttcagtcatttctggcagaaagatgcaaagggactgattaaagcgttgcatctacattgccatgatctagtcccataaaccataaaccattggttgaaaagtgtagtgtatttgcacttctattaaatttgaagaagatagtattgcttgaaaggggagcatctgagtaagcaagaaaagtttgtggaacaggcaaatctatatcaaaccagcagcatacagctagtaccttgcaccattgtcacctaggccatgaagccacacaatggtggcttggtgccttccctttggcctcaccacataggtcctcccgtactcaactctctgaccaccccgtccacctgaatcaccatttaaatcgtgctcagaattgttcttttgcagctatatagattattataatgggcaaataagttttcgagaaaaaaatgtataatggagtagacagattaccagaagaactgcttccatagtaactcatgatgttttctgcagcaagtctgtactgatgctactcagctatagtactatactactatttctgtatgatgtgcactgaacgtccgaacgtatggaagggtatgaagagcacagccccagttggcatgtatttatagtgaaggttatctgaagagggaatattatatgtgtgtgtgtgtgtgtgttggacactcctttgaatctgcatctcaggacagtgcggttttccgcagcaaagctgtcataggaggagcatctggagtctggaatactcaagggatggtagggtaaaaaagattgaagccctttgctctagagtgaagaatcctgtacaatgcttacagccttgcacacagagatacacacacagtgacagtgacggtgacgatgaaagtgatgcctaaacatatcatgcaagcaaactaaggccaaggaggaaccatataatacataaatgctgtttcatgtcccttttttcccttattttttgtctgccaagcatatatccgcttgtaggatggagtactaatgcccactgcattctgcccacaaattgttgcaactccatatgggaaaactttaaataaaatggcaaggaataagcataacggaacaaattgtccagtcattgagctttcttttcacatcatacttaccagttactgctagatggaacttcagatgttcttgctggaagtacaatttcaaaaagacggagtacaaattctgattttggtatttcaagtttttttatgcagatgacaaagcagaaagaatttttttttcctggaatgtgcaaaagaactgtgcgccttgcattaattttaggagaaagcaaagcaaaaggaattgtatgccacaacttgttttggcataccatcaagatatagtgaagagtccagaaaggatgattacattggtagaaatatctatcaagtgtcgacaccaaatcaacatggatatgggaaccaaatcagacacaagtgcaattacacttgcagattgcctcataaacgtggtgcaatcttcatgaaggtacagatgcttgcaacagaaacatgacatattgttgctacaattacgtcaactgttaactgtagccattcaattagttaaagggtcatatcaaactagacagtagtttgccataacatttagctgttgttgactttatgcaacacaagttttaattttcttttagactggaaattgtctcaaccttgatgcaataattctagtgaaatttatcctgtttacactgttgactatgcgaatgttactaaataaataggacaactacagcctttttttttacctttgatgagctagctttatcttaccctagatttgcttgccaagaaaggtggacaactttaccaatatgcctcagaaatggagctgagttgatccaccctcaacaataaagattaaagatgaaccaaaagtcaaataaaaactgaccttgaatgaaattttggtaattcggtagcagaatgatgcaaaaggtctgcatatcttctttcagagaaaaaaaggttcacatctggtttttccatgtgttagcccactacacacaggaaggatcatattctgttctcctttttattttctaatgattggtacaggtaatgtggggggcagcccaagccagaatatgtgatttatatgtcattcttgtctctcttagcaccagaggtttgagtctacagtgagcaagaatgaggatgggacattagccacctgatctcactttttctcacactggaaattatagactatgattttgttgtgccctagtactataagcctgcatattcctccctacgcacatcattaattttctttattgcacatgttcctgtgaagagttaagttttctgtgaagtcagaaaaatattctaaaaaggccatggagaagatattggatttgtcattactaaaacatataattaaggaagatatgaccacaggaaaagatatattcttctttaaatgttctctattctgtccatggttaaccaagttcttattcatcagtattctcattccagtccatttctgctgctaaaaggatgaaacacaagggcagtgacaatatgataaattgatatatgcctgtagtgatgtagtataatgcgattaccgatacacaaggaattcttgtgattgcaattccttgcaagcaaattgctgattgcagatgccgcctgaatcagctcccaccagagccaaatcactgaataaaacaggaaaaatattacctttggccaaaccactgaatagtggatacaacaggcaaaatattactcacagtaataagaagtctacatcaaggcttaacagaagtcaacttccaggatgcaagagggaatgttgcaacatgaaagatccacggccaccattagacgaggaattatgccttataaagtactggggcattatgcatgcttctaattacattgcttgatcgcccagaaattcttcagtaaaatctcctctcatttctatttcatactttattgagagaatcctttctactcatactgttgatagttcatgagctaatactttcttctagagtgttttcctatatacatgctctcctattctcttttaacttttagacttataaaaattactttgggcgagagaaaatataagaaaggcaaagtgaagttgacatcactaagtgcagaatttatcctattatcactttatcaaccttaggcaatccaaaacaaagcgaatatttattttcctatgtgtttgaagttgtgcgataggacatatataatcagttgatggtaggaaaaatgagttataagttgcatcatgtctataggcttaaagaatcgaacctgaacttttcgacatatgatctcccatagatcaaccggaatttcttttgattgcccagccattttctatttctaatgtggtagccagtaatcatagtatttgttctcatcaggaaaaggaaaagagaaagctatggtgattagttcggcgatcgatcgattgcaaaagtatttccttaaatcaatgatactaaaaatttttgtttcacactaatataaaattttaaatattggtgactaaatcatatattggaaaccatgaaatgtcaacaaatgtcaagtaaaaagagtatctatcaaaattcaaggtgttacaaagcatactaaaggttaatatatagtagaagaaccagatcattattgcctagatgtggcctataaatgtagagtaactagtttgtaaatgtcaatgcataccttcaaaattcaaacagtggaaggctcggaaagaacatccaacagtctataatgtggggtctggtttatctagctttcacatagacaaaaaggcatcggacataaccagaccatctctagttttttttttctagtacattcaacactaaaacgcagagagtctagagtctaatagaagtgaatatggatatttagtcggcgcgcaaaaggaaacagcaatgaacaaataaagcatagccatctttaaaagaagaaagaaatggcaaagctaaacaaaagtacacgagtaaagtatctgggaagtaaacatagctagcattgcgcttgatttgggacaatcaatttagcaggacatttaacagtgattgctatataagtagactttgtttctctttttccatctagttaagatcaaaagactgcctgctgacccaacgcaatcaggagcctttgaggagtcgcaactcacaactaagcagaagcatcaggattctctctgacacagagtattaatggtctaaaaatactacgtaacaatatagcaaccacaaggataaagaagctgtgcacaggcttccgcaggcagtcagtccgcccagttgattcagtccatagctcaggttcacaatcaccttctgcctgccaaatcaagaaacgatctcagtacatggaattgtaaaactgacaaacaagaatacatggaggcagcatcgagacattaagccctagtatccaagggaaaaggaaagtgttcagctaacaagaactacaatgtatttctttatgagcttgcaagtgaaaggctgatgatatccaccactgaagactacttaggatttagtcataacaatgttacctcttttcctgactttcaactataaagcccacctatatctaaacatgccaattaagcatgcaaatcataagattcttatattattgaaagggaacactccaaaacacacaattgaacaaactgaatcatataatcttccctcagttgtgcatgtgactttcctctggtaaatgtggtacggtgtgagccagaccgtaggaatttacatcacaaaacaaatgaaaatataacatataagtaaaattgaagaagtttcgaggtggatatacactatcagtctatcaccatgaatcagtttctgtacttgccccaaaaacaattcacacagcaataaagagaagtgatacattgacagttttattttatcagaaaaaaatgaaggtgttaaaatagtaactaaagtaaatcaattgaactacttaagtcaagcaggtggaacatacctgtaactagttaattttagggcttaagtagtactgcggatctctgaagaacctgacaattgtctctgccttatccgtggaaaggtcagtgttttctagaataaatttcttggatgcttttgcaattgcttcaatagacccaatagcttgggcaagcttgaaaatcaagtgtgacatcaatatcagcatggcattatatgaacagtaaaatgttatctcatgttaagcatgaggattgaccatatatatctactgggtaggctataggagaaaaggaataaatgctaacagattagtacataaatatatcaggaatagaaaacgatcaattctcatcatgaaaagttccaaaaggtcagcactttgcatggagaaggtccaataactgtgtttaagctcagttataccctgaattagctgtggagtaatgctaagcttatcctttagaacgatttagtagaatgagtacacaaagatggtacttatatatgcaaacaatgtctctaatacattttccctaaagaaagaactatcaattaagtatgcggacttataattaacatttttatgcaagcaagcaaaagaccatctggtcatacataaggctaaaataattgagtgcataccgcattggcgtcatgattgtcaataccaggaatagaggtgagcacacgtagaaaggaatcagtgcactgaactgcttgctcccgctacagacaagcaggaaatcattaggctccatttcaattatagaccaagaaatagagcactgtgtatctggaaacatgtgaaagcacctcattcttcagtcttgagataatgtcttgctgcttgcatactgaataagaaaggagtgtcgatcaatgtcagcttacaattcagaatttgaataggactgagagaattgctaaatgaagtttgagatttacctccaagtgcatgagctatcttcacgattttctcgaaccccatctccggatcagtaacaggcacaaacgtaggaaagccaagcttcataccataccttgaataagaaatacatgaaaatcaatagctcaactaaaatattctggcattaacattatgataggtgcatacttgtgatatgatcgattaaatgattcgttttgctcttttgtaggaacagcaacaacaacatatagatgttttaactgcctcttcagcatattcaccctgaaaaggcatatcgaaactgaagtcattatcatagtcgttagggtggattggaataggagtctcgcacctgctaaagacagcaccttcattttgacaatcccagtttgtctcaaagataaatgcaacagatagctccccattgttgaatataaagtcctgggaaacacttgctcaggttacagaaaggcgccacagaaacagttgtgtgacgttgaagcaggaagaggtgcttacaggagatattgacaggaagtttaggcggtatgagtttgcagctaagaatgcagcaataaagttgatgaggcttggctgttgtttatccctccatgaagtgctcattgcgcatactccacgacctgcaggacggtgcccaaaaccccaaatagagtaaccaaaaatgtgctcagtgtaggataagctaaaagcagcctgctgcttctttgcttcaggcttcctgtactggtctaacattggagattccatatgaaagaattctagagtgcaaactgaatttctaagtgctcctgagtcctaacatactgaaattgaacagcagagtactgcagactgattggtttaaatgaaataggacatgaacatgaacatgccattagcaagtaagacgtgtccacaagtagcaacaggctggtgcttccggaaacaagcagccattcctagaactagaagtaagaaatgccgaaattgaacaggtgaacactgcaaagtgacggccttagctccttaagtaggagatgaacatggccacgcgcccatgccatataagcaagtaaaacatatccacaagcagcactagcctgatgcttccagagaggcagccattcctagaactagtaggattgagaaatgtaactcgtaccgtactgaactcatgattttgcgacattgcgggcttgattgatccagtatggggcgatgccctagcgcgtgcgtgagagggggagagagagagagcgagaggcgagggagtggatgacctggagcagcgggttcgggcggcggcggtgggaggcaggtccagccggtggagtgggtggagcgctccatcggatcggaggaggacggcgagacgaggcggcgccgcgacggggatcgagcggaagagccagccaactcgccgccggtttgccgtcgactcggctagtgcggtttcgcggcggcttttgctcgcgctgggcctcaagtgctagactgctacttcttccttgaggcctcgttttgttatgggccaaagcccggcacttcggcaaggatgggccagatgtttgaacccagggatttggtccgtttgaaaggaaatgaaaatgggccaaatttcctggatttgaacaaaactcttttcttgtgtgtgcgctggatttttcatcttttttgtccttttagaaaacttattttacagatatcttttttttaaaaaaaaacttattttagaaatggaccatttttcatggcatcaatgaattggcgtcatctctattgtccccggtgaaaactaagtcactaatataaagggaaaaggcgccaatgtataataagtttttcaaaaggtgaaaaatcgggagggggtgtaattgctgaatggctgttaaattattggcgcatttcatcaagtagtaagtatatattatattccccttatgtaagtattgcgtcatgtttgaacattgtttaatcgtgcttttccggtatttctgggcactgacagaaccatatggcgttgctttatatttctcttcttttcttttcggactgaaaggatatcactgagtttgaagcctgatcgtgtcgtgtaattctgcactgtacctcaatttggcgagttaattctagtattgatcatctgtaagctaacggttgggcaaatgaagagcagcacgcaccgtgaaaaatgatgatgcagctacatggtagtatctcttttgagcttcacgccgtggagactagttataattcagctccaatgatgctgcccccgcgaggcacatggcgaattcgcccaacggccggccaaacaacaccatcagtaaaatctttttttaagaggctcgctagctagcggcagctaacaaaatgatcaaccacaaagcgaagcgactgaagaagtcttcttaagtttcagtttcagtttcagggcgtccagttgcgtgcgtgctactgaaacaaccacgagttcagaccacggtttacatcaccagtttaccactaaattttgagccccatcaatatcacgatttttgataaattttgatcggttttcgataaatttcaactgaatttcgatcaaatctattgtttaacctttaaaatttcaatcgaaacttaatttcgagtcgtgtcaaaacatcgaaatttcacgaaattcgaccggttttcatcggaactgtgaacctgattcagacttgagagttcagacatcgacacggctggctactgaatgatagtatatagtagtagtagtacttacatatccgtggcgaatgcgatcgattgaaaactgaatttgagaggccattattcagagagaaaaaaaaaagggtgagcagcagcatttgctcctatcctaatcggtcaccatgattgcccgatggagcgggcatcatgacatgagccggcttcagtactccgaaaaggatatcagggtaaaggactgattaaaaagcgacaacgtacacaagcatgcatgtccaagtagtagtagtattagtttgaactagagaaagagcaagcaaagcgccgtcggggcggggcatcgtgttcgcagttgcaaatgttcagtgagatggggaggtatatgatgcatgtccattcgatccattgcttgtgatccacgtacaaatcgaatccgaggtgctcgcaattcgttcgtaaggcctcatcaattcggatcctcatgatcgaacgcaatgcgattccgagtgtcgatggcatgatgatactttgcttcctccttccgcgctccaattcgccttattactccctccgtcccacaatataagggattttgagtttttacttgcaacgtttgattattcgtcttattcaattttttattataaatataaaaaataaaaagttgtgtttaaagtactgtagatgataaagtacgtcataaataaaataaataataattttaaaaaaaattgaataagacgattggtcaaacgttgcaagcaaaaactcaaaatgcctaatattatgggacgaagggagtagcatttagcagtaattcctctctatgtctgtgtcggcggcggcgagtggtgactgctgagcccctaatccactgtaaactatcactagcaaaggacgctaatgtcagtcgatcacactgtttgaccagaaaataggagtactcagctttctttctgcatgctctgtttcttcgaggtttatgtcagtcgaagattcttcactgctactgctctcggtttctagtgtacagtagcagaagttccacgttaaaattgaaagtttaaagaaattagaacgatgcgacggaaaaattgaaaggttgtatgtgtaggaaagttcgatgtgatggaaagttggaaatttgaagaaaaaaaaattggaatctaaacaatgcctggattatttgaaactctcgaagggacgttcactcattgtttatatcattgtatgtcacttaaatagctatgaaaaaaatataaattaatatgtgatagatcacatgaacatttcataaatatacaagttactcattccgtctgtaaatataagggattttttgttggatatagtagtagtagtatatcatatgaatgaatgtggacaattcaatcaaaatctcttatatttagggacggaaggagtataatttaacttctatatgttacagtgaaaaaaaacaaattttattataaatatacgtttaactaacttagtttaatatgtttccttttacaacttacgaaagtgaattttaagttacatgggaagtgtataaatgtaaatatatcttgttatttcttaaaaaaaatcttgagagtttaaaattcctactacgtagaagtagacagcagtggaggccagaaagagaagatctgggccgtttattttaggcgatacggacggaagcaggacgtgtcccatctggcacggcacggtacaatcctccaattcccattcccattcccattcccaatcccaagcataaataaaaccaaaactccctcttcatattcccacccatgactccgactccgacactgacccatgcccatggccgcgctccgcctcctgcttctcgcgctcgccgtcgcctgctgcgccgttgccgagccgccgcagcaggagcgctcggctctgcgtgccttcctcgccggcacgccgcacgagcgggcgctcgcctggaacgcctccacgcccgcctgcgcctgggtgggcgtcacctgcgatgccgccaacgccaccgtcgtcgcgctccgcctccccggcgtcggcctcatcggccgcgtcccgcagggcactctcggcgcgctccgcggcctccgggtgctctccctccgatccaaccgcctcttcggcgacgtccccggcgacctcttctccctccccgacctccgctccctcttcctccagggcaacctcttctccggctccgtcccgcccgacgtcgccaagctcacggcgctccagcacctcgcgctctcgcacaacaacctcaccggcgccatccccttcgcgctcaacggcctcgccaacctccgctcgctccgcctggacggcaaccgcttctccggcagcctcccgagcttgactctcccgctcctcgaggacttcaacgtctcctacaaccagctcaacggctccatccccgcctcgctcgcgcgcttcccgcctgagtcctttgccggcaacctccagctctgcggcaagcccctgagccgcccatgcgagcccttcttcccgtctcctgctggcgcgccgacgccgacggatggacgaggcagcggaggcggttccgtgccagtgtccgagaagaagaagaagaagctgtccggcgcggcggtcgcggccattgccgtgggcggcggggcggcggcactgctggccctggtgctactcgtggtctgcaccgcggcctcccggcgccgcgcggcgaacggcgaggtcgggaaaacagcggcggcgaggggcctgacgccgccgtcgacggcgtcgggggagctgggcgaggtgacgtcgtcgacgtcgaaggagatcgctctggcggcggcggcggcgacggcggagaggagccggctggtgttcgtggggaagggggcggcgtacagcttcgacctggaggagctcctgcgggcgtcggcggaggtgctggggaaggggagcgtggggacgtcgtacaaggcggtgctggaggagggcgccacggtggtggtgaagcgcctcaaggaggtggcggcgtcgcggcgagaattctcggcgcacctcgactcgctgggcaaggtggaccaccgcaacctcctccccgtccgaggctactacttctccaaggacgagaagctcctcgtctgcgactacctccccgccggcagcctctccgccacgctccacggtcagtcgctctaaccactcctccattcgaccggaattcgcgcggtttttgcttgcaagtacgcgcccaactccagtccaactaaaacgctaggaattgtcgctgcatatgcattgcagtatagtacgataaacagtgtgggtgtcatgctgtaaagcgaaagccattggggcacacctacacacacgacacactgactatgagtacgatacacgcaatgctaatctcatcaagcgagtgtcgtctgtgatttcaatttcgatcggagatgctgttgcgatatcaactacgaacaggtgaaaactgtagctactgaattcgtcggccaagtgcgtgctagtacttcagaatgcagtccagcaattgagcaaaattatcaagtacatttccacgcatgaaacattctctgtgttggcgattactgtttggagctacatattcagttattactactactttaacggtacagctactttggtacggggtttttctttagaatgtttcatggcatggaggtacgtatgtttgctctaacaaaagcaacagtacggcacatagtacatatcactgtagagtgtaggttaagcattgttttagacaacatcgtcgtttgatttgcatcaacatcactgcaaacttcctcagtagtaaaccttcagtctaattcaggaggtggttggtaggaggtgtaaggtgaattttgggtcaagctgtagataattagtcacagtgcaatccaatgattcgagatgctacaactacgagtagtcagcaaggggcatgtacaagagatgtggactctagcttctttccagcggcgcatgggcttgaggttccaaacctaggaaagtgattgagagggtagcgtttgcatttgaccagcgttcttcagattccaaatggcttatgtccaaatcatccgaaagggattgaaagataaatgtaaggttcagtacccatcttctgctatccatgatgccgccctgaattttaaaattttctgaacgactggccatgctagtttgtttctttcgattttatgcaagtagtagcaaaatttaattactgctgttcatcagttaccagagggcaactttgctttattttgggtatcactcaaatgtcaattgcctgtcacaagcgaagcatttagtaccaaatccttaattctgagatttctctgattgcttagttgttatattctttttcaataagtcaaggttttttattaactgtaaacgtcacatgttctgtcatacgcgtatgctaattactacctactacagcttatccagcatgttgatctttcatacaagcaacgtatgtagcatgcataatctgtgtgttttacatcacaattgttatatttagaagtccacgaacacgtacggcatagttttttgcttcttaatttcgaaagagaatccattatttctctaacttttttttttgctgggctttctctaaccaatctctcattctctctaccaactcgaccaacctgagtacaggttttgtattctggtttcaataatagaagatgcttgccttcttgctgtccagtagtagtgcctaccaaaaaaaatcaggtttactactctgtagtgtatgcaccaatggaaacaaaattggaggcgcgattctgtatcactaataattcagccgatagagacaggctcatgcgatctttatcccgtttaagaactgtcttttcatcacttcacttgtaaaactagcatgtagaaatcacagaaatgataaaaattttcatgcaaaactaattgtagcataattgtaaattgtacttgtttatgttcataatgaaaagtgtgcgcgtccgtattgtgttaaaacaacactcccttcttcccacaatataagatgctcactcatttcaagatttcagatttaaaacattttgaccaacatttaatacaacatttagttttactgtgcattgctttgctgctctgtgttttgtggctggaaatggctgacagtgaattgacctcagggagccggggcaccgggaggaggacgatggactgggacgcgcggatgcgcgccgcgctgtcggccgcgcgcggcgtggcgcacttgcacgccgcgcacagcctcgcccacggcaacctcaagtcgtccaacctcctgctccgcccggaccccgacgccaccgcgctctccgactactgcctccaccagctcttcgccccgctgtcggcgcgccccaacgccggcgggtaccgggcgccggagctggtggacgcgcggcggccgacgttcaagtccgacgtgtactcgctgggggtgctgttcctggagctcctcaccggcaagtcacccgggaacgcgtccgtggacggcgacggagcggtggacctcccgcggtgggtgcagtcggtggtgcgggaggagtggaccgcggaggtgttcgacgtggagctggtgcggctcggcgggagcgcggaggaggagatggtggcgctgctgcaggtggccatggcgtgcgtcgccaccgcgccggacgcccgcccggacaccgccgacgtggtcaagatgatagaggagatcggcagcggccacgggcggacaacgacggaggagagcgaggaccggtcgagggggacgccgccggcaggcacgacgccgtgaacactctactctctctactggtgtcgtaatgcagcagcacatgtcagggtaaattgatgcatgaacagcttcgttcgttcgttcgtggcgaagttctctcactctgtttttttttttgtcctccatttcttcagtttatagcctctcttgacttgatctagtaattcttccattgtttcgtcgatcaaatgagttgttactacctgttcgttcctcttcagccaagtgtaatttttcagtccgtatctactaccaccattgtagctcttcgtatatgcatcttcattttgatgctgtgaagtatatgtaggagtatgacacatgaataaacagaaaacctgtgaagttctgtaccatttgacaaagctgggcgctacctgaatctgaagacccaagaaaaagacaaacatgcattgaggctcatgctgtatcgcaaaaaaatcaggaaaaaaacaatccatctcatccagaaagaaaaaaacgtgccctcagccttgttgacacgaagtactagtagtacgtacagtaggttgtttgattggagtcagcacgtcagaatgtgggatgtcatcttgctgaagaatctgcatttttgcagctgtggatgtcccagcagaagtaacatcgtcaggttagatttacaggtgctctgctccaaccctcgctatccgggccagaagggggaggctgcggcctgcgggcgagtaggccgtagtgaattgggcttttgtaagttgggcctttgcggtgcgcgcgcgagtgggccgcggccttttgacttgttcctccaactccaactccaactaaatcggtggaacctttcgtcgcgcgggcgcggcggcatgcgcgcgctaatcttcatctcctcgtgaatcaccactgcagctgcagctaatagtagtaaattccatccatggccgtcgcctacactagtgaccaccggcaccaccaccaccaccacgacgtcgtgggcaggctgagcagcctcgtcgccttgtgcggccgcggcctctcgcgcgtcagccgccgcctcctcctcctcgaccgccgctgctacggtggcgggaggtccgcgccggccaagcaggacggcggcggcggcgaggccatctggcagcggacgatcctgatgggggagcggtgccagccactggacttcgacggcgccgtccactacgacagcttcggccgccgcatggccgccccgcgatccgcctcctccctctcctcttgctgctcctccgatagcctcggcgccgccacctccgaggcaagctacatcacctccacctccacttgtgacgatggcgtactctgaatgtatcaccatgccatgcatctagctctagcttcatgcgtttaattgccttcaattagtatttttgtcaccgatgatatattctgcattagttgctttatacatgtgcatgcaccgtacccttcagtttaattagcctccctcatgcattacaagagcgaggccgccccagctcatccaaagcttaacaacctactccctcgatccatttctaaatatttaacgtagttgatttttttaaatatgtttgatcgttcgtcttattaaaaaatttaagtaattattatttttttttcttatcatttggttcatcgttaaatatacttatatgtatgtatatagttttacatattttatataagtttttgaataagacgaacagtcaaacatgtgtatcgatctcattgcatttgggggccttttgctcacatatacctgcctcttgcatagttggatatgtacacacacaaagaagctgcctgcatgcacgggcgaattcagtgggtccaaacagaagagcagctgcattgcctgcatccatgatccatatccatccaacagatcgattataacccgtcacagttacatgcacgcgcgcgtggtgcgtgcagatccaagcatgcgtacgttgtgatactgcatgtgtgatgtgcatatatgctgcatggtttgtgttagcttcgatcttgtggttctttgcatggcaagatatatagcatatgtagctacacagcggaggagtcgccgtccttgggcagctcgagggcgcccttgttcttggccgtcgacccgtcgtagtagcagaagtagaggatcaactgcgccgcgcccagcagcgtccccatgccgttcggtatctatttatttattaattatgatacattaatatatagtactattagctagaattactctatgattataataacaactatactacttactgatcctagtaattatttatgagataattgaaagcatatatatatatatgcatgcataatatgtataccgtgatgaggatgtcaaagcggatgaacgcgtatattgtccagcatatgccgttgatgaagctcaccagcgacaacgtgaagggcatgtactccacgctctttgtcgcgatcacttgtttctacattcattccatgtagtaattacatcattttgccaccaacacatataaatcaaataattaatcatcagatcagattcatgcaaaaaattaataatc

SEQ ID NO: 37292 - DNA, 3850 bp, Oryza sativa
tatatatatatatatatatatatatatatatatatatatgaagcatctacaagcaggttcaattcgagacgacgtaccgatgattccaacgacattgcggacggcgtcagggttcatcaccatcttgcctgctcctctttgctgctacttttcgatattttctcaggcgaatagatgggagtatgtattagtacagtggcagctagcgagagcgtgtagctgatagcaactaatcaaccagcaagagattaattaactgtcaggccagcaactgtaacctgatcaaatagttaacttagcagctagctagctagtgtgctgctaagttaaaattgggggttaaattaaatatataaaatgcgtggattttatttccactgattaaaatggcggcctctgccctccaattcctccccccttaatcttacgagagtcggaataatggagaggcagagcacggattcagattggccatggccgcccttatatacacgacctatggctaaaaaaaaacacatacaattaacctgattaattaaagtggtgctagctagcttgaggtgcagagacaatctagctagttttggcttaattacgtggggccaaaaaatggacaagccagggtggagagcttactggagctccgaaatgcatgcacagccgtctgctcagttttactcttttccgtcacaaaataaattaattttgccatgtctatagcattttccaaaataatcatccaaaacagtctggatagtagactgtaaaaccagaaattgacaaaaccaagtctattactcgctcattaccgcctctctaagaggatctaggacgccataagcacatgatcgcagctacataacaaaccaatagagttgacgaactgtacaacaatgtagcagtggtgggtgaaaaccacctccgtgcaaaacatgccaaagaaagtactcaagtcgatgattatcctagtctcctgggagttgtgaaaggagattaactcttttccctcttttgttagggccgactctaactctcaaatgatgtacatatttgaggatctcctaactctatcaatataaaagataattcttttgccttctttttcaaacaaataaatcaaaataaatatgtttgtaccactcaagttctctaccgctcgtctcaactaactacaaccattttacatttaatttttcacttactttcttttatcaaccaaacatcaatttgtacctagcttttaatatccgtatatagcttcaagatacttatattttaaaatggagggaactgtactcacaaattaataattattggtcatttgactgacacgtggcacgcaattggcgttagataggcatccgtaccgatccgatccgaattattaaccgtacacttgcgggattgcaggagagcatgcgatttgcatggcaagtgaagtgattgatgatggttcgaggttttgcttgcattggcatgccgatagcatgaataacgttcgatccatcaaacaatacaccaagcattttgaaagcacgggctttcttcttagccgattcagcccaacgcgttggtgcggttagttagtttcagttgggctgatttccaaattctgatgggccgatcgagttggacccgatgaatagtaagtttacctcgtgtccctcaactttacaccaagtttgtttgacatccattatcctcaataccagaaatattcacccctaaactatactccctccgtccctaaatatttggggccattgactttttaaagcatgtttgactgttcgtatacataaatgtttaaaacttttgtgaaatatgtaaaactatacgtatacataaatgtatatttaagaagaaaaggaattaataattacttaaattttttttgaataagatgaatggtcaaacatgtttaaaagagtcaacgggacggagagagtatacaaaaccggataatctgatttcgttgacgtggcaccctaccagccacattagcacggcccaccccctctccctctccccagcaattggactcggatcgccgcctcataaccgcatccgactcatgagagcgttgcagcgttatatatgtaggatggacgttacgatcgatgtgatacgtgtatccaaatagcggtagcgaattgaaggaagatatatcgatcggttgaaagtgatgatggacgatgtgatgagcgagatcctgctccgtctgccgtccaagtcggtggtccggtaccgcgccgtctgccggagttggcggcggatcacaagctgcccctacttcctggccgcccgagatgctggtgggatcctgcgacggcctcctggtgctggagcaggaccacggcctgtacggatgctggtacactgtagcatttggacggctaggttcgtgtgtgtagaggagagggatgatgtgatggtggtgtgcgagtccgcccatgacaagaaacttaatacccaacatgctgctggcctttaccatctccgtgacaacaagtttttggagcccgcacttgatcttggggaatgctccctctcagagtttcggttcaaggaaaagcctcgtccgacatgccttcttcgacttgccccgctctcccgacttcaaattcatacccttcgatctaccccccccaccaatttccccttttctcacatataattataggccctatttagatcccctggcaaaattctacacgctgtcagatcggatatttggacacatgcatggagtattaaatatagacgaaaaaataactaattacacagattgcgtgtaaattgcgagacaaatcttttaagtctaattgcgccatgatttgacaatatggtgctacagtaaacatttgctaataccggattaattaggcttaataaattcgtgtcgcggtttacaggcggattcattattagactacgtttaatactttaaatgtgtgtccgtatattcgatgtgacacatcaaaacttgacacctctggatctaatcacagccatatatcatgatgcaacactgtaaatatatatatattgatgatgaatggaatgcctggagataagggatgtggggctctgttttcgtctgtttcacaagctatatgaaaacttagaggcatctgctttttatttttctgaaataatttatgtgtcacaatacatcacgccatgtacattcactagatctatagaggggggggggggggggtgtatgtacagatttacaaagttacagggtttggagaactagcccaaaaggatcaatttacagggctttggccaagtccgctactcaggttgagaagatagagagttactacaggagagcgggaggttgcagagctctctgcctaggcagaacctctccctagggctggttatgctgtgtcctgcttctccatgaaaatttctgcttccctccagatatcctcaaatagctgttgtgccgtgcacattttgtgttgaaagatccttgcaaatctatagccttctgcagggctgcatataactacatgttcaattatgagcttgattccctgagccaggctgagaaaaactcggtggaccgttctccaaagcgcgttttttcctgtaaaagacatctataatgtcgaaatagctggaaccaataaggaattctaatcattctgtcaaaggatccttaccttctctgaaaatggttctgtttcatttttccagtgtcaccatgggactcacaacctccttttgcttcctcacgaccttgcttcggcaactcaattgatgtctgaattggaatatcgcaacaagggaaaaaaagacacatgcaacagttgtgaatatctggggctgcagg

SEQ ID NO: 37293 - DNA, 5234 bp, Oryza sativa
aaaaaaagacacatgcaacagttgtgaatatctgataaattcagtgaaacgcagaggaaatgtatttcttttgcgaggtggaaaaaggggaaatgcatgacaccaatatttcacatttgcacacatgacacatctcatggctaagcatgcatgactaaacacgttctcaacaactagatgaaagtgggcgtgcttagtagcttgctgctggtagtaggtaaagtttttagagtagaagacttacgcctcttgcattttgatgatgcaacagctctttggacgagtttgttcttcttgccggcaaagctgggtctttcaaaatgttaaatgttcttcttgacctctcttgccgctgaaggacagagctgtcttcacggcttggatatatcttgcaaatctgaaagaagaaaagtgaattttaaacaaatgtctggaacgaactaatgaacaaagttaccaagaaaagctaaaccgcacttccaatttaccattgcacaaaggaattcagttacctgcttgataacacgatcgataagcttatccaaagtaaatagtacgtaggagttgggcccaagaaatttcaagcagtgctgctcaaagttccaattgtcagtagacccatcaatcaggctgcagagtttctccttgaaactacaccattcaataaaataaaaagttgttgttaaaacacagatattcaatggtgaaatttgaataattctacttatagataataggtgagaatcttagacgttactgtgcatatgaatcatgggtgcttgctccttctgaaagattcttagctactagtagtctctcgtacataacctgccacataaattaaaaataaaataagatcataatgccaataattaggtatagaggccaatagtttgtccagaagaaatatcatactgctgtctattagattaacaatcatggtgatgcatattgagcaagccgtctctttcatgtataacaaagtaagagcatacataaatatttttttgaaagtaagagcatacatatttgtgttgaactgtgtagcttgctgtcttgctcagtgctcactggcatattaaaagtcgccaatccaaacaaaaatatgtaataggaacatactgaaatacctggagaagccggcagagcacagccagagtgcaacaagatattcctctgtttgcatcacattctttagatgttcttccaaaatattctgaacttccaacctcattgttggagtcatctcttgatgatttatgctcttcagatccactccaatgtccataggtactatgcatagaattattggtaggcaaacatcgaacacgcaactgtatattttctacatctggtatgaactcaccctcctcaacctccgcgtcaaaatgatcaagcgaagaagtagactcattggacttggctcttagactttccacttcctgaatggaaaataaaaatcatgtagctttacttacatttatctttcaagtcacccaagttacttttttttttcgccgggacggcgaagaatgccgaccgatgtatattaaggaaaaggggaaaactgtacaaacacccaagttacttttacttgataaagatgagaaagtaagtgttcatcaattaactttcatgacagaagctatttatgcaaatccaaaacacgaaatcatcataattctaagagtaaagtgttgtaagtacatatacctttgaagaaaaaacaaactcattagtaagcacagcaacaggaatattattgagaaaatctctgctcatcccacaatgttcacaaacgtttctgcgagaaactgtatccttcaagtctggccattgaaacttcacagaaacaaatgcctttactaactttgtccaattcatcattggcttatcttcagtagaacaacttctactatatgcatagttaatgataacgcctacgtcctcatgaatgtgaatatcagtatgagatttgatccgactgatttgtttgtcttctgccagcaaagctgcaagagagatactgaaatgagtaagaacgaactaataaaatggtaaaatttccatgaattataacgcagaacctagcttcagcagtacataatagtaaaagtaccttttgggctcatcctttccatgtctagttgtttgaaggagggactacaatgatcaagtgatctgtagtaattattggcaacagtatctgggcacattttattcaaggataatcgtgcctcggagaaatctcctatcttctgatttagacgagaaagtataacagcaagagcagaactggtgttctcagattctgacaaagcatcaagcatgtcaatgccagaatcatcatatagctgttcaatgcacctcttatgtagagctgcacatgtaaaaacaaggaaaaaatgtaacactcagctaaccactcgaaaagttttggctccgaaaaatttacatagtacagtatacttacgagttaggtgttcttgaattttcacattgctgccaaaccgatattgaagatcctcaataaagtcagcagttgctctaaacctctgcaatagcatgtcactctcaaacctaaaaagtagtacacaacattcattgattatcagtgaccaggcaaatttttgctgatagctgaaagaatgaaaacagtgctgaagcatctgaaaaactaacatctgtgtacttacaagtcatcttcacacttaaacatgttttcttcatattgatttttagttctgaacttgtagcaatcctcacgtccagatgtaacagaaaccaaagaatcatttaaaatagaccttccaagttcagtttggtagcttgactggagagtcacacactgagatcaagaaagagaatgttagaacagatgccaatgatttacatggaaaacttgtgcgtttgtaggaatttacattctttggtagcaggcaatagctaggagtgcaatgcttgcaattactaggatccacttttaggggtaattcgttttctcgtgaggtactccactgaagcaaaggttcagccttgtgttcctcatcatcttctgcatgaggtgatttgtcatcacctatcataaatgattaaacataacttcaacacaaggggttcaattaaatatatacaaaatacaaaaacaagtggctagccacacaaaatgatactgcatttgtctgttgttacattgtatcatgtgcacatcaatagaaagaaactagataatataaaaaccaacacacctaactgttggaaaacagttgtactcagaagtcggaacatcatgctgtacaacatttgaattgaatggttcacaatagcggtcctcatagtttctttttaggataatttaggaagcacgaaagggtttaagaaccaatatattcaacttttaaccttttcatttaaaaaattctaaggtgcattcctcctagagactgtaaattgtaatttattatctagtaacttgcctccacgttcgctctcacggcctagaaattatcatattaatcggagaaaaagaaaaacaaagtccatatagaaatacaatttagagatagctgaaattcggaattaaaaaataaagaatattggaagagaagactacagtccatgccggtatacaatttagaactaataaaaattcggaattaaaaaaaagtaaattaaaattaggttagagtccatatagatatacaatttagaaataactaaaagtcggaattaaaaaagaatattgaaagaagagtatatagtccatatagaaatataatttagaaataaatacaatttagaaataactgaaatgaagaattaaaaaataaagaatattagaataagattatagagtccatataggaatttataattaactaaaattcggaataataataataataaaattaaaagtagagtttaaagtccatatagaaatacaatttacaaaaaactaaaattcataattaaaaaatatgggaagaagagtctagagtccatataggaatacaatttagaagcaactgaaattcaaaattaaaaaataaagaatattaaaagatgagtctagagtccacatagaaatacaattagaaataataaaattcagaattaaaaataaataatattggaagaagagcctagagtctatatatatactccttccgtttcacaatgtaagtcattctagcatttcccacattcatattgatattaacgaatctagatagatatatatgtctagattcattaacatcaatatgaatgagggaaatgctagaatgacttacattgtgaaatggaggaagtacaatttacaaataatgaaaattcggaattaaaaaataaggaataatattggaagacgaatctagagtctatatgggaatacaatttagaaataactaaaatttgatattaaaaataattaataactatcacgtatatacaatacaatatgaatgtactgttacacattggtagtttggttagtacaaaatttaaatttatgttgtcattttaataataaattgagaatatatttatactattatatgagagaaaatacaatgatgctagccgcgtaatctgcgcgggccaccatgctggtttcatatatgaaaataagctctagcaaatgtagcactcaattgctgagaaatttgatagtgacactccacgatgtgggcttcgattatttgacaccctggcacacttctattccctcaaatggtcacacatgtcatctcacaagagtcaattaaagcaaattggcgacgaagaaagtgtcaaattatcaaatttctctcaattgctagggcatacttcgaaataacatctgataccatgaaataggtgaatgcaaagatacgcaaatcatttgtgcattctctagcaaaaaggaaaacagttgggcatgtatgactgttattaagaaagggttcattatttgtgtctaacttcattatttcctgagaaggatgttaaagcaaagcacctagggctcgcctgtatttggagaataaacaaattaagagaaaactttcacacaccttgctttctaggattttcaatcaggccagtggttctcttagtttgtttatgcctcaaactataacctctgccttcatggttttggttttggtcctgagtatacttcaatggagtcgcttggtttcttccattggttgcttttactcggagaccatccaatttattcatagcatctagag

SEQ ID NO: 37294 - DNA, 9980 bp, Oryza sativa
ttatgcgaagcatgtaatgtatacctcgctgactcgactactctttggacttgtgcaagatttctcatttggcagatgagcccttaggtggtgaggcacaaaaattttgaactcttctaggaactcgggatagttacctatgattctctcaacctgcaagtaaatcattgtgaaatcagggcctttgcaattattttgtcaagccattattgaagaatgaacaccttttcgagaacttcttcgctggtcttgatttcgttcttataatatttagcaagaacgttcagcaaagcatggaaatcttcgcggctgatatcaggacatgcctgcaggtataaggtcaagttaacaacaattggtaccaaacgagcacccacaccacacaaggagggagcaagcaaagcgggtttctttgggcaccttcactctctcaacgaaattgtgtgccttgctacgcatctttgctctgcaagggctatatccttggatgaagtgctcgaagacctgtatggcttcaggttggccgtccaatatctcgagaataatttctttgcatttttcaatcgacatgttcctgaattcaggatcaggattctttatcatcagtcatcaaaactcacagccgagtagatgagaggatatagtgattgatacctctgcctccttatcttgatcatagatcggacgaaatggctgtatacgtcgtcaggaagctctgacttgacaagtaccaaaaattccatcgtctcgactctgtagggatccctctccgtcctcgcccttttggacggaacgccatcgccaggatcaccggcggaagaatccattctatttctcctaattatttaggcgaacacctgcacaagagcagacagatgcaacaaatcagcaaagacctgcacgagaacagacgaatctacagtgacggcctcgtctaggcaaccaaaatctaccgccgctccggttatcccctcgcaaaaaaaccgaaaaaggaattcgattcaaccaagtcatcaatccgccgtaagggctgacgaaaccgaggcgattaggaggagtactctcgtgatctcggcgccttgattcgcgcacgcgagtggagggactgacctcaagtatgccggcggcggcggacgcctggaggaaggaggcgagcgacgagggcaccgagactccacaccttccggaaccttctagaacccccgcggcgcggccgcgcggccgagggaaagaagagagagagcgcgagggaagagatgaagagaaggaagacgcagagtatttaagtgggctggattggattggaaaccgagacgtttccttccggtttgaaataagttcattttgggtccctctatttgttgctcagtccgaatttcgtcctttgaccggggtatgacccatcccctaatttacgaaaaccgggcaaacgtggtccctcggcggttttggctgacgtggcacatacgcggtttgtttgactatatctccgtcccacatgacaatgacatggcgcttacgtggcaattatatcttataaaaataataaaaagcgtggccccacatgtcagctgcaaaaaaaattgaaatggtggggcccatgtgggccccacatgccagcctcactcctctcttcttccctctcccttctctctcttcttccctttcccctctctctctccttccgggcagaggacggcgcgggtgggcgtcggagcaagcgagctccggcggcggcggcgggcgtggtcggcgccgccccccgaccggagcgccgtctgtccgcgtgaaggcgagtagcgcggcgacgccctggaagacgccatcgacgccgccatccgtgtcgccgccaccgaccacccggacgccctccacgcgcgccgggacggcatcgccgagagcctctcaccgccgctccacaagccgcctacgccgcgctctcccctcccgacgccgtgctccgcctcctttcctccctcccctgcgcccccaattccttcatgctcaacaccacgctccgcgccctcgcctcctcccccggctcggcctccgccctcggctaggccaccctcggcttcttctccctcctccgccacgacagcggcaacagcagcggcggcggtggctcgtactcgcctcactccctcccgggcacgcgcgtatgggaaaggagaagaggaacgaaggagctagagccatgccgagctccctcctctcctgccggcgagctagaagggcggtggatggctaggcgagctcaaccggcgagcgcgcgtgcgtcgctccctcctctcccgccggcgccgctccctgtgcgtcagccatccgtgtgcggtccgtgcgaggcaccgctccgggcgtgtaggcttccgtgtgcctccttcctcgctcgccgtcgccctcacttcaactggtaagtgattcgctctgctccccgtgcgcgcgtggcttcgagttcgaggtggcgaatttgagttaactccggagctcttgaacttttgaaattggttcggattctgcgtgccttgttcttaatcgagtgtggtttcgatgtgcgcgtgtgtttctggacggaagttcggtgtattggaggaagggaattggtttgaactttgaactaacttggagttcctcggttggatttgagcatctgtgatgaagcagtggagaatcgcctcatgaattgcttgtctgtgtttgcattgcggtgatttgaaccttgctgctgtgatttcagtttggttattaggcgatcgcaacataacccagtgaagcagttctggtgctgctgtttcaatcctgccgccgccgcaccgcccgccgtgctggacgccgcccggcgagaggagggagcagagagatggggattggggagagccggagagaggaggaagaagaggattggattcggtcatttgagaatgacatatggggcccacgtgggccccaccatatttttttaagctgacatgtgggacccaccatttttaaattatttttcctgtggctgacatgtgggcccacgatttttattatttttccgacatataattgccacgtcagcgccacatcaatgccacgtgggatggataagccacgtaggcgccacgtcagccaaaaccgccgagggacctcgtttgcccggttttcaaaagttgggggtcgggtcgtaccgttttgcagttaaggtacgaaaatcggactaggcgacaaatagagggacccaaagtcttattccttccggtttctatcctcttgttgggccttgcgctcaatgccaggcggcccagttaaactacacgcatgacagcccatcacagtttggacatccagatgggccaaattggaatatagcgatccattcggcccatcatattgtaaggcccatcttatgtatactgaacagaagggaaagcccacgacgcaccggtactgagcaccgcagccacggcgccgccggctgctcgccggcgaagggagcagccacggcgccgcccaccaccgcctcgaaggccacctactgcactcgtcgaggtcttgtgtctcctcggccgacgagtggctagcgttctcaaggcggcctctctctcacagacacccattctcgctgcttcgtcgggctgtggtcaggtaatctccttccctcccgggtccgggtagtcggcctcttctagtttcaagagatgcttgttttgattggggatctatggcgctcttgacttgatccctgcgtacttgtgctgtgcggcagtggcaatgtcggatttggccatttggggattttcagggttcggctatcgtgccggcaatggggagggggattaacttgatgttttatcaattgatcttctgaatagtgattgatttgctaatactattacttcactggatagcggagataacactagttaaattctatagaaacgtgtcaggttctgtgcaatcttatgaatgaatccttcatgcctcgtcaatttatctcttgttaattaattgtaatatggtagcttctgagtaatactatcatattcaaatcactgttgacatcatagtagaatcgaaacctaaaaggattaatgatgttgcagaaattaagagttagctgtaactgcagctgttcttatatgtttttaacatggctgtattaattatgtatcatcgaaatgttttcgtaccctttcatgtcatgtccctgctatttatttagcattcgttagcaagtatatgtggccaatcatgctgatgaaatccgctaatgcgctgagaaacctacaaccatcaactagcgcaaaaaagggcatcatgccattgtgcattcttactgctccaccatcatttagtcaaaaaaactgctccaccatcatgtcactcaactagcacaatcacctttttctactatgtactttcattggactcttcttcacaggacaaacctgcatgtttaaattcacatgggatgcatgtgtagaaaggaccaaatgttgtattgtagcggggcttattttctgtatagtacaagttttgttttcaatcttcttatacatattacaagttactcaatttgcattggcattcaagtttagagttacatagttgaagcattgtcatcaggattttggttactgcagaagttcagaggactttatatgtcaatatgttttggttgctgcagaagttcagaggactttacatgcccaatgtacaagttgccgatgtgtctaatttgacagcaggaattacggtctacaagaaagataagatgaactgtatgctggatgcttatgtgtttaacaagtccttcaaggtacagagtacatcaattgaacctttggtttaaccttctaagtatgataaggagtgctaacaattatggatcagaacatttttgaatgataccagcgatttctagaagtaataactgctttgtggagccatttattgtacctgtctgttctgtgttttattaatactacatcagttttcgctgtgttgttgtttatccaacatttcaaagatgcatgcgatctgtagaaacactttggtttcacctttccttttggaaaaatagtagtcctgtcgcttgacttaatccccactaaggtgttataaggttgattgtggacctgtagtcaaacttcaaaggttacctgagaaaaacagaagttgtcttttactgaaaaaaagtacataatataaatgtcacttgacttctcctaatcttaagaaatttaaggtcagcgagtccttttagaaggtgattggtgacaccttctccacatatataacaatcagctgtttcctgtcttcctgagctacgataaacatttctcattgcagtgataggaactataaattgaatatgtaataaataacatatcgttgcgcatattacatctaaaaaaaatgctctctggttgtcatttatggtcaaaactgtaacaattttcgcaatgtttttataggcctcatttacacgaggaagtgcttgatcacgattagtttctataatcctatcttccctgatcaattgggttatgatgaattttacaccattgactgctcatatttatttatcttctgatttccattcttgttttcagccttggtctctccgggttcattcctctttgccttcagaaactcagcaagaacctgaagcgcgacatcgacatcatcattcctcattaggacctctgcaacctccgcaggcgttgtcagcacctcctcaatcagctgctcgatttctgggtacatggcatggttttcgacattgtggtagttgctagccagaactcggaaagcctctcgagtgcaataccccatgtggatgtgcatgtccatcctgccagggcgcagcagtgctgggtcaagccgctctctgtagtttgttgtgaagacgatgatcctctcctcgccgctggttgaccacagaccgtcgacaaagttgagcagtccagatagtgtcacctgttagaacaaaaatacccaaagtggcagcatcattggtaaggattaagttagttatcaaatcaagaagtggctgggattggcattgtctatcatactatatattcatgagacaatgattggttataaccaagtaactaaccttgtcttcgttttcttctcctgaataggtgggcttggcacgcttgatctctccttcgtcccgttgctgcaggtcgatggtgcagtcaatgtcttcaacgacgaggatggaccggttgctcatcccgacgagcagcctccggaggtcagagttggacttgacctcggtgagctcaagatcgtagatgtcaaacttgaggtagttggccatggcggcgatgaggctggacttgccggtgccaggtgggccgtagagcaggtaacccctcttccacgccctgccaatcctcctgtagtagtctttcctcttgacgaacctctcaagatcgtacatgacggagtgcttgaggctgtgatccatggcgagcgtgtcgaaggtggaggggtggcgcaggtcgacagcggtccaggcgtcgtactcgatcatgtgcatcttgaggttcctgtgcttgtcgttcatggccttggccgtgtcgatgacgaaggggaggtacgacctgagcgccttctccttgtgcttcttgtggaagctcacctcgaaggacttgacctcgaagcggctgcggcccctcctgttggcggcgccgccgccgccgatgccgtagggggcggcgtgggcggtggcggcggcggcggtgtcgcgggagacgaggcgccaggtgtactcgacgccgtcgtggacgtcgagcatctcctcgccctggtccatggtgatcatgatgccctgggcgtcgtcgacgcggctggcgcggaggcgctgcatgtcggtgttgatccgcgcggcgaggtaggtgcgggcggcgtcgtagatctggttggtggagagcccctccgtctcgtcgatgaccacggtgtgggtcgacgagacgcgcgcccggatgccccgcgccgccgaccggagcatctcgcgcagctcgtcggggaccagctcgctcaccacgccgcgcaccaccatggccgtcccggccacggccgccgccgtcgccatgtacttctcgtagtcgccggaccacgacatggctgactgccgtggatggacagaccgaccacctagtagctagtgggggaggagctcttcttcttcgtggtcgtgggcgctaggcgacgcagctaggcgggaccgcggctgatcggaggggcgtgaagtttacttgaatctagggcaccgttttgggtttgtgtaccgatctgtcacgtatttcttctacacggagtatttgtttttcttcctggacacgaaaaaaatagtgtatttgggtgcagaaggaagatctggatcccaagggtcaagtttgtagacgtgccgtattgtggtcacgtgtagaaacagaacctgtattcgaacttggagataccaacgacttgtgttgatagaccacggcccattgggcagaagaggcccggcgtgaaaccttttcaggccgaagcccattgctgttgatacttcatttatggcccaacaccgtccaaatgcactgcactgcatagccactgtcctcttcttcccccaatcccacaacctgatgcgggtggaggcgatggtggcgggtaatcccgtaataggaatactggtgagtttcttctctaacaacttttgcttcagtaatgacaacggttagttaatctatacattcggggagcccaatggtgaacgccagttcgaggatctgcgaaagtgattattctgtgtaaattctcatgctagtctatttcatctatttgttccaaatctaacacttaagagttaagagttcttctgtttgttccaaatctagcacttgagagatcagagttgtccacatctagtaacatttttcttttcccgttttcaccagatctgaattccatatgttttaaatgaaggtttcgtgtgtgccttggtggtttttgtctgggtgtgggttaatgtgaaatctaagaaatcaatggggaattgttccttttgaatagtcagatgtatttcaccctgttttctgaattagcttgcctggacaatgtttcgtacacaaacaaaatctgatgttgcatatgtatgacttgtcgagacaatactttaaatttcttaggaagcacacttcattaaataccagtgcacctcctatctccaaatacacattgtaattagtagtcaaaaaacgatcacatgttttgaaatggatcttccgttggacctatctagcatatacacattcttgttgtcattgttgtactccacaatcctaagtgcattcatcagttgaggagtcatttttgttctccatcgctttgctatctttattctcctccgtctgcttatttgcatccttgctttcagccttggtctcgctggcatcttttatctttgactttaggagctccagtagaccaaggagtgcaacatcaatatcatcatttctcatgagagcctcagcgacctccgcaggcgtcaccatcacctccttgatcagctcctcgatctctggatatgtgacatgatagtcgatcgagtggtagttgctggcaagaatccggaaagcctctggggtgcagtaccccatgtggatgtgcatgtccatcctgccaggccgcataagtgcttgatcaagacgctccttgtaattggtcgtgaaaacgatgatcctttcctctccacttgttgaccacagcccatcaacaaaattgagcagcccggataatgttacctgtgtggacggcaatcaaattcttatcagcataggtgagaataatcgtgaaatcaaggagatgaaaggtttgcaaatatgaatgttattatgcattctgattttaaaggtactcactttgtcttctcccttgtcttcttctgtagagttggacttggtacgttcctcccctgcctcccgttgtttcagttcgatgctacagtcaatgtcctcaacaacaagaatggaccggctggtcattccgactagaagccttctgagctccgagttggaatggaccccagtcagctcaagatcatatatgtcaaacttgagatgattcgccatggctgcaatcaagctggacttgccagtccctggtggaccatacagcaggtaacccctcttccatgccttgccaatcctcttgtagtaatcttttctcttgatgaacctatcaaggtcgtcaataattgactgtttcagcttctggtccatggcaagcgtgtcgaatgtggatgggtggtggagatcaattggagaccatgagtctgagtattcattcatgtatatctggagaattctttcctggtcttttatggccttggctgtagcaatgatgaatgggaggtatgatttcagggctttctccttgtgcttcctgtggaagctcagctcataggagcggacctcacgttggccgctgccattgccattgttggggtcagctgaaatgctacgtgagattaagcaccatttgaattctgttccctcatgcatatcaaccagctcttcaccttcctccatggtgacaaccatcttctcggaagattcatccatgctgctgactcgcaggcgctgcatgttgttgttgatgcgtgttgcaaggtaagcccgcaccgcgttgtagacgtggttgtgggaccagccctcagtctcctcgatgatgattgtgtgctgagatgaaatttgtgaacgcaggtagccgaggccggaaaacagcacatcacgcacctcgtatggaaccagctcgttcacgacgctgcggaccagcatcacagacgctgcaacggatgcagcggttgtgatggccttcttgtatgactcgatggccttgtcgtatgacgccatggtgagcaagctctggctcctctcttgttcttcttttgatgaacttctcttcctctttgttgctggtaatggtatgaaaca

SEQ ID NO: 37295 - DNA, 5678 bp, Oryza sativa
  unsure (1)..(5678): unsure at all n locations
ggtgttgatttgaggtagagtttgtggggagggggttttataggtgcagagttgggggcgaatggtggcttcgtctgaaagaaagaaatctgaatactactcctacttccagcttccacagttaggaaaatgacatcaccattacaacgtaatactcctacacatattcacctgggaaagaatgcaaccggtacaaattgtcgatttctgaggcatttgttcttaatctattgcacctttattcctcccagcgtatcttctttactgaagagaactttgaataatgatgttttaactgtcacgaattaagatctcaataaaccaaatactccttgggcagctagaaaaggcaaactttacttccttggcatccaagttttcctctgaaccattctttctgcagggagcagaagagttgtgcaccgcaagtttctgctcgaaatactggagcagaagaatgcccgcatcagtattccagaaaagaatgcccgcatccatctaccacctcgttggctgaatccattccatgtgcgcaaatcgcataccgttccgtgcagacgacggttggtcgacgtccgagtcagagactgtcgatcagcaactttataaaattctgaaaagttccagctgcatgcatataatggtccatttggggaaagtggggggcgttgctttggctttgccttgtctcggtctacgtcgccgacgtgttgagatcgacggaaccgagccccccatggttacaactgctgctgctgctacagctggtgatggattttggaccaaaggggtcaaattgttgatcgcgtagcggcggtggcaccaatcgacgtgttgctctgtggtttgtccggcgactccatggaccattttccttggtgatatcatcagtgagttgagtgggtgcttttattcgtttctgttggtgacagctactcgtattctatccttgtgtaaccgcctctctctgttctcttgtgctcttctgttgtgatggggaaattatctagtacatttaagttcatacagattcctcatgaaactattaaaaacttttgtgagctgtaaatgtattctgggcacacaagtttttcgtgcactcagctcttggggttatggccataagcagctcttgattcgttgatactccaagagggcctattgccaaggcatcgattggatcgtccagcaacgtgcacgttgcacatcacaaacaaattgattgctttcagatcgttgcgctaactgtattttactgatcatcatgcggcgcgcttgaatacaagggtcgacactgtgctgccatgatcaaaacactgtgttgtgttgttttcgggggcacaacgtgtgactgaacctgctaaagcaatcgtggtcgccacgtttaatttgcttttgcaggagagatcgaaacgtgaatgggactgcgtgttgcaatttaaagcagccataaaggaaaactcaattaattatctaaagtgtcaagacaaaataaacaacattttcccttttccctttgggtggtagcggcgccatcgacagaaagagcagaatctagcatgcacgttttttttattttccttttatttttttcctaaaaaacattttttgagcatgtgtggctggcacgttggtttctgatttcttcatcatcaagactgagtcactgacacgtgtgcacctatgcggtccacgtgtggtaatcgcttggatgatccggtacttgtttcaatcgcgtaaaatgaccattcctatttctccctaacaaattgcagtgccatatttaaggatgaaaatattttatgattaaccttacttgcagagtgcatctttggcttgacgcagtgtgattatctaaaagagatttcgcgagggaaaatgacaaaaaaaaagatgtttcgactttgtgaatcttaagatatgttaatacggtcttccaaagacacaggagtagagcgtgagtatgtgttcataaaagtaaatgtgcgtgcgtgattgtattgtattctattttttttaaaaaaaataaaatgatgtcagcaatggcgaagaaaacaagtagaccattttccaaaactgtaaaaaaaagagaaaaggaaaacaagtaggcttgcagatcctgcggtccagcccaagagaacgttagtgtgcgcggcctacctgcgcgtgtcggcctacttcggtctggctgagaaatagtaactgggccaacatgcgtgttgactagctcggcctggttggcgaagacgacggcccaaacgcggagagagatatcgaatattccgtggcccaccaaagccgacaacgaccgcagctcgcttgtcagacatcggggaaagcaatcaagcaagcagcggccgcatcgatcggagcggagaaattccccaactctgctcaccctcaccgttgccgacgacttcgtgcggcggcgaagaggagaggcgatgggagggggagacgccagcggcggcgacgggccggagcaggagctgaagcgggctgctgcggcggcgtacaactacgagggcgacgcgcgctgggcggagtactggtccaacatcctcgtcccccctcacctcgcctcccgccccgacgtcgtcgaccactacaagcgcaagttctaccagcgatacatcgtgagttccaccaccaccactgctttgcttcgcttctcccccctatcaacaactacttagggtaggggatctgacacgctttctgtacggacggttttagttcggggcttcgtccccttcgatttgtgtggtgatggcggtagccgtagctaatacccaagcttgcacttgctaatacatgatggtgtgttgatgacttttaagatggtaccaacgcagatgtgatgcttgctgctaaaccgcttgcttcatgtagctgagctgtgagcacaatctacactttgatgcattgcttgtttcaaccagggttttgttttcagttgatgatgaactcgatgctacaactactgttcagtactagttcatacctctctttaccaaacttcctaaggctaagggaggtttcaaatactttttaatcttgcttcatttcatgacgacgtagcttggcaagcttgcccttggtttcttttgttgaagcaatctatctccatgttaaaacgaaagctacatttgttaagcatcaaaccacagctttcttggcatttatcacagttagaaactcaaaaacaaaaacatgctatttgcattcggtcattttagaatctatgctgttacccatgtacaagtaaagagcaaatcaagatgatggtaaagctgtttgatttccttttgctttcctaataggatcgtgatttggtggttgagccgatgtcatccactggttccacccagccaagcggaccagaagtaaggtcttcgtccttctcatccagtgagaatgtcagggcccgtagttcaggtaagttgctttcagtttaagtatagtacatctctcgttttattctgtcgcgtgtcacatctatttatcatgtgactcattttcatatttaggatcaagttccagatcagctgcaccaccgcccccaccgccacaaacagacagtgctacaaatcccttacggtttgatgcacggaccatacacttctccattaatgcctgggtaagaaacaattcaccttcttcattcgagagaatctattctataccactgagtttgtttgggttcaacaatttgccatcgacattgtctctttctataatataccgacgactttatcaattgttctacgatacgccattgggctagatcttctttccaaaaatacccaaagtacccttagagccatacaaggttaacaattgatttatctcattagaagtttcaaagaaaaatgaaaacttttatgtggcctctttacacaacatggaagtttacgcggcctccttacacaacatggaagtttccagtttttttttttggtatatgagagagagtttactaatacaagagataatagcacaaaaatatcttatgtagtgtatgaaagatgatatataataaaaacaacaataaaaagtatttacaaagcatataacaaataattatattttctttttaaaaaatagacatgtaaaaaacttaaaacttgtatacaaatttccatgttgtgtaaggaggccacataaaagttttcatattttcttgaaacttctaatgagataaatcaattgttaaccttgtatgttcataagggtattttgggtatttttgaaaagaaggcccagcccaatggcgtgttgtagaacaattgataaagtcatcggtatattatagaaagcgacaatgtcgatggtaaatcgttgaactcgaacaaacttagtggtatagaatagattctctcttttcattagcatttgcatgtgtaattatttgtcctgaaaatagttggcacctttagtagtgagcttttaaaaatcaaacattatggtttctgatagatatctcatatattggtcctggtaaccttgatcttatgatcattattagctacagcctacatggccatgacaccctcatatattttcaggtacttgttgttgctggtctggggatgcttccaattttgccaaaacatcttgcagatagagcctgcaaactttcattgctgggaacaatactctcctctgcatactctctatacagcacttatggggtaatttccttgctacttgaagcacgaataactagcactatttttaatcttatttcttttttttttcgttgctgatctgttctttttttctgtgctaagaaaccaagagcatggaacatgcctgcagtccagggttggttgcaagctgtacttggaaccaaggattttatccatttgatgttctctcttatgctcttcacgtctcagttgcacttaaaaagtaatacgtggtttccctttcaagtttgtggttctgacctgtcttttgctcgtttcacatcttcttacatgttatgttatcctttttgtaacagttgctgcactacctgtgttctgctgggcacttgatcatgttgctagattcctaaggcgtaattttgctcgctcatccttctataggtaattgtgcgttccattatcattgaatttcgcctttgcaatctggggcacaaccagtgtgcattgctctgtgattaattccatctttccggtctctcattcaggagttacttggaggaaccctgtctttgggtagagacaaataacactacactcagtctcctcagttcaaatgctgagattgccttgggttttcttctgatcatatcacttttctcgtatgttccttcccctcctccgacaattttggattttcttttgtctggaaagtcatattgtatactcatatgagttacctttgtaccttgcaggtggcaacgtagcataattcannnnnnnnnnnnnnnnnnnnnnnnttatcatttgatcatcattattttgccccattgctttatagctacaacatgatgtaagggcgatttatgctggtttgttacatattatcaaaagattcaagaatgcccattgtcaattttgtttagtcacactttctagttggacatgaccacatgagtactggccagtcgtcagggcatgcatactgtttcagttctagaatcccaatatttttctgccgactccaca

SEQ ID NO: 37296 - DNA, 8581 bp, Oryza sativa
  unsure (1)..(8581): unsure at all n locations
tctctcattcaggagttacttggaggaaccctgtctttgggtagagacaaataacactacactcagtctcctcagttcaaatgctgagattgccttgggttttcttctgatcatatcacttttctcgtatgttccttcccctcctccgacaattttggattttcttttgtctggaaagtcatattgtatactcatatgagttacctttgtaccttgcaggtggcaacgtagcataattcannnnnnnnnnnnnnnnnnnnnnnnttatcatttgatcatcattattttgccccattgctttatagctacaacatgatgtaagggcgatttatgctggtttgttacatattatcaaaagattcaagaatgcccattgtcaattttgtttagtcacgactttctagttggacatgaccacatgagtactggccagtcgtcagggcatgcatactgtttcagttctagaatcccaatatttttctgccgactccacatacgagtatacagctagttaacatttcaattaataaccgcatttgtcttaatattacttttgatcattttgaaaataaaaaacagttgtgtcaaatatactggcgccctttccatttctcaagtaacttatattgatgtcagtacgtattggtgttctttgcatgcttgcctgttgtgcaggtgttgaagcagatgtaccatgctcctgtaaccgctagctaccaccagagcgcgtgggcgaaaattggccggattgtcaacccgtacatccatcgctatgcaccattcctcaatacacccatttctgcagcccaaagatggtggttcaggtagcaaggctgaggacagaatcacgatatttgcagatctgatcatgcggagaacttatctacaatgtgttttgaagagctattacaaacttagcacgccgttgctctcgtcatgatggagctgtgcatcataaaaactcctgcaagtagttcccttttgtattggcttatactttgaggttaacattgatgcaagaacggtgttataaaccctggagggctttttcaccaccgtaatgctcgatcagtgatcacgacgatgttctatataattcctgccaaactcaggctgacctgtatacaatggattgctcttagattgcatcatctattcatgagtggctatgaaatactccatccgtttcacaacgtaagttattttagcatttcccacattcgtattgatgttaatgaatctagacatatatatctatctagattcattaacatcaatataaatgtgggaaatgcttgaatgacttacattgtgaaacggaggaagtaatgagttgtgtttatctgttgtggcatatctttatgctctgttctacttctagccagggaccgagtgacggtcagaatgcacaacacaggcagggcaaccgtttcgcccttctcccctcagcctccaggggcaatgatctctctggagggaacacctgcatttcctacatgaaagagaggtcaaataatatcgaagaaatcacatgggtgcagaactgcattttgccacaaccagacaggcaggtagacaaaaccattacacggtcagagataaattttgggattttgtttgatgccagcaccgtttccattagaagacgatgaaagacaaaacaattacatgttcagagataaaatctggcattctgtttgttgctagcactgtttttgttacatgttcagagacagtttaagggggttgcagcacgttagaagttccgagacaattttgcagcaaaaaggaaaattttgctttaaagaaagttattagcacataagattgtctgcaaaaaggaaaattttgtttttaagaaagttattagcacataagatgtttagacaattttgcagcaaaaaaacaaaacatatgttgctgcccaggatcgaactggagaccttcagtgtgtaagactgacgtgataaccactacaccacagcaaccaagctgtctccataatgaagtttgtagttcaaatagatttagatccaaacatctgcaaatcggaatatctaacttccgaaactccatcgcaaacaggattgctcgtgcggaattcctctgtgacagacagtttttactcactattcttgaggaaaaggaaaggaaaatatctcgcgagaaaagatcccaactcgttttctttcaccctaagatctttctgcctgtccatgtccaaccaaagaagagtctgagactctgagttggatggatagggtccccaacccttcttcaccaatcaccacccccatctgctgccattgctgttgcaggccagctaacggaaggcccgggcgacatgggtttgcagatgatgcgtggtaggccctgcgccccgtgctgttcgtcctcctcctcctcctcctcctcttcctcctcgtcctggatgccctccaagcatcctcacgcgccatgtgagttaccttctgcatcttccttttctttccccccactgctatagtattccccaggcggaaaaaataacttattttttatgtaaaaatgcattggtactttgagcaatttgccagcggaatctaaagttccaaacttctaatgcagtgagtcgaaggaaaatctcatctgagtcacttagagcattggccttgcacctcttgcccaaacgtcggaaataccaaaatggggatatctcaaggatttcagcatcttcgtccggtgtgcttgaaatcaccgagaacaagtccaataacaaggtcctcacttaaatccgtaatccatgtacgactcatttttgtctgttgataatgattgcaacatgaatttcaggctgatgcagaaagaaagatccttgatgatgctcttgacagaaagccgcagattgactgggttgaagaagatatctcttcttggatggataagagttacacaagcagcaatttggagtataacttattaatgcaaaacattcaggtcttagaaagtagtttggctggtaaagacttggtaaggctggaaagagatatccttgtacatatcgaacggctgggagcattgaaatcattcaacgcgtctatctccagggccactctaacacaaacatatgaattagagttttcacttcctggggatattattaagcttgatccagagattcctctcgaggagcaaaatgatgtggtaattgttcgaagtgggaaaagtcaagagaggaaactgaaaagaatgaaagcatcagaaaagggctctcgggtctccgtgaaaacaccctcacgaaaatcaaagaagtccagtagtagtcaatttatagctgagtggaaaaactatccaggccgaagaaggagcattgtacgagaacaatcagcattgctggttactatcaaggtactcttcatcatcagcatatttattccttttagcagtcaatctattatattattaaaggaatagaaaaaggagcctccacgttcgctctcatggcctagaaattctcacattaatcggagaaaaagaaaagacagagttcatatagaaatacaatttagaaatagctaaaattaaaggaatagaaaaaggagcctccacgttcgctctcatggtctagaaattctcacattaatcggagaaaaagaaaaagcagagttcatatagaaatacaatttataaatagctgaaatttggaattaaaaaataaggaatattagaagaggagacatagaaatacaatttagaaatagttgaaattcggaattaaaaaacaaggaatattagaagaggagactagagtccatatagaaatacaattaggaaataactgaaattcggaattaaaaataaggaatattagaactagagtccatatagaaatacaattaggaaataactgaaattcggaattaaaaataaggaattttagaagtagagtatagagtccatgtagaaatacaattaggaaataataaaaatttggaattaaaaacaaggaatattagaagtagagtatagagtccatatagaaatacaattaagaaaaaaatagaaattcggaattaaaaaataaggaatattagaagtagagtatagagtcgatataggaatttaaaactaactaaaatttggaataaacataataaaattaaaagtagagatataaagatacaatttacaaataactaaaattgcaaattaagaaaaacatgggaagaagagtttaaagtcaatataggaatacaatttagaagtaactgaaattcgaaattaaaaattaaagaatattgaaagatgagtttagagttcacatagaaatacaattagaaataataaaaatttaaaaataaaaataaataatattagaagaagagtatagagtctatctagaaatacaatttacagaaaattcggaattaaaaaaaggaaatattaaaagacaagtctagagtccatataagaatatatataatttataaataactaaaatttgatagtaaaaataattaataactaacacttaatattatataagatataatatgaatattacccattagtagttttgtaaagttattgcaaaatttaaaattatgttgtcattttaatatatttgaataatataatgaggaaacatatatgctattatatgagagaaaatataatgatgctagccgcgcaatctgcgcgggccactgtgctagttattgttaaccataacatatccttcatggttttattcttactgttctctaggagtgtgcaaaccttgagaaaataagagaaaacttgttgaaggatgggagtgaagtcagccatgcaagctgggccaaggcagctggaattgatgaagcattgttgaggagtaggctgcaagaaggttactgctgccgagagagattactggtaaccaccgagtggctagtcaagtacattgcaaagacatacgctggaatgggaacagcttttgaggatctactgcaggttgagagataacatatttattgagaaaaaggtagactacattgacaacttccattttacaatttgatttgttggaatgacactgcaggctgggaaaatgggtgtccttaatggagctgagaaattcgacagccaaaaaggatgcaagttctcaacttatgtgaagtactggataaggaaagcaatgttagcacttcttgctgaaaactctggagtaatccagctgcccgtatgcctctgaaactatcttgatatgcttcactttgtttcatgagaaaaatcattgcttaatgatgtgaactggcaatgcaagtgtaggcaaggatggagggtataattcgtaaggtcagggaagcgagaagggcgattcgctacaacacagggaggaacccaccagatgcagaaatcgcagccctcatcggtgtatcagttgccaatgttaggttggcacggaaatgctctcgtcgagttgtgtcgctttacacagagatcggagttggacagaatgcaaaatttgtggtgagcctctcagccctgtgattgaccgatgataaaaaatgacaaatagttcttccatcacccgttgatggtttattttgacgtatacaatctgaatggtgtttaattgcaggaagtgactccggacacatctttagaagctccagatgaggctatgttccggatgcagttgagagagagactgcttcatgtcctggacaggctccccccaagagaagggcacgtactgaagctgcggcacgggctggaagatgggaaatgcaggtccctggagcagattgggagcatttaccatgtctccaaggagtggataaggaaaatagagaagtcggccatgtccaagctgaggaacgacgacgtgcataatgaactcaaggacttctgtggattctagtgctcctgatcgagctttcttgtgcatatagagctctctactttgcatcaagtacacatgattttcacaagggttcctttgcttcaggaggaggaacaaggatgcgttcaacgagaagttgagaactgtactgatgatgttgtgatagcattcgatagaaagttgtatatatcgcataacattacaagcatttgtttacctttttattttgaaaatttacaagcatttgtttcagacgaactgttcagtatagagcagatgtaatacagaatgtggatcatacattgatggatgtatagtgcaaaagaaatattgccatactgttgactgttgctaaaaatgctgacaattatatcaatgttttgaacactgatcttccatgatcttatttttgtttggtatttcacttgcgccagactttttatctcatctctttcgattttttgttcgtaggatcttacatcaagattcatgttgttgtagaccaaattgtaattacacacaattacttatacttagttatagagcatttacactcagtttcaatgcactaaaattagattttacaactgtttttatctttagatttatgggtttttgacatgtttatattttttatttattcagaacggtttatattcattgattgggttaatggcttaatgcttaatgctctaaatattaatagttaggattaaatgtaaatgtcaacagacaaaattggtgtcgtggtgtangttgngtttaaattcccaaaccccggtttttccaaaagcctaacacactgaaggtctccggttcgaacccgggcgacgccatttttttaatttctactttctttttttatgcttcgattacagagcaggccggtccatgacacgaagcacccgcgggccggcccacaggcccatatctacggccccagtgtttcagcgatgatgatgacatggctgtgatgtgagccggcaagtccacgtctgcagtttgacatctttgtccatccctttagccaactgtggaggtaattagacagctaaataattgcatccacaaagctttgagaaatgctgtagctcaggtggcgatgcacagtaggatcctagtgtgttctgtgcgtgttttttccagcatgtggctgaggaaagcttcgcctttttgccacctcaccaaatgtattagaggagctatccttccttgcaagttgcaaccacaccaaaagccatcatcagccatgtaataataatatgattaagcaaaggagacagggtagctcacacatcactgtcactcaaaaggctctttctgctatgtgtccaaacctttagatcttgttgtacatgtgtgtgtagccaagccaagcagctagcagctgcatcatgagcatcgttttttggccaagaaatatactgattctagatatgccttatccggatcataagcttgctcgacgatttgtcatcacatctgaacatctctgaattaatctgatgcatgccgccgtggctcctctatctccactatctcctgtttcagagttgaaaccatttaggcagctgtcctagctggtgtcttttgctcatggattgtgacatgtcataggtcattgttcaagttatcaagtatgggtgatacatctagtccttgtcctgttagcatttaacctttctctgatggcaatatgtcctggttattggcatgttgcttttgcaaacagtgcacaacttgtcccccaaacacaaccagagactaaattcctaccaaagtgctgatctgaagatacctgaatatgtagtacccgggaacaccaggataccagatagactaattggtaaacacacatcagaatatcagatattcagcataggttgaggacagagcattttgagaccttctttgcactgtcaattgcacaaaattaaagcaagcatgtaggtattgtgaaagaaaaggagagggcaccatggaagcaaaaggcttccaagttggtactatgaaggagagtgaattgggacgagatggacatgcacctaacatcgatctcataccagattaaggattgtagggcctgagcgccatacagtgcttcaggcactacagattgcttgccaatcgccattgacactgcaaccacattcttgtcgctagtgctgtttgctcgatcagtggaaggatatgagtcataccgcaaacaaaatgattcagatattaaggacactatatacatcgctgcaacaaaaaattctattgatgcagcagagaatactaagcatggtagcattgcagatatgcacagtgcttgtgaccatacaatgggtggctacatgagacaatgttacaagattccaaacttttgtctacaacactgtccccatggctgtcaattagattcagcagcaagatggttggaacttgaccctgaggataaaatttgttaagcatcttgggaatccagtcgatggatgaccacggcaactgatggtgctaggttccgatggatggcgtggtggacagggacatgcccagctccaggtccagcggagagcaatggtgactagtgccgtatccatgaccttgttgtgcttctgaaactgatggtgtttctgacgaaggccacgcactgtcacctgatttgtggtgcgaaacttggagagacagagaagcagagatgtagatgttgcagcgagtggcaggatc

SEQ ID NO: 37297 - DNA, 662 bp, Oryza sativa
cctctcgcagccctcgtcgatggacagcaacaacgaggacgtcaacggcgacggcgacgacgacgacgactgcaaggaggaaggagaagaaacctgcagccgcaggcaatccatgctgtaactcttgtgcaagtaggacgccggcgagctggccgccgcagcatggagctgcaccccgaacagccgtagcccggcgccgccgccgccgccgccctcctcgccggctcgttggcctgcagtcgagtagtcaccagagcatcgcctcgccatgatggcgtgcatgcgtcaatgcgtttgtgtgtgtgttgtgtgtgtcgcggctgcagattagcaggctagttaagggagggagaatgacctgcgcatttgcattgcattgcacaatcgaatgggatacaaatatggtaatatatggagaaaagagtgatgctaatctcgctgctgctagtaccgattgatcgagagggacgtcgacttgctactagtgaggacacgacaattattgcacccgtcgtttttgtgtttagccctatatttgtaatcaatttgggttttaatttatcgttaaccgtactgtcataccataccactgttgatattatgggcatataatgatttaatttattccataaataaatcatgacattacagatgaaaactag

SEQ ID NO: 37298 - DNA, 252 bp, Oryza sativa
atatatatatatatatatatatataaaccatgcagcaacagggccatgcaaaaaaaaaaaaggtcagctcgatctttagtcccggttggtgttaccaaccgggactaaagatcgatctttactcccgattattttacccgggactaaagatagcgatctttagtcccggattggtactcccggtttggaaaccgggactaaaggggggttacgaaccgggactaccgagggtttctccaccagtgcgtatgt

SEQ ID NO: 37299 - DNA, 518 bp, Oryza sativa
ttctatctcattcgatttctatgtttttactatggtccaattaaacggccattcctattttttttctatgttttataattacctgttttacatttgcatatctatcagaatcccgtgttttttctatttcttcgttttttttcatttctgcgattcaaaaggacctatattttatattattatatcttattaattttttataactatttaaatgacatataagaaacaacctatatcctcatgagatgaactcatgaaaacacttccctactgccgcctctaacaagtacctctacttgggggcgcaatgttgttctagccttgcatattggctttggtggcgacagccgaatcgattgttgtgttgtgctccgacgaagtttgttgtgttgtgccgtttgaagatgcagtggccctgtagttatgctgcatgtgacaggtacaaacaaactggccgacacaaatatgtcaaacagattgcccgccgttggttcacgggcttatggagatgggattgg

SEQ ID NO: 37300 - DNA, 665 bp, Oryza sativa
agatgagatatcaaatctttgacgggttgcaaatttaacacccctcacaggtgaggtcaaactagtaatgggctggagagcaaccccgtcactacctcacctgcgacggcttaaaattctggcccatcacatgtaaggtgatacatgtgacgggccacggccggatgcctcaccgatgacggcaaacctaacgacccgtcaaagatgacggtcatctgtgaccaatccttaggcccgtcattggtgtgccgtcacagatgtagggttctggcgtagtgacttaaatagctaggtagacctatattgtacccatcgaattgatagggattagctgcattgtaatctctactcgccgaaataatacaagaagcagcacctggacgtacgtaaactcgactacgaggttccgaaccagtataaactccgtgtcagctgtgattgctcttcgcaccaagcacggttcacaacgatccaaatattacgtgtctactgtgattactcttcgcaccaagcagagtgcacaacgattcaaatatctgccggtctaaaacagcgacagaaccatgtcaggtaggggatctaacagcgacagtaaaacagcgacagaagcgcgtcaggtggatccaggcgacgacgtcatcgtcacagtcggtggtgggacccaa

SEQ ID NO: 37301 - DNA, 544 bp, Oryza sativa
aaaagaatgaaaagatgacagagctagctaatgccaatattattattattattatatattgtgccagaagaaatatatctttcaaaatccttttatctccttgcaaaaagaaaattcctcttagctagaagaattttacaactttctttttttggaaaaagatcatttttacaacgattttcgatcaatcaatcacgaaatgatgagaagctttcgttttctttcgcttaatttgttttgtttcagacgagggattaagctgtcgtccaaccaattaattaatttgctgttcccccgtttccctgctacttacatgatacactacgactaagccagtactaacatttggtgagaaattaagtgcatacaagaattaattaattgacgaaatgcgcgttgcatacgcttttacgcgtcttgcacatgcgtgcgaacgacatttacgtacgtagtaaacgatcaccgtcgtttaattatgagcaagcaaaaattcttattatgaataggtaactcagctccgacgaacggcgacaccggctgatta

SEQ ID NO: 37302 - DNA, 923 bp, Oryza sativa
tattcacataattaaggctactatttaatacttcgtctattaatttttattgtcatatttgctttaaccagcaataccaagaagagtgccaaactttattagggcagtctcaacccatagtgtccataagtagtgcctatgatgccatatcaataagacatcacaatagaaaccacactccacaactcatagtttcttaaagtgagccattaataaatatatcatctctcttctctaccaatcacatttattcttcatttattatgaagacccaattatctcccaatgcaaaacttgatagtgtctggtgcataggttttcgtgttgaaggtatgtcttgcatgagacccagtttcatcctctcttcactctctctctcttaattaatatagtgccacataagctaaaagtcctacatggcaatgtagttaatgccatagacaccatcctaggtggagggttaggactgcccttaaggctgtgttcgaatggtgatattggaaactaatctttagcgcatgcaaaactaagcaacccattagcatatgattaattaaatattagctactccctctattttaaaatataagtatttttagaatagtgccaagtcaaccatttttagctttgactattaatagcaaaaaaaaaaaccaatcatgtaaagttgatgttattagatttatcattaaataaattatcataatatgcaactctttttatttaaaacatcttatttttatagatattgttggtaaagtataatctcgaagactgtgttaaagtccaaaaatgtttatattttgggatggagggagcatttttttagaaaaatggattatatgattttttttaaagcaacttccgctagaactttttttcccaaaaaatgcactgtttatcaaattgaaaaacgttagggg

SEQ ID NO: 37303 - DNA, 741 bp, Oryza sativa
tgatctatcccttccccaccttctcactctcttgtagcgcccattcattcagttgtttgtaacaagccacacaataaaataaaacagaatgccgaaaccaactttgtctaatcttaatggtataaaagtgaggacttaaaaattaagatcttggtatacagatagtggttattcagatgtaagatgatcgcatgaatgctgtgcaatttccataacataaaacaattccccaactttctatcagtaatttggtcctggtttatcaatatgccaggttgtaatgagttgtgtcagaaaaaacaatcaagacaaaaatgagcggtcatatgagtatcacaaacaatcacagatagagtcgcatagctcaagactgacagtaatggccatggttcatgtgtcatgattgagttgaggaacttcactatgaaaagagaaaataataagtcattgagtggttgagttagatgacacctagaaactgaaaacatgccaattgagtattgtggtattagatttccacctaggacagcttttggtacaagtgtccaaaagaagtactccaaacaaagaggttcttccaaattgtccaaacctagcagcaccaccaagctgcttcctagtgcattggtcctttcaaggtatattattatgcatataagtgtacaatgtgacgagaaacattaactaccacttaagccaagttcacctcatatattgtgtaaaggaaaacaattatttttt

SEQ ID NO: 37304 - DNA, 523 bp, Oryza sativa
acatggcggttttacagatggctcgtgagaagaggtcgtgtccgagagcttcagagacgcagcagaacaattcagaaaagaagggaaaggtggatggtgagagtgcagctcgagacaagagggctatcactgtcactgtagatcctgaggttctggaatgtgatgtctgtttcggccctctcactcccccactttatcaggtaaataagcatatattgatccttcttcttgctgatcatgattccatttacaagtttgtttattagtatttactttgctcttcgtgttataagtttttcagtgtttcagaaaagaaactttaatcatgttcaggtcatatctgcattatctgcaaatgtctcaattcttaactctttgtagtagaacgtccagtgattactcattcagtttcaagtttcaacaaactgacacgaatatgtgctgaataatcatcgaactttgatcatactacaatattatttcagatttataggactgtctgaacattctgaaccagcattcc

SEQ ID NO: 37305 - DNA, 569 bp, Oryza sativa
ggcctgatgcacatcgcgcagcagtctggcgccattagtggtgccagtcggctattgttcgaagaaacgaccagttccgccgcgaggggctcgataagccgccgatccacatctacaacgactttgatactgaagagcagcgcggggacattgtaggggcgtatgtaacggtaaaaactgacgatggtgattaccttacccatacgatgcgcatcgatgccatctactccatccgtgaccggtctgaagcatggaagaagtacaaatctgacaacagcaagaagtgtccatgggtcaccgatgaagagcagatgatcctaaagacggtcgtgaagcaggcagcaaaatactggcctcgacgtgagcgcctggatgccgccatcgaccatgttaataccgagggtgaggaaggtatcaacttctcagcagaacgccagccagaacgcgatgtaaccccagcaggagacgaaattatcaaggagattaacgacgtccttatcgcaatggataagacatgggaagaaaacctgctcccagtctgttcgcaaattttccgtcgtgatattcgc

SEQ ID NO: 37306 - DNA, 499 bp, Oryza sativa
ccaacgatgagcgagcgcttgtcgtatgtgtgggcgccgaggagcacgccggcggcgacggcggcgaggaagacgagctccacggtgaggacgccgagcatcctgcaccgcttgggcttgggggcgtaggcgaagtagatggcgaggtaggcgatctcgatgaggagtccggtgccgttgatggtgacgacgaggatgctgttggggtggatgaagggtaggccgtagaacacccacagcgcgcagttgaggaacgtcgccaggtacggatccggcacgaactcctccacgtccttcttcttcacgatcgtcacgaacgtcggcaatggcgacaagaacaacccgaacgatatcaagttacctagtacaattaatcaattattagtcaattactaatgttcgatcaatatatatatatatatatatatatatatatatatatatatatatatatatatatatatatatatatatatatatatatatatatatatatata

SEQ ID NO: 37307 - DNA, 409 bp, Oryza sativa
cctgaaatccttgcttttaagatattaatgtttttttatgttgtcccttgctacagacttgattcatgtcttctcctcagtgccaaggcatctcaacttcatcgatcacactagtgatattggatggaaagagtatgttatatctgaacttataaataatttatctgcgcaagtattagtttcaccaacatgctgtgggtaatactgttacaggactcagagagtgcaaccaatcatagtagatgctggaatatacttggcaggaagaaatcagttcttccaagccacagagaaacgtgatactcctgatggtttcaaattcttcacaggcattttctgactcctttcacttcattttccttcgtttgatcaactagttctgtgattcatgggtttcctcacatacagg

SEQ ID NO: 37308 - DNA, 600 bp, Oryza sativa
atgtaatccaacgttatactccgggagtttgttaattttccggccagacttcaatggtcttttcacatgtctagacgatttcatataatctttaaagctattcactttgcaattaccgtttgattgtcacagttcataaggatagccggcaccggtttttcaacaacaggcagatccattaatagatcacgcaaccattctgcctcaacagtagcagtatccagtgccgttagctctgcttccatggttgacctcgtcaaaattgtctgtttgcaagacctccatgaaacagcaccaccacccagtgtgaaaacatatccactagtggctttgatctcatccacatcagagatccagttagaatcactataaccctccagtaccacaggatacccagtatagtgaagccccaattccacagtacctttcagatagcgcattactcgctcaagcgcacgccagtgatcatctcccggattagaggtaaatcggctcaacttgctcacagcaaaggagatatcaggcctagttgcactagccaggtacatcaacgagccaatgatttgggagtattccagttgattcctagcaattgtcttg

SEQ ID NO: 37309 - DNA, 282 bp, Oryza sativa
atcagatccacacggcgagtggcgaaggtatggatatagcgtatattggtcattcctatgtttctactcctaatcgccccttgcatttaaaaatattcttcatgtgccccaagcatctaaaaatttagtatcagttcatacacttgttgctgataactatgccttcctagaaattcatcacaaatatttttgattaaagacaaggccatgaggagaataattcttgaaggtccatgccagcgaggactctatcccctacccaccggagcaccaattaaacaa

SEQ ID NO: 37310 - DNA, 291 bp, Oryza sativa
cggctcgccgccgatgctcctcgcccacctcgtcgccgaccactcgtggcccgtcagcaaggtcccctacggcgaggtcctcaccatccacgtgccggagtcggagcggcgcccgggggggcccccaaccctggtcgtcgcgggggccgccgggggggacgacgagcgcgtgttcgtcctgtccgtgggcgcgctcggcgtggcgagggccgtctcggtggcgtgcgtcagggcgaacgccgcggcggggccgcgctaccgctgcaagctctgggcgcacgccccgggcgg

SEQ ID NO: 37311 - DNA, 169 bp, Oryza sativa
agatgcaccctaagctaatgctactttccacaatgtatatggctcactttacaagtgcaatcattgtcttaaggtcatctttttcatgcattgtggctgcccttatgttttgaggcgtgcggtttttgtctctttacggagtgaattgttgtgttctcatttttaccgt

SEQ ID NO: 37312 - DNA, 812 bp, Oryza sativa
acacgtaaattttcaagcaatgaaactgctggtggacaagaagatggcgggggtgttccggcaatcgtccacccgaatcagctgtgccaatcttgcctggtggcgaaacaggccagggcgccgttcccggcggcggcgcacttcagggcggaggagccgctcgagctgctgcacatagatctgtgcggcccgattacaccgaatacgatgtctggtaatcgctatttttttcttatagttgatgattattcccggtggatatgggtgttcgtactcaagacgaaggatcaatcgctcgatgctttcgtaaagttcaagccactggccgagaacacggctgggcggcgcgtgaagacgttgcggtcagaccggggtggtgaattcctgtcaggcgagtttgcacaggtgtgcgaggaggcggggattcaacgtcacctgacagcgccgtactcgccccagcaaaacggggtggtggagaggcgcaaccgcacggtgatggccatggcacgctcactactgaaggggatgcgcgtaccgggcaggttttggggggaggcggtgcgtcacgcggtgcatctccttaaccggctcccgacgaaggcaatgggtgatcgtactccgttcgaggcatggacggggaggaagccacagctgggacatctcaaggtgttcggctgcacggcacacgcgaaaaacacgcagccgcacctcaagaagctggacgacaggagtgcaccgtacgtgtatctcggtgtggaggaagggagcaaggctcatcgtctgttcgatccgcgtcgtgggcgcatacatgt

SEQ ID NO: 37313 - DNA, 810 bp, Oryza sativa
gtcctccggtagcacgccatcgccgccgcctccttctccggcgccttctgcgtcatcgcctccgcacccttctcctccatcaaactctctccccccgaagaattttgatgatgttttttggctgtcgctgttgctacgatgatttgggagaggtggcgtcgtttacattttatagggtagtgtttttcttgagaaggaagctgagcagcaaggcgtggagaggaaaaagaggcggtaataagccttggagtagggaagaagaaagaaggcgagcaaaggcaaagccaccgtccgatcacaattactagtagaatcattaatcatactatcatcttcggattacggaagaaaaactttcttttcatgaaagaaagaaaataccaatgggctgaccggcgggtgacctcttctcatgatttttgcctactcgcaaagttttcaggatgatagaattgaatatttcaattttatgatagaaaacttgccatacaggttggggtcaaaatgtgtagtagattatacaagaacgttttggcttaaatgtctttgctgatcaattttacatgcaccttatactgtcatcaattggatttcgatgtttgcaaccaatctgactaactggacgtccgaacaagaatacagcttgcattaaggcctagtttagttcccaaatttttttctcaaaaacattacaccaaatctttggacacatgtatggagcattaaatatagattaaaaaactaattgcatagttaggggggaaatcgcgagacgaatcttttgagtctaattagtccatgattagccac

SEQ ID NO: 37314 - DNA, 2294 bp, Oryza sativa
  unsure (1)..(2294): unsure at all n locations
agcttacatgccagatttagttttgctgtgttatccctggttgcccatatcatacatacctaaattatttgtcctgctgtaaaatggaattcatgacctaaagcgacaatacttgaaagatcttatcagggactatcatataatatatttaagaaaatatacatatagaatgcaattagtatactacaacttacacagaaattttaaaaaaaattaacaaatatagttctcgatggatcactctatggacaaacatacagttagtgcattacaagtatatagtcctctatattaagcgccattattcattttcataaaaaaattcacaagcttatgcataactccattccaccaaaatgagtgatcaaacagagtatttgagaacaaaaaactctagttaatgaatatcatatttccagtccttaaaaccggtaaattatcaaattttgtaccataacagaaataaacattttcgagctacataataccaaatgccagagtaaaacatgtcctcattcctcagtactatacaacacatattagcattctagttagaacccccaaataatctactacatatctcgaaattaaatccggaccacacacaagtttcaactacagaatgcgcagtcagtcgaaatcagcacgaactaatcggcatagatacggatccaacgcagtggaaacgagaaaatgaacaaagctacgggaacagaacgcatcgaggcaaatcttgatccagatcatctcgccaaccgaaccagccatcgcctaatcacctaaccgacactcgctaatcaactaagacacataagcaagagaagagggaaaataaaaggagaacattctctcgctgcgtcaaatcgcactagcaccaaccaagacgacgacgaagaacacaacaggtaaggcccgccgttcttggacgagagagagggagaggaggaggaggaggagctacgcacagttgcggtagaagctgacgtgaaccatcgtcgccggaccgcctttcacgggccgccgccgncgncgccgattgctggagcttttggtttctcgaggggaggaggagtgaggaggaaagcgcgtttatagtgcggcggcgagaggaaaccctagctttagggctaggttaaatgggccgagatttcccggcccattaacggacgggtgggaattaggcccacatatcgaatgggccttcggtgcaggggccatatttacaccgctcgttaaatggtctttttctcgttcttttttccttatttttataacagaaatgctagtcaccggtatactgtttcgagtcggtcccggacaggacaatttcccacggatcaaacacacaccctcacggatcagatacacacactcgagaaacattgagtcactcccaaacagacacctgcagctcccaaatcgtcacgagcatggctgcggcggcggagtcgccggcggcggagccttcttgcggctcctcctcttcagcggcgccgatgcgcacaaggtcagttgtgccagagagggagagtggcgtgagcgtggtggtggcggctgtggcggcggtgtctgcggcggagccggtggcatctgcggcagagccggtgcgcacgatacccctttctctcattcctcttttttcatcgatttcctgattttgatttaacatctcttcatttttgcattttctagggtttgttgaatcactaatctttggatggggctcatcatatcacatccaaattgaaatcaaagtaagctaatactctctctcttttttctgtgtgtttttgttcattcactgggggtgtttgtagcagaggtgagggatgtgtgtatgtgctgaatcatatgatacttgatatgatatttgcagcaaaatgttcgaattggaatagatcgcttgaaatgcttctagctgtaacaagtattgcttggagcaagcaattttgccgttaacaagtacacactgtcttaaaacagagaaatctccattcaactagtaggattttttttgggtgaactgaagtgtaaacaaaatcagagaaatccgcatcactcggttgctagcttctagttccgggcacgctttgcttgtcaattgttatcctctttgtcataaagggcagtgcgtggtgacaaagttggcagatgcagctgagtcatagatgcagatgatttggattttttttttctgttgatgtttgcatatcttagtggctacatgggtgttttctgttttaaaatgatttgatacttttgttcaatcgaggatgaatcaccattgaaatgat

SEQ ID NO: 37315 - DNA, 772 bp, Oryza sativa
acatctccatatgtttagatgtgctgtcccgtgtttgccataccttctctgatatgagatcagcaattctttcttcgagtgagcttatttgactggcaaattcttcagtggttctggagagctgcttctccaattcacaggctatatttttctgcaaccgggatatcctcatattaaccttttcaaaattcctgaaggatgcaaacaagtcctccaacaaaccttaaattattgcagggacatgcgcaatgacattctgccaaaaggccaatagtgaagaaaaaaaaggaaaaactatagagaacccaaggcatgtctagtctaaaatgtttttccatttcaagtatggagagtagtcctggttgaggaatgaggatattatatccaaacaagatgcaaccacaaacaaaaaatgtatacctgaattatctgactgttatattgtattagactattagttactatgaattatctgactgcattatagctacagttgtaaattctgaaagtatacctgaaaataattctgagcatcactcagttgctgttgtagtacatttaaatggtcgttcatgctagcagaacgtgatctttcatcttcaagttgcttcagcaattctcttattttcttctcatgagatttagttgtatcggcaagaatatttgtgtttgagatgttctcaagctgtttttgctactaacaacaaaacttgtgttagaactgtgaaattattgaaataggacatctcagtgtcagcagaactacatcaaa

SEQ ID NO: 37316 - DNA, 3529 bp, Oryza sativa
catgatacctcccagagttcacatgatcctactcaagtatcatatgtgaaaccagtagggaaccactttacaagacatcgatattggataggatcatgtgatacttcacatgtatcaatcataatgaaactcatgtatcacatgatcctacctacccatgtatcatgatagatgattttcctgggtaggatcatgtatgatacttcacaggtatcacaccatcctactaaagtatcatatctgaaacctcacagggatcatgttaccagagatgatacccaagtagaatcatgtgtggtacatgtaaagtatcacaccatcctactaagtatcatctgtgaaacccatagagatcatgttagaggacatgatacctaagtaggatcatgttagaagacatgatacctaagtaggatcatgtgtgatacctcacatgtatcacacttaatgatacttttttgagtaggatcatgtgtgataagtatcacgccattaagtagcatttgtgaaacctattgggatcatgttagaatacatgatacctaagtaggatacatgatacccaagtaggattatgttaaaagacaagatccctaagtaggatcatctgtgatacctcacatgtatcacacttaatgataatatttttagtaggatcatgtgtgatacttgtaaagtatcacaccattaagtaccatctgtgaaacccatagggatcatgttagaagacatgatacctaagtaagatcatgtgtaatatctcacatgtatcaaacttaatgatacttttttgaggagaaccatgtgatgctatagaggtatcacatgatcctacaagataacaagagtaccatgtgatcctacaagagtaccatgtgatcctcaagagtatcacatgatcctaatagagtatcatctttgaaaaccacaagaatcatgtgctacttgtgtgaaaaatttcagcaatcacataagacgccggattgcagaggaaattggctgacgacgtgtgcgccgatggaatcagccgagaaaacaagcatggaggcgcgcgattccgcggatgaatcttcgggatgcggaggagctcgcgccggcgaggaatcacgcacggaggcgcttgattcctaggaggattcatcgggttgtggaggagctcgcgccgacgaggaatcgcgcacggaggtgcgcgattctgaggaggattcgttgggttgcggaggagctcgcgccggcgaggacgcgcgattccgaggctgattcgtcgggatgcggaggagctcacgccggtgaggaatcgcgcttcgtcgggttgcggaggagctcgcgccggcgaggaattgcacacgggcgcgcgattccggaggaggattcgtcgggatgattcaggcggggcggtgagcactggtacgatacgtttctgttcctgtttttgttgacgcgctcgcgcgatactgtgttggtttcagaattatcctgtttttcatcgggataccggtatatagcagccctcttttataaacaacaaaatccgggcattcatcaacagaaggaaacgattccagataatcaaccagagagggttaggatgcaatgctgattgatatggtctcaattctaccaactagacaaggtttacagcttcagggaaaaaaaaagcatcatcatttcatcaccaaccaaacatggcagatttctacattactcatctactggtgtatattggagaaatatgttacatgatgacatgtcataacaattgacataggacaaacttgtgacaaggaggtgagttccattttccttgctttcttgatgaaatggctcctggagactgctacctaatcaaagaggctctctacaccgggctgaatttttcttctttggcccgtaaaagaaatgcaatgatcaagtaagttgacatgatcaagactgcaacgaaaaatatatttgttgagttcaggggttacatgtctagagacctctagttgcagtaactattcatcctcaaagatcatgaggcagcaaagaggctccatgagttgtgtttcggatatgtgctctgataagcagaggttggatagcagtcacacttcaattccttctccggctcaaatgccacactcttgttgctcttttgttcaagttcatctgaatcctttagtgaaccttgttcttctgagcctttcttgcgcttttcagtatcttcgagtctttcggtaccttattttgttcttctgaatccttcgccgccttcatatcttctttcgagttcgatggcttttgactctttcaaaatttttggtggcttcggttgttttgaatcttttgacggctttgattccctggattcctttgatgacttcgaataccgggattcctttcatgactttgaatctttcgatgatttgccagactgtttagattaggcatcacagataacagtgagcaccatgacttcaggatcatagctaattatatacaacatgaaagagcacatagactagtgcatgaagttcaaagtagagcctttttcaattttcacaattgtatagtgcatgaaatggggaaatatgtaactaaattttgactcaggtaccttctttgtcagtttattgagatcttcaggtccattttcttcaataaacttatcaagtgccgtgaggaagtcatcaaatttaccggaaagaccctttttctctgagggatataccaaatatttactatctggttctttataaacacagatatcacataattttggtacacataggctgcaccgctgaaatatggcaagacaggccagcaaataaagatcaatttcatggatggccaaaaaggaagcctgcaaaaatataagatggagagaccaaggaatttaatcagtcaatgtatcatgctaaccaatcataaatttgtgcaagccaaagggagggagagatattagagcaagcatgaactaacagatctttcttccttaccattatgttgtaatcaccatccaaaccaaaatatgcaatgctaaaaatcacaattgcattattaaaaatcctacaaaccttttatcacacagcaatggcatgaattgaaccatataattgcagaacacttgtaaacttgtattgatatctctttacatttttgaaaaagggaggagggtgcacctgacagaggaaaggtgtatgtttccgtactatatctaaacaatgcatgacaagaactaaataatgcttgcagttgcagggtgaccaagtgaactcgtaatttccctgcattagaataggcaacatgtattcccccaaaaatgccaaaatggtcgaagcctgtttgttacttttttgcaactgtttttttcatgtaggcatgttagaacattgtatggtcatagctactactgtttctatgctaatgataagcatctagcgtacctggatttcacgtggtcgtgtagtcctttagtactgagagtgccaatgtggtgcctattttcagatctaaaaaatgtctattcacagctcacaaagaaaat

SEQ ID NO: 37317 - DNA, 563 bp, Oryza sativa
ttattgataggtgggccccacgaaaacacgcacacgcaaaacagctatataagcgccggggggtcgctttcttggcccattgttgcgcccgtctttgtctcgtttgtctcgaatactctcctctctcaaacacttccgtatagacacgcctttcgagttttctgcttcgagagtttctgattcgagtcttctcagcgaccatggggaaatccaaaaaaccggcctcaaaacagaaagcgaagaaaacatcttccggtcttggtccatcgattatctctgaaaagcggctcaataaacttgtttcaaaaggtgccattgctagtctcaatctagtcattcgtcctgctggtgagttgatgtaacgccctgattttcgatcgggattaaaaattattaaataatgtattttttagaaattaaatataagttaaatcaatttaatcaagtaaaataatgggagaattaaaatttccccttaaaaatcattggccgggaatattttgtaatattcttgtgccctaaaatactctctgaaatttcccgcgaattttcggagcccaagt

SEQ ID NO: 37318 - DNA, 774 bp, Oryza sativa
tttgatacttttgttcaatcgaggatgaatcaccattgaaatgatattttctttgtcctttcacacatgtgcacagagttgaaatggcattgccacctgctccaagcgaatccgatttcatgcatgtttcaaagaagacaaggtgctctccaaggttgaacaagggctcagcttcacccccactttgacaaatctaacactgctcattcttgtcatctatgcaggactacatgaaagaatatcgtagtaagctatgcaaaaggttactgtaccatcgcttcaacgacttacatccaaaacgtcgtttctaagcttcagaaccaatatgcttattcggttcaagcagtgtcggatgtgtgcttaggccatttttgtagccccctccctccctcttccccaaccaacatatgtaacaagtcaagtttcagaattgtgtatgtagctactatttttgtcttgaactggaaggttgcgaggggcacaacaatcaaagacatgaactctgtatgtggctactgttttcatgtacagatatgttggtaaagaagtggattatattgggtagaccttttctgtggactatatatagtttgagtacgttgtacacaatgaaatcgagttcagtatcatatgaaacctgaggaaatgatactgaggaggatcatgatacctcccagagttcacatgatcctactcaagtatcatatgtgaaaccagtagggaaccactttacaagacatcgatattggataggatcatgtgatacttcacatg

SEQ ID NO: 37319 - DNA, 1153 bp, Oryza sativa
tagggatgtaatcatcagcacttacttccatttcttttgtttcgataaagcatatattttggaccttttggcttcttctgttgtttcaattgtttatcatttcagatttccatgtccgaagatataggctgtgttcggcactgttcccaaaagaacagtgctcacggaaaacggagcgatccattagcgcgtgattaattaagtattagcttttttttcaaaaatggattaatttgattttttttaaagcaactttcatatagaaactttttgcaaaaaacgcaccgtttagcagtttgaaaagcgtgcgcacggaaaacaagggagatgggttgggaagaaggggtgccgaacacagccatagtcagttgtaacttattctggtaacatctagaatggtcagttttaatatatatatcaaagccatcttccctcctaggcagccaccctagaccctcctaggtccaccttagggtaaattaggtgctaagcactgatctgtttcccagctagagcctgaaccttcgcaaacacttgttcacatatatgatacatctaaaaccctttatgagttcttactacattggataactatcccagagagtaaccttcaatcatggtgtcccatctactataatccagagagcactatgctacaaataacgtaaaccattgccagattcaaaatgtaaagcggcaagctagcaaataccaatttatgtaaaacataaacaacttatgcaaaatatatgtatgaaggtaaaaaaacatatacaacttatcatcaaaactgttgtgcacaaaaaatacatatggaaactatgaatgcaaatttcctattccctagggactctagaagccttagcttcccatatagagttgggcaatctagaatccaaggtgacttaagagaggagaggagagagagtacagcttaggggaggggatgagggagagggtggagaaatgggctcatggactgggtagcgggtgggtgtagcggcttgagtgggttttatgcgctacattttccatttgccgtttatatttccatctgatatacttggaatataatgtgatttagttgaagtctagcttacacctagcattgtggtgatcctgtaatgcggcgtctcccaggagcaccatgaca

SEQ ID NO: 37320 - DNA, 667 bp, Oryza sativa
  unsure (1)..(667): unsure at all n locations
attcttgggttaatcagacacaatgttatgaattgttttttaaatccttgtcaaacatggttgtatatctgaagctcttagtatttactgtacacaagatccctactactatttgtcttgaatatccatactattattgggcgtaatctcaacaactactgtagttttctttatttgtattgttgcattgtctttccgggttgtgtgtgcagtttctttcttgctttgtatatttttggggtcaggatataaggaatttgggactgtagggcttctttctatgttattgtttggttcctcatgaacaactatgctatctgcagtggtttctttctctgtcatgtgttgtgaacaaatttattacttcattgcagatggtaagacattcaagaagccacgtcgcccttacgagaaggagcgtcttgatgcagagctgaagctagtgggtgagtatggactgaggtgcaagcgtgagctgtggcgtgttcagtatgctttgagccgtatccgtaacaatgcaaggcatctgctcacacttgatgagaagaatccacgccgcatctttgagggtgaggcactgcttcgccgcatgaaccgttatgggctccttgctgatgggcagaannnnnnnnnnnnnnnnnnnnnnnnnnnnnnnnnnnnnnnnnnn

SEQ ID NO: 37321 - DNA, 1170 bp, Oryza sativa
  unsure (1)..(1170): unsure at all n locations
cgcacgttttttaatatttaactctttaaatgcgcacgttttttaatatttaactctttaaatatttgaccaataaactataaattaaattttattcgatgaaaataatattattggattgttatttaaatttactttcatataattataattttattgcgacaaacattataatatatgagaaatttaaagttacaaattagttttaaaaattgcgccaagtttaaccgcactttagtgagtggacgaagaaagtacactagtacttactcctgaagatgaagatgacacttcctgatcttgtcacccaccccaagggcgtcaagcgcttgcaacgcattcctccacgtcgcgatggcgaaccccgacgcccggagctccggcgacgactccagcacccggcacttcacccctttcctgcatgcggattaatcaagcaagcaagcagatgataccatctcagctcaagttaacctgcagctgtgccaacacagagagcagtctatatccagttatccggcaaacgcatcgctcgccgcgccgcgcgctaatagctaagctcccacctgtgcagcccgagagccacggcgagcccggcgattccggctcccacgacgacgacgacgacgtcctcctcgccagcttccttttgttgcaacacggttggtgccatccttgtgtttggatttaagccaatatcatgcagtagtcagcttctttagccacaggccctcttattacttattaggagacacctcacgttttttttcagctttcttagccacaaaattctctattgatcctcgtggctgcaggctgcatcatgaatagcctatctcgcacgtgtttggatcctggagtcctgctgtctgcgagagtgatggcctctagccgtagcttgtgtggctgctgtactccggtgagtgttgacatgtttcccttaccacctataactgcacggttaccgcggggtatggtaaggttatcaatagtagggtttttgagcaaattcaaaaattctaaaaaaatagaaaaaaatcatggatgtagttcttgatttttaatggtagatggtgaagaattttttttttgaaaaagagtaagataaaatnnnnnnnnnnnnnnnnnnnnnnnnnnnnnnnnnnnnnnnnnnnnnnnnnnnnnnnnnnn

SEQ ID NO: 37322 - DNA, 711 bp, Oryza sativa
tttcgatgagcctgtatagacaacactagcagctcagcaacccccgtgtatgaatggatttggaaacccaatttatagtctatagacagatcattgtgcccatttctccactgtaggcagcaaaatccttcccacgtacaaatagcgttatttggcttcgagatcgtgctgtaggagcttctacgtcaaaaatcggatacaaatgagcaacaatacacttgatccagtgacctcacactctgcgcagaggttgagaccccagaccccaattcaccaagacagtaattgcaccatttgacactctgatattgactctatgacttcccgttgaattggcagctgacgcatatatctccaaggagtgctctggtatgtatgtaagacctgtagtagaaagatatcaaacaaaacaagcaggaaacatggaataaattccactatagtctacatacttctttctttttttacaatcaattccaacaggaaataattatatgtcaacatcctaaggaatctaggatattcacattgtgacagattgttaaaaaaaaaagtgttcctccaatgccactaatttgtttttctttctctgtgtttttactatgcttgcaagaaaaagtatacctttctcccttatcgttatttgaagtgtatccagtgtaatgatcccatccgttaatggaagtagctcaagcttgacggtggtgcttg

SEQ ID NO: 37323 - DNA, 312 bp, Oryza sativa
atacagacaaacatcacaaacagcacgacgatatgattacaggttgcagacttgcagctgggcggcggccaaaacccaaatcacgtcaacaagcaccggaactcgagagcgtgccggaatcgtagtcgggcatcatgagcagcgtcttggcgagcaccccggacaacagcttgtcacgcaggaagcccagggggggtggtcgctctgctgcacgaaccccaccgcgtacgacgcaccggtcagctgcgcactcctccaccgccgggcgtccgcgtaccggcgcagcgcggcctcgacgacccggtgactctc

SEQ ID NO: 37324 - DNA, 638 bp, Oryza sativa
catactcagtggataatgataatgtgtcgaatatgtattccattgagatgcatggacaccgttctgatattaggagtcttgcacttaactcagaggacaacctcctgatgtcaacaagtcacaatgctgttaagatatggaatcctagtactggcgactgtctccggacaattgattctgattatggattgtgcagtgcatttgttcctggaaatcggtatgcccttgtaggcacaaagagtggtactttggagattatagatattaatagtggaagctctattgaggttatagaagctcatgctggttccatacgatcaattgtactcattccaaacgaggatggaactgctggtgcatggggttttgtcactggaagtgctgatcatgatgtcaagttctgggaataccaattgatgcagaaatctgataatgtgagtcttctgtctaatcccttggcatcgtctgttctcctatgactctacagaagtgtctgtttttcttaaccaagtctccattatttatatgccaagaagaacaacaatttattgtgatgcatctcttaatgacattcttttggtttattttgcgcctgcaagtttactaaccagttctccacatgaagaggcatgttttgc

SEQ ID NO: 37325 - DNA, 725 bp, Oryza sativa
cccaatcatcgggtatgttggtttcgttgtcccacagtgttgtatcttctccttccactacaagcgcaaggtattcctcgttttccacttccatctgatccactaccgcctcattctccttcgctgcatcaacacgcataggcgaatcaggttcttcatcgtccaagtcgttggcctcacgattagtaccacgaacaatgacctctccttgtgtattaccctctactacttcttcccctcgaccttgcttagtctgccaaacattttcagcttgtccaccttccaacggagtttcttccaccacggcatgacttgactcccccgatcgatcaacacatgttgtcttctgcaccactattgccaggctatagcctttctcccttactttactaacaaacttcctccaactcccagttgacgcaacctccactactctccactgccatccatgttgacccctcactggccacacggcacttatgacaaatttatcgtgcactggatctaccccaaacatattatacaaccaccctaacacgtcgttcaaacccatatgctccggtgcattcagactagtatcatggaaggcatatacagtcaaatccaccccgctatcacatatttgtataggagcatcgccataatacagacgaatgggcatatcacctgacatcctgataaaacatgacaaatagtctcacgtttaatcatttaatcattcgata

SEQ ID NO: 37326 - DNA, 1513 bp, Oryza sativa
cacatgaaagtcctaataatcattttgttcttatatatcgaagggttatccatttccgatggcctctgctcttaattaatttgtgcagttcttttaatccctgatgctgttgcatcgttgatccgttgccaaatggaggaaacaaaacacacagcaaaactattttttttcatgctctgtttttgtcttcatacgtgtgcctgactaagaatattctcccaaatggcaattaaatatggcgttgattaactcaggcaacatgtcagaaaaacacggacttctgaaagctgaaacttggaaaatgttggactgcaattcaatttctggaagtagtggataacctaatcctgtacgaacaactgctggatatgaatctcttgtcggtgtgctgattttccattagttaattgaataattgagtcggtgttttctttaattatggtttggggcatgccgcattgccgccctgattacgcaaattgtttttatattttttgtctcgtgggtttacgaatcggaagaattgggttgtgtttagatccaaagtttgaatccaaacttcagtccttttccatcacatcaacctgtcacacacacacaacttttcagtgacatcatctctaatttcaaccaaaatataaactttggatccaactaaacacagccttggtctgaccggattgcaatgccggtcgttgtgcactagacttatttttttttaattttatctacattcatgttacattattcgataatatcataatatggcagcaatatggtgcttttatattttagggaaatgttaaaaataatatactccctcatttcctaaatatttgacgccgttgacttttttaaacatgtttgaccgttcgttttatcaaaaaacttttgtaaaatgtgtaaaactatatgtatacataaaagtatatttaacaataaattaaatgataggaaaagaattaataattacttaaattttttaaataagacgaacggtcagatatttttaaaaaagtcaacggcgtcaaacattttgggatggagggagtatgtatcactggctgtgaggataacatcgccatgtcattgggtcgttctgttctctgttccagcctcattggatgagaaacacattaatattcaaacaatatcatgaatactgttggtttggtcagcttgtcctagtcggatctttggacaaattgacctgaatcgagctggcaaccgtgctaattttcaaggaaatcaaaattttgaaagaaacaaccaaccgaccggtcaccggtgatcttatattcttatttgaatagtacttgcagaccgtcataaatcacaacactttggttgtgtttagttcgtgtgccaaatttttttagtatacggatatacatttaaagtattaaatgtagactaataacaaaacaaattacaacttttgcctgtaaactgcgagacgaatttattaagtctaattaatctgttattagtaaatgtttactgtagcatcaca

SEQ ID NO: 37327 - DNA, 4652 bp, Oryza sativa
caatgctcccatgttttttttttttttttttttttgagaaactttcatggaaatgtcactgcaactgaattcaggttctgtctgaattggattgcaactagacatgatccatgtaaactcccgcctaaattgaaaggcaatctttgcactgccctttaaaacctttttcttctttagctcaaatttccttttgactttcttctttcttctttatgtttccattttttatttacccgcaataaaaagaacaggggatcacttttcactagggaatctatcaaaaaacaagaaggaaagaaacaaagacagtttcagactttggtaagggcagtgggccttgctcatttcaccctttaatcacatgtttgggccttctttaatcccagatttggcactccaaacttgtccactttctgacagccatttccctgatggcaggtagcttctgtgtgtgccacatacctgcatatgctggatgagtggctgccaaccatgatcctggaccatttcttccattctttcactcatcctggcagcttcaggtctggtgagaccgtgagagtggccagatcacaaacttttggctcaagtgaccaactgaatctgaatgtgggtggcctgcaggtaagtgtcagtactaacttgcaaggccaacaatcaactggttactgatctgatctagtattgcagcacattattttcctgctaccaactgcaagatcgtcatcattcttaggcctgtttagattccaacatttttcttcaaactttcaacttttccgtcgtatcgaactttgttacacacacaaactttcaatttttccgtcacatcattccaatttctttaaatttccaattttagcgtggaactaaacacagacttatgccagctgtatggcttcgtttgttaattgttattattgttaactttgctgattacaaaagagtcaattcatgcagttctttctttgttttatgggggctacttgtatgaaattattgaaatctgtaatcaaattgcacacagtcagaaaccggtggttagaggccttggtcctgaagtctcaactgtacttccttgaattcgctagataaatcacagaagatgattcgacgcattaactaacaccattgagttcagcatcatgcatcacaacgaagagatcaaagtttcaattagtaccacacaatgatcttgactaacaataagctccaaaccagcgtacagagttacagacagttttatttggcgtgatctagactttgcaagcaacaatttgggcgatagagataagaagggaaaaaaacagaggcacccgtactaacacaaaatgtcagctgatcatgacgtactgtttaccttcctatgatctgaagaaacctcacaatagtgttaactgtttactgcgatacctcaaccatgcaatatataatttttcttttctagatttccactatgcttgtattccaattaaaaatactactatcttctaagattgaccttagttttggattcagaaccaccaaaatccaggattgaataaaataccacaaataaaatatatccctagcttgaccttacttttttattgtcccttcttctaccatgatgaaagggttgaaagccaaacaaaaaagaagtcctttaagctaaagttaaagaacaaagtggatcgcattgcatggccccccttgacacatcactttcgttcctctatttcttcagacatatcatcacttgtatcaggtttgctgcatacatgcaggagaggatttggtggagaaagtgaaagtggaagaaaaacattcttgcacgagcagagcacactactgcctgatgagtgttctttgcgatccaactttgtagaattgtaggtcaccacagacgctttacgcacatgtgttgttgcacgcgatgtcgcatgctttgatccagacatgaggagacgaaatgcgtccatccaaatttctggcaaaagtgtcgagggaagcatcgaagtttcaccatagtttacttgaagtttcgcaaattaactagctagaccttgcactttacagtgctgaaaaagttgtaaaactcgcagcggcttcacaattcagttaggaaaaatgaaaccggatatataggggctgttcagattgatactattttcaaacattctatttttttttgttaaagttgcaaaaaaatgtctacatctagtttgttttcaaatttgataaatacatatgaattccagccaaaattttgacaatattgacatattcggtattgccaaaaattagtaagatttatttggctacaatctaaacagatcttattttttggcccatgttatcaaaccggcccattccatttccgaagtagtatcacgtcatttctctcttaatatacaacaattgtgctttttctgcagctccgtcacctccctgtcactgaagttccaaagtaggaggctaggtgcagataacttgtgtcttgcaagtgtcatagatattgtcatatattcaaacaaaataattttcagttcacattttctcagtgctgcaaaaaatgtaaaactcgcagcggcttcacaattcagttaggaaaaatgaaacagaatatatagaggctgttcagattgatgccattttcaaacataccatttttttaaaagttgtaaaaaaatatctacatctaatttgttgccaaatttaataaatacatatgaattccagtcaaaattttgataatatcgacatcttcggtattgccaaaatttggtaaggtttatttgctacgatctgaacagaccttattttttggcctatgttatcaaaccggcccattccatttccgaaatagtatcacgtcatttctctcttaatatacaacaattgtgctttgtctgcagctccgtcactgaagttccaaagtaggagcagagaacttgtgtcttgcaagtgtcatagatattgtcatatactcgaacaaaataattttcagttcacatttttttgtggctgaaatctcaacggatgaattcccagaaattcggacaataacacaccattgtcccctgcaaacttctaagcaaagctctatgacttgacagttcgtgaaactcgtcctaaaatccaaaaccggccggaaattccaaagggggatttgacaggagtgataggcctacatgagcccaaatgcaaaaaggccccacaaataaattcagcctaagcccactaaaattctgtggataaaatcgcatctccgccgtgtgacactgacaccctgacccaccagtggggcccactagccagcggcaacgacctcctcccccctcttcggcttcaccgaccaaaccaacacaatcgcgcggatcaacagactcgagtaggggagagagagagagagagagagagagagagagagagaaggcgacgcggcaatcgatctgcccgcctcacctccggccaccgaccaccgccgcctccgcgtccctttgcctcacctcgacgccggctagcatcgccggcgatgggttgctcctcctccgtgccaggttctctctctcacacgtttccatcccccttttttagattagatttcctcgttggctatgtttcggctgcggatattgttggtaccgagtgttaggtaagcaggtgttgccgtgggggttttcaaattgggttcgattcgtggcttgctgctttggaaaatgggagggagggaccagcttttttatgctgaaagctgattggggataaatgttttcggtcacagcgttgatcggggcgaaaattcgcgcaatctggacggttttgaactgtgatttagtgaatttaagtcaatttgtgggttaattggaggttagagcagggtgtctgcacgatctctatgaatgggaggatcgtgtgtggatgtatgtgagtgggggctggggaaagtttgtagctggagtagaagaattagccattttccgccatttgttaacacatagcactgttttgtcatccagctcgaagcactggagggttgaacaatattagcaacgataactccgctactgattcaaaggacttgcgtgctaaggtttactgcacattttgccctttattactacaataatgcctctatatcatgttactagcagctttctttaacgtgtccatccttttgatgttgtagttggtattgcttggtgactctggtgtagggaaaagttgcattgttcttcgctttgttcgtggtcagtttgatcccacttccaaggtgattactgttttgagtctcttagtttcagttgataatgttattcttcaccttagatgcatgattcttactttcagaagttcgattgttttaaacttatttcctcaaataatttcaggtaactgtcggtgcatcatttttatcacaaacattggctttggaggactcaacaatagtgaaatttgaaatatgggataccgctggacaagagaggtacacatacagcactatggttttagcttcttccaatcttgggataatggcatgctgttggtgcattagaagcattggttttgtgagaaagttctagtagtatgtgttactgatttttacaattgatccatcttacgtgccacacatgcatatggtttttctcaatcaagaactcattggtacc

SEQ ID NO: 37328 - DNA, 695 bp, Oryza sativa
  unsure (1)..(695): unsure at all n locations
agcacgaactgcttcttcttggctagagcatcgtcatctagagcagcaacgcaccgatcaattgctgatcactaatcgattcactgttcgtgacactgtgtcaatgacagagactaaccgtgctcagaaggagaccaggtgaagaaccagtagacatcagtatcgttgcaggggatcacgccgatgttgattaatttcagctgtggcccaatgcaagccgattctctcggagctgaacgggaggatgaattagtctagcaggagtttgttagagatgcaaataagtcgcaaatcagttaatcgtgaccgagtctagcgctggcagtggcgcgggtgtgtgcatggagttcagagaaaagcggatcgtgggatggcgcgattttgcctcggattcctattttttttgcgttgagtataagtagttctcttagctctttattctttttgtaaggtttacattcagttgaatgagaaaaacccagaaaaaaattgccccatacattctcgcaagaattctttctctgaaacttctcctctgctctgtttgctgctctgttcgttgttgccgctgcagttcttgccgtgccgggcgtgaacagtctgccagcaaggtgtttgatcggagtttttttgctattgccacgtggaannnnnnnnnnnnnnnnnnnnnnnnnnnnnnnnnnnnnnnnnnnnnn

SEQ ID NO: 37329 - DNA, 501 bp, Oryza sativa
taattgttacaagcttatggcacttctaaaagcatgacctatgttccatggcacttcaaaaggaaaattttcagaaaaatatggatttccttagaacatttagcagatcttgtagagatattcctaacaaatggattcttattaaccagtaatgactttaaatgaaaataaagacgggcaagtcaaagggcacatactgttcggaattgtgatccatccttcgtcatccaaaacatcggtatgctttccagtaggaactgaattttttgaatctgcatctgcagagtccccaccgatatctacatctccattatcagtatcttcatcttcaggggaggggtgatatggatcatcggcaataaggccctccagagttgtaactggcttttgtaggctatccctttgctgatcttgctctggaatccgcggaagctcgggtgcaacaggctgcgaagtccggtagaggaaattcatctctacccgtcctgccaagcaaagcaa

SEQ ID NO: 37330 - DNA, 988 bp, Oryza sativa
acctacaaaaagtaatcaatgtcagcacagttattgatttgatgcaatgacaagagactgaacaaatgcgcagcaaccatcagaagaactttttttcccaccaaaccacaattataggccgtaaatgttcatctgctaatcataaaatattttactactaaagaggatacaagcaaattcaaagtgaggatcaccttcccagcccttgaaaagaattcgtacacgtctctttcatccgccttcagagataactgtgattatgctcacaaacattagtttcaaatagaaaaggcttcagcattttcctggtcacaaagtgaaattcaaatgttacactaaaatgcacctggtaggcaaatactgtcctttgatctcgttctggatctgcttcaggctctccagcctcttctttcctacgtctgcacagacaataagcaaaactgtcataagcattgatacgaaaatatagaaaaatatatatataatacaagcccacattaatcatcagctccaacagtaatggagttcctcataaaaagaatactacctcagtttctcaatatcaatcattccctacatgttagtgtccatccatactaatataaatttatatcaccactcaatcctctctccctacctctaacggtctcacctaaataacaagatttgttaagatcacaacgcttaactacccaacaagttatccaataataataattgaagaaatgaatgtgtcagatctaggggtccaggaagaataactttcaacgttcactgagcatagttcagccatcattatagatcataactgactaatcgagttagacatttcattagaatatgtggcccatcaacattctatcaagtcacatcgtaacaagacatgccttggagataagcaaaaaatgtagtgtaaaaagccctttgttgtaaggcatagacatgcatcaccatgattgggggtgaacaaaaacggttttactaaacc

SEQ ID NO: 37331 - DNA, 420 bp, Oryza sativa
  unsure (1)..(420): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttgtggcacaaatggtatattcaaaggtggttagaaaaacatctttgtcccctttcaccataatgcatgacgttgagaaagagtacggatatgagatatcgtacgacaaggcttggagggcaaaacagaaagcattggagatgaggtttggaacttatgaggattcttatcacaatcttcccccactattggaggtgatgcaggcaagaaatccg

SEQ ID NO: 37332 - DNA, 557 bp, Oryza sativa
tcatcaccggcgcgttcccggacaacatcgaggagatcctcgacgtggccctgctgctgcaggccgaggagctcgacggagcagcgtcgtcgacgacgtcggaggaggagagcgaggcgcgcgtcacggtgcgcgattgcttggcatccgccattagggtcgggctcagctgctcccggcgagctccctacgagaggatggccatgagcgtcgccgccgacgagatgcgcctcatcagagacgcttgccttcgtgcttgtggtaaataagtaggacagtatactgattatttgtagaactttgacagccgaattagtcgatggataattattactacgtcatcggcatcgaattctatcactattcgaggcttcgagcaagctgttgtggagtaaaaaaaatgaaaatgtaaaatccatggaattcaggagctctgatctcttgatttatctagtgtactgtactgacagaaaatggatgtactctgcatattcagatttcagaatagattgttctgtttatgtccagattccagaatataatgggccctgggaaat

SEQ ID NO: 37333 - DNA, 578 bp, Oryza sativa
acactagatttgtacaaagttttcttcagctgtaattcaattcaagtctataagaacagaacatgaattaaattttattgagaataatgccaaaattggcattgttagcaaaatcctctaactggaagtaatcaaataaaagtttctaatctcaagccctactaccccctaactcagtagggacccaacccaacattgcaacctccagctggactaattttccttgaagacaggctgataacttaagctaggctgaagagtacaagggccttgacacattcactagcccagtttaatgatattttttgggccttgacatattcactagcccagtttaatgatattttttgggccttgactgacataattttgagcatacctagcaggccaaatccttgtggggcttggtcaggttgggccacttgtgttatatctggtccatcgctacattcgtaacctagcataatttattagttagtttcagttgtcgcttgtcagaaaaaattgctcaggtcacaagtcccctgtgaaccaaaatgtttgagtcacgaaattgtcgattgatgaactacttgcag

SEQ ID NO: 37334 - DNA, 503 bp, Oryza sativa
  unsure (1)..(503): unsure at all n locations
cccgcgaattttcggagcccaagtaacattatcaatacaaagttcatttaatcaattaaaataaaaagaaaaccaatttaaattccccttctttcccttgggccggtttcggcccaagtctgctttgcctccccgcggcctgggcgccctccctctctctaaggccggccgccccgtcccttctcccctcgggcctccggcccagatcgcctccctctcgaagttttttttgcgtcccccaaccgacctcctctctctccctctggccgacaggtgggacccgagaccccacctgtcagctcttcctcctacctccggccaaccgccatggctgccgttgccgcccacgattgccgccgaatccggccaccttctccactccgcacgcccgcacccggccgtgggactctgccgccccacgtnctcctcattcccccacctctcccgcaaaatccggccgccactttcccacgtcggcgccacctccatccatcggccattgc

SEQ ID NO: 37335 - DNA, 507 bp, Oryza sativa
ctaccgaaacggacaaaatatgccatctattaaaataggcataactttctcatacggactcggaatcaggcaaataatatatgcacggacatctatagaaaaagttacatccgattctcccccgctttgccgggttcgacgatattaaaacctccaaattccgcttgcaagattgtgttttcgaggaaagaagtttttcggtggagctttggaaaattccacatgccacatatttcgtccgtttgagtttattttttacatggttggttcctgtgaggtcctaagtgtgaaaaaaatatcaacaaaataaaataaaaataaaaaagttgcacatctctctcctctgcactagttcggaaagagaggagaggagaggaaaaattatacatgtcacatattacgtccatttaagttcaatttttctatggttggttcttgtgtgtccctaagcgtgaaaaaaatatcaaacaaataaaacaaaaataaaaaatttcggggggggggggg

SEQ ID NO: 37336 - DNA, 1203 bp, Oryza sativa
ccgcaaaaaacgaaggcgacgcgcaaccttgagttgctcccgcgcccgtcacccgaggtccaccgcccaccgccgccaccaccacctgctcgccgccgctgccaccgagcccccgcctgccgccggctcatgtcaaggggggagagagagagagagagagagagagaaataagggagagaggaggaagaagaagggtagcgagagagaagatgacatgtgggacccacatgtcagtgggtcctataatttttttgtgtgaatgacaaatggccccgcatatatattttttattttagtgccacataagcgccacgtcaatgccacgtggaataaagatcaggtcaacactgccacgtgcgcgccacgtcagcaaaaccgccctcgaaaaccactcaaggagtcaaattgcaccggttttgcaagttcggggtgaagatttatggtattacgattgagagatacgatttagattcggtggtcaattgacggagtcaaagtgatcttattccttttttttattggagtaggccagcacaggcccattcgtagacagcctgggccgaagtttttggggccgataggaggagccgcgggtcccacaagtcagtgtcctgttctcggtagaatacaggagcaccgggagcgtcgcggctgtgaccgcgaaaaggaccgtgagtacgtgtctccatgaaccgtaaatcgctctcgctcggaagaaaacacggaggaaagcggcaccggcaacgcgtccgggacaaagggccggcttcggcacccggcactgcagattttgatctattataagtaggtaagcgggtttatcacttttgcctctatcactagttcgctctcatgaataggacgagaaagagatgatagggaaaaaaaacgagaggagaaaaattaacgtgactgtgagaaggagggggagagatggagaagtatacggcgttgaggagtcggaccaggtccgtccaactgtccaagcgagtgcgaccacgattgagactaccggtcgtgactgaccgtggagtcaggttttctcacctgtattgatgaccttctttcatttttcatgtttttccctcaacactcaaaattttctctaatgagttaagttctactagcttcgtactccctataacaaaaaaaataatggtcaaagtacagctttaaaaatcataaaagttactacgattcat

SEQ ID NO: 37337 - DNA, 361 bp, Oryza sativa
cctagtaattagcggtagtagtatgctcgtcccttctacaaacaggcgagagagagagtgagaaaatcaaaaacgataaatggcaatgcgcgctcgatcaggccgccgtgcgaacggctcagctagcagcgcggcatcttcttcttcttcttcttcttcttcttcttcttcgtctactgttgcggctggcccgccatgctgaaggattggctcttcatcgccgtcgacttcttcgccggctcgccgccggcgccggcgccggccatgctgaacgattgtccgcccatcgccctcggcttctttgccgccggcgccgcctcgtcggcaggtacttctgcggtcacccgctcggccttcttct

SEQ ID NO: 37338 - DNA, 681 bp, Oryza sativa
tccaatccaaccacccctcgaccgttttgctacaaaatgaaggcgcatcatagaaaaccctgaactggttcagcagcagtacagccttcgaccatcctcactctgtttccacttgcgagcgacaccaaccgcgggtgggggttcgcgaacaatggagggctcgggcgtcgagggcatcgtcatcgccggcgccggcctcgcggggctcgcgacggcgctcgggttacacaggtaagcctctgtgccgaccgtttcgccttgatctgctccgcgtttgcgcgcgcgcgcgcggatcgatctggagctgatgatcgagctgggccggcggtgcgtcccgtgtgcaggaaaggggtgaggagcctggtgctggagtcgtcggcgacgctgcgggcgtccgggttcgcgttcacgacatggacgaacgccttccgcgcgctcgacgcccttggtgtcggcgacaagatcagggagcatcatctgctctacgagaggtgagcagccacttgctttaccaatcccttcccttctagttgtagatccagataatagccagacagagacagtggaacagacgaacagtggagtccgttgaccgtcacgaaatcacaacaaatcctaacgcgagtataataattctcgtttaagcgaaatcaaatttacagcccagctcgtttgataggc

SEQ ID NO: 37339 - DNA, 700 bp, Oryza sativa
  unsure (1)..(700): unsure at all n locations
ttgttcttgataggtttatgccttgaaacgtgttcggataggcaggttcaggcttccaccagatctcaggtaatgcagtttaccacatctgtatatgtttgaaatggaccattatacatttacactgtctttttagcatcttagcacctactcgacatgacatgttcttttcatgtaaaagatatgaacactgaacactatatactgtaagaaaaagatcatgtctatgaaacatcgcaagaaagagcatggcactttcttgctgtaaatgatatgaacaataactatatcataagacctgtcaaatattgtgaggtaacatggtgctgtatacttgatagcatctgccagcaggcatgctaagacctgtccagtatagttggctgattcaaagataactggtatgccatcattttagaggcatgattccatgcacaaaatgataaattaatttggtatcctggacctttttgttttccatttattcttacagactgggaggaaaaataacactgaatattaacccttgttggatgttacatgttcagaattgggaagtttgttgaacttaaacaaactgatctcaagtcactggaaggcaagaagtagagtgaaaacctgggtccacgggtgctaatttcgacggtaatnnnnnnnnnnnnnnnnnnnnnnnnnnnnnnnnnnnnnnnnnnnnnnnnnn

SEQ ID NO: 37340 - DNA, 12615 bp, Oryza sativa
  unsure (1)..(12615): unsure at all n locations
atattgccgtgtactaatttacaactattagtaacaaacaactagtttaataatccaaataaaatataacacctttgtacctattttaacacacaacatatcaataatatgtactaactaagaactaatttaaccgtacaattacttaaatacctctaccaacatttagcaataacaaatatgtgctaaccatacatactaacatcgaacaatgcgaaacaattaacaactcttaaaccaatttttttattaaactttcatatgcattgtacttagggattactaatgtataccttaacttcactgctggagggcgtcgccaaccctttcctcccggccggtgcctcctcggcctcctctccggcctgctatcccctcccctcgctccctccggcgctcacggcgacgatgtggcgactcttggcggcagctggcgatgtggtcacaaatcgaactcgcggcctgggtggacggggctttaaaccggcctgtcgaacgcccattgttcgacagggtcggtggagggccctgtcgaacgcccccggttcaacaggcctcgcggcgccgggtggtgggccctgtcgaactccctccgttcgacaggtgagcgtgtcgaacgccagccgttcgacagagctttgtcgactgcccgtcgttcgataggtgccctatcgaattgcacccgttcgacagggacctattttcacgattttccccggttggccactacttttacgattttccataaaaataatattaatttttttctcaaaaaaattccaattcaacgcaccctcgagtcagcactcaccacaacaaagccctcctattctcccgcaccaaccaaacccaagaggcgggggaagccatggcgagcgcgtcggtgccggccgccggctacggcgcggacggcgtgtaccgctcgctgcgcccgcccgcgcccgtcgcgtccgacccgggcctctccctcaccgacctcctcctccgccgcgccgacgcctgcccctccgcggtcgcgctcgccgacgcggccgccggcggccgcgccctcaccttcgcggagctgaggtcggccgtcctctccaccgccgtcgcgctctcctcccgcgcgggcgtgcgacccggcgacgccgtgctcctcctcgcgcccaactgcgtgctctacccggtctgcttcttcgccgtcaccggcctcggcgccgtcggcaccaccgtcaacccggactacaccccgcgggagatcggcaagcaggtctccgacgcgcgcgccaagctcgtcatcaccatctccgccctggtgcccaagattgcggggctccgcctccccgtcatcctcctcgacgacgacgcgaacgccgcggccgcctccttgcctccggacgccaccgtcacgctctacaccaacctcgtcgccggcgtgaaggaggcggattaccgccgcccaccaatcaagcagagcgacacggcggctctcctctactcgtcgggcacgacgggggatagcaagggcgtcatcctgacgcaccgcaacttcatcgccgcggcgaggatggtgacctccgaccaagacgagcgccgggaggggcccaacgtgttcctctgcttcctccccatgttccacatcttcggcctgtccgtcatcacgtacgcgcagctgcatcgcgggaacgccatcatcgccatgtcgcggttcgacatcaactccctgatggaggccgtgcagaggcaccgcgtcacgcacctgttctgcgtgccgccggtcattatcgcgctcgccaagcacgggaaggccggtaagtacgatctcagctctctcaagttcatcggctccggcgccgcgccgctcggcaaggatgtgatggaggtcgtggccaagaaattcccggacagtgagattgttcaggtactaattgaactgaacatttgatatttttcactgtttactttcataatatatgctgatgaattgttgaaattagcttatggttggttgctttgaggtgtcaatccatacaggataggttgatccatcatggcatcatcccgtgattacgatgggattagtcaagtcattgattgaccaacccattgcattcctcaaacctaacacgaaataatggttcagagttacgtttgggcagtgaattcataacaacatttgttctgaccgtacgttttataaggacatacctggtttgatttggaatgactacgaaattaagtctttctttggctgtgcctttgtggggtctgatcttggttgtgccttccagggcgtaatatagtgttcatatgtgaaagggcatgtagcctagtgattgcagtgacctgagtagcaccccaaggtcctgagttcaaatctgcataggagtgaatttcagattgtgttatttgagggctaagttccttgtttgataggctaagttcctaatttaaaaaggttgcatatatccggttggatgtagaggccgggtaaaaaatctctaaaaaaatattgattcgatagaagctggaaaatgacatttaagtgcgggagactgacaattttgtcctataaatataacctcattgaggcaaaggacatttaatttctttttgtttctatatttatacttaaatccttaaagtgtgttcgcgtgtgtgttggtgataggaaattaagaatgtcaacttgcaatatctgaataataatggatattttgcctaatgcagtgggcattgaactggttcattcgtaaactagtcctatcagatctgtttggatcaatttggtatattgtatgtgctaatttcagtctgatgtggtccacaggccaacaccaagacaactcgtcaagatgtaaaaacttgctctaaaagatgtgatttctggtctgtagccaactgttctagactcaagaggtgtgcaggcatttctagtgtgtcttcaaactgcaacttatgacagctaaggcctttttgttgacatagctgtaataaacattgtccggatacatctttgatgcagaggctggatttatttccgtaatccagttttggtcaaaaaaaaaaaaagacatacaccgtcatggtctagcacctaagcaaccactgcaataagatcacagaactatcttaaagtggtttggtagtttgttgcaccacactccttgtgggaacatgattagtgtggtggcattcttttcttccatgatgctacagtgtatctgtaaaatcaactagtaaggttaagaattttatatctcaagttgtatggcatgttatgctcctctttcagggttatggtatgactgagacttgtggaatcatatcgctcgagtacccagaaaaaggacaggctcgtgaatttgggtcaactggcacgcttgtctcaggagttgaggcaaagattgtcgacataaagacattaaaacatctaccgcccaatcaagtaggagaaatttgtgttcgagggccaaatgtaatgcaaggtaaaatttgaattatacatttgatcaattattatacactggttctcaaaataactatttcaaataccagtatcagtctaatactataatcatattacaatggaactgtagctatttatttgtattctttgttttcaattgtacattgagtcattgacaatgcacaatttaacaaagactagtgatgtcgagcatacaaaaaatatttgaaaatattccacctactagacctcactatttttcactgacaatagatcccaatatatcttatgcattctgtcctgcaataataatagaacaaaacaattgcttacctatctgaatgttgcgtttgtagggtatttcaacaatgtgcaagctactgaatttacaatcaagcaagggtggttgcacactggtgatcttggatacttcgacggaggaggccagctttttgttgttgatagacttaaagaactgattaagtacaaaggtttccaggtaaagaaattgattctttttccctaaatacttttttttgtccaaaaaaaatttctggtcagcccctctacttatgttagtcacatcagggcccttgctaatactatgtaaattatgtcattgaatctcgtgctgatgagttttataagcagacttgaaagatcatatacatataggatcaattcagagtttgccgcaaggatagattgatatagcacaccaaaccttctgaaattgtcgtggcttactagaataatttcgtgcatatattatttatttattaaaaaaatgcttagcaggagctctttccattcactaaagaaagaatcatatagaatagagctggttacaatcagaacaccaaagagagaataatataggattatttctgggctccgttcgtcatgtatcttaacatttttgtcttgagcataccataacctcaccttttcttttttatggaatttcctgtcttttttgtttactctactgatagattgcatctactgagattacaatacactgaaaagccttttctctattaccatttaccaaagcacatatttatagatgggagttgtctgaataagatccttcttgttttagtatccactataacaatcataacaggaatccaacctaatgcttgtgttttgtcttgcttgagcacgcgtcatattttgtccaatatatggaaatagctaatcatctcctttattttacttctttagattgcacctgccgagcttgaagggttacttctatctcatccagagattctagatgctgttgttatcccgtaagttgaaccacctaaaaatttaagtgtttcttgctccttatgatataaactgttcgcttgttacaacattgttgttttggatcgttctctctctgttgtgccttgtttcttaacggagctctacttgtttccaaggtttcctgatgctaaagctggggaggttcccattgcctatgttgttcggtcacctgacagttcattgacagaagttgatgtccaaaaatttattgaaaaacaggtgaggctgatttggaagttggaaccttgtttaattgggattgtagactagtggaactttttagcagcatgagacaatttgggtaaagctcgtccagatactaatgttaatgaaacatggagcatcaattagtacatcgagtttcattcatatttttcttagagttctacccactttgactatacatgtacctggtaaaaatccaagatctaaatagcaagaatagtttgctgtgctggccaaacactggtattagcatccaacatttgcaatccatgaatgaacaagtattttgtgttttccatcgactgcatactaccctaggtgctaatatacttttttttgacacaaaggtgctaatatatttcactaatgaactgcattatcaggtggcgtactacaaaagattgaagagagttacctttgtgggcagcgtgcccaaatcagcttcaggaaagattctgagaaggcagcttatcgcccaagtgagatcatccaagttgtagcaaattaatctgcttctctttgggaatcaatcgtgcttatgttttgccttgattcagccattttcaaaacttgtccgcgaaggtttatgtagcattgtgaagaccacgtgaatgtatgatgtatcagaatggaacccccatactgtgcattataataatggaacataaatgccaatttcaagataacatactctggaaaggatatagtactaaagaaaaaaaaagctctgacttaggctgcgtttgttagttaggccttgtttagatctaaaaacattttagccaaaaacatcacatcaaatgtttggacaatgcatagagtattaaatgtagaaaaaaaaccaattgcatagttccgtgtaaattgcgacacgaatcttttgagcctaattacgccatgatttgacaatgaggtgctacaataaacatttgctaatgacggattaattaggtttaataaattcgtttcgtaatttacaggcataatcttgtttagttattagtctacgtttaatacttcaaatgtgtgtacgtatacttcaaaaattttacacccaagaagtaaacacggccttagggttcccaacccaatccctttcgcgcgcacgcttttccaactgctaaacggtgtgtttttttgtaaaaaaaaaatctatacgaaagttacttaattaatcacgcgctaatggattgctccgttttccgtacgtagggcactagttcctaattgggggaaacgaacacagccactatcctctagcattgagcctacaagtaccaacttattccgttccaaaaatccaatctagttagggataggacattacctctccaatgaatgtctcatccctgcaaggtcaatagtgcagcaagcggtaagctccaaaattttatcatgttaagatagagctaacttaagaagccaactcatacaacaggctaactacaaattatctataagctgccttggttagagcaagtttaatagtatagcccactactagctccaattcatctatagccaattcatacaatagtttcttactatactattaatatatggtctcacatatcatacacacattgtgtcttggagtccgtgctacagctgactacatatctatagcctgctgctcttctctccaattatttatctccataaaatatgtttatagctagttaatagcctgctattgtacctgctcttaaagcatacatacattaaatataacaagtttttttttgtgtgggacctacataacaaattttttctcatctcccgtgaccgatacagcgtggggcgctgtgcaagcgccggcgctaaaacaagcatccgcttgtttctcttccagcgatttctttctctaatctggtattaggctgattaataagttttggagccttcttaacggcgctattgtacctgctctaagtaggttaggtttatgggatagagggagtacgagactcgcgcatcaatcatttcattccatgccaaacacatgatgcatgtgattgacaattgtttggaggcaaaaggtaggggtagcgatgtgtgctacgctggcagccttgctgcacgtgtcatcgtggaggacgtacgtgtaggcaggcgtcttgatcgacgagctcctcggctcttctacgggtccggtgcttgtgacttgggagagatccgagagggtaaaccggccggcgagaaacgggaggaggcagcttgcgagcagcaggggtgcatgcctcttgcgggacacgagcgaaaatgccgtgcgcgtggcgcggaccgaatagttgatgggccgaataccggcacgagagggccgtggtttagcgggcccctcatggaccgtagtttggccttttaggccttaatttccatgggcttctagtcacgtgtgtgcgctcctaggctattgacggcatagatgtctatcaaaaccggtgcaattttactccgcttaaaaataagttcactttgctatatagcactctatccaaaggaaagatttgaacttagactagctgcgtaggtactctattttaggttgatatctactccgtcttgatcagaatcccacagtgagatgagatgttccaattccaattgtgctagtccctgtttgtaatgtgtaaatatttttcataaataaattagtcaatgtccatctgaatctagagtaaacacttgtaacccgcttgccattgtttttttttcattaaaagaaagaagaaaagttgcatctcatttagaattttaagattaatcattttcgttaaccagccttgttttcatgtctaagaagacgactttaaaaacggcctaaaataatctttaaaatcatatttcacaatctgactttttaggaactaatgaggtggaagaaacggtggccaagcttacatggtagtagcacgtatatcgtttcacatgcattggttgatctaaaaaaacaattacaattgtgtacctgtctctctatataaaaaggggaaatttaatacacttttatttgccagccagattgagttggcaacgaattcttaacaagaatgacaaaaaaaaaaagggaaaatgaaaagagaaaatatcatcgagcttttggtcgctgttaaaaaaaactcgacacgacattacttgcaaaattaagcctagtaattagcggtagtagtatgctcgtcccttctacaaacaggcgagagagagagtgagaaaatcaaaaacgataaatggcaatgcgcgctcgatcaggccgccgtgcgaacggctcagctagcagcgcggcatcttcttcttcttcttcttcttcttcttcttcttcgtctactgttgcggctggcccgccatgctgaaggattggctcttcatcgccgtcgacttcttcgccggctcgccgccggcgccggcgccggccatgctgaacgattgtccgcccatcgccctcggcttctttgccgccggcgccgcctcgtcggcaggtacttctgcggtcacccgctcggccttcttcttgttggacttggtcccctcctcctccgccgccgcctcatcgccggcggcgccaccagctgccgcttggttttcatcctcggaggccgcagcagccgtcttcgcctcaccggccgccaacctttccgccatggcgccgcctgaagcatccgtcttcgcctcaccggccgccatcctttcctccatggcgccgcctggtgccaccttcctggactccgaggcggcggagggggacttcccggtggccggcgcaaaggagcccatcatctcctcggggttcagcgagctgatccggatgacggacgggccgtcgtcggtgttcaccgggttgttgaactcggagcacgatttcctgatctcgccgtccttgccggtgatgaccttcatgccgctgagcttcgtcatggccttgccgaaggtggcgtcgaactggtcggtctttttacccatggactccacgatgggcttcgttcttgcgtccatccccatgaggcggtcgatggtgagcggcatcttcttgtccatgacgagttcgaagtagttggggtcgacgacgtcgggggtgatgggatcaagggggacggctcccttgtcgccgtccttgccgtcgcagaaggcggtgatgttggagcggtaggtcgggtcgatgggcgccgcgtcgacctcgatgaagaagcacttggccttgccgatggagtggccgccggcgaggaggacgaccatctcgtcggcgctgaaccccttctcggagaactgcgccatgagcttcgggacggcgatgtccgggccggggagcgagtcgccttcctcgcggttggagacgagcgagtcgcggcggccggtgggcacgtcgtagttggggcccccggcgaggcgcacgctgtcgcgcgtgctgagcgccacgatgtccgcgcacgacaccacctgcgggcactccttctccagctccgtcttgatctcgtcgatgatgtcgtagcccttcaccgagatgttcggccccgcctccttctccgcgctctggttcgacagcgggtcgatcaagatcgacgcgtcgcatccctacaccacccacacacgcacacgcacgcacgcatccaacatcacatgcaagtcagcatccgccattgccggcggcgggcaaggtcgtagaacgtgaacgtacattggcgaagcagtcgtgnaagagaagncgaagaagaagggcgaaggtggtagggtcctccttgaacttgcgctcgatgacggtggagacgaccttctcgacgttggggcaggtggaggagtagaagtcggcggagagctgggcggtggcgagcagtggcgccgcggcggcgacgacgccggcgaggaggaggaggagggggaggcgggtgtccatcacgaggggtccagtatcgtgcaatggtggggctcgttgcgggccgtgcttatacagagcgcatgcagaggtggtcagcgcgggagaggagtgagcggtcgaggcgcgcgcgtgcgctggacggttcatggctatcgcgcctttcgacttctgggggtgtaataatagcaggggatgcttcttcctgcttccctcagctcttctcggcatgcatagccacgttaccttgttcaaaaaaaaatgttttctggtcgttttctggtgtatcgacgggacgatcgatcggctggaggaacggaggatgcataattaatctaagagaaaatccaaataaatataattgacaagcacacaatttcaaataagtccaagtttcatgaaatgtcattgcatcagcgatttaatttgtctcaaaaatatcatcgtcgttaatgttccgttagtacttagcatctctccattaagtgctataggataaataatacatttatcgtggcgggatgatcgaaattctaacggcaatttcatcaacggtgcagatccagatccggatctaggtgctatggtggtccctatatggtggcgtttggtggtagcgatggttcagctccacgactcggtgaagctcagcggcccggctaggtggaggagcgggtcatcaacagcgctgtccagtcgtggtgcgggttgttgtggtgtgtaggtggtgtacatagtgcaagtagtttcgatgtgcaggtggcatatggttggataggactccaaggtgaaagtcttgcttggcttgacggtgctagcggcggcgacatcctctgacgctgttcactttcttgaaggcgttgctatggagtcctcattcaactccacatcaaaagatttcttcgggtgaaaaccttatattcgtttggattgggcgatgtcgtcgttctgttagcgtgtccttaaagctttgtttaggagttttttccttattggatggttgttctttagttcagtaagtcaacggcaggatttttgccggttttatataaattaaccgtgccgttgtgagatttttagatctgttttttttatagactctcttttttctcttctatagtgaaatgtgggagcacctcggaaaataacatccatcagcaatgtctcttaaaaaataccatcacctctcaaaaatcacaagaggaaatagatacacaagagaagacgaacaaaactaggaatttcgaggaggtagaggtgaatgtatagatggccaaaaggcccgaggcccgatggcccggcccatggcatggcattttggcccggcccaagcacagcaccgggctgtgcctgggccactccaccggcacgttgggccagcccgacacaaccggcccggcacggcacgatgggccggcagccaagcccgatacacaaaaaaaaataggggagtaaaaatagacatattatatgccttggacgaaagaaaaggatgtaaaatagacttattttatctatacatatgtcagcccaaagaggagggatggaaaatatacttattttagctatatatatgtcagaccaaagaggagggacaaaaaaatagacttattttaactatacatatgtagaagcccaaagaggagggacggaaaatagacttattttaaaaaaacccgatgggccacccgtgccttcgggccgccacggtacggctcaacagttggtgggccatgcctgggcgggaggtgcagcccatgggctggcacggcccggcacgaagtgccgatcgggccgtgccggtccaatagctggtgggtcgtgcctagccgtgcctgagctgggccgtgccgggcgggccttttggccatctataggtgaatgcaatgcagcaatcagaaaaaaggagcacaactcttaccccttcgaaattccttcacgccttccaacaaattcaatcaaccactcccatttacgaagatgcaacttttctacataggcctggtttagttcttatttttttcttcaaactttcaacttttttatcacatgaaaactttcctacacacaaacttttaacttttctgtcaaatcgttctaattttaaacttctaattttagcgtgaactaaggcacccataatagaaggccaaatcgtcgtcgataagctgcagtcttcagtggggaagaagccatagttggctgccagtatcgccgctcccagagacaatccagagcaccacacaggcactatcgaggcggcttgtgcccagcggccgcgcgttttccgcgagcgacgccacccagagcccccgtccctcgaacccaacccgcccgccgaaggaagacacacaggcggataggggcacagccccgcggcggcgacgctggggcatcgggagttcagtagatcaactgcctggatcaacgacggcagcctgggtgaaggtcttgcgaaggttcacgttgacaaaaaaaaaaaacaaaaggaaaaggttaacggaaggcaactcacgttgattgaacggcgatggtaaaaataacaaaaggagaaaatagcttataccatggtattttgtagagcttacatctctatctatattatcataaaatttattagtggtaatggttttgtcacttccacctatcttatgtgctactatttgcttcctgaacagtataatacattgtttatcgtatcatctttaaccagagttttaaagtgataatttattattatatcaccgttaatcag

SEQ ID NO: 37341 - DNA, 3483 bp, Oryza sativa
tagttggctgccagtatcgccgctcccagagacaatccagagcaccacacaggcactatcgaggcggcttgtgcccagcggccgcgcgttttccgcgagcgacgccacccagagcccccgtccctcgaacccaacccgcccgccgaaggaagacacacaggcggataggggcacagccccgcggcggcgacgctggggcatcgggagttcagtagatcaactgcctggatcaacgacggcagcctgggtgaaggtcttgccgaaggttcacgttgacaaaaaaaaaaaacaaaaggaaaaggttaacggaaggcaactcacgttgattgaacggcgatggtaaaaataacaaaaggagaaaatagcttataccatggtattttgtagagcttacatctctatctatattatcataaaatttattagtggtaatggttttgtcacttccacctatcttatgtgctactatttgcttcctgaacagtataatacattgtttatcgtatcatctttaaccagagttttaaagtgataatttattattatatcaccgttaatcagagctggagaatgatgattaattttagttagctgataacccatttaatataattagagcccgttgtaacatatggatattttgctagtatcaatggtatttcttagaatcgatggtttgtcgataaacaatcttagaaatttcccctttttccataagagcaggtacaatagcaggctataaatcagctgcaaatatattttaagtagataaatgaggagagagaaaggtagcgggctacagatttgtagccagctgtagcacggactccaagacgcagtgtgtgtttgacagatgggaccagatattaatagtgtagtatgtaagtattgtatgaatgagctattagattgattataaatgaattggaactagtagttggctatactattaaacttgctctaatggcaatggaaaattggtggactcttcaaaatacattggctgattggcggacgaaaggcctagagaaccaccactccaaaagctttaatgaagtgtgaacgtgtgattgttcaaccgagatgcatttgcagtttttttctggtcacctgaagttgaggataatcacaccagcgtgtaaagatgttcacaaagaagttgttcgtgtatcccatattcccttgtttccttcatagccaaaaccaaaaggcaataagggaatcagatcgatatagaagtatggaaaattttgctaagacaagtagtagtatatcatataactaaggcaaatatccaatacaaatgtatatgcctacaataagcatgcaaaaggctgaaatttcactcagatcaaatgctaactacttcaaaatgctttaaacaattacatgacgttaaaagacgtcttttctcaaccatggcggaacagattaaaagccggttagaagttactcggggagtgatacaggtctggtcagggcacccgccactctaccaatcagactgcagcgttaaatcggaataaactacttttccaatgcccactaatttacaggccatttacacaaaaaaataaaaaataataaaccaaacacgccagacaacaatcaacaaacacactacactaatgctcgtgcttcactcgccctttcagtattcctggaatagggggtgagcttggcaatctagctgtaccattagttgatcttgcaggttgctgcacttgctgcctataaatatttggcatgcttgagctctcacctccatttgaaattagatcatgaataccgtcgatttgttcttctccacaagaactcattgctttcagtacaaatgagtcatcatgcaactcaaatggtgtgctgcagtttcagaaatgtaaatatcaagaacttacgctgatctaagggaaatctaagaggctgcaccgatatcaaattatttctttcaacaaaaataaaaggcatattttgatatgtttcattcatttgatagttccttttagaaagagtaaattgcactcatggtgcaagaacttgtcaggtgggcgtgttttagtactagaacttgaaatttgagcatattagtccattaacttggctatatggtgcatatttgttcaaagtgaaggccacattacatatttttgccacatcagcaagggacgctgtcgattgcacatcaggcacacaaatcgcttatctcccatcccaacaattttgaaacaaactcccgactatttttcatgttctaattgttccagatgatatataatgtctgcttctttccatttattatgaattcacgactcccaggttgatccattacttttggtgaactatgaatcttgtgaagctagatcatctacggcaagatgtggcaatgcatatcattcctgttcacatgatcaaactttggaaatatataggcaaaaatcgaacaggctagctaactcaaagatgttactgtgtgcttcgtcagtggtggtggcgggtgatggtgatgctagtcttctcgaagcaagcgttggccttttagatcaagctaaatttctactgtctagtttcattgttcaattgacagtataactatgaattgattcatgcatcaatcaagagattacagtgccctctatcaaagctaaatctagacctatagagcttttgatttgatattgttaccattgaactggggatatttgctaaaatgaaccttcagtctatctgtcgtttgaaggaagaagcaaaaacatgttacatgaatgacatgtcttgctaacgtggccgaaaattccgtgtggtattcaccttgaccaaaagcgcaccgtctagtcaagttggtgagccagtttgttcagttttcaagttcttacaatagaatgcacccacctaacaaattcttgtaccgtgaatgcaatttactcttttagaaaagtaaaatgaatttcacacttgggctctcatcttcccaatttaggatgccaatgtctccctattattcaagaattagtgatatggcaaatgtcactaggataatgaggacctgcgacctgtaattggactaaaactagatgacttagctcaaccaataaaagctaacaacacttttcaaaagtcacattatttacacttccgcttgtaccgtcccatcactagaggtttggagacaaaaatctctaccatccaaatttgatatagcagctgagattttagttcttttttacagagtgaattatattatattttaagggttaaaagaccactgccagaatttaaatgagataagaggatgcccttccagtgaggaccttctgcaatcatatcatgaaagaatagaaaaatggaaacagaaagagaaaggtgtggcttgctagataaattgtaaaggtgtgaccagatgggagagaataacaggattcttgttttacctattaaagtcaaaatgtacaagttgcatatcttctgatatttcaacttccacag

SEQ ID NO: 37342 - DNA, 6535 bp, Oryza sativa
  unsure (1)..(6535): unsure at all n locations
nnnnnnnnnnnnnnnnnnnnnnnnnnnnnnnnnnnnnnnnnnnnnnnnnnnnnnnnnttgcactcatggtgcaagaacttgtcaggtgggcgtgttttagtactagaacttgaaatttgagcatattagtccattaacttggctatatggtgcatatttgttcaaagtgaaggccacattacatatttttgccacatcagcaagggacgctgtcgattgcacatcaggcacacaaatcgcttatctcccatcccaacaattttgaaacaaactcccgactatttttcatgttctaattgttccagatgatatataatgtctgcttctttccatttattatgaattcacgactcccaggttgatccattacttttggtgaactatgaatcttgtgaagctagatcatctacggcaagatgtggcaatgcatatcattcctgttcacatgatcaaactttggaaatatataggcaaaaatcgaacaggctagctaactcaaagatgttactgtgtgcttcgtcagtggtggtggcgggtgatggtgatgctagtcttctcgaagcaagcgttggccttttagatcaagctaaatttctactgtctagtttcattgttcaattgacagtataactatgaattgattcatgcatcaatcaagagattacagtgccctctatcaaagctaaatctagacctatagagcttttgatttgatattgttaccattgaactggggatatttgctaaaatgaaccttcagtctatctgtcgtttgaaggaagaagcaaaaacatgttacatgaatgacatgtcttgctaacgtggccgaaaattccgtgtggtattcaccttgaccaaaagcgcaccgtctagtcaagttggtgagccagtttgttcagttttcaagttcttacaatagaatgcacccacctaacaaattcttgtaccgtgaatgcaatttactcttttagaaaagtaaaatgaatttcacacttgggctctcatcttcccaatttaggatgccaatgtctccctattattcaagaattagtgatatggcaaatgtcactaggataatgaggacctgcgacctgtaattggactaaaactagatgacttagctcaaccaataaaagctaacaacacttttcaaaagtcacattatttacacttccgcttgtaccgtcccatcactagaggtttggagacaaaaatctctaccatccaaatttgatatagcagctgagattttagttcttttttacagagtgaattatattatattttaagggttaaaagaccactgccagaatttaaatgagataagaggatgcccttccagtgaggaccttctgcaatcatatcatgaaagaatagaaaaatggaaacagaaagagaaaggtgtggcttgctagataaattgtaaaggtgtgaccagatgggagagaataacaggattcttgttttacctattaaagtcaaaatgtacaagttgcatatcttctgatatttcaacttccacagttgcatgaggccgtgtctgcatgattcattcttgtcatttagcctgaagtcatgtgcaggaaacagtgccatgaaacaagagaatagaagacaaagaatttatgaactattcacctgaacaaggataaatggtaatgcaactccacccgagggaatgtttcctgaaccatatagctgttcatttctttgtatcaacttttgcatacctacaaacttaacatgccaaaaacaatgttaccgagtaagggcattatgtgtatcacagtatctaccactaaagccacacaatttgaagactatggtacactgctagctcagtagaacagttcattttatatattgcattggacatgactaaagaaaagcaggttgagctatatcattacttggtcttgcagctcctgcaaatatgtatttttcttctcaatcctacttttcagtcctacaagttccgtctgtaaaagagcataaataaattaataaatatgactaccaaaagtacatcaaatgtcgataaccagtgggaaaagaagacgaaaaacctgcaaatcttcaatatcatttatactggttcgaggcaaccccttccactgaatttcctttttatctttagatataatctccatagccatcagaacattcagagcatcataaacccttctccgtatatttttctcgtcatattgttgctgcatttaacacaaagtgagcatacaactgacttaagaaataattggtgatgcaggcaagtcatttctcaactgcattgggattatccggatctggtggcaaaatgctgttattgggatctgcaaattcggcaacaagttcatctgccacctgataaagataagtcagaaggactatgagacttggacttcaccaataagggtaaacattgaaaactatcaacaaatgcatagccaaaattattacaactttttgccagagagacaaaatatgatagtttttagcaattttgaggaactccaaacatgaacatgaatagatgcaaagacagattgttagtttaaatataacagtagaagagggtgatatgtatagcggatttacaatgatcaatatggtggatgtcacatattacaacacatcaccatagtaagatctgagcaagctgatcaaacagcagtgttacataagacatgtgagtgagttaccaattttatagccccaaatcatgatgcggaacatggcagttttatagataatgaattgtttgacaataccaccaggtggacggacaatatgaacatgttggcttattggagcaatagctagtcctgccctgtgcatatattgctattaggttttacattgcatacatagcctaagtcctcttgaaataactgattgaatcttcaaggatagagttaacaagaagacaactatgcaaagaaacagggagctgacacatgcaacatttgtgatctcaatttgctgcttcaatccatgtgatgtgaccacgtacatgatgccatcagatgctcagaacaagatacatgaactcggtagaaagaggaaagcactaacctcgttgtatgttgttctccctttactttcaactttctcacaaactgcaaaagaacaaacagtgtcatcatgagtttttatagcacatacttgtggtgcttataaataaactcaaatggtgtactaatagggaacaaatgggatttaacacacctttcatactaaactggcgcagccccctgccacctttgtcaggaccaactgctcgtgctcctctcttcttcttcttgctgaataattttattcatagcaaaaacccttattgcaaatgcacaaaactagataacaatgaagggatttattttttgaaaaggagccttaagaggtagagaacttctgccaagtcgtacttccaaattcataatgcagaaaaacatgcactggcatccaaacagcagtgttctacagtctggaatctatgtagcaaaagaggtcacatgactgatgttttactgatcatcgtgagtacagtatacacgtgtaatagactacagatgagaactactccgtatatatatagaattaacactttcagcaaggtaaacctacagagcataatcgtataagcatccccagaaaatcttacttgcaaccacacatcaaagtgatggcaggatacacttccctaagcattttgcagcccaaacacagctaattacaacactacggacaattttaaccacccggtgcatctccggagcattttaagtagcgtacagctacagagaaaaacaaaaaccaaccaaattctcaaaatcttaaaatcttgtaataacattgggaaaaaaacgcaaccccgcggcgaaaactggcaaaccaaacgctgacctcgttggagcctgtgaggaaggcgcatcgtcgccgtggatgtcaaggtcgttgaggcggaggaaggtattctcactaatcggagtagaggccgccgccgcccccgccgccatgcctgcggctgcggggacatgctgctcgctgcggctggacggggagcccgcgctcccgccgctcgtcgaagcggattgcgctccgcccgagggcggcggcgtggccagggacggccgcgcgccggccggctgcggcgggcgctggaacgtcgaggcggcgcgcccgccgtcgtcgtccgggcggtgggcgacgccggagaccatgggtggccgagatcgcgcgaatcggggaccagaatggggaggagttggagcgcggaacccctaaaacgacaaagagggggcaaattggagggagagaaagaaatgagaaatcgacgagagggcgggcagagacgcggagacgagcttcttttctcctctttgcgtttttgtttctttctttttatttttatttttttttcttatgaaatttggcggtttcggctccgtgacgcgccggctgccggcgcctgaaatgagcccaaagcctagtgcggtgccaggtggcctcatcgtctgaacccaaagcctagtaggaatgagaacttgggaagcgcgagcatttccgacgaaatcagcctctccaaccattcacatagctaattcctctcctgatttggctatttggtaagccagactcgcagttttttcatctacacttttcatttgggtctataacagtgagacctatgtatcaatccatcacttttttttttcggaaatccatcactttatttctctccttctccttcctcccacgtcccaaccactactccgtacctccatcctcaatgcaatatcctcccaagtgccaaccactaatctattcctccatcctcaatcctccaccctcggtagtagtggtgggagggcgaggacgacggcaacattaagcaagccgctacacttgcgtagagtgggtaggcgatggaggaagctagagttgaggatgaagatgtgtaagagggcagggagatgtatagataaatggccaataaattcaaaatcaatatttgtttagtagtaaaaagtaggccacaatggtgataaagctattagcgcatgattttatccattaaagctcaaatcctactgctgatttgcatgtattcctagagaagttgtaaagcctatatacttccattatcttaaaaataataataataataataataataataataataataataataataataaacaacgttattaataagtcatactacacgttgaattcaggcccaaagttccagttgaacccaatacaggcccagtacacatggataacaccacgtgcgtttaggtcttttaaaatacaccgaattgccgaataaaaaaagcgttttttcggcccaagtggcacagcgttaggcacgtcagcccaaaactgacctcaccgccgcacgcggcagcccaccaacttaggtcgttcttatccaacccaccagctcatcgcaagccagtactagtagttctagaacgttcgagaaactgaaccatcgcgcgtcgctgcagcggctcgccggtttccgagacgtgggcccacacccacttgggcccttgatgggccctacttggtccaaagcgagcgcggcttccgccactggattccagcgaaggacacgtacaccgcctcccgcacgtagggcccatttttgttcgagaaaagtgaagaaaaaagaagggaagggccagggcccacgaccatctcggcacacgtcgccttccaccttatcgtcacagcgatcgtcacacggcacacgataattttcgtcgcacaaatcgtcgcctcgtacgtgtggttcccttaaaaagggaaaacgtcgtacgcgaggactgaagaaaaggggaaccaaagccgttgcaattaccatcctcctctgactggaaatatcaacgacccctttctaaaaaaaaaaaacaactaatgccaacatttacttgattgatcaccgtgttttaccatagtttttgctctgaagctacgtggcaagaaaggacagtactgtatctctgtcacgtatgagccgtggccgcatagaaactcgaacattgtgacaaggtagtactgtacaaacttgagttgtggagtaccaaacagtatctggtcggtgacatccaaccaaacagctgttgatcctatctaaggcaagtagtactgtactagtactaaagtccagtacactggctacgtaggagtacacagcagcaaaggcaccagcaaaatctacgcgatgacgccacgtgacatgacatcgcaggtgaccgtagccaaagccaaagcaccagccgcggcaggcaggctggctttgctggtgggaaattaccggccactgaaaggaaacttgcgcccgacgcgtacacggatccgcacggcgggcgggcgagcggactgacagggtggccccacccaccccaccgcggcgtctacggtttctttctctttctctctctttttttttcttcttcgtctccgtcgcctagtcggcttcgcctccgcttcctcgtctcgtctccctccccctatttatccc

SEQ ID NO: 37343 - DNA, 440 bp, Oryza sativa
  unsure (1)..(440): unsure at all n locations
cccacttgggcccttgatgggccctacttggtccaaagcgagcgcggcttccgccactggattccagcgaaggacacgtacaccgcctcccgcacgtagggcccatttttgttcgagaaaagtgaagaaaaaagaagggaagggccagggcccacgaccatctcggcacacgtcgccttccaccttatcgtcacagcgatcgtcacacggcacacgataattttcgtcgcacaaatcgtcgcctcgtacgtgtggttcccttaaaaagggaaaacgtcgtacgcgaggactgaagaaaaggggaaccaaagccgttgcaattaccatcctcctctgactggaaatatcaacgacccctttctaaaaaaaaaaaacaactaatgccaacatttacttgattgannnnnnnnnnnnnnnnnnnnnnnnnnnnnnnnnnnnnn

SEQ ID NO: 37344 - DNA, 765 bp, Oryza sativa
attggaacatctcatctcactgtgggattctgatcaagacggagtagatatcaacctaaaatagagtacctacgcagctagtctaagttcaaatctttcctttggatagagtgctatatagcaaagtgaacttatttttaagcggagtaaaattgcaccggttttgatagacatctatgccgtcaatagcctaggagcgcacacacgtgactagaagcccatggaaattaaggcctaaaaggccaaactacggtccatgaggggcccgctaaaccacggccctctcgtgccggtattcggcccatcaactattcggtccgcgccacgcgcacggcattttcgctcgtgtcccgcaagaggcatgcacccctgctgctcgcaagctgcctcctcccgtttctcgccggccggtttaccctctcggatctctcccaagtcacaagcaccggacccgtagaagagccgaggagctcgtcgatcaagacgcctgcctacacgtacgtcctccacgatgacacgtgcagcaaggctgccagcgtagcacacatcgctacccctaccttttgcctccaaacaattgtcaatcacatgcatcatgtgtttggcatggaatgaaatgattgatgcgcgagtctcgtactccctctatcccataaacctaacctacttagagcaggtacaatagcgccgttaagaaggctccaaaacttattaatcagcctaataccagattagagaaagaaatcgctggaagagaaacaagcg

SEQ ID NO: 37345 - DNA, 1061 bp, Oryza sativa
  unsure (1)..(1061): unsure at all n locations
agtgtacgtatatttcacagtaaaattgctacatcttataaaagttgaatttaaaattaaatatgtttatgaactgatatattacatatcaatctatttatcagtttttctaaaaaaaattataattattttgtgatatgcaataaacgagtagacattcaccgagtgattagaatccatctaccgatgtacggattcactctgttctttttctacctttgctctgagaattgcgccgtcggctaggtgtaggatcttggcgtcgccgtcctcttcgatttcaacgattttggaggagtagcgtattgtgccattgggtagctcttcctcaagtgctcgcagtagccagtcccgcctgacgcagagcatttcgttgggtcctctgcatccaagccaaatcggcgtgtaagcacggcctggagtgtgtagtagagatcagtctgagcatgccatctcaccgtttcccctgcacattgagagacgttgtatgtgacatctctcccgtggacgaagagaagacctgcaacctgtgtgatgtgaacgattcagatcaaaacatagagatggaattttgctctaggaaatgtccacttgtttcttgcatttatatttttttcaaaaaataattaatatacagtatatcactcaaaaagtacaaaattaaattaactactacaatttctcaattaagaattaactactaacaaattaaaatgtacataatattcatatattcacgtacggccgtatattcttttttttttgcaacttgtagagctcgaattagacatacatggtaataaagtatacacatgaatttattttgtttcatctaaaaataaattatgcatgtttgagtgacatgcaaaaacgaaataacaaaggtgtatctcctgcagtgtttaggtctttgttaagtcttgtgcgacttcgtccactcattaaggcgcgcacgttttttaatatttaactctttaaatgcgcacgttttttaatatttaactcggtaaatatnnnnnnnnnnnnnnnnnnnnnnnnnnnnnnnnnnnnnnnnnnnnnnn

SEQ ID NO: 37346 - DNA, 2195 bp, Oryza sativa
gtcttaccggggtgggggcggtaacctctccccttaattttatgttttcataatttttttcataataaatgataagtgcaaataatcacacgatgaagtagagaagataaatgggagagagaatatgctgtatctcatgtaagaggtaatctataggagcaaccttttccaagagccatgacccactaataggcatatatagcgtgccttgacgactgaaattattgctaatgaaaaaaaattgaaaatattgttcaccatttttttctcgaaaatataacactgttgaatttttcacaagattagatcgtcgtagcaagaacggcatgcaaacacgtaacgagtttgtctacccaccatcagatttggagcacaatgcgcgtggatccagctcctctgaccttggatggaaaaggcagagaataagggcccgtttagttcataattttttttttccaaaaacatcacatcaaatctttggacacatacatgaagcattaaatatagataaaaagaaaaactaattgcatagttatggggaaaatcgcgatatgaatgttttaagcctaattagtccgtgattagccataagtgatacagtaatctacatgtgctaatgacgacttaattagtctcaaaagattcgtctcgcggtttccaggcgagttctgaaattagttttttcattcgtgtctgaaaaccctttccgatatccggtcaaacgtccgatgtgacacccaaaaatttccttttccctaactaaacacaccctaacagtaaaatgtgtctgtgctacatcagaaacagtaatacgtagtgtttcactgtagcaacagcactctagctctctaactttacccatgtaaagtcagaggatccaaatccaatgcgcgtgtgggcgggaagctaagtaagtttattgggccacgatatctcatgtaccttcagcgcgaactcggccgtgtgagaccacaagcatgcatcatgcctgcacgaactcagggcctcattggatggatgtttgggctgaggcttttcagccaaaacccattgaattgcttattgggctgatgagtaccagccacagaaaatcttcatcaagttaaataagccaatcaaaccaatcaatggtttttctttagcttaaaggaaaaaagccaactttggcagtcaaagctatttgcttaccgatgagggcttcgtacagtgagtacaaccccatgaaggtgaggacgacgtcaacttcacgagttcacatttgctttgatcactttgttattaaggccgtgtttagttctatttttttttaaacttccaacttttccatcacatcaaaacttttctacacaaaaactttcaacttttctgtcacatcgtttcaattttaactaaacttttaattttagtgtgaactaaacacagtctaagagagaatggtggtattttaacttgtaagaaagtttcacttatgttcataaaattacaaagtgtgtattgaggttcgtaaacttgttttatcgtattattctagtccaaaacaacttggtttatcgtatcattcttgtccaaaaccttgtttgacctacttagcatgctacgtggataatgacatggcacttttttttttccctttttttctcccctctccctcagggaattttttttatttatacttttttttattaaaatatttacaaaaataatttgttgtttcgaaaatttacaaatctaatcgcctgccgccctttgagagggcgatttttaaaaatcgcccttccacagggcggcaagggacctaaatgtaaattttccagcataacttgttagctctataattttacaatttaaaattatattatataaagtcagatgaaataaaactttatatcaaaattgtagagctcaaggagatctacaactttgtagttaataactttttcatttaagatgttttagatatccaaatattcgttacaaaatataaaacacattttaaaaaatctcagatctacatttcaaacgacattagatggagataaactttatataaagttgtagatcttgatgagatctataactttgtagtttatcacttttccatttaaaatcatttggagtatcgaataagcattattagtttttaagcaattaaaaccggtgggaagggtttgaacacaaataaaaattttgtattt

SEQ ID NO: 37347 - DNA, 1786 bp, Oryza sativa
tatttgttacctgttttttttccttgagttgctaaaagaggggttttattttcttagtggcttggaatatctagcagtttgcttataatagccaaatatatctattgtttacacatttgatgggagggaggcagggtgttacttgtgtttcctgttttagaatctccaaaagatctgattagactttggtgttctactgattgttaccttggtcgtttggtgcctcccatggattcataacctgagatctagagagggagggtggggcttgattttaggttttacagtatcggaatgaactcgttagtttgtgctcataatgcttctggttttgtgtccaagtggcaatattgacttactgagaatgagggagatggacccactgttttggggttttagtctgtgttgctaagccatttgtttgtagcaagcaaatagcaaatgcctcctagctttctgtaaagctgctccagttttgtgctcatgtggcaaatattgtgatttaggttgttggattcaatgttaggcatgtttgcacgtgagtgtaggtgtgctgtaaggtccattgttggtgggcaacaagggaaggagatgaactgaatcagaaggtatgaaccagagtggagtagatgtctcacaagaggctgcaaagagatcaaatgtgtgagaattgttttttgggtggggggtgattggtagggtatttcaaatgttaatgaataccgaccatatttgtcaatatttttctggttgctgttatgattacacaagcatttttaaactgtagctacatctacgatttattatgggggaatatattcaccgatttttcatactcggcaggaatgtttataatttggtgtatctactgggataatcagctacttatgactaagatggaatacaagatctttttgggggaagtaagcagcgtggaacatcaaacatagcaattccacattattggatgccatttctgcgcattttcatatgattttggttggaggaatgtgcaattagtttgtgctgggaaaaattaattctaaacctgtttgaaaatgtttgatatgcaagattttatgtgaataactgaatatcttttcaaaagattgaacgaatgcggcctaattctatcggcgacatgatatcctgatatttattatgcttttgcgtttccaggtacatcgaattctatgatgttatgtctgtaccaatggcaatagctctttctggccagctgcttcttggtcaacaggtgatggttaagccatcagaggctgaaaagaatttagttcagtcaaatgcttcttcaagtggagcagcttcaggtggggcaagaaagttgtatgttggaaatcttcactcaaatattactgaagatcaattgagacaggtgatgccgacaaattgttttttagatgagttggctgtgcttttggaagaaaatttcccttggagttcataatggaaaacatattacttttatggggtagaagaattactatggcatccttgttatgcatatatagagtttaatgaattctctttaccaggtcttcgaaccgtttggtcaggtggagcttgtccaattgccactagatccacttactgggttatgtaaaggttttggttttgttcaggcaagtgtttgcttattaagcaattcttttgtttttgtggagagttctgtgtggctgacttctgtttcatcatgtagtttgcacgccttgaagatgcaaaggctgctcagagtttaaatgggcaacttgatatgctggacgtgtga

SEQ ID NO: 37348 - DNA, 20923 bp, Oryza sativa
cattattggatgccatttctgcgcattttcatatgattttggttggaggaatgtgcaattagtttgtgctgggaaaaattaattctaaacctgtttgaaaatgtttgatatgcaagattttatgtgaataactgaatatcttttcaaaagattgaacgaatgcggcctaattctatcggcgacatgatatcctgatatttattatgcttttgcgtttccaggtacatcgaattctatgatgttatgtctgtaccaatggcaatagctctttctggccagctgcttcttggtcaacaggtgatggttaagccatcagaggctgaaaagaatttagttcagtcaaatgcttcttcaagtggagcagcttcaggtggggcaagaaagttgtatgttggaaatcttcactcaaatattactgaagatcaattgagacaggtgatgccgacaaattgttttttagatgagttggctgtgcttttggaaaaaaatttcccttggagttcataatggaaaacatattacttttatggggtagaagaattactatggcatccttgttatgcatatatagagtttaatgaattctctttaccaggtcttcgaaccgtttggtcaggtggagcttgtccaattgccactagatccacttactgggttatgtaaaggttttggttttgttcaggcaagtgtttgcttattaagcaattcttttgtttttgtggagagttctgtgtggctgacttctgtttcatcatgtagtttgcacgccttgaagatgcaaaggctgctcagagtttaaatgggcaacttgatatagctggacgtgtgattaaggcaagtgttttcttcagatttactagaatacatgttgttttcaagctatacatctcaaatataagggttctgcctgacactatgctaaactgctgtaaccaggtttctgctgtgacagaccaagcaggagttcaagtcagtggagtaactactggagatttggatgatgatgaaggtggaggtttggtgggtgccatttctggagacacatcgagaactggaaattcacttatcatatttgatatatatatcctcattttcttttaagtacaattacttgggacatagcatgcttttgcttgcacctcgcctcaatctttttagagaagattttactccctccatcccaaattgatcaccatatatgcatatgcaccaaaaccaatgataatttaattcacatcaatcaagacatcatgcacacattctcccacagcgcatgcattgattaaaacaccatgccaattacacccttagcatgcacacattctcccttgctgcattaattgtattccgatgaaatccatgttcatgtggttatatgatgatcaatttgggaaattttgaatttcattatatgatgatcaatttgggaaggagggagtaatgtgcaagaactttaccatatgatggtttagtatacactgagcactctgcatacctagcatatctactatagcaagcctttattgcatggtcatttgttcattcttagttggttaatgtttgaggctgtttttaaatgccacatacttatgcatattgcaacagtatctcaattgtgtctgtgatgactttgctgaatgctgatgtatgcaggcactgaatgctagttcaagagctcttttgatgcagaaattagaccgtagcggcgttaccaccaggtatatatatgtgagcttaatgggttaaactatctttttggtgccctcgtggccatgtcaatctaactacatcagtcatattcaatcttacatataacctttgtcccataaatactccctctgttttttaatagatgacaccgttgacttttggcatgatgtttggccatgttgaaaaaaattatataaaaatgtcatttattttgttgtgacatgttttatcattaaagaaatctttaagtatgacttataggcatatttacactaattataccaaaagtcaacagggtcatctattaaaacagaggtagtataaataggaagaaaaaaaagaccatgatacccctctttaaatgtggtatggacgggaggttggttaggggttagctcgtttgatggcacaagtagtactatagaatcccttatattttgggatggaggtagtagcttgtttaatagtgtgttgctcagtcaaccaggtaatttctgtaatttgttgatggtactgcagagccttaagttcatatttagaatactgggatgtcaaatgtccagaacgtcaattatcttgcttgttagagttgctgtcatttgtatcaaaatcattcgttattgacctttactatattatcgtcaggattcatccaccactacatcaacactgtttccatatgtatatagcttgtcaaggtcattctccaaggacctcttccaattctttggtgtacatcgctattgttaatattttgtttactccatttctaacatcaaatgtcaatcgcattgactactacaaatttcaagagagtgaaccatgattgagaaatgccgagaacatgccacagtaccttattattcttatggtatcatcaagttatcgtgacaagacatgttagccataaccttttaatttttcactgcatttccaattcaaaaaatgtgcgtggcatatattaactacaaatagttggtactggtttgaacacttggccttcctctgaattttttaccttccttttgtctgtctgcagtttgactgctgggatagccggtactggtttgaacacttctgttggattaccacctgcatcagttcttggtgctcctccagtcgctgcatctgtactgcctacagtgcctggtcttggttcagttcctggggtgtctcttccaattactacccaagccattgagacagccccacccagtgaatgcctattgcttaaaaatatgtttgatccatccgtggaggtttgttcttactactgcattctttttttttttgggttcaccaacagtccataccttttttaaaaaaaatctttactggtctgtatcctttctgtttggttgattaaaaactaattgaaacttactttattgcagacggaccctgattttgatttggatatcaaagatgatgtccaagaagaatgctccaagtttggccaagtaaaacacatttttgtggacaagtaagtttgttcaacactaattaccagtcaacaaatctgtaacagcttgcatacggcattattgtaaccatctacagcttcccagtacataagtcccaacacaatctagtaatctagtaaaatatagtattcaatagttaccagcatgtacttgtagagtgttaggggaataattctctattctctgctaacatatccaaaggctctgtttactgtgcttttatctttcaattttcttgtgtactgcaacttcagaaaggtgcagtgtacttttgctcctcgtactgcagtgcaattattgccgtgtgcaaacctgatttaccttgaaaagcctgccaattttacaaggatagcctaaggccatgtacaacgtgtgaccctggcctgtggtctcaaacctccacatcggacgggcgcatccatgtcagtggggaccgtggctctgcaggccgattccgcgcttgcagaggaaccggtcgaagcgccgtgcctgggctcgggagccgcgaagccacagcccaaggccacgcgttggcggagccggagccccgtgcttcgcctcgtccggtcggtcgccgtggtagtcgtcgctgctcaccgccgccaccgctgctccccgccgccgccagatgcgaagaggagcgccgccgatgacaccactgttccccgccgccgccagatgcaaagaggagcgctgctccccgtcgccgcaggatccggcgagcccgcgcccggatccggtgagcccgtgcccggatctggcgaccttgtgcgcagggtggcggcgaaggaagtaggatgcagcggaggagggcgtgtgcgtggcagaggaggaggagaggatggcctgggggaagaacgcggcggttgagaggaggaggcggcgctgcggcggcgcaagagaagaggagcggcgctgtggcggcgcacgagaggagaagtggaggcaacaagaggaggcgttggagaggaagagggtaaggcagagccggttggtaggaggagaaaataaagggaagaggattggagaggctgacagtgggtccatatatagattaggggtatctatttctttttgttgttagaaggactaaaatagttaattttataataacaaatatcatagggactaacacaaataggtaggggctgaaacacaaaatatactctgcagtggtctccattgtagatatcgtggtttttgtgtggccttatcctatgtggcaacctgagaccatagttgcttgtggcttgcattgtacatgccctaattatttggtattgttgcaactattttgcaggaatacttctggctttgtgtaccttcgatttgacagtataacagctgccatgagtgcacagaaagcacttcatgggaggtggtttgcgggaaagatgattacggcaacatttatggtatggaatacaacatttaattgaggtcaatcttccctttctaaattttgggtttgctgattgctcttttgctgtgtcagtctccgcagcagtactcaacgaagttcccgagctagcggacagcaactttcggttgatcgctgaagattcttgctctattgctgtgtaacggtctcctgtaacattatgtcatgcagccttttgtactttatagcatgggttattcaacactaagttcgcatacatcactcgtttttgcttaagacattatctataagctctcgaagtgtacggcgggcaaatattttaactcttggtgtttcaattgatcgtgccgtgatggcaaatattaaagaaatgttgtcgaattttggggcaatcgtaattgcccaggaaaatgatctcattacttgatttatacccctatcatccgtttgaaaagcagaaattcttgttttagaaagcacagttccctcgagatttcctaataagaaggggctatacatggttccattacatgtaaagtaaatcattggatctccttgaaaaaagctggatttgaatttaatgcctttttggccaagttacgcgtatcatccctggatgattcccttgatatgcgaaggagctccttgatccctccggttagaataatgtcacgggcgttatcttctgcgaatatgcgcatgtgataggaacatcagtgatgagggtcaaatactcaaaatgcgtgagcttgattgtacacagggagggatcgaaggtgacggcagctagtcagtttacgtaccattttgagctaaatggcaaaatgcaagctcaatatgtcttcgagttgaagcagaaaacgcggatgaattggccaccatccaattaagaacaccttcttcgatgaggagggatctccctttcctgtgacctattttgggtagaatggcaaaaaagttggattttccctctcaagtttgcatagttatcttcaggagaaaagagctgaggacagtagtgttccatagtgttcaaggtaaaaaaatatgtaacatgtgacaatgcaatccatgttaaggcatatttagcatatatgattgtgtaagcctaccaggatattattaattgattagtggtgtaatatcggttcgtgttcttgtgaacatgtgcgttatatgcatagatctactatagtaattttcaagaagtatgtacgcaatttcagcaggctctagccctgttggcatgttgtatcatatcagtgtatcacacttcagattgtcctctgccgcattttacctcttttcaactacacccagatcgtcataactatccaaataaattcaggactgttctgcagttgatattcatgcaaccatgtggagtttgatattcaaaccataagctcatagaaaacaacaaacaattacagaataatatgaacgaatatatccatcacaaatgagtaatagagaatgtactaaccttgacttattactcgggattcacattttgcaaaattagccattccccgtgctatctgagctatgacttcgttgtgtccagttcggaacattccgagaagtgcttttattccgccatcttgtttcaacataacatgcagcttttctgcaaaaaaaaaaagaaaaggagtacatggtattggtcactcattatcaatcaatgttctacatacacgagctctcttgtttccattccaaaggaatgctagctcgatagttgcatgtcattgctgttcaagaagccacaagtggtgcaccctcacaagtcacaagaggacaattgcccaactaaaattacattattctaaaacaaaataaattaaagaaatgtacttatcagctcttgacaaatatccgggcaccaattaacaagtttgatccgtaaaatcatgactttatcttgtttacattctgcatcgctatccacctttttatcttcatttcagaactactagcaatcagcgttaaaaaaggccctgataagctgtcctgatgcgccggaggattagtggctactggctagaaggatatgaattcaaactaaacactcaaattgtaaatttagattttttttttcagcaggtaactgcacagttaccctccggtactggtaaaaaaaattcaaattttggatttgaattttatctagtaaaatctggtaatcggtggaaccaggcctggtaagttagggaatactggtatttggaacgctgctagcaacattgtcaaacaaaaatagttaactcattaaaattgaaattgaaatttgaataaaaatatgacacccactgccgttcaagaaaattgaaattccatattaaaaggaatattttgctataatggatacaataaagacaggttgtaccgtttccacataggttggcaagggcaccagcaaccatccgcagagtttggggatcattagttttcgacgcaatatttgctaataatcgagctcctcctttgttcattattagtccctggtttgatcctgcacttacaaggatctaacttaatactcaagttattgcctgttcattttataaatatcgcaatataaatttgactaataatatagatatagttcaaatatgtaaaaagaatatctcatgctggaaacctattggggaattttccttcagtcaatgactgggccatttggcatgtgcggaagacatttagtgaaagactatagaacacaccggttaacaactacttccatgctgcaatattatcagcagtgagccaactatacaatgaaataatagccccttttgaccaaatgtggaaaataaatctcatgagaggttggaataggcattaccattcattgccaaattagcaatagcaccagctgtgactcgatgaattgtggtattttctgatgtttctagaagtgacagaagagcatccagtcctccttcttcaacgattttttcctgattaacgtctgcaatcccagatggattggtgataacaattaactatggttataacagttgccttctaaaggagaaaacatagcatagacagcagataactgaaacaaatcactggcttcaatattatgaccaagtgcaaattacaattcgtatggaacagttgaatatgttcgtcaacagaatttgaacaatatgccactttcacatttttcacatattataaccaaaagagatccacatatttttagggaaaaaaaatcctcttttcaggaatattttccatgcaaatgtacaaggaaaggcagtgaatgaaaaatattcagagttttacataaagtcccgtaccttcagcagcaagattagctactactttgacagcatggatctgcacctctagttcatcagacttcaacagagccaggacatttggaagaccgactgaatgccagttggaccaaaaataatgtcaagatggctacccacaaaaaacagctacactgatattgtaccacaaataaaagtaccttcttcaaatatctttgatatgttacttctctggctagatagcaactctctggattttcctgacttagacataaaaggcacactacctaatccagatcctgatctaaccataccacataatgctttagactgtcaaaaagagagattgacataagatatgattggaaaatgagcatcagaatgtcaagattataatgcaagtgtggtacctcttcagagcaattatcagccaaagattgtttcaaccttagaatttcatcttcaaggccctgtctatgtctcatctcctgttgcatcttttcttgagtagatttcagctcttcatacaccaactcctagaagaataattaaataaaaaggtacattaaaattgtttcagatttgagaaaacctaaacatctccatatgtttagatgtgctgtcccgtgtttgccataccttctctgatatgagatcagcaattctttcttcgagtgagcttatttgactggcaaattcttcagtggttctggagagctgcttctccaattcacaggctatatttttctgcaaccgggatatcctcatattaaccttttcaaaattcctgaaggatgcaaacaagtcctccaacaaaccttaaattattgcagggacatgcgcaatgacattctgccaaaaggccaatagtgaagaaaaaaaaggaaaaactatagagaacccaaggcatgtctagtctaaaatgtttttccatttcaagtatggagagtagtcctggttgaggaatgaggatattatatccaaacaagatgcaaccacaaacaaaaaatgtatacctgaattatctgactgttatattgtattagactattagttactatgaattatctgactgcattatagctacagttgtaaattctgaaagtatacctgaaaataattctgagcatcactcagttgctgttgtagtacatttaaatggtcgttcatgctagcaaaacgtgatctttcatcttcaagttgcttcagcaattctcttattttcttctcatgagatttagttgtatcggcaagaatatttgtgtttgagatgttctcaagctgtttttgctactaacaacaaaacttgtgttagaactgtgaaattattgaaataggacatctcagtgtcagcagaactacatcaaatactaagtacaaaatcaagataaacattacatatgagagaaatatataatatggcaaagaaaatctaccttattctcatccaatgatgtttctaagtgaataatttgctcagataaaatattatttttgcctttctctttctcaaggtccagcatcaatctcttgattgtagattccaattgacgcttttccatcgccatattctgcgaaaataaatcacttgttacattatatctataatgccctgaagcaagttttatgtactgaaagtgatttttcctgaatgctcacaattaataattatatggaaagcacaaacaaaaatacaaccaatttacttgtcagaaattacaatagatatttacttcaattcatgtacccaataggaaggacaaaggtaagtaagaaggttctgtaataaacaaaaggcacccaaactggtagatttttgtggagtgacaaaaatgaatcaaaattaatatacaatgcaaacttcatagtctatgctttttggacaattagtctatgaaagttatacctcaatttgcatgttagaggtcacttttaaatcattcaaggatgcttctgattctttcagttttttctccaactgcattttctcactgtttttaagcttttgctgcctctccatctctgacgtaagatgatcaacttcatgttctaccttcttatataggctttcataatcaacttcctcctttatccttatcgtgttcactattttcattgcctgaaatcacataatgaacgacttaatgtggtgttataacttataacaaaaaaggaacaagaagaaggaaacgatataaaacaactagacaacatgagtttctttctttgagtaaatgcagagttgcaattttaaacaacgagagccattgaattcatttcaagaggaaccagtaacaagtagtttagttcatgcatgaattaagtctctgatgtaatgcaacatgcacagtttgcactgtgtgcaaattaatgctgctcagttcactctagtaatttatccagttagaagcagttgaaatgatgtttccaactccatgaaactaggtgcattatgttggtataagacaggtgcatggcataatttaatggcctgggatggagtagagttcagatattaactaaccatcatatatctagtgggattaactaaaaatatatctagtgggaaaagctctgaataccatttacaagaataggttccatacagtagaggccaattttgcacaaattggaatagggaaagtgagcaaaaattcatcaacgtagacagatcttagtatcttacagatggacctattgtgcagagagagagagagagagagagagagagagagagagagagcaatgaaatattgaccaatctacacttactcgctgcccaaacataattgtgcttgaagtttctgagaaatgccttgaagatggacctattgtcacaatgagtgaagtccttgcagtccctgcatttggagatttgagcaaatcaattacagtgttacacatgtagtgatgtggagaaaaagtaaccatgatgtttgaacaaatgtgataaattcaaacaatctaataggcacctatactttggacaaacacaagaaattcaatcataccaaaaggaaatcatacctccaaatgaatcacgcagtattcttgtaagttttgaatctcttgttggtatatgaggactattttctgctaacgcgttaatgcatttgcctagagatgttaatgacagattgatgaacttggcttcttcaatcatgtgaccttcacttcctgggagacaaaagattaatattacaaacaaacaatacaacatacgaaatgaaaaggtttgtttcaattatatggtaagacctaccagatttatcgatacgttctgatccagcaaggtcgacaatcaagagcttgctcttgagaacaagcggtaaattatcaggaaaaaggttgtcagtaccattaggaagagaggtattacttccatcttctattcttgaactcctctgtatatgaatctgaaaagaatatcaaattcgcatgggcatgtaatttactttggaacttaaaacagaatacccacagcaaggaagaaggagcatacaatgagaatagcatgactacgagatgattctgtgttcatcttagtattagcagcatgacgattcatctcaccaatttggagaagttgaaaaacatgttcaagatctctgatttcaacttttgcagcaccaggcaaagaaacttcaccagtttttggatcctcaacaatcggaatattagtcttctctggagcaagtaaatcttgcacagattctaagtaaagctataaaccaaataaacatgtatacattagtatggaaaaacatactacaacaataagggaccactaatgaatattcaaataattttatataattgagaaaaaaaatatggacatagaagcttaagcattaaatgaaccatggtgcactttggttcaatttgcagtacaccatgaactataacacttcatcccatttgtgcagttttttatgcaatttatctagcacgatagaaaaatgcctttatctttgtcgtccacgtttaacatggcaaactacctggaactatggatggataatattaaagtgagtgaaagtgttcaaacacatattgttatacatgacctatttgatgtcatgtattaaatacaaaaactggtgctatgtcttacataatctgttcaaaaatgattgtgacaatgtggcacgataatcatataagccttagcatataaatatgactgttcctggcttcctgcattaatcgagacagtttgaagaatcctagctaataagaaagttaaaacaattccaccattccatgccaaaaaagaataatgtcgatcaataagaaataatgatacatgtacaaaacaaataacttcagttgttgagaatagaacctggagaaatgatattgccacactatctgtctccaaagacatgacagaaaggatatgttccaatgctctgaccattattccaccttcagaagggtcgtcatttccaagccgaccaactgtgtatgtcttgccagtacctgtttgaccgtaagccatcacggtcccattatatccttctaacacgctctgcgagatttatcagaatagtttctacattctctcaggccaatataacaaaatatcatatgcaaatgggtcataagctagtaacaggctaaagggaaattccaattgtatacacataaaagtttgttcctactagcaatacagaaaagcgttcttaaggcatagttgcaggcctgttgtacactatttggcacctaagagaatcacttcctgataataatcaagttctaccaactgaagttaatgtaactacatagaaaacagacaaacataagcatttgcaatgaaaatatgttgctcatagttagtagtacgttacatgtgtaaataaaagggtgatgacatgtacgacttgcctcgactacaggttttgcaacgacctcatatacacgtttttgtgaagcattttcactgaaaacctcatcaaacctatatgattcacagctccagttgtttttctttagcttcagcttcttacactgcacacaataaaaaacaagcagaataagtaattaagttgttaattacttataatgaggtacaaagcgcagagagtaaaataggatgctcacctcaggctgcaactcaacacaactatcgaagtccgcgccatgagctaagtcctcagaattcttcggccggagccttacagcaactcttactctgcacgaatctgtgaaaaacaccctttatcaattctgaaaacataccatattgacatcaactccataaacgactgtaaagcatattaagctacattcaccgcatcagaatgtgagaaaacagcatcgattacagatatctagcagaatgtactgtgctagaaggctagcagcaccagggaaatggcgtaaattcagagcgaatatataactgatagcgaacatatatgacttgtatacatgtgtgtgcgaacatatatgacttgtattcatgtgtgtgcgatttaatgagtacaatatataactgatagcgaatttccaatgctgaaatgcataaatggtcatctctccagcgacaatgatattcccgtcgccgttgcaagtatccgtaacgtttggagtttcccgataaaccgacgaagagcgaaaaacccgagacgcgctttcacggtttctcgaacagaggaaatgcatcattcaccggacggcctccgacgaaaagcaccaacagcgaaaaacccccaatacaccgatgatgaagtgcaatctccgatgattcacgggtgcgcggagcagcagaggagcgcgtacctgaacccccgtcgttgtcggcggcggcggggcgcgcgcgggagggggacggggagggcctgcgcgacggcggggcgaccgacctggagcgcccggcggggcggggcggcgcgccgtgcctctccacgggccgcaccgacgcccgcccattcgccgccatctccgcccgccccacaaccccacccgcgccgcggatccctctcggctcgtcgccggcggcgcgtgctggatcgggtggaggaggaggacgcggcgagatggagagagagaggcgttgggttggggtttttgagttgaggcgcgcacgacggcgggcgggcgggcggagacggaaacggagtggcttgcaggagaaggaggcggcggctcttttcctaaacgctccacctcctcggtttgaattatttaatgcaggggggtgtgtgctttgcgtttggggttgagagggtgggatggttgatgtagattgaggtgatggatccaacggcggagaatggatgttggagtttgctggatgtctctcacagactgacactactctccgtgacgaccaccagccaagcgatcttttgttgcatttgcttctttttcatactgctgtgcatgtttggctgtttgcccgtgagagagtcataactaatgaacagtaattattactacttcatttctgtaaatgttttctagctgttttatgttaaactaaatgaatgcaggagctttactacgaataaaacaaaatatacgcgagttacacatcttttttatgaggaatgttcacctttagttcgattttatacgtggcagcatattttaaatgagctcttaatattaagaggttcaaggttaatttgtaactttacggatttattgccaccaccattatcctattttaaagaagtgtaaaaattttgttatgtactgttcttttctttaaaataatgttgtttatgtactatctttgttttcttttttttccgagctgtctgttttctaatagaggtatcattgattttgtcacaacactttaatatttgtcttattcggaaataaaattagtgcacatatggaaaaatataagtaatacttaaaggtcctttaatgttaaactaagtcgcatcaaaataaaaaatatttagttaatttttttaataaaataaaatggtcaaacaaaatgttaaaaaaatatcggcatcatccattaaaataacaaaacggaagcaatacttcaataagatatgctctctccatcccataaaaagccaatctagtaacggatgtgacacatccttatattacgaaaataaacatacatctataaacatatatctatttagatttgttgtattacgaatctaaatatacatctataaacatatatctatttagatttattgtaccactataatgtattacattcaattgtttttctttctggatggagggagtatatacttagtaagtggcactgaattatctatggaggatctcagttaaggtaacgaaaacaatgctcacaaaatctgcaatgcgctagtatagcaattcagtatgaaccacgagcaaagatgatacatctgcgaatttctccttcctcgctacaccatatgcatgatacatctgcctgtcgattgtcgaacaaaagatgggcactgtccaggtttacacggaacaaaaatgaacaccacaaaaatggaatctgaactatgcaacacaaacattacagattttcgatgagcctgtatagacaacactagcagctcagcaacccccgtgtatgaatggatttggaaacccaatttatagtctatagacagatcattgtgcccatttctccactgtaggcagcaaaatccttcccacgtacaaatagcgttatttggcttcgagatcgtgctgtaggagcttctacgtcaaaaatcggatacaaatgagcaacaatacacttgatccagtgacctcacactctgcgcagaggttgagaccccagaccccaattcaccaagacagtaattgcaccatttgacactctgatattgactctatgaacttcccgttgaattggcagctgacgcatatatctccaaggagtgctctggtatgtatgtaagacctgtagtagaaagatatcaaacaaaacaagcaggaaacatggaataaattccactatagtctacatacttctttctttttttacaatcaattccaacaggaaataattatatgtcaacatcctaaggaatctaggatattcacattgtgacagattgttaaaaaaaaaagtgttcctccaatgccactaatttgtttttctttctctgtgtttttactatgcttgcaagaaaaagtatacctttctcccttatcgttatttgaagtgtatccagtgtaatgatcccatccgttaatggaagtagctcaagcttgacggtggtgcttgaacgtgcaggaatacacctaccacaatggtgacaacaaatgttattctttagtgtatagaaatactccctacgtcccaaaataaactaaccccatacgggatgtgacatcctagtacaatgaatctggacatatcgtactaggatgtggcacatccagtacgagattggtttattttgggacggagggaatacaaggtacatgggatgtgtcactcaaagaaagaaaagcaggtgaggatcaataccctaaaggaaccgcactctgcaaccacagatgagtacagcctccagaagtgctaattctatttcctccattgtcactttcttttggtgagccagcaaggactgaattcattcttcgaaaaccagctcgatgtttacccaagccagatcttctcacagactcattaagattgtcatacgaactatttggtgtggttggagctgagttcaaggatacaactgaagaagaaccagacgcttctggagcaagaaccgttacggtaaggttttctgatgtcatattagtagcctcaagggttaagacctggaaggtaacagtggattgcactatcaaaatgaaacatggataatctgcataatatacctaaaaaagcataggaattacctgcactgggagttgaggaactcgagcactcgaaataggatttcgcaaagacagttctgatgatacagagatcataaggtcactagcaacacagggtcgccagctggtggcctgcttgaagaaaagttttgattctacacaggaaagaaggctggaagtcagaaataacaattcaacgcttcttccaagtcacttacccccatctgttaagtagtttacctgtgtaattgcagcgatatgatacaagtacagcatactgatccataagagagccaatggtctcgccaaccttagccaaagaaacatttgtggcagttccattcatcttagggagtgacaaagtcagaggtgcatcattgttggtcctccggtccctaaacgacatagttgctggcttgagaataaaagagtgctcctcgcctctcctggaaaggaaaaggtaacatttaagaaagatggaatattctagaatctgacataaacttcaatgtttagagtaagaaatactcaacatacaaccatgtttactactactagcatatacttgaatctggtgaaagtaaaagggaaatgtggaattaatccagtcctgctttgactaacccagtactctagggctctaggccatacaagaccaacttgtttgaggccaaactcaaactcctggatttgatggaccccgagggggaattgaaccaatcaatttctttgcataaagctgaaatggtggatagagagtgaaatcaatgagaaattgcatatacctgagtgcaagatttggtaagctatgcccgtgcccaacctcaatactggcaattgggagtgacaaaggagcacctcctttggatgcctcctcaaagacaattgtaattgcatctaccaatacaactatatctttcacatgctgtggagaaatattctgaaatttgaagatagaagcattaggtttgaaagcttctctaagtaggagatattaatggttagggatgttcgcgtaaccttgattagaacacacagaagattttccgaagtacattttgcggcaaaagagtgaacctcaattggttgaatgatctcaacttttctccgccatcttttccctggtagatatacaccttctagaccacaacgtacggaataccgttcaggctccaatggaactcctctaaaggaaagttgtccatcatttataatatcaggtgttttcgcaggcttttcaggcacaaattcttgactttcagaaattggtggtggcctaatgttgggtggttgagtggaggaggctgaaggcatggaatagcttctgaagtgacttaatgaaaaaatttgagaaccagaagcagaataagattgcttgtgtgatgcactaggattgagagtaggaggtgataaggatcgcggaggaagtgtgcgatccaaagggagcagccagcttagcagctcctgacatggatcctcatcaccactagaaagtccattgaccagattcttggttatataattgcttgatgaagatttctcaaattgaagaacttctagcactggagcttccattttgttaacaccaacattcacttgcaaaacaacctgcatccttccaacaaagaacatgagtgattaatcagcatatgtataacatctaaaattaatcaacagatacacgtgtgcttcctttctttctgaaaaaggggatttcaccgaaggtaattctatatgacttctaaagatctcagaacattgctcaatgccgtgatttataaagttgcagaaaatgaagagagtactaaaaggcatgggcatgaggtattagccagttatgtcaatctgctaagattgacgcaaataggtagcacatgagaacagtctaccatgtttatgcctggtgaagttattatgattaaagcatccaacttgcaattatttatgcagtgctcataagtaaacttccaatgtgcatacattatacaaaagttctagttatagtatcacccagtaactaaacagaaggatcattcataccacgatgtctccattttgcagagcatagcaccttgctgtaccacgagcgattcctccagatgtgctaccatcaaaaactcctttatcagaaatggtattataagcattactccttgaacccttattgttttcctggttgtctgaatatgattgctcttttggcacctttgatacagctagttttttattggaccagagaggttcatctgactctgcaattcggacaaaaaaattggacattttgaatcctttgaagcatactttcaatttgttgcttgtgatcttccaatcgaaggagagattcggtctccaaaatatcttgttttgaaggagagatttcgttgttgagttcaacattttgcatgtcatcttgttttgaaggagacatttcgttgtcgagctcaacattttgcatgtcatcttgtgtcataggagacatttcgctgttgagttcaacactttgcatgtcatcctcaacaacctgggaaccattctctccattctttacattactatcaccattttctgtggcatgactagatttatttgtggagtattgcaaagaatttccattcttagacatcacggcagcaattctaaagggagatatgacctgtgtttcttgcttcgaagcggacatgcacgccaatatatgaacctgctcacctgataactgaactagttcagattctagaaaacaggcagaatcatgatgcacttgtgccagaccccctagactaagtcataggaaaaatgcatttaccaggaaaaaggaaggggcggtccaaaggctgtaactgcaacatgtctgaaaggtcattccagttatcaggaagctcctctgtggaagtaaattgaagatgttactgaccgtagatgtaagaggattaattgttacaagcttatggcacttctaaaagcatgacctatgttccatggcacttcaaaaggaaaattttcagaaaaatatggatttccttagaacatttagcagatcttgtagagatattcctaacaaatggattcttattaaccagtaatgactttaaatgaaaataaagacgggcaagtcaaagggcacatactgttcggaattgtgatccatccttcgtcatccaaaacatcggtatgctttccagtaggaactgaattttttgaatctgcatctgcagagtccccaccgatatctacatctccattatcagtatcttcatcttcaggggaggggtgatatggatcatcggcaataaggccctccagagttgtaactggcttttgtaggctatccctttgctgatcttgctctggaatccgcggaagctcgggtgcaacaggctgcgaagtccggtagaggaaattcatctctacccgtcctgccaagcaaagcaagagggtgaaaaaggagataatgatacgcagatgattaaacaaacaaaatcacaccaccgggagctccagttcgacagagagaaacaggatcaacgagaggaaacagagattcatcgatccggcagctcattgaagacaaaaacaacgggacatcagatcaggcaaccacccgcggcaaagcgagccattcgaggcagcaattagccatggcggcgcctgatctagcggctacacggcacagggggcgccgcatttccgccgatgcgggagcctgcctagcaatcttagcaaccactgacgactctcactgaagaagtaggagaagaggaaggcttagatcacacttacagcgggggcttcctatgggcatcaaacgatacacgcacagctgggctcggagaaccgcgccccgccggcgcggggagggagagagaagaagcgagcgagcgagcgcggcggcggcggcggcggcggcggcgacggggagcgatcgcgtgagggggagcggctgcgtcgtgcgcaagagaggagagaggggagcggggcggcggcctggcgctccgggggacggacggatctgagccggagaagatggtccatggcgatgcgtgggtcggattaaactaatcttcctcgttgccaacaactaacccaaggcccagctgaggcccatgcgagcccaactatctcacgtttcttttgtaagtttttggaatatcaatttttttttactaaatttcagcaaaccccatgtttttggttgaagttgtataaaaccc

SEQ ID NO: 37349 - DNA, 1672 bp, Oryza sativa
ggcgctccgggggacggacggatctgagccggagaagatggtccatggcgatgcgtgggtcggattaaactaatcttcctcgttgccaacactaacccaaggcccagctgaggcccatgcgagcccaactatctcacgtttcttttgtaagtttttggaatatcaatttttttttactaaatttcagcaaaccccatgtttttggttgaagttgtataaaaccccagttattgcacataacctcgtaattcttaagtttcacaaaacaccacacatatacatatttggcaaatatttacttaaaattttaaaacatagaatatatacaaaacttttagtcgttgatttcttgattaaggttatcagtttaactcttcgctactttaagaaatattgtttctgatatcctgaaatcaattgaaatttgtatcagagtgaggttttatgaaacatttaggccataaaacatgtgattatatgtcgcaagtcatcacacgtgtgattgtctacaactttgatcataaaaacgtgaggtgttatgaaatttactccattttttagcaactttcaaatacccacttatacaatgtctttttttgggtagcattgctaccattggcaaaatgttcaagaataaaaaggaacatgcttttgtcaatcacaataatattccagctgtagcagaaccataacatggttaattcctgctcaaaatacagattacgagagaatttggttcgtatacctcctggattgctacttgttgataagtgttgaatcgtgtagcaaaatggttcgtatacctcctgtacctcacgtaagagcatctatattgataaagtgtagcctctatcactaaccctcaacctgacaatatcccatctccaccaccatatatattgataaagtgtagcctctatcactaaccctcaacctgacaatatcccatctccaccaccaaacactgctgccttgttgggcactggaaaatgttcttccaagcagcttgtgtgttcttcaagccaaaagtatgtctttgtctatcttcaccatccgcaccaacttaacgtacaggcattggtgtggagtagctttcaccttgacgtgagaaggagcaattgctattcttcgatggagttgtgcggatccacattaccgtcgaaattagcacccgtggacccaggttttcactctacttcttgccttccagtgacttgagatcagtttgtttaagttcaacaaacttcccaattctgaacatgtaacatccaacaagggttaatattcagtgttatttttcctcccagtctgtaagaataaatggaaaacaaaaaggtccaggataccaaattaatttatcattttgtgcatggaatcatgcctctaaaatgatggcataccagttatctttgaatcagccaactatactggacaggtcttagcatgcctgctggcagatgctatcaagtatacagcaccatgttacctcacaatatttgacaggtcttatgatatagttattgttcatatcatttacagcaagaaagtgccatgctctttcttgcgatgtttcatagacatgatctttttcttacagtatatagtgttcagtgttcatatcttttacatgaaaagaacatgtcatgtcgagtaggtgctaagatgctaaaaa

SEQ ID NO: 37350 - DNA, 3429 bp, Oryza sativa
cctgaacctgcctatccgaacacgtttcaaggcataaacctatcaagaacaaggataaaatatcagctacttcccagaggggggaaaacattccaaggtatacaattccagcaaaaaacgcacttactggtacacaaggatatatgcctacctcacccataagaatataagataagtgcacttcttagacttcactgttgtttttagaaacacctaagactaggaagaaatcccaagctgatgtgaacaaaatctttcagacaagtgatgttccgttgtacaggtattacagttagtacaatttatcttatgcactgtagtgcttgtagaagcacaagaattgagatctgcaaagtgctttgagataatatcaactaataaacatgctaggcatctcaaaagctactgttctaagaactatatagtagaatgtagtatatcatcataagcaggtttgagaagaaaaactctgaagcgcaatgtgctaggtgtatgacatttttttagtaagtacactatgtctttagcacactgctaatctctgtcgttgtaatattcgatcatcataataatatttctgttgaaaagaagactctgaagcacataagatgcatttcaatcctcttctaaaacatactgttaatttgtcaatagtgctactgatcattaatcgtcctcatttctaacaattcaatcagataagggattaacaaacaacatttgctcttgattctagaaccaaattacttgagttaccaaatttgatattgcacaatgggaaatgttaagatatgatcaataaaacataaagggaaaacttgagaaaaaaaatattgagcatacaaacaaacctctaggcctgcattctgcacgagttcacgaacttcatgatttcttccttcatgaacctgccagacattaaaaaaaatagcataccaatgagtagatgaccaaatgctatgcctttgcaagtttacatctctatagaattgctttagttaagaatacatgcaagaattttgagcaataagtccataacatattgatgtcattgaaaatactgtatgttgcccagagtagtgacttttccttctacactggtttttactcacagggctgaaatattatcaagaaatggttccaaattagctggtaacatgttaaaattatttagctagttttgaacaatgcgaaacatattattgcttaagctttgcagaattaccagtttcttatggtttccacggtttcaatcatttgaaaaagtaagcaggtgaggcaaattatcgatccaaccaactgcctgttagacatttaaagtgaactttacataatcactaaccactttagcttgtcatgacatttaaaaataaatcttgaccgcaagatactatctaaagagacctttcgtgtgtcatgtatcatgttgtatatcccataaaggaatgataggatagattcattgctagggtatatttttcactgaacagaaagagccaagttgcctatcttctacattatcctatgaagaatttggaattcatgaaacagacagtaaagtcaatccggaatctaataaaatgaggtataatagaaaatataagtaccgctattctaatccgggtcctttttgtattggattgtacatccaatggttccactagatcaggtatacatttgacgccatcaatttttgtgccttcactgatagctataaggtgatttctgtgcactggtccatctatagttaccacatatctgcaagatcaaacaactcaaagtcaatgttggtttcatttgaaatttgataaaaatgatatttcagatatttcttttcgcaattaccagtgcatattgataatgaataaatgagagtaaaaaaatgtgaatattagggaatggcctaatatcaaataaatagaaaaggtgaggcttcgaacccaggccggctagcccaccaccttgtggagctagccggaagacccctaggcgtttctccaaataaatgagagtgataccaacagactgttaaattttcttctacaaaagatctggatagtgtctacagtgttcctagtacgtgattttgtattactgtacttcgaaggacacaagaagttgagcttactccttcattatatttgacgaagggtgtgagagtttctgggcaaactcacctgaaagagaaacaaactaactttaggtattggatggtcaaaatattgattcccaagtatttattatgaaatacaatgaaattaccgtcatttgtaattattatcaaaccacttgtagcaacatcaagacgacccacagtaaacaagcgcggttttggtactcctggttgaatcttgttctgcaaatgttaattgaaaatggaaaattgtaagtcctagctataaagcataagaggtgaaagatttcacaaatattaggaagtaccatcactataaaaaaaaaagaacatacccaacccttcaaatagtcatcaaataaggagataatggactttggttcaccacaggaacaaatatacctgcagtacattggaaataacatttagatatgttgctcatatggactgctgcctccatatatatttcaaaaatgctttgatggaacaagatagcggaatggaatataagagctgacccttttggcttgttaacagcaaaatataacttcggaggaagcttcttggaaatgcggtttccattaacatagatagaatcctttgagatgtcaactttggtctacataaaaaagaatgtataagaatcatatgtaacaaataataaacttgtctatgaatacatttgaagcacatggatcaaaattcatagtaaaatgacctagctaaattaaaacaatttatattttaccgcaatagtacgatagctggtctcagaccagcaccaaataaatgaggataagagctaaaacattacttagacatgcaacaaacttagagaagtagcatttcatcattcataaagctaaaaaaaaaaacatacctggggtgcagtgcagacagaaccattgacggtcaccttcccttggaagatgagctcctcgcatgtccttcgtgaggccactggaaggagcaatcaggccagcattcagacaactgatgtgttgctgtaactaagtaatataactttgattgaattgattctgtccaattcaagcacttcagtaaaatcatgcgtgataggaagactacctcctgccgcggcaaggaccttggcgagccgctgcggttcgtgctccttgatattctcattgtagaatctcctcgcggccttggagaacttgggcggcgccgtcgcgggggcggccttcctctccctcaccttggcattggcgacgggggtggcaagggcggcggcgcccttgtggcttctgcgggggtccttcttggccttcttg

SEQ ID NO: 37351 - DNA, 1176 bp, Oryza sativa
tgaggccactggaaggagcaatcaggccagcattcagacaactgatgtgttgctgtaactaagtaatataactttgattgaattgattctgtccaattcaagcacttcagtaaaatcatgcgtgataggaagactacctcctgccgcggcaaggaccttggcgagccgctgcggttcgtgctccttgatattctcattgtagaatctcctcgcggccttggagaacttgggcggcgccgtcgcgggggcggccttcctctccctcaccttggcattggcgacgggggtggcaagggcggcggcgcccttgtggctcctgcgggggtccttcttggccttcttggcctccgcctccgccagcgcaatggcctggaggacgtccggcggcggcgcggtgcgcatggacggcttgccgtcctccccacgcacgatccacggcaccacctgctccgcggacggggcgggggatgagggtttgggtttcgagggggcgggggcggtgggctccgcgaaggtgatgttgaagtccggggcgctggaggtggaggaggaggcggcgcggaggaggaggggagggaggcggcggtggcggccgcagcggaggagcacgcaggcggcgggacgggagagcaagggcgggaaggagacggccgctgccgcggcggcggcggcggcggcgagggccatggctcgagagtggagagtgtgggagggggtttatcggttatcggatatgcccgcgacggcgcctgtttggttgcttggtacgcctggcttgagacgtgccggaggggagaccagcccgaacaacgttgccacactgacgtcagttccttttttttttaagaaagaaaacgtcaaatggggtcgggattaaaactccgaccccccctccttcgtttcgagaaaattaaaagtcggcgatttagattttttttttaaaaaaaaatacacgacagagattatagatgcataagtgcacatatgcaatatcacgctcacctccacaaatacattctctataatgtacttataactctaaaaaaaataaccttgtttagaaatatgaaaaatgtatgttaatatagtcatataaaatagcactatgctgaaataggctaaactgttccgatataatacatcaaatcacaaactcgactacttgggcaaataatg

SEQ ID NO: 37352 - DNA, 9628 bp, Oryza sativa
  unsure (1)..(9628): unsure at all n locations
nnnnnnnnnnnnnnnnnnnnnnnnnnnnnnnnnnnnnnnaaagatgtagactaaacttgcaatattccataaatatgtgcactttaggatcagagactaaaattttgatcccttcctcatttcgtttagattaacaaaataccaccttatagtatattcatcactatttaatggcattgtgatatcttttattggatacaaactagagagtaacaccagtcatatagtacaactatttctaactagtccacatttcactttatgttttgtatgaaatactccctagaatttagtttgatggtttcactgtagcttagttacatgttttatgtttgatggattcaccgtacaagcagttgtccatgttcatctctataattttttttttctgcacaaaaagtgataaagaggagattcattaataacgccatactttatatgttttgccattaaaggaagccaaatcctctctcgtagggaacaagggagaactaaatactaaacctgattgaaaaacggttaggaaagctatattgttttatagtgtgacaatgattggtttaactttgggttaacaactgttatttttttcttaaaaaaaaagggaagcaagaccgctgaaaccgtccttgttgtcaccgcagaccaccttacacaccggataaaacaccccaaccgggtacgggctaatctgaccccttcattctttcttaaagctaccaaccaacggcccagatccaacatcctcctcctgtggccaagaacaaaaaccgaccaagagaccaagcgccggccaccacaagaaaaaaagagcgcgcacgcatcgcctccccaaaaaatccacccatttttccgcgatcccgtgcgcatctcatcgcccccacctcgtccgccatggccgattccgccgcagccgcattcttctcccttccccgctcgctggcgtccaggaggccgctgccctcctccctcttcgcggcgggaggccccggtctccccggcgctgccgcttcgggtcccgctcgcttcaacggctgcgagctcgagctgggaaggacgatccggaggatctgtatgggccctacccatgggatcagtccttggatctcaccactggcctcggtaagttcatgcccccacactctccctgatcgttctggttggtatccgaattcgaatggttcttcgattcgacggcgagcaatgagctgggggctacttgcgctagtcttgcggtgggggtgatggttgatttcccagctgttactagtctgtgatatgatgatgaactcattcattgttctgcagattttgcttatttcactttgtgagaggctttatacttgcgtttatggcgtggctttatttggggttcaatctctgtttcttaacagatattcagtgggtgccagaagatagagtcacactgttcacttctgatgggcttgttcaaatagggggttccctggttcctcgtcgaattactccatcagaggtgccgaatcattcaacttgggctcgtttcattaatcgttcatttttcagtaataaactatgtggtatattagaatatcttgacattcaagtaggaaaacaaagtctcttgcatcatagacagtagtaaatttattcttgtcagtaaaactagggtgcatcttcagttcaggagtgagatatgttatagatattgcagacactattgttcaatgatcaggaatgttctgttccagggagacatagtttcacattaaatcagtttcaatctcttttgcatagtgcatcacagcctaacttcatataattcaatcatagacttggatagatgattagactattaaaaatgtttgacttgtcactatgctaaaagtgcttatattttgggacagagggagtatcaaacaacaaaaactttttcagcatcctgaccagcatcaaatgttccactatgaaatataagctctttcacacctctgttcatgaaacatttggatatatgcagcagtacttatggaaacgtgtcatgtcagcaagaaattgaaggggaatgaatccttgaaaagcagtatcacatacattatagcaccaattttgtatctcccatggtggcaccaagctaacaccatagagtagtgtacgtctgtcatgtaatgttggagtatcttattgcataaacaaagcatgccatatttatggatagccgtatctttttagtatttgtgctcgcattcagttcagttgacctgaaattatatccaactgaaacaaattccaagtcgattacaagtaatccagtatgaaatctagcacagtgtgaatcatctcaagaacacgatgtatctcaagctgacaggttataattatgatctgtgcccaatgtgctagtttagaccgaatcatagtaatgtactgaattacttaaattgtgctagttatgaaatgataattacttaaaagatgttgattttagatagaactgcaagttttattatgtattcaccattatttcccatattatctgtactcacttcttttgttatattttgaccagaagaggcaacgaaaagtaaaaggtatacaaaatatccaacggtttcaggagagctcgtacatggacccaaatcaaagtctttgccttggagcactatttaacatagcagcaacaaatgtaattatttcctcctgcctatttgcctatcatgctgttgctttcttttcttgatgtcatttctcatttcagggtctagatatgggaagaagactatgcatctttggcttttgtcgctctattgaaatgctaagtgatgtagtggaagatacagtattggagcatggtggtgaggtatgtgcaacagtcttacatggaaaaaaaaatcttttggtactttgctccttacagttttatatcttcattctgactaccgcatagactatctttccatatttgaaataagccatgtaaagggtaccaacagattaccttctttctgagaaaaaaaaagatttaaaaatggcgcacatggacaatgatgtggcgttttatactgaagtagattgcgaagcaaacataacggtgcccaaggaaacatgccaggtgtagctaagttttttctaaaaaaaaacttaataaaaggttgagtagaaatgctaaattgtcaatgtttttaaaggaggaaacatctatctagtcagctcttgttacatttggattttttttagaactttacatttggatactaaactgtgaattgagtaaagggcgccaatctgcaggttgtcacggcagagaaggcaagcaaagatggcctccaggagaagttgaccatgtctgttgcagtgccattgttgtggggtgttcctccagcatcagagaccctccatgtcgcggtgcggagcggtggaggcattgtggagaagatctactggcaatgggacttattttaaaagtcccaagccgtccagtcattaacaaatgatccatgccacggtgtaaatactcattcagtctaattcgctgctcgcattgtgtcagcaattgtaaattgtgcatatatgtaaacagaaaactttggaatctctatacatgtacagacatggtcacacccctgcatataagaaactgtgagttaacagctcaacttctacttttatccttgttttaatatttaccagtgaactgtcgtcaccgtttgagtattggaatattggagatttggagtaactaaacaatgcgaaccagtcattagttgactccgggaatcgggagtaactaatccctggcctatgtcattgtagacacgtttatgagttttggagtagtaactaatgggttgtttggttgatgcctaagcttgccataactaagcttaggtaagttgtagcatgtggcaaaagtatggccaagaaatagttagccacaagtgtggcaatgttagctctagttatctgagtatgacatgtgggaccatctaaatatgacatgtgggacctaagggtagaaaagtgtggcatgacacaactgtggcattgaaacaaacacacgcctaaaaactgtggcatgactgaaatgtggcgtggcaaaatgaagcaatcaaccaaacaccccctaaaacaatgtgttgacttcgggatttgggacaagattactctgtgttttatattgtcgctgggccttgatcatgatgagttgatgatactccaggtgtgatgcttcctgcactaacccgtgctagttgtcgcgccggtggtgtcatgcatttagacgaatcgaaaagacattttcaggggcgttagggttgcgagttgtgggtcgtttggactgtggagatcaggccaggaaccaggacgacgatttttaagacctttgcaggcagtgcaaggctgcaaattatggcattttcgcttgcgtttatacttataagctaaactttaaatttgattttttcgtcctagtttatttttagtatttacttttgaatcgctaagaatatatataaaagttttactcgcagataatttttatttgctaataagtgatttcgaatcaacgtatgaataagcgaaacaatggaatggcctagtaagagatttgttcaaacatccctttcatcctccaacatgaggtcgccacaatgccacttgccatttttctggaccgtaagatagttgtccaaataccaaattagccaaacagtagttgcgtatcgggatttataatgacgaactgttcaaagctttattggacttcacctagatcaatccggttgaggttgacactcactctctccctcgtgcattcagatttgtgacaagcaagaggggatctccatcgcgtgctgcattctccgtatggaccgtatattcagatttgtgacgagcaagaggggatctccatcgcgtgctgcattctccgtatggaccgtatatagccatggtcgtcgcctctcgccgaactgaaattactccctctgtcctaaaatatcttatctccgttatatttaaatatagtaacctagtagtacaatgtttattcttatactatttgctatattttgatattgagagagtaacaaagagtgtgtttagttcacgtaaaaactggaaatttggttgaaattggaatgatgtgacggaaaagttgaaagcttgtgtgtagaaaagttttgatgtgatggaaaagttgaaagtttaaagagaaattttggaactaaactcggcctcagcatcaaacatgatatatattactacaaatcagaacagtaccacattgatagaaatcagaacagtaccacattgatagtagtaggatatgttgtatccaatcgtaattgctacttctttgtttcacaatataagtcattctaacatttttcatatttatattgatattaatgaatctagatgttaatcacatcaatatgaacgtgagaaatgctaaaatgacttatattgtgaaacggatggagtatattttaaaattaaaaagtaggagtataaatctatgtgcgaaagttgaatctcgtgcatacatattgaatatgacctttgatctagacggtcgttcctatccactgtaccctaggtatctccatgatgcagacttcgacttcgttttcattccacttccatttgttcgatcatgaatgtgttggtttaactattatgggagtgttcggatgtcccttttcctaactcacatctctcgttttctgcacgcacgctttttaaactactgaacagtgtgattttttaaaaagtttatatacaaaagattaatcacgcgctaatgaatcgctccgttttccgtacgtgggtgatgggttcccaacacccaccatcgaagacaacctatatgctctattgctcattcatgctccacatctactaccccagtttttcaaaaggttctcgaattggattgacataaatccaattgatatgacggcgttatggttgattgttatatgttcggaaggaggtgaacttcttcccactacacaaaatatgatgatttattggggaagtattaaagatgtggtagtgaagttgtgggtatgtgactccatttatcagggttcaaaacttcaaatcatgttgtcacgtatgcaggtggactttcaacaagattttcagggatatgccgttggttttcgtctcttatgatgcaattgtggttgattgttatgggttcagaaggaagtgaatttctccccactaagcaaaacatgatgattcattgggaaagcactagtagtgtggtggtggagtcgtgggtgtatgattccatccactaggatttaaaatcatgttgcacataaatattagaaatacgcacatgcaggtgagattttaacatgattttagtgagattaggtatatgccgttagttttcgtctcttagagtatgtgttaggggacgttcgtagggggtgtgagtgtagtgttgcatgtgtagtggtgtaatatataatgactcattagtgtacaattaattacttcatccgtcctaaaataagtacaattctctaaatttgaattagaggcgtgcacttatttcgaaacgaatgaagtaaatattagttcaaaatattttaaaatatatattaatatgttttttacactaatttatatgtaaaaagtttatataaaaatatattattattcgataatttgaaaaatatgcccatgaaaagtttggaaaagtgaagttagtaaaagagaagttgggaaaggagcagtactacaattctacaaatgtacaattcaacagaatttttttgagaattaatattatttttatggaaaatcgcaaaagtagtggtcaaccggagaaaatcgcgaaagtaggtccctgtcgaacgggtgcagttcgatagggcgcctatcgaacggccagagcgcgactggcgaggagatcggaaggctgccgttcgacaggacctgtcgaacagcccccgttcgacaggcagggctgtcgaactgcccctgttcgacaggagggctgtcgaactgcccctgttcgacaggatatccgtcgaactggcgcagttcgacagggtcgcgttctccatttatttgtaataagttattttttttaataatatgtaatttattttagtgtgtaagaaaggaaaatatttttgtaatgttatatgtatatgatttagggttttgataatgtttggtcagaaattgtagtatttatttgttggttaaaatatttgaattatttagtttcattattttttgtatatttgaatgataatttgtcatgattcattcgaagggtatgctactgagtaattatccgaagaagtttatgaaatagtactgatagtactaagttaatcgtaaagtgtttctcaaatagtacagacagaacataaatgactaaaagtttaatacaaatagataagtcaaggacgatcagtgcccttcgcacgcttgctaggtcctcccttctttctacgcctaatctgctcagtgggatatgtcaaattatcaggggggtgcctatctctagctgcctactgtggtgtcacgtctggcccctgaccggcctccgtctcctgcgtcggctgtgtgacctgaggtgctgcgtgccagtaatccatccctacttccccctggggaggatcagtggaaaagaagtcctcaatgaatgctgtgcgaggggagtaagcaggcattccgtgatgcgtcgacgccgaaccgtactcatcgtctgtttacacaagaggaagaaaccaaaaaatatggcgtagttagtaacgatacatataattagaaactaaagcgtgttattgtttaaaatgacttacatgtgtgctgtgtgtggccctgctctggcgcacgcggagtgatatgaagtccccatgctggtgtgttcaacacgttgtcccccgttggcatgtaagggaagtgtgccgacccagatgctccctgcgaggggtgaacataaggcggagtttggaatacctgcggacgtggtggtgccgtgctcgacgtgggtacccctgatccggctgaccccctggtgtactccggtgctggggtgtgctgaaaggaaggacgaccgtgagatgtgtgggccgcttcgtacccgcgacgtgaagaggatggaccactccgatccacgctggaacgtcggggtagtggtggtgatggccgtcggcccgacgtctgcaccacatctgccgcgctccgacaggagacacgacgtagtagtgcggcagcacgtgcaaggaagttgtgaaggatgctcgccacgtcgtcaggcctgacgactggaggtctcgcctctagtctttgcagcagggtgtcggactccacgtgaacgtgctcaacaaattccgcatgttccacaaataatcaaggcaattaaaattatttaaccagttgcacatttattaagagtatttaacaagatgcacatttgttagaaataatgaaccagttgcacatcatttataaatactgaactagttccacatttatgtaagaaaaggaactagttgaaccaattgcacatttattagacatactgaactacttgctaactttttaaaaatattgaactagttgctcaaattccacaaataaacacgtaccattgagttgtaagctgatctaggctgaggggcaaacgtgtcagtaatcgctgcctggtgggggacggtgctatctccttgtggaggaaaacacctccatcgtgtaacactgcggtaccaacgaaggtaagctccataataactcccatcgtctggaggtgtctgaagtgccaagttatcagctgcgtgctcccactcttgtatcgtcggctgaaccgtggtcacaataactagctcgtaggaaagcccgagcccctttctggagtacctgcacaacaacaaattcacacattagaaaaaatgttgtgcagtgatttattttaaaaaatgtaggattaaacaactgtgatgtgaactaacctatgaagactatcagccaaaggacgaccatctctcggagggaagtcctgatacatgcccaactgtttgagaaccctgtggacattgtgtggctcgacgtgcacgtccaccacgaggtgacaagtcgtcatccagagttgcatatctcgcgtgcaaagatccgcgagaccgtgcggtgcacgatcattgacatcgtgctgagtgtagggagtccaccgaacacggtcaggcgtaagctgatcaaagtcagctacaaactgagtgtagacacgatgtagatacagatattacagtaccagcacacatagatacagataagaacagttcagtacatttcaatttaaaattacaagcccacgacacatatattatgatattacaagtgcagtgcagttcgaaatttaaattacaattccaatacaaatacatgacgatattaaaagtgcagtgcagttcaaaatgaaaattacaaggccattacaaatagattcgggtaataaaagtgcaagaaagttcaaattaaaattatagacgcaataaacgtaaattgaacgataacgatcttcaaagtagggagtccaccaaggataatagcgaactaaggattatttttcttcttcgacttccccttggaacgcgacgaacatcagcgcctgtggcat

SEQ ID NO: 37353 - DNA, 1597 bp, Oryza sativa
tgcaagaaagttcaaattaaaattatagacgcaataaacgtaaattgaacgataacgatcttcaaagtagggagtccaccaaggataatagcgaactaaggattatttttcttcttcgacttcccctttggaacgcgacgaacatcagcgcctgtggcatcttgccctacattgtacatgctgcaatctttacgggaatggttctccccgcaaagaatgcaagctttcttacgacgagaacgatctttcactccagcttcatccataaggttcttgatcctgcgcgactggcgatgacccttagtatcaactaataaatctgagtcaggaacccaattggtttgccctggaggaggacgagtgaaatcgcacacggcacgccaaccacgcaattcaccacgccaagttgcctcccacgattcctttctaaagtagggagaaacaaaaatgtttccatcaacacccccttttgcggaagcagcaagaacatgggaacatggccgatgtaacaggtaaggcttgttgcaattgcatttgcaagcgtgatactctggccacaacgtgcattccaatgtgatgtcagtagtcccaatgccgacaccactcttgtcacgaagtcgtatctcaaataacaactctgtattcccagcaggcaaaactctgtggattcctcccttcttacttttctcatccatgtactgtgtaatagcggggctatacttaacactgggtttgctgaggttcagactagccatggaatacctttacaagagatacttttgtgtacccctcgtgatgccctcaaggatagcaacaagtggtagaggtcgtgtattcttcataacccagttatacacttcagcaagatttgttgtcatcacaccatacctcgatccatctgtatcgtacaacaacgaccatttctcccttggctcaaattctacccactccgtgaagcacttcgtgacccttccacgcttcctgcgccgagtaatacttggtgcttcattaggaatgggttcaagtccctccggctcctcctgtctggcaactataggttttttcctaacctcttccatgtgtgtagtggtcaaacgatccagttgatcccatatggcatcaaactttctttgttgattctgcttgcataacttcttgaacaggtccatcaatctcttactcctgaattgtctataaaaattagccccaaaatgtcgcatgcatcatctgctatgtaaatctggccatggcacggactgtgtgacatcttcttgaagcttctgtatcgctgatagcaaaccggcgtgtcggtcatgcagaacacacacatttggtctgttttcaacaacacacattttaatgtgccgcaaaaaccatagccagcttgatgtgttctcgctttcaacaaatgcaaaagcaataggaacgacatggctatccgcgtcgactccgatcgcggttagaattgttcctctgtacttgcttgtcatgaaagtgccatcaacacagagcaaaggaatgcaatttctaaaggcctctatcatgcacccaaatgaccagaaagcccgacgaagaacattctccccatattcattca

SEQ ID NO: 37354 - DNA, 678 bp, Oryza sativa
  unsure (1)..(678): unsure at all n locations
atccttttgcaaccaaccgtgccttgtgcttgattatctcccctgccgtgttcttcttgagcttatacacccatttcagcccaatcgctcggtgcccggctggcaacatggccaactcccacgttttgttcttctcgattgcctccatctccctctgcattgcttcttcccacgcaggttggccggcagcttctcgatagcttgatggctcttctgactcagctaggagcgcctctccatcacattcgtcctccaccaaatccacacgcggggcctcacgcaggacatctgccagcgatctataccgcctaggcccatcatctgtatcgatgttgtcatctgtgcccggtgacggcaccaccccggcagagtttgtcgatggagaaccgggcgtgggcgttccaggcagagtcggtgatgctgccaccgggcttgccggtgacggtacttcttctgccgccaccactgcttccttcccggcgcgcctgccaggagacggtgcctggtacggcggtaccacgccggccgctgttgccgggctcggcagctgctcaccaggctcctcctccatcgcgaaatccgttggctcctgtcctgcagctgatgtccactcccaaggtannnnnnnnnnnnnnnnnnnnnnnnnnnnnnnnnnnnnnnnnnnnnnnnnnnnnnnnn

SEQ ID NO: 37355 - DNA, 880 bp, Oryza sativa
caatggtgacggagagagatggtgaacgtggcggcggcgtttcgtaggcggataggggaaaaagagtaggggccggggtagagctcggcacagcgatgccgatgacggtggtggcgcggcgcggcggcccctagggcggcagtagcgggcggctggaggcggtgagtggcggtagtggcttggcctcgcggtgggaaggtggttccggcggtggaggaggaaaatgaagtggatgccgaggtgcggcatagcgcggcgaagccggtgggaccaacggcggcgtgcggccgtggctttagcggcggtggagggcgactggagggtcgccggcgagcggcggcgcgcgggagcgacgcggggagagcgagggaggcgatgggaagctcgggggaggagggaaaacgaacgaggggagcacggggagggtttatataggctcgggagggtgagatggagccggggtgagttggatttgggcggcaatggccgatggatggaggtggcggcgacgtggggaagtggcggccggattttgcgggagaggtgggggaatgaggaggacgtggggcggcagagtcccacggccgggtgcgggcgtgcggagtggaggaggtgggcggattcggcggcaatcgtgggcggcaacggcagccatggcggttggccggaggtaggaggaagagctgacaggtggggtctcgggtcccacctgtcggccagagggagagagaggaggtcggttgggggacgcaaaaaaaacttcgagagggaggcgatctgggccggaggcccgaggggagaagggacggggcggccggccttagagagagggagggcgcccaggccgcggggaggcaaagcagacttgggccgaaaccgg

SEQ ID NO: 37356 - DNA, 9677 bp, Oryza sativa
ttatttaataatttttaatcccgatcgaaaatcagggcgttacatcaactcaccagcaggacgaatgactagattgagactagcaatggcaccttttgaaacaagtttattgagccgcttttcagagataatcgatggaccaagaccggaagatgttttcttcgctttctgttttgaggccggttttttggatttccccatggtcgctgagaagactcgaatcagaaactctcgaagcagaaaactcgaaaggcgtgtctatacggaagtgtttgagagaggagagtattcgagacaaacgagacaaagacgggcgcaacaatgggccaggaaagcgacccccgggcgcttatatagctgttttgcgtgtgcgtgttttcgtggggcccacctatcaataattaggcatgaaaaccgaagtggccccatcccctactcgcgtagtatgtccggataagcaccgccgacgacgcacgattttccttcgtgcttatcggtgcccttgtctgagtcgtctcgtccatgaacgtaagcatttgacacgtggtttactagtaaaaaaattaattaaaaattaattacaaaaaattaataaataaaaaataataataaataattaagaaagaagataatacaaaaactcacatgtgctttcgcccaaaacagggggacgacagtttatcccttacatatttctgaccacggtttcggccgaaaacatcccgcccttatccgtgaggggcttgttgtagcaagtggtaaactttgcccccccccaaaaaaaaaggcaaaaacacatttcgcccaaaaagtctacttaaagataaaatactcagagagtttcccctaaaatataaaaactcgaatgaagttctcctctttatagaaaagttcttttaggacatgttttacccaaaggaaacagcgttacgaggaaaagtacattcgagttaatgtcaagtagacagatgtattcgagccaacatcatccacctgacattatttttcctaatagttgtatccgagcaggtttctagggagtgacaaggcgccaagataatgggaaagtatattcgagttttctggtgcggccaagacagctgaaataacaagaaaagaaggaaaagtcttatcgagtagttgactcattcgaggaaaataaccgtggggaccacttcgactactctaaccagctggcaccagatgtcgcctagggaccaccagcaaagtactattatacccctagggcctatggatcactaagagtaatacggtaactttatgtaagcccatgatggcaaagatgtaaatatttgtggtgatggtcgaacactatgaaaggccgaccagagtcctacagcaagaatacaatgaaatagagaaaaagtaccttatatgcatcctgacatctactcttaggctcactctcaagggtaaacaggaatctacactttctcgtttacacccaactctgttggtgccatgaggtcgtgacaatctcggatgcgagtaagccttgtacatctctggaaaggactccgacatggacctgaagtgattccacagttgcttttcactcatctgcttcttgtcccgtgactcaaccctgatgcagttcagaacatggcataggtagaagacctcctcagggctaagttggaaccagtgcttctgtgccgcagcaatttcgacggcgtggccaaaggcagcacggtttaggatcacggcttgttttggctcaactccaagaatggcaccgccacctggacctgacaaaattgccacaggctttgagcttatgaatgaggcattgagctcagcaacaatgactgacatgggattagctgctgctagtgctaagaagtccttgccatctttgcccttcttccatcttggacctgacaaatccatatgctgaacacactcgcagaggatggactaaaattgatgcgtggtcaaatgctgtagtgaatagcaacgacaataaagcaataagtaaacaaagttgtccaaacaaatacctcaacaaatggagattcactacatacatcactaatttatcgaacatgttaatttgtaaagcatagatacataaataatctgccaaaatacccctgatacggccctacctctcatactctctccactctctcctactcttccccgtacataagactttgccttgagcatctgccgagtgtgtgatactagtacgttgtacggtggactttaagctcgccccctcgtgcttggttaacaacatcacaagattgctccatgtgctaattaaagacggttcccgctcaccgctgatttctttcttctcttcttgggttcttgatttctcgtgaacagaatcatagctttccgcaatcgtaatcagccatggcgatcatagtttttgccagcaatcctgacaagaacttctccctgaggaacttgatcaccgggttggtgctctgctggatgaagccgacgacgtaggccgccgtgatcagccggatgccgcgccaccgcctctcctcggcgtacttctccagcgccgccttgacggcctcgtaccccgggtcgtgctcggcgccgtcggcgaggaaggcctcgctgaggcaccgggcgaggacgacgccgtcctcgagcgccgcgcagccgccctggccgagctcgggggtcgtcgggtggaaggcgtcgccggcgacgcagacgttgcccctgctgatgctgccgcggacgagcgcgagcggcgaccggaacctcagcggcgacgacaccacgtcgctcatctcgctccgctcgatcacgtccagcgcctccgccgggatcctcgccgccctcagcttcgccaccacgtagctccgcatcttggccacgctctcctccgcgtcgccgtctgcacaccacacgtgacagattgatcagcgaattaatccgccattgttgctgctcgtcaaggggaagtaactagcaatggtccgcaccatccggggaggggtaccaggtgtagttccagtagacggaggtgtcggaacaggggagcacgccggagcggaagccctggccgatgaactgcaggatctccgggccgaatccgtggccggccgggtactcagcgaggcccctggtggccgagcgccctgagaggatcggctttggcaggccaagccacttcgccaccaccgagttcacgccgtcgcagcctatcagcaccttcagaaaaagcacagtaatgcatcaggccatggctgctcttagtgagaagaagagaggtacaagtgatgatgaacaatcaaggttgcatctagccattgttgatctcacacacctttgctcttatcgttgagccatcggacaaatgtaggagcttgacattgccgtcttcctcaatcgagacgatcttggaagagaacctgatggtgccttccggcagttcgttctccagagtctccagtaggaagttgcgcttcacgcaccgaatctcatgcggtccactgacgaagtaacgacacaacgacgatttcagttttcaggtgtttactcgtataagtatgattttgttacaaaattttaacattcaggtctcagctagcggtagttgcagacactgtaccttttcccttgcatctttagactcaacttcgcggcaggctctcccgtggatgcagagaaggccaacagcctgccaacaagcacgacaagtcacaacttcagtcgatcacaaactctttagtcttaagagttacagattactcctgcaacttcagtaggttaatcgaagggtaaactcaaaagatgggctggaaggagcaagagacagtgtaagcacacaagttcagagctcagacacggagtgggattgtggaaaaagcccaaaacttataaggtctagtacatcagaccaggcactggcagactgacccagcatatggacctaaaatcaggttcatcagtacggcccaggatggcctatcaaacgagctgggctgtaaatttgatttcgcttaaacgagaattattatactcgcgttaggatttgttgtgatttcgtgacggtcaacggactccactgttcgtctgttccactgtctctgtctggctattatctggatctacaactagaagggaagggattggtaaagcaagtggctgctcacctctcgtagagcagatgatgctccctgatcttgtcgccgacaccaagggcgtcgagcgcgcggaaggcgttcgtccatgtcgtgaacgcgaacccggacgcccgcagcgtcgccgacgactccagcaccaggctcctcacccctttcctgcacacgggacgcaccgccggcccagctcgatcatcagctccagatcgatccgcgcgcgcgcgcgcaaacgcggagcagatcaaggcgaaacggtcggcacagaggcttacctgtgtaacccgagcgccgtcgcgagccccgcgaggccggcgccggcgatgacgatgccctcgacgcccgagccctccattgttcgcgaacccccacccgcggttggtgtcgctcgcaagtggaaacagagtgaggatggtcgaaggctgtactgctgctgaaccagttcagggttttctatgatgcgccttcattttgtagcaaaacggtcgaggggtggttggattggacggagaagaccggattccaacgaggcggcgcgtccatccgtcatgccagcggtgaaacaaactggaacatggcggctttcacgaattcttgtatgactagtacacatcgaaatattggtcaattggtccatgttagtcctctcgatcgatttggtaacgttgcgcgcaagtctgattacagaggatccagcattcccgggttcaatgattggcacaaaggaactgtcagggctgtttcgtactagaatcgtagtacgagtacagccacgagggcggcttgtgaataaacccaaaaagaattgttgaggcagcaggtatgctcgcaagcagtgcccattcccctccgggttgacacgggaattttcgatatccgaccaaaaacccaaatgcactcgactttatttttctgcacacaaaaaggagcgtttcacaggtttgggatcattgacacgtgacggaacagtaaaacagacggagcacatacagacaaacatcacaaacagcacgacgatatgattacaggttgcagacttgcagctgggcggcggccaaaacccaaatcacgtcaacaagcaccggaactcgagagcgtgccgcaatcgtagtcgggcatcatgagcagcgtcttggcgagcaccccggacaacagcttgtcacgcaggaagcccacggcggggtggtcgctctgctgcacgaaccccaccgcgtacgacgcaccggtcagctgcgcactcctccaccgccgggcgtccgcgtaccggcgcagcgcggcctcgacgacccggtgactctcctcggcggcgcagtcgccggtacggagcagcagcgcctcgccgaggcacctcgccaggacgacggcgtcctccagcgccgtgcacgcgccctgcgccaggtccggcgtcgtcgggtggagcgcgtcgccggcgacgcacacgttccccttgctgatgctcgcgaacgggagcgacagcggcgatcggaaccgcagcggcgccgcgagcacgtcgttcatctcgctccgctcgaccgcctcgagcacctgtggtggcacgttcgtgctccggagctttgtcagcacgaactgcttcgtcgcggctgaactcttgtcgacatccttatctgtcaaaagacacggcattaatcagtaatacgattcagtgttcatgtcctccttgcagccgatcgagtgttcgacacttggatcttggcagctcaggtgactgaccatctggggaaggagaccacgtgaagaaccagtagacgtcggtgtcgttgcagggcaccatgcctgcacggaatccctggccgaccaactgcagaaacctgggctcgaagccatggccgtccgggtacttggcgcgtccgcgcgtggccgtgtgccccgagtccgacggcttcgcgagccccagccatctcgccaccaccgagttgatcccgtcgcacccgatcagcacctgcatccatcgccaccatctcctcctcagcaaccgatcgatcgacagagacagcacgcacgccatgtgtttttacctttgctctgagagtcgatccgtcagacagatggaggatcttggcgttgccgtcttcctcgatcgagacgatcttggaggagtagcggatggtgcctcttgggagctcttcctccaacgccagtagcagcgcggtgcggctcacgcagcgtgcctcatgggttcccctgcgtcacaggtgttttcaggtgtgcgcatcacacgacaggggggaaggggagtagacagatatatcttctcagttctcaccgtttgccttgcgccctcagatcaatttcttgcactatttctccagtagctgaagacatgacattcaacctaagaacaaacatggagagaaaaaatcaggcttatccgtactgtacaccgtatgatacagacatacagtaacagttacagttagtgtgtgtttagttcacgctaaaattagaaatttggttgaaattgaaacgatgtgacggaaaagttggaagtttgtgtgtatgaaaattttgatgtgatggaaaaattagaagttcgaagaaaacgtttgtaactaaacgaggccttaggagttaggacttctactttaggacctcggtcaccctgctgagtcaacccaaggcctcagggcaagtactatgagccccttatcactaatttcaagaagtcatgtagacttatatgatgatgtggagagaagagaagagagaggggagcagccacctctcatgcaaggggcaacctccacaccaatttcaagaaatgagagaaaaagagataagttgattggttgggtgtagtgtaagtagatgcaatctattgtatgtattacatctaaattaatgtgtagatgatttagacaaaattagatgtgaccactatctctatcataaaacttgccctcacacattcagataatgataaagtggcaggagaaaaaagttagtactactgtactctgacctggaggtcaagatctcagtgactcagagtctcctactgcctctgaatctgttacatacctctggatctgctggtgctggctcctcatcttgtcgcctaccccaagggcatcaagcgcgcggaaggcgttcgtccatgtgatgaacgccaacccggacgtccgcagcgtcggcgacgactccagcaccacgctcctcagtcctttcctgcacgcagtgccgcacttcgatcggctcccatggagttggaacacgtcgctaggcactcagaagcaaaaaaggttgtgtacctgtgcagtccgagggccactgcgagcccggcgaggccggcgccggcgatgacgatctcccggccgtctgcctgttcttgctgcatgcttgcaactggctttgtgcgaatgcaaactgacttggctgcaggaaagagatgagaataaatgctgtgagcaaatcgagtgagcgccaggagtttaaatatgattgctgcgacggcgagggtgagtgagcagcaggccagcagtgaaggcactttgacgtcatcgctgatgatgatgcgccactacggtccggtgagagtggacagacgtcgaacgggacgtgccttctcattgttttacaatatcttggacacattttttgcggcaagatagcagcctccagggaaaaagtaaatgggaatataaaacgttatggcattggttaaagtcaaactatttaagtttaattaagtttaaagataaatatggtaaaattttcaaccaaagataataaattatgaaaatatatttaattattgattcaatgaaactaatctaatattataaatattactatatttgcctataaatttagttaagcttaaaatagtttgactttgaccaaagtcaaaacgtcttataactataggaggagtagtaaccactgccgccacggatgcaccttcatcaaggttttacttgacaaaatgacaatggtctcatccagcacagacccagggtatggtgatcatttttatgtcctcaaacttgctgatagtgaaagttttagagcctcatgggtaagccatatgtttaggctgatcaaccaaagcctttttccaattcaagcaaatcaatttcattggttaacttatttagttgaatggcttaatgagtgatcctatgtggttggtggttgtagccagtggtggatccagaaaaaaatagcagtggggtctgagcaaactagataagttacagtcccccctcccatctacatatggtaaaaaaaatgtagtgggtctttgtggggtctttcatagtctttacgtcagtagtggaggctcgagaccccgccgctctcatgctggatccgcccctggttgtagctacagttgtagcattggcactagagagttcataggattagctaccaccaacgatcctactctcctgttggccccgctatatttggcaaataaacctcatcccaatcatcaagtcgtatgggcttcgggattgagatcacatgcagccatagctaggactgcaagttagtgactccatggtatctcatccattctttttcagatcaaaagtgcaaatcaagtgctacagcccgttactatagcggttgcattgcaccgttacgatgggatttggttcatgtgcaatccctgtgactacaacttaagcagtcatactattgttcctactatggtcaactgagactttttaattcttccatttttgcgctcaacaccttatccctactagtgtcctagaaatatagattcccatccttatccacaaaatttagacctaaacccatacatgttttgaggcagcttttatcacaaaatccaattccatcatttgttcagacacatgggtacaaaatccatttcgtaatcttattaacttgggtacaaaactgagttcccacgttttagagcttgccacagtcatagtccgccattttcagaagccttccggcgagcactccggccaaccacttgtcccgcagaaagctgatgaccgcattgttactctgctgcacgatgccgacgacgtaggctgtcccgacgagctcgacgctcctccaccgccggattctagcgtactcacgtagactcgcctcgatcctctcgctctcggcggcgccgccgccgccgagaagggcgtcgccgaggcatctcgccagcacgacgccgtcctcgagcgccgcgcagccgccctggccaaggtcaggcgtcatcgggtgcagcgcgtcaccggcgacgcacgcgttccccttgctgatgctcgcgagcaggagcgacagcgggggccggaaacgcagcggcgacgcgaccacgtcgtttatgttgctcctctcgacgacctcgagcacctcggttgggatcttggagctcctcagcttggtcagcacgaactgcttcatcttttccgcgctctcctcgacgccattactttctggaacggcaactaaacaccgatcaatcactgatcacctgtcagatcaccattgttgacatagttgacacttgatagtgacgagactgaccgtgttcggaaggagaccagg

SEQ ID NO: 37357 - DNA, 558 bp, Oryza sativa
  unsure (1)..(558): unsure at all n locations
aattcgagctcggtacccttcattctgactaccgcatagactatctttccatatttgaaataagccatgtaaagggtaccaacagattaccttctttctgagaaaaaaaaagatttaaaaatggcgcacatggacaatgatgtggcgttttatactgaagtagattgcgaagcaaacataacggtgcccaaggaaacatgccaggtgtagctaagttttttctaaaaaaaaacttaataaaaggttgagtagaaatgctaaattgtcaatgtttttaaaggaggaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 37358 - DNA, 691 bp, Oryza sativa
ggttagtaaaccttcaggcgcaaaataaaccaaaagaatgtcattaagagatgcatcacaataaattgttgttcttcttggcatataaataatggagacttggttaagaaaaacagacacttctgtagagtcataggagaacagacgatgccaagggattagacagaagactcacattatcagatttctgcatcaattggtattcccagaacttgacatcatgatcagcacttccagtgacaaaaccccatgcaccagcagttccatcctcgtttggaatgagtacaattgatcgtatggaaccagcatgagcttctataacctcaatagagcttccactattaatatctataatctccaaagtaccactctttgtgcctacaagggcataccgatttccaggaacaaatgcactgcacaatccataatcagaatcaattgtccggagacagtcgccagtactaggattccatatcttaacagcattgtgacttgttgacatcaggaggttgtcctctgagttaagtgcaagactcctaatatcagaacggtgtccatgcatctcaatggaatacatattcgacacattctcattatccactgagtatgtctcaagcatgttattattcagagatagagacaaggtggcaaggcaaccttttggtggattggttggagaaaatgcgacaga

SEQ ID NO: 37359 - DNA, 539 bp, Oryza sativa
  unsure (1)..(539): unsure at all n locations
nnnnnnnnnnnnnnnnnnnnnnnnnnnnnnnnnaagtagctgatattttatccttgttcttgataggtttatgccttgaaacgtgttcggataggcaggttcaggcttccaccagatctcaggtaatgcagtttaccacatctgtatatgtttgaaatggaccattatacatttacactgtctttttagcatcttagcacctactcgacatgacatgttcttttcatgtaaaagatatgaacactgaacactatatactgtaagaaaaagatcatgtctatgaaacatcgcaagaaagagcatggcactttcttgctgtaaatgatatgaacaataactatatcataagacctgtcaaatattgtgaggtaacatggtgctgtatacttgatagcatctgccagcaggcatgctaagacctgtccagtatagttggctgattcaaagataactggtatgccatcattttagaggcatgattccatgnnnnnnnnnnnnnnnnnnnnnnnnnnnnnnnnnnnnnnnnnnnnnnnnnnnnn

SEQ ID NO: 37360 - DNA, 833 bp, Oryza sativa
attattccgcatgcagaaaaggggttaagtccggggttctgaattcgtcgccgaagctccgggcgtcggggttcgccatcgcgacgtgaaggaatgcgttgcaagcgcttaccgcccttggggtgggtgacaagatcagaaagtgtcatcttcatcttcaggagtaagtactagtgtactttcttcgtccactcactaaagtgcggttaaacttggcgcaatttttaaaactaatttgtaactttaaatttctcatatattataatgtttgtcgcaataaaattataattatatgaaagtaaatttaaataacaatccaataatattattttcatcgaataaaatttaatttatagtttattggtcaaatatttaaagagttaaatattaaaaaacgtgcgcatttaaagagttaaatattaaaaaacgtgcgcgccttaatgagtggacgaagtcgcacaagacttaacaaagacctaaacactgcaggagatacacctttgttatttcgtttttgcatgtcactcaaacatgcataatttatttttagatgaaacaaaataaattcatgtgtatactttattaccatgtatgtctaattcgagctctacaagttgcaaaaaaaaaagaatatacggccgtacgtgaatatatgaatattatgtacattttaatttgttagtagttaattcttaattgagaaattgtagtagttaatttaattttgtactttttgagtgatatactgtatattaattattttttgaaaaaaatataaatgcaagaaacaagtggacatttcctagagcaaaattccatctctatgttttgat

SEQ ID NO: 37361 - DNA, 616 bp, Oryza sativa
ttgtacatgccttaattatttggtattgttgcacctatttgcaaggaatacttctggctttgtgtaccttcgatttgacagtataccagctgcaatgagtgcacagaaagcacttcatgggaggtggtttgcgggaaagatgattacggcaacatttatggtatggaatacaacatttaattgaggtcaatcttccctttctaaattttgggtttgctgattgctcttttgctgtgtcagtctccgcagcagtactcaacgaagttcccgagctagcggacagcaactttcggttgatcgctgaagattcttgctctattgctgtgtaacggtctcctgtaacattatgtcatgcagccttttgtactttatagcatgggttattcaacactaagttcgcatacatcactcgtttttgcttaagacattatctataagctctcgaagtgtacggcgggcaaatattttaactcttggtgtttcaattgatcgtgccgtgatggcaaatattaaagaaatgttgtcgaattttggggcaatcgtaattgcccaggaaaatgatctcattacttgatttatacccctatcatccgtttgaaaagcagaaattcttgtt

SEQ ID NO: 37362 - DNA, 693 bp, Oryza sativa
  unsure (1)..(693): unsure at all n locations
nnnnnnnnnnnnnnnnnnnnnnnnnnnnnnnnnnnnnnnnnnnnnnnnnnnnnnnnnnnnnnaaatgccgagaacatgccacagtaccttattattcttatggtatcatcaagttatcgtgacaagacatgttagccataaccttttaatttttcactgcatttccaattcaaaaaatgtgcgtggcatatattaactacaaatagttggtactggtttgaacacttggccttcctctgaattttttaccttccttttgtctgtctgcagtttgactgctgggatagccggtactggtttgaacacttctgttggattaccacctgcatcagttcttggtgctcctccagtcgctgcatctgtactgcctacagtgcctggtcttggttcagttcctggggtgtctcttccaattactacccaagccattgagacagccccacccagtgaatgcctattgcttaaaaatatgtttgatccatcccgggaggtttgttcttactactgcattctttttttttttgggttcaccaacagtccataccttttttaaaaaaaatctttactggtctggatcccttctggttggttgaataaaaactaattgaaacttactttatttgcagacggaccctgaatttgatttggatatcaaagatgatgttcaagaaaaatgctccaagtttggccaag

SEQ ID NO: 37363 - DNA, 622 bp, Oryza sativa
ctagttatgaaatgataattacttaaaagatgttgattttagatagaactgcaagttttattatgtattcaccattatttcccatattatctgtactcacttcttttgttatattttgaccagaagaggcaacgaaaagtaaaaggtatacaaaatatccaacggtttcaggagagctcgtacatggacccaaatcaaagtctttgccttggagcactatttaacatagcagcaacaaatgtaattatttcctcctgcctatttgcctatcatgctgttgctttcttttcttgatgtcatttctcatttcagggtctagatatgggaagaagactatgcatctttggcttttgtcgctctattgaaatgctaagtgatgtagtggaagatacagtattggagcatggtggtgaggtatgtgcaacagtcttacatggaaaaaaaaatcttttggtactttgctccttacagttttatatcttcattctgactaccgcatagactatctttccatatttgaaataagccatgtaaagggtaccaacagattaccttctttctgagaaaaaaaaagatttaaaaatggcgcacatggacaatgatgtggcgttttatactgaag

SEQ ID NO: 37364 - DNA, 1248 bp, Oryza sativa
acttttttttattaaaatatttacaaaaataatttgttgtttcgaaaatttacaaatctaatcgcctgccgccctttgagagggcgatttttaaaaatcgcccttccacaggcggcaagggacctaaatgtaaattttccagcataacttgttagctctataattttacaatttaaaattatattatataaagtcagatgaaataaaactttatatcaaaattgtagagctcaaggagatctacaactttgtagttaataactttttcatttaagatgttttagatatccaaatattcgttacaaaatataaaacacattttaaaaaatctcagatctacatttcaaacgacattagatggagataaactttatataaagttgtagatcttgatgagatctataactttgtagtttatcacttttccatttaaaatcatttggagtatcgaataagcattattagtttttaagcaattaaaaccggtgggaagggtttgaacacaaataaaaattttgtatttaggtcccttgccgccctttgagagggcgatttttaaatatcgcccttcttaagggcggcataagggcggcatgcaattagatttgtaaattttcgaaacaaaaaattatttttgtaaatattttaataaaaaaatgtataaataaaaaaaattcctccctcaggagtccggaccggtttgctgcccgccgccggcatgtgggccatatttccttttccatggtagtaggccagtacaggcccattcctaggcagtcccggcccgcaaatttatcggcccaatatgaggggtgtcgggtcctacaagtcagtctccttgctcgttctagcgtgttcggtgttcctcgatagaaaagaggactgggggtttagctgcgcgctctctccctcccccaattttctctttcctcatctagggtttccgcgtcgccgcggccgcgagtcgccatggatttcgacgagtacgactacttggagaagacggtggagggctccggggcgccgtccaacggcgccgccgcgcccagatccgaggagaaggagcgaagctctcgccgccggagcggcggcggcggcggcggcgacgaagagcgcgacgatggcgagcgcagatccaagcgctctcgctcggaggagaaccgcgaccgcgacaaggacaaggaccgggaccggcaccgcgaccgcgacaaggaccgggaccggcaccgcagcagccgggagcgtcgc

SEQ ID NO: 37365 - DNA, 564 bp, Oryza sativa
aaataaactcaaacggacgaaatatgtggcatgtggaattttccaaagctccaccgaaaaacttctttcctcgaaaacacaatcttgcaagcggaatttggaggttttaatatcgtcgaacccggcaaagcgggggagaatcggatgtaactttttctatagatgtccgtgcatatattatttgcctgattccgagtccgtatgagaaagttatgcctattttaatagatggcatattttgtccgtttcggtagagttttggaaaattctacatgtcacatattttgtctgtttgagtttattttttatacagttggttcctatgttctcctaagtgtgaaaaaaatatcaaaaaaatgaaataaaaataaaaaattgcatctctacgtactgtttaacttatatatgtcatttcatatggttatattttgaattagattaagtaatttcatatagtggtagagtgcattatgtttaacatgctgatcaaagggttttactaaaggagttatggtctaattttagtgaaggtgcaaagtagactaagtggtatgctagatattt

SEQ ID NO: 37366 - DNA, 5197 bp, Oryza sativa
gcaggaattcctttacaaggatttggtggtcagcaggtacatgcaatcggaaagatatcattacaagtggtgtttggaggaggagaaaataagagaagagaagaagtcgtgtttgatgtggtagacatgccatatcaatacaacgccattttgggaagatcaacaatcaacatttttgaagcaatcatacaccacaattacatctgtatgaagcttccggggccgaaaggggtcatctccgttcgaggtggtcaattagcagcaagaaaatttgagcttcaaggaactccaaatatgaaaggtgtacatattgttgaacaaaaacaaggagagtacaacaagaaccaaaagccagtaccagaagggaaaacaaagaaagtagtgttggacaaaaatgaacttgaaaaatacatcttgataggagaaaatttggagaaagaagttgaagaagaaatcttaaaagtggtaaaagccaacacggatgttttcgcatggtcaccggaagaacttgaaggagttgagagaagtctaattgaacacaatttagcaatcaagccagaacacaagcctaagaagcagaagttaagaaggatatcgatagataggcagcaagcagcaaaggcagaactagagaaattgttgaaggctaaagtcattcgagaggttatgcacctcgagtggctagcaaacccagttttggtgaaaaaaaagcaaatgggaagtggagaatgtgtattgacttcacagatctaaacaaggcatgtccaaaggacgattttccactcccaagaatagatcagttagtggatgccaccgctggttgtaagctaatgagttttcttgatgcttactctgggtatcaccaggtattcatggtaaaagaagatgaagaaaaaacatcattcataacaccttttggaacatactgctacataagaatgccatttggtctgaaaaatgcgggtgccacatttgcaagattgatatgcaaggttctggcaaatcaacttggccgaaacgtagaagcatatgttgatgacattgtggtgaaaagtaagaaagcttttacacatggaaaagacttacaagaaacgtttgagaacttgaggaagttttcagtgaagttgaatcctgaaaagtgcgtgtttggtgtcagagctggaaagttacttgggtttttagtatccaaaagaggaattgtgcaaaataggaatggagccacccaaaaatacaagagaaatgcaaagattaacagggagaatggcctcgcttagtagatttctttccaaatcagcagaaagaggtttaccctttttcaagacattaagaggggtaaacaactttgaatggaacgaagaatgccaaaaagattttgacgatctcaaagattaccttcataacatgccaactttgtcaagtccacaaaaaggagaacctttgttgctatatgtagctgccacactggtgacagtaagcgcagtcttagtacaagaacagggtaacaagcaaatgccagtttattttatgtccgaagcattgcaaggaccaaaaacaaggtatacagaagtggaaaagatgatatattctattgtgatggcatcaagaaaattgagacattatttcttatctcacgacataacagtaccatcaacttatccaataggagaggtgttgtcgaacaaggaaatagcaggaagaattgccaaatgggctatggaacttttgccttttgacttgaaatacacatcaagaacagcgataaagtcacaagtgttggcaaaatttgtggcagaatggaccccagcagagttagagaaaaagaaagaagaagaaaagccgtccaagctgagataagatcattgtgctccaaaaattccttttcaagctccggagtgatgaggctaggagcaatttcatttccaagctgatgaagagacgagcgatacttaaggtcatcaagacacaacttagaacctcgactgctagtctccccatccgcgcaaaaatcaggcaaacccatcaaccaagtgccatttttcgaacatcgctcgctgaaaccaccaagtatatcttttatcaactcgggagaaggggtcattctgtggcttgatcttcaactatgttttttctggattggaaattcagattaacaacttcaggaacgttctctgtttgaacaggattgacagggttcatgtccacatcaatagcatcaatgcaaataggttcctcaacctctttggcagcagaagtaagaacgttcaagggagcagagaggtaatcagctgcagctgaaagagaattaacgttcgaaacattcccaatctcaactgaacttatctcactgatagcaggtagctcataagacagaatgttttcatcctcatcatcactatccagagcaattcgaacttttttcaagttcgagtcaacaggagaacttgaaggcatctttttacgcttcaaagcaggactcgagttttcttgcacaaaaggagcagtgagagtatgttcgctcgactcagaggagccggtgtcatcagacgattcatcacttgaatcagactccccatccaagctattcttctcattatcagaagatgaagatgcagcatcttttggattgatattcgagtttttcttctttttcttcttcaaatcaggatgaactcgaaccatcatatcttggccgagggcacttagaatcctgttttgttttctaccttgctgaaccgcaagatatgtgccatgctctttcttggtataagggccaatatatttcttgcttggcccatccacgtccttcacaatttttgctgcaaaaaaaagaaaaaaagagaagaaaaaaagaagaaaaaaatgaattacatatatatatatatatataatgcttgaaataaaaaatacatatacaaggtaaacacttactattcgcagatatctcgaaaggaggaagcaaagaactagaaccctcaggaatttcaccaagagataaagtccagttggcagaaagaggtcgaataccaagataaatgaactcctcgaccaagtctcgaacactaaatttagagacaagttcttcaattcgagggcgaatgtcagcaaagtcttttgacaaagtaacagctggatctgagatgacactcaaagatttacaagaaaacacaaaagggcatttttccatggttttcagatctgctggaatcttatgatagaaccattttgactgccaatgagttccccatttggtccacataacagagacaactggccaaggacaaccgcgatttaagcgtggcataaagttaacacacccaaattgggagttttgccttgtatagcgccgaatggtgtgaaaataagcaaaatcgcatccatgcggagtaccaccgcaactccgaataatccattcaaaaattccaagcttaacaagggtgtttggtgtaagctgagaaaactcaagtccatatagcctaaggacctcaacaagaaatgcactgcaaggaaacctgaagccagcttcaaaaaaatcatcaaacaccaaggtgtagccggcccgaggtgaaggactcaactgtcacgcccataaatttagcccaaatttccagactattttgtgtattaaatccctgtccaggaccagccagggtacacaaaacgacaagtaataaacagttccaaacgtaaataaagcgaaaattacttacagaagaggcacttagtcctcacaccgaaacaaaaacagcagcagcgaaaaaggcaatcctagcggggcttcagctttactccaaaggcaaaactcaactggggtctgagccttggtcttctaatttcatcttcagctcagaagcactacacttctgaaaagggggaataatagcaaggctgagtacaaccaccgtactcagcaagccacaccaacgatgcagatgtgcaaggggaacacaaggactgtttatggctatttgcataaaggcggttgtaaagcattttattgaacaaaacagtaaaacagttgagtaattaaagtaacattaaatctccactgatcaacgctacaccacgttgaacaggcccaaccaacccacctgaactacagtgcattgggtcgatttattaagtgtgagactaatcacggtgaatttggtcaaccgcccataaccacggtcacggctattcgaatagttttactctgatcagaggtgtacaactgtacccacaagacacagccccacgacacgtttccgtgcgccgacatgccaccacgacataccagaaagaggccgtgacaggacccttcgcataaccccctctagccaagcacaccacacctcaggtttcacccccgtccccagcaggcaacgggcagtcccctctcgtgcctaggtgaatccggaagcgacagaggccgtcgcagggcccgccctgctccatcacgcccacccttgcctggatgcgtcaactagaagaaagctacactacaggcctagccgttgcccacgctagcttatggtaagtacgagaaattcttccaggatttcccgcgaaccggtccttaattgccatgggtacgactagcaaaaccatgcacccatagcccaccattcagttacattttagttggataattacgaccactgaaacatggccaggtgtctcgagcatgcaactcgttctgttgctaaaaaggtctaatactgcaattatcccatcaactgagcaagtggtaattaagcatggctaagcatatagttctagctaggtcacataagtaacataagctagtcgatttattatccaatattgacaaaggacagatataaagtaaacatggcacaagcaaacagataggtaaaaccctgatcccatgtaattagcaaaacatgcatgtttatttgcaaacggtaaaaaatttataaattgggatcaacatgctcaaggggaatgtgtgacttgccttgcttcttcacaacaatcttctgaactctgatccttgcgactgcgaacttccgaaacaacagaatctactcgctggcacacaaaacgagaaaaaaaactaataaacaccaagaaaacagtatataaaaagtaaacaaacatgtagagctcaattttagatgaattttgcaagttgaatggctcaattcggagttcgaatgaattagatatgaattttagaagttttgagccattttaa

SEQ ID NO: 37367 - DNA, 1073 bp, Oryza sativa
ataaattgggatcaacatgctcaaggggaatgtgtgacttgccttgcttcttcacaacaatcttctgaactctgatccttgcgactgcgaacttccgaaacaacagaatctactcgctggcacacaaaacgagaaaaaaaactaataaacaccaagaaaacagtatataaaaagtaaacaaacatgtagagctcaattttagatgaattttgcaagttgaatggctcaattcggagttcgaatgaattagatatgaattttagaagttttgagccattttaatgaatttctataattaataccaatttatcgagcaattattaaatatttttccaaaggaaatgataagcgctgacggcagcaaggggaagggtgccgacaagcgggccccacacgtcagcgagactaggggagggcgcacggtggacacggtccaccgcggcaggggcggcaccgtggaccgagaccacgggtgtggtccacgagcgcgaccctcatcgacaaaaggggaggctggctcgccggccaacccaacaaggcggcggcggcacacgctggacgaccggcgacggcggcacgacgcgggcaaggggacggcggaggagggggaaaaggaggggaaacagagggagagctcaccgagcgccatggcggcgaggggcaacgggcggcggcgatgccttctcgagaagacggcgggggcggcctcgggcaacgaccagtggtgcggaaaggatggccgaggcgcgggacgacctagggagggtggtagagaggttaggatggggacaagtggcccgagacggtgtgaatcgccggccggaggaggaggtgagaggtggagcttaccggcgcgcgaggaggacggagctccggtgggttcccgacgacgagaagcgaacgccggacctcccctcgtcgctgcgaagctgatggaggaaggtgcgacggccggggatgtctcggagtggcggcaagcggcagctggaggtggcaaatggcagtggcgtctcgggttcacggtgggagcagtgcttcgggggtgaaggagggagatggagtgatgccgagct

SEQ ID NO: 37368 - DNA, 521 bp, Oryza sativa
tcctcctgccaccgtggcgcacgcgaaccgacgtggcaggaggaggctggcgccgccccaaggaggagggcgccagcatggctggcagccgccgcctccattcctgtttctctgtatggagttgcaacggtgtcatttttattttattttttcggatgttttttcacactcaggatcacgatacaaccaaccacaaaaaaaatttaaactcgaactaccacttagctaagtttgaaaatatctagcataccacttagtctactttgcaccttcactaaaattagaccataactcctttagtaaaaccctttgatcagcatgttaaacataatgcactctaccactatatgaaattacttaatctaattcaaaatataaccatatgaaatgacatatataagttaaacagtacgtagagatgcaattttttatttttatttcatttttttgatatttttttcacacttaggagaacataggaaccaaccgtataaaaaataaactcaaacagacaaaatatg

SEQ ID NO: 37369 - DNA, 960 bp, Oryza sativa
caaaacgacatgcaagtatggcctagagtgtaaggtgaatagtcatcagtagagatcagtgggagagaacatgacatcttaccgtttcccctgcaccgtgagatccgctcttcgtgttatctctcccgtagacgaagagaagacatgcaacctgtgaacaattcagaccaagaatcagtcactattttacattttcaccacacctacaagtgttcctctctttttctacatactcctgaagatgcagatgaagcttcctgatcttgtcgcccaccccaaggttgtcaagcgcttgccacgcgttcgtccacgtcgcgaaggcgaaccccgacgcccggagctccggcgacgactccagcaccgagcacttcacccctttcctgcacgcggagcagatcatcatctcgagttaacctgcggcagccaacacacagagcaatacgcatcaccggctcaccggtggctcctctcacctgtgcagcccgagagccacggcgaggccggcgatcccggcgcccacgacgacgacggcttcctcgccggcttccttttgttgcatgcttgatcgatgctagattctcagtagtcagtactccccctgagtactcttaatcaattgggaggccagtgtttaattaagaccaaacactaactgagtaaagcttctttgctcactgaaatctagtgctgctcgtggccgcatatatagataggctagcaagtgtttgggacctgggagactgggagtgatcggcactggacttactgaagcagatgcgacgaaaaagaagtcaggttggtggattcgaccttgtacacgaacatgcggaaattggattagcgagggcagtcagagtcgtgacggaaatgggaattttgtacggcccaaactgttggctagtgtgtttggatgtggaccatatttccttcctttttttttaatggaataagatcactttg

SEQ ID NO: 37370 - DNA, 713 bp, Oryza sativa
cacagcaaactattcttgctatttagatcttggatttttaccaggtacatgtatagtcaaagtgggtagaactctaagaaaaatatgaatgaaactcgatgtactaattgatgctccatgtttcattaacattagtatctggacgagctttacccaaattgtctcatgctgctaaaaagttccactagtctacaatcccaattaaacaaggttccaacttccaaatcagcctcacctgtttttcaataaatttttggacatcaacttctgtcaatgaactgtcaggtgaccgaacaacataggcaatgggaacctccccagctttagcatcaggaaaccttggaaacaagtagagctccgttaagaaacaaggcacaacagagagagaacgatccaaaacaacaatgttgtaacaagcgaacagtttatatcatagggagcaaaaaacacttaaatttttaggtggttcaacttacgggataacaacagcatctagaatctctggatgagatagaagtaacccttcaagctcggcaggtgcaatctaaagaagtaaaataaaggagatgattagctatttccatatattggacaaaatatgacgcgtgctcaagcaagacaaaacacaagcattaggtgggattcctgttatgattgtatagtggatactaaaacaagaagatcttattcagacaactcccatctataaatat

SEQ ID NO: 37371 - DNA, 934 bp, Oryza sativa
  unsure (1)..(934): unsure at all n locations
tcttattgcataacaaaagcatgccatatttatggatagccgtatctttttagtatntgtgctcgcattcagttcagttgacctgaaattatatccaactgaaacaaattccaagtcgattcnaagtaatccagtatgaaatctagcacagtgtgaatcatttnaannnnacgatgtatctcaagttgacaggttataattatgatctgtgctcaatgtgctagtttagnccgaagcatacaaatgtactganttaattaaatngngcnagctatgaaccccttctnnntttnaaagatgttgattttagatagaactgcaagtttattatgtattcaccattatttcccatatatctgtactcacttcttttgttatattttgacaaaaaaaaaggaaagggcaacgaaaagtaaaaggtatacaaaatatccaacggtttcaggagagctcgtacatggacccaaatcaaagtctttgccttggagcactatttaacatagcagcaacaaatgtaattatttcctcctgcctatttgcctatcatgctgttgctttcttttcttgatgtcatttctcatttcagggtctagatatgggaagaagactatgcatctttggcttttgtcgctctattgaaatgctaagtgatgtagtggaagatacagtattggagcatggtggtgaggtatgtgcaacagtcttacatggaaaaaaaaatcttttggtactttgctccttacagttttatatcttcattctgactaccgcatagactatctttccatatttgaaataagccatgtaaagggtaccaacagattaccttctttctgagaaaaaaaaagatttaaaaatggcgcacatggacaatgatgtggcgtttatactgaagtagattgcgaagcaaacataacggtgcccaaggaaacat

SEQ ID NO: 37372 - DNA, 1418 bp, Oryza sativa
cgattcatattttatatttttgacacggaataaatatttttatgtcctattgataaaattgaataaccgtgtcttttatatttaaagcccttaacctttaatttctttctattattttatttgttatacatatcatacaattaataataccccgtatctagaatagtgtaccatgtaccatattcgtgtctgtatccgtatgggagtgtccgtataacatagctaaccctcatttgtgttttgtgccaactgtatcacaaaaatcagttccatcatttgttcatgcaacccacatgtaagtacaaacaacgatgtatttggatcgtgggattggattctaaactcttgatgagatataaattaaattatagctagttaatgtatatctataatcaaatttacttttttcgttgtaacttgtagaagttaaatttgatcttgcatgtttatggatttgtttatcacattttaatctatcatgttgatttttttttattttattttataactatttagatgacatgcaaacaacaagatgatatccctcaagagtttagaatagtttctagtttggaccgtccatattttttatggataattgctcatttggctctgttttgaagcataactaccaatcagactctacttattctaatttgctcatttgacccctttttcaaaatcaaagttaccatctaaccctactttctctatgatgttagggcttcattcaagaaaagggaaaaaaaatccatttactagtcaacctgatcaaaatacccttgatgacattcaaccatatccattcattagctcccaaccctatctctctatgttaggtgaggcagtgacgacgcacacgtagagggatggcacagtggtgccagcgtcgccggtgtggagagggagggagcggtggttgcgcatgaagaaagggagcgacgacgaaagctgcacacgaacggagcagcgataacggcgtgccaagagagggagcggtagcgcacgcctcgacaatgatgatgaggagcgatggcagctgggcccgggcgtcagagctaggactagggcgggaggattcagtaggggatgggtggcgaagctcaggctgaggcgggtggatgcgacggggaaggagtgtggagctcgggctgaggcgggtggatccagcggagaaggggcaacgatggctcgatgatgatgaggaagagcaccaaaggcaaggctcaggcggcagagttcgggctgtagcgatgggtaggcgatcaatccggtggcggctgagtatctagctacagatccggcggcaccgagacgtgcggactgcggatatggtggcggcatcgtggcagtggtggaattcagtgggtgtgggttagttgtcggcaacaacgacgatgacgccatggcaaagagga

SEQ ID NO: 37373 - DNA, 12557 bp, Oryza sativa
  unsure (1)..(12557): unsure at all n locations
aatttttgaacaaaattttatcaaatttgaataaatagtaccaaatgagaaccaaaatttctgaaattttgttatggaattttgaaccctgccctcaaccactgatagcaaaatatttttttattagaagcagaattcataaatcaatagttggtcacttgtactaatgataatacaataatagtgtattacgagtagagagtctagagagtagagaccactgtaaaaggatcccggtacagaaggccaataaccattcacattttagagcttgccacagtcatagtccgccattttcagaagctttctcaccagcgctccggccaaccaattgtcacgcagaaagctgatgaccgcattgctgctctcctgcatgaagccgaccgcgtaggctgtcccgatgagctcggcgctcctccaccgccggatcctcgcgtactcacgcagacccgcctcgatcctctcgctctccgcaccgccgccgccgccgccgaggatggcgtcgccgaggcatctcgccagcacgacgccgtcctccagcgccgcgcagccgccctgccccaggtcgggcgtcatcgggtgcagcgcgtcgccggcgacgcacacgttccccttgctgatgctcgccagcagcagcgagagcggcggccggaaacgcagcggcgcggtgagcacgtccttcgcctcgctcctctcgatgatctcgagcacctcggctgggatctccgcgctattcagcttggtcagaacgaacttcttattcttggcgagagcatcatcatctggagcagcaaccaaacatgcgtgcaccggttaattcctggtcaccaatcgattcaccattcgtgacagtgtgtcaatgacagagactaaccgtgctcagaaggagaccaggtgaagaaccagtagacatcagtatcgttgcaggggatcacgccgagacgaaagccatggccgaagaacatcttgaacttgggatcgaagccgtggccgccagggtaacacgcgaggcctctcgtagccaagcgccccgagtaggacggctttgcgagccccagccattttgccaccacggaattgaccccgtcgcaaccgatcactacctgcatccgcgccattaacaattcaagaattctcagttcgcaatctttgggattcactgtgttttttcttcttctacctttgctcggagaattgcgccgtcggctaggtgtaggatcttggcgtcgccgtcctcttcgatttcaacgatcttggaggagtagcggatggtgccttctggtagctcttcctccagtgctcgcagtagccagtcccgcctgacgcagagcatttcgttgggtcctctgcatctaagccaacaatcatgtaagcgttgtctagaatgaacggtgtatataatcagtagagatcagtccgagcatgccatctcaccgtttcccctgctcattgagagacgttgcatgtgccatctctccggtgaacgaagagaagacatgcaacctgtgatgtgaaaaattaaggtctaagatatggagatggaaatttgcctccagagaatacaacctcctttcttgcatttcacgtaacaatttaatatgatatattaatatgtgatatgtcattgtataaacatgcaggttagaattcgatctctaaaaatatttataaataaataaaaatataacttgtacgtgtaaattcacggtcatatttgtctttttacaatatgtaggagctaaatttaaacatacatatttgtgaaatagaaaataaggaatactcaaagaagtttgagaccatctagcagaacacaacacgagattaatttaaaataaaatataataattttaaattagaaaaatataaatatgtgagttcaagtatcaatacaattttgaaataactgtaatccggaataataagaaatagtgaaaacagatcaatattgaacactatacaagactaactaaaatcggaaaaaaaatgaaaacaaaattagaaatttaaaaaaaagttcaactaggaacacgatttataaataacaaaaatttggagtaaaaaataaataatattgaaaaaacattctatctataacacaacagtgacaatgatgataaaagagaacaacatgcgagccgtaaagaggaagagtggtgacggttaatgggaaattaaaaaacaatatctaactaatgattaggttcagtaggggagaggcgacgggaaggtcgtataagagtagtgttgtgctggttgacgggactattagaaagtaaaaaaagaaacctaataataataatcatgtttaatttctaaaatctcaatgacaagaacatcgggcatgccgtgaaggagtctagtgacggcatttgaggggacttccaaaaaaatatgggcttgttcagattgtagccaaaataaaccttaccaagttttggcaatgtcaaaattttggtaaagtggtaatattgctaaaattttatagcaggatttcttatgtattgatcaaatttggcaacaaactaaatataaccattttttttggcaactttaccgaaaaatggtatggttgaaaatagcatcaatagatagacaaagaagtgaaagtcggtggtgggtgtgacttttaaaacatataaaaataaaaaaacaatgatgataagatttattttaaaaatcttaaaacaacgagattattatttagcaaattttaaataaattagataattttaaatgagtgctagccgtgtgtttacgcagactaccagctagttctaatgatatgtaataattttctcgtcaaagatatatcttcatgcagtgttttaaaccaggtgcgttgtacttactcctgaagatgcagatgacacttcctgatcttgtcgcctaccccaagggcgtcaagcgcttgcaacgcattcctccacgtcgcgatggcgaaccccgacgccctgagctccggcgacgactctagcaccgtgcacttcacccctttcctgcatgcggatcaatcaagcaagcaagcagatgatatcagctcagctcaagttaacatgcagctgccaacacggcgacacatacagaaagccaacacattctcagggggctcagggggtgtttgggagagaggggctaaactctcaaaaacataagtccctctggttttgtgagaggggctaaaatataacaccccctcagtttcccacctgtgcagcccgagagccacggcgagtccggcgattccggctcccacgatgacaacggcatcctctccggctctctttcgttgcaatatagttgatgccattctactagctagtagatggtgcaggctaactgggggtcactgttttataaacaaaccaagttcacataggccgtgtctagatgttttggcaaaaaaaaaaaagtttgacgtatacggacacacatttaaagcattaaacgtaaactaataataaaacaaattacagattccgcatataaactgcgagacgaatctattaagcctaactaatccatcattagtaaatatttactgtaacaccacattgtcaaatcatagcgtaattaagcttaaaatattcgtctcatgatttacatgtaaattgtgcaattggtttttttattcatatttaatgctccatacatgtgtccaaacatttgatgtaaaaaaaattaaaagtttgaaggtaaataaagacagtcgtactagtcagcttctgtaggctagctgtagccacaagcttcttacacctcacgtttttttagccgcacctcacgtttttctagccacaaaagtccttattgatccacgtggctacagcctacgggctgcatcaatcaagttcgtactcctcctagtattccctcgaaaataaaccaaactcttacaacaatataacacattctaggacgattagtttattttagaatagacggactctctctccatcccataaaaaaccaatataatactgaatgtaacatatattagtattacgaatttggacatatctctgtttaaatttgttgtactgaatatgtcacatttaattttagactcggtttttatgggatagaggaagtaggtgcttaggccctcgagtctgtgattaatgggcaaatcatactcactccatccaaaaaaaaggcaaaccgtggattcccgtgctaacgtttgactgtctgtcttatatgaaatttttttataattagtattttcattgttgttagatgataaaatatgattaatactttatgcgtgacttatctttttaatttttttcataattttttcaaataagatgaacggtcaaatattggacacggaaacaagggtttgtctttttttaaggcggagggagtatgccatacctagcttgacaattgatacccctgacactgattgaagcattgtgtggctgctgtactctagaaaattgatattttgccattatcgaaacggttcgctggagtgccacttacaaaagtggtctcgttaaaatgccacctttgaacagggataacatgttgcaatgccatttcatccatttcttcttagtttaatgatttttgtaatattttttcttgctgagatgaccaaaataccttgatcctatctcatgtctcctccatctcttcctactctccgttgcagatggtgggcggcttggtggtgcggctggggatggggacggcggccccccccctggggactgggacggggacgaccccgacgtgggtgtggaaggctgcttggctcggcggcgctgctggggacggcgtacctacgccgcgcgggcgcggctgccgcccatggaccccgcgctcaacaccgacactaactgcatccggggatgcgtctcccaggtctgggtccacgccgcgccgaaggagggcgcgccggacagggtcagcttccaggccgactctgacgcgcagctcaccaagggcctcgccgcgctgttcgtgctcggcctcttcgacgcgccggcgcgggatgtcgccatggtgcccgtcgagttcatcgagttgcttgggatcaggcagagcctctcgccgtctaggaacagcggcctgctcaacatgattagcctcatgaagcacaaggtgctggagatcaccatcggtgaggtaaccactgaggaaattggtcgccaagatgtggtccaagaggttgccgaaccgcctgctgctgtcaccgtccccatgcccagccgagccgccgccgccatccccgtccccagccgcgccggcgccacccaccattggcaatggagaggagtaagagatatatagggagagatgagataggatccaatgctattttggtcactcagcaataaaaaaacattaaaaaatcattaatttgagaagaaatggatgaaatgacattgtaatatgttgctcctgtttgagggtggttttttaacgaaaccacttttgaaagtggcattccagcgaaatccagtttttgaccatggtaaaatatcaattttctcgctgtactcgctgtcccctgctgtaaggtctcaaatgacgcttcctagaatttcccatgttctctccgtctcaacgtgtggaattgaagtactagtataacggaattgagatattacggctgcctcgaaccacaaagcatctaggagtatatgttaagacagagagaacacatgaatatattttagacggagataacgcatgataaagtagaggagagaacacgataaagatatgacaaagatgtcctttatcttcttatttatttgttctcgtaattaatgaactttctgagtctcttttagatgcaggcaatcaggttatattaaagggataacgacgacaggaggtacaattcttcattctctgatgtatgcaaataacctaatcactgtgggtcaggcaaatgatggagaagctactagaatttttcaaactgttcaaacttgttgtgctcaatctgttcaaactcctaactgggggaattttctattttctttagctcaagcactcctaatcaacaaaaacatcaaattctcaatatttttcatgtccctctgatagaaaattccactaaacatcttggtcaccctttgattattaacacaagaactagagcttctgcttataagtttattatttccaaattcaaagctcgtcttacctctcttaaagctaacatgctctctcatgctagccacttgtctttaattaaatatgttttcgcttcaatccctatttactgtatgtccacgattttacattctaagagcttattgaacaagttgacagctattattagcgcggttttggtggacaagagtgcataatgaaggctctaagaaaggtatttcctggcggtcttggaatgatttttgcaaatgcatctcctaatactatttctcagctttgggatgacaggacatgttgggaactgagcaaactcaatcaaatatttgatcagccaatggtacaacatataatgaaagttcagatcgttcctcgggacaatgaagacaaaatttgctggattcataattcttcaggtgaatgtacttcaaagagtgcatacaagcaggtatataatctatcacattcagttttcacaattgttacttctttgcagcttaatattcttttgaaaatctgttccactaagtgcattcctcctaaatttaaaacttttatttggagacttaatagaaaggctcttccaactgttgccaatcttcacttaaaattctgtgacattcctgatatttgctcttgtttcaattcttcagaaaatgaggttcatcttttttttcactgttcttttgctagagtcacttggcatatttcagaaatcacttttgttaatcgcatcactgatttaatgtataatgtctctgatattttagcttacttgcttgtcacaaacaaatctgagaacatcctacaaaaaacttgtgtcatgcttaggtttatttggatagctaggaatgactttttttttttgccgggacggcaagaacaccggccgtagtatattaagaaagaatgaccagtattttaagaataaaaaaaagaccgcaaaaaaaagagttttatttgtatcctcaagattcagaacagtagttacttgacataacacttaggccttagctacattacagacctgcaaaggctcccattccttttggaactcttccaattaaagatgatattgctgctgcctctatcaaattgttgccaggaactagatgttatgtagatgcttcttggaaagataatctgtttgggtttggtatctttattcatgactctctaaatcatcaagctatttttgttcaagcaaaatcagatctttatgtgtcccttattcgggcagaactagcagctttttaagttagctattttcatttgtgttaaacttcacattgcaaatccagtttttctttcagataatcaacagttggtgtttcttctccagcaatcaaattacataaatcaaaatcatcattggagccttttaccgctgcttgcaataaagctgcgttaattttcaggtggtgcttcaatcaatactacatggattccaagagaaatgaacaaaatgattgattacttatctaggaaaaggccagagaatcaagggttgttttgcctatagcaagctgtcaaaaatattaatcatgtttgtaatagcaaatactagttccaccaaacaaatcctgctttttgcctcttgagcagctgaaaatgttgttagagtgcgcagcccggcccaccaaccgtgggccacccaggtcacattgggtctgctccaccacagacccaaccgaagccataactttaggtcctaggattacacaacccaaaagactagtctgatggggtgaggaccgccccaccttttaagtgggactaaacccagcaatctcccttgtcacacatcgggcccaacaatctccccgtcacattaacccatgtgacctcgaagacttgttacctggcctcaggcccaacaatctccctcgtcacattaaccccatgtgaccccgaaaacttgttacccgggctctccaccatgtgacccatggaaattgttccgggttccaaaccggagctagtcttttgggttgtgtaggctcaggacctaaagttgtggctccggttgggcctgtattggagcaggcccaatgtgatctgggtggcacatggtcggtggcccaggctgcgtactctaacaaatgtatcccttgtgcacgtgttgtgcttttaatgtttgatgtaacaagttctaaaagaaagaacatgataaagtacagggagaaggaatgagagataataaattattccttacacttcctccgtcccaaaatataatagattttatatggatgagacatatcttagtactataatttaaacaagtccagattcatagtactagaatgtgtttcctcatttcaaaatcccttatacgttgggacaaagggagtataagaggcactaggttcggcaatagcaaaaaaaagagaaaagttttctgttttttcgtgcgcacttttccaaactactaaataatgcattttttaaaaaatctagatgcgtgacccacacaattgtgtggctagcatctatacaaaattatctatttttaaaataattttacataaagtttattaattagatatctcgttgtcttaagattttgagaaaccaaaccttatctccccgaattaaatttgaaaatgtactattcatttgttttttctctcagaaatattcgggatgcaatttttttacacaaatatactatcgatctcgcagaaccattaagtgaaaaatgacgtgggtgtgacgacacagatagtgtcgtgcggtgacattgcgagaccgagctgtctcgcatatggaaatagcgagaccgacgtccatgtcgaacggctccaatttaatttgtgattaattacccaattaatgactaactaataataattagtgattaattattttaattagcaattaattaataaattgctaatcaggataattaattaatttgaagcggccaacctgttcggtctcgctcgctggtaatgcgagatcgagcggtcttgcaccgtcactgcgtgacacagcgcgatctcgcgccgtccgtgccgtcatgcccatattattttcaaccaacggttatacgagataacggtatatttctatcaaataaattgcataaggaatatttttgagggaaaaaaaaggttaatgaatagtatattttcaaagttagttcttaaccttcctgtgtttctaattttatagtttttaaaaatcgtacctattgctacccttactcctatcgctcccttcgttatttgctcgatctaccattgtttttatttatttttatggaacctttaaaaattaaatcttatagtttttaaggtttattatctcattagtttttatttttataatttttataagtcccgtcaaacaacgatacctttgtatactcctctaatgataatacaataatagtgtattgcgagtagagagtatagagaccactgtaaaaggttcccagtgcataaggccaataaccattcacattttagagcttgccacagtaatagtccgccattttcagaagctttctcaccagcgctctggccaaccaattgtcacgcagaaagctgatgaccgcattgctgctctcctgcatgaagccaaccacgtaggctgtcccgatgagctcggcgctcctccaccgccggatcctcgcgtactcacgcagacccgcctcgatcctctcgctctccgcaccgccgccgccgccgccgaggatggcgtcgccgaggcatctcgccagcacgacgccgtcctccagcgccgcgcagccgccctgccccaggtcgggcgtcatcgggtgcagcgcgtcgccggcgacgcacacgttccccttgcggatgctcgccagcagcagcgagagcggcggccggaaacgcagcggcgcggtgagcacgtgcttcgcgtcgctcctctcgatgacctccatcacctcggctgggatctcggcgctcctcagcttggtcagcacgaactgcttcttcttggctagagcatcgtcatctagagcagcaacgcaccgatcaattgctgatcactaatcgattcactgttcgtgacactgtgtcaatgccagagactaaccgtgctcagaaggagaccaggtgaagaaccagtagacatcagtatcgttgcaggggatcacgccgatgttgattaatttcagctgtggcccaatgcaagccgattctctcggagctgaacgggaggatgaattagtctagcaggagtttgttagagatgcaaataagtcgcaaatcagttaatcgtgaccgagtctagcgctggcagtggcgcgggtgtgtgcatggagttcagagaaaagcggatcgtgggatggcgcgattttgcctcggattcctattttttttgcgttgagtataagtagttctcttagctctttattctttttgtaaggtttacattcagttgaatgagaaaaacccagaaaaaaattgccccatacattctcgcaagaattctttctctgaaacttctcctctgctctgtttgctgctctgttcgttgttgccgctgcagttcttgccgtgccgggcgtgaacagtctgccagcaaggtgtttgatcggagtttttttgctattgccaacaagtggtatcagagcactcaggttgagggctgatctgacaccatggcgttggttccggcgggagcgggagcggatccggcgagggggagctcggggagtgctttctcctacccacaactcacggcaacgaactacaccagctggtgcattcgggttcaggcgatgatggaggaccagggtgtctgggacgccatcgagccggcggccggggtggccgtcgacccaagaagggacaagaaggcgaggtcccatctgttgcagtcccagccggaggacttgctgatgcaggtggcgaagaagagatcggcgaaggaagtgtgggattgcttgaagacaaggttcgtgggcgcggaccgcgttcgcgaagcgcgcttgcagacgttgaagggtgaatttggtgccatggtgatggagccaggggaaactctggatcagtacgcgggccgcatcaccgcgatgagcgtgcgtcactcggcgttgggctcgacgctgggtgattccgcgatggtgaagaagctgttcgacacggtgccggaaaaattcgtcagcctcgtcgcaggtattgagcaattttatgacattgatactatgccatttgaggaggcagtgggtcgactgaaggcctacgaggagcgcatgcggaagaagaaggctgccgccggcggggtcaccaccgacgggcaggtgctcctcactcaagcggagtgggaagctcacttcaagaagaacggcggggaatcctcgccaccacagaagaacaaaccttcaggtgaaggtgctgggcgcggccagggcggtcgcggtcgcggcagaggccgtggcgcaggcggacgcggcgggacgccgcggggcgactcaggtgcaggctctggcggcggtggccgtgacaagagtcacatcaagtgcttcaattgcgaggagtacgggcactactctaaccaatgcccacatccgaagaagaagaagggagaagcacatcttgcacagacggaggacgccgggcctgccctgttgcttgcggtgacggaggatgtgccagagcgcgcgtcgtgcggcttggtcgtacgcgagcagcgcgtgtggcccaagctgctgctggcagacgctggtggacatgctggcgatgtctggttcctggacaacggggccagcaaccacatgaccggcgatcgaagcaaattccgggagctggacgagtcgatcaccggacgggtgaagttcggcgacgcttccacagtgcagatcaaggggaaggggtcgattcttttttcatgcaagaacgatgatcaatggctgctacaggacgtctactacatccccagtctgcaatgtaacatggtgagtttgggccaactaacagagaccgggcatcgcgtggtcatggatgaggatgtactcgaagtgttcgacaaaagtccatggcggctggtgatgaaggtgaggcgcactgtaaatcgtctttaccgaattgagttgaagctggcgcatcccgtgtccctgctgtccagcctcgacgacccggcttggctgtggcatgcgcggctgggacacgtaaattttcaagcaatgaaactgctggtggacaaggagatggcgggggtgttccggcaatcgtccacccgaatcagctgtgccaatcttgcctggtggcgaaacaggccagggcgccgttcccggcggcggcgcacttcagggcggaggagccgctcgagctgctgcacatagatctgtgcggcccgattacaccgaatacgatgtctggtaatcgctattgggnnnnnnnnnnnnnnnnnnnnnnnnnnnnnnnnnnnnnnnnnnnnnnnnnnnn

SEQ ID NO: 37374 - DNA, 3077 bp, Oryza sativa
agctgccggccaacctgcgtgggaagaagcaatgcagagggagatggaggcaatcgagaagaacaaaacgtgggagttggccatgttgccagccgggcaccgagcgattgggctgaaatgggtgtataagctcaagaagaacacggcaggggagataatcaagcacaaggcacggttggttgcaaaaggatatgtgcagaaacaaggggtcgattttgaagaggtgtttgctccggtagcgaggcttgataccgttcgtgttgtgcttgcagtggcggctgatcgccgctggcaggttcatcatcttgatgtcaaatcggcattccttaatggtgaacttgaagaagaggtgtatgttgcacaaccggaagggtttgctagatcaggaaaagagcatcttgtgctcaagctgcataaggcattgtatggactccggcaggcaccgcgagcctggaatatacgcctggacagaagcttgagggagctcggctttgatcggtgtacgcaggagcaggcagtatacacccgaggcagaggaagtgatggcataattgtcggcgtttacgttgatgatctcattgtcaccggagaaaatccctctgaattgaaggttttcaaggaacaaatgatgggggagtttgagatgagtgatctcggtttgctcacatattatctcgggatagaggttgatcaggatgagagtgctaccacattgaaacagactgcatatgccaagaaattactgtctcagtttgggatgatggagtgcaactcagtttcaattccaatcgatccgagatcgcagctgagcaaggatccagaaggtcacccggtggatgcaactgagtatcggcggatcatcggtagtcttcggtatttgcttcacacgaggccggatctgtcatatgctgtcggggtggcaagcaggttcatggagaggccaaccgtgatgcatttcaaggctgtgaagcaaattctcagatacatcaagggaacgatggattatggtctcgtgtatgctgcaggcactggggcactgaagattacagggtatactgacagtgacctcgccggggacttggatgatcggcgcagcactggtggaatggcgttctacatcaatcagagtctggtggcgtggagctcgcaaaagcagaaaactgtggcactatcgtcgtgtgaagccgagttcatggcagccacgacggcggcctgtcaagcgctctggttaagattgttgctagcagaagtggcgggagtggaggagaaagcagtgaagctcttcgtcgacaataggtcagcaattgcattgatgaagaacccggtgtttcatgggagaagtaagcatattgacacccgttatcacttcatacgggagtgtgtggatggcgggcaaattgttgtggagttcgtccggactgaggagcagcgagcggatgcactgacgaaaggattgccggcggcgaagctggtgacggcgagacaccttcttggtgttcgttcactagggtcacggcagaattaagggggagattgttgattaatttcagctgtggcccaatgcaagccgattctctcggagctgaacgggaggatgaattagtctagcaggagtttgttagagatgcaaataagtcgcgaatcagttaatcgtgaccgagtctagcgctggcagtggcgcgggtgtgtgcatggagttcagagaaaagcggatcgtgggatggcgcgattttgcctcggattcctatttttttttgcgttgagtataagtagttctcttagctctttattctttttgtaaggtttacattcagttgaatgagaaaaacccagaaaaaattgccccataaattctcgcaagaattctttctctgaaacttctcctctgctctgtttgctgctctgttcgttgttgccgctgcagttcttgccgtgccgggcgtgaacagtctgccagcaaggtgtttgatcggaatttttttgctattgccaacagccgagacgaaagccatggccgaagaacatcttgaacttgggatcgaagccgtggccgccagggtaacacgcgaggcctctcgtagccaagcgccccgagtaggacggctttgggagccccagccatttcgccaccacggaattcaccccgtcgcagccgatcagcacctgcatgcgtccccgccattaacaattcaagcatcccgggtaatacttttaatctccaagatagatatatataagctgtaacaaaaataacaaatcaaactctcattagtatacatatattcacagttaaatttgttgtttttgttacttccttcgtttcacaatgtaagtcattctagcattttccacattcatattaatgttaatgaatctagacagatatatatgtctagattcattgacatcaatatgaatgtgagaaatgctagaatgacttacattatgaaacggagggagtagaacttataaaagttgaattttaacttgcatttttgtggatatatcatctatcttgtaaattttttttaatttttttcatgatcattcagttgacatgcactaaacgagtggacatccgctcgagtgattagaatccatcttatcccccgttcatataatcttttggattcactgtgaaacacttttagcaacttaggtagatatccatccatttattgcatgtcaactaaatagttataaataataattaaaacaacttgataatattaaaatatatcactctactaacagacaagttcaaaatcaacttttacaagttataacaaaaataacaaatgaaactctacatagtgtacgtatatttcacagtaaaattgctacatcttataaaagttgaatttaaaattaaatatgtttatgaactgatatattacatatcaatctatttatcagtttttctaaaaaaaattataattattttgttgatatgcaataaacgagtagacattcaccgagtgattagaatccatctaccgatgtacggattcactctgttctttttctacctttgctctgagaattgcgccctcggctaggtgtaggatcttggcgtc

SEQ ID NO: 37375 - DNA, 683 bp, Oryza sativa
cctagtaggaatgagaacttgggaagcgcgagcatttccgacgaaatcagcctctccaaccattcacatagctaattcctctcctgatttggctatttggtaagccagactcgcagttttttcatctacacttttcatttgggtctataacagtgagacctatgtatcaatccatcacttttttttttcggaaatccatcactttatttctctccttctccttcctcccacgtcccaaccactactccgtacctccatcctcaatgcaatatcctcccaagtgccaaccactaatctattcctccatcctcaatcctccaccctcggtagtagtggtgggagggcgaggacgacggcaacattaagcaagccgctacacttgcgtagagtgggtaggcgatggaggaagctagagttgaggatgaagatgtgtaagagggcagggagatgtatagataaatggccaataaattcaaaatcaatatttgtttagtagtaaaaagtaggccacaatggtgataaagctattagcgcatgattttatccattaaagctcaaatcctactgctgatttgcatgtattcctagagaagttgtaaagcctatatacttccattatcttaaaaataataataataataataataataataataataataataataataataaacaacgtt

SEQ ID NO: 37376 - DNA, 2648 bp, Oryza sativa
  unsure (1)..(2648): unsure at all n locations
nnnnnnnnnnnnnnnnnnnnnnnnnnnnnnnnnnnnnnctaatgccaacatttacttgattgatcaccgtgttttaccatagtttttgctctgaagctacgtggcaagaaaggacagtactgtatctctgtcacgtatgagccgtggccgcatagaaactcgaacattgtgacaaggtagtactgtacaaacttgagttgtggagtaccaaacagtatctggtcggtgacatccaaccaaacagctgttgatcctatctaaggcaagtagtactgtactagtactaaagtccagtacactggctacgtaggagtacacagcagcaaaggcaccagcaaaatctacgcgatgacgccacgtgacatgacatcgcaggtgaccgtagccaaagccaaagcaccagccgcggcaggcaggctggctttgctggtgggaaattaccggccactgaaaggaaacttgcgcccgacgcgtacacggatccgcacggcgggcgggcgagcggactgacagggtggccccacccaccccaccgcggcgtctacggtttctttctctttctctctctttttttttcttcttcgtctccgtcgcctagtcggcttcgcctccgcttcctcgtctcgtctccctccccctatttatccccgcccacccagcgccgccattttattcgcttcgtcagaactcaaaatctcaaattccagacttccagaggcgagcacaggaggaggttggaaaaatccatccatgggggatgagaaggctgctccgaaggcgggcgccaccgccgacccggtggtgctgaggatggagttgcattgcgccggctgcgcgcagaaggtcaagaagtccatcaagcacttggccggtacgcatctcggtctcgattattcgccgctgccgcctctcgtttctttctcttttttctttttgagccttttttggggggttcgatttggtgtctgggtgtctgaatttttgggttgtctctgggatcgcaggggtggagtcggtggcggcggacgtggcgacgaacacggtcgtcgtggcggggacggccgaagcggccgcgctcaaggcgaggatcgaggcgaagaccaagaagcccgtcgaggttgtctccgccggcggcggtggcgccgccgccaagaaacccgccgccgagcccaaggccgtcaaggacgatggcggcgagaagaaggacgcccaggcgaaagaggagaaggggaagaagcaaccgccagaggagaagaaacccaaagaggtcggtacacaagaggcaaccctaccaacgccatacgcatacgcttctctgctcctcccaactactcgtttgacctgagaactcaaaatgtctctctgctttgttgttacaggaaacggtgctgctcaggattcgcctccactgcgatggctgcgccgaccgcatcaggcgacgcatctacaagatcaaaggtgaggattttatttttttaattaatctttcctctgtcagtttttgtactactctcgttctgctgtttgttttgttgctttggctccaaaactgacgccttctggcttttgctatgtgtcaggggtgaaggaagtggtaatggacggcaatgccaaggatgaggtgaaggtgtcgggcacaatggacgtgccggccatgctgacctatctcaccgagaagctcaaccgcgccgtggaggccgtggcgcccggcagcaagaaagacgagaagaagaaggacaagggcggtgacgccgacggcggcgagaagaagaaagacgccgccggcggcgacaagaaggacaaaggcaagagcatcgaggtcgccggcccgtccaccgccgccgccgcggcgtccatggcgccggcgccggccgaggcgagcacgtaccacgtctcgccgtacggccacggctacttcgcgtacccgcagcagcagggacctccccccagctactaccagtactacggcggcggcaatggcgacggcgtgggctacgccaaccccaatgccggcggcgccggcggctactaccacccccaccccaacgacgtccctacctaccagccgccgccgtcgtacccgccgtacccctaccagctcgacatgtcgccggcgccgcagctgttcagcgacgagaaccccaacgcctgctcggtgatgtgatcgccatgtctccggcgacagagctcagaggccaatctgacgacatgtacataccgaggactttagacttagaagatcagaggcatccaccaaacgtgttgttatgctttcgatcaatttttgtccaaacttaccccttctgttgtagcgtcattttttttagatcaattcttgactggttaagcgaaatttgattttaactagagtattagcggatgaaatggactgatggagtgatgatcttttggtcgcaaaatgcgtgcctagtcagagatgttggttgaatcgtggactagttctgtcttggtcgcgttgcttttcatcaaagacgtggtgtttaaccaggcgattgtaaattaaaatatatgattaaatcttcgttggtcttgtgctgttcgtgaggggcaaagaaaagtttcctcaaacgcggagtagtttaattttctttcaaacgattcgtggcggcaaaattgatctcgttctt

SEQ ID NO: 37377 - DNA, 1811 bp, Oryza sativa
tcagaggcatccaccaaacgtgttgttatgctttcgatcaatttttgtccaaacttaccccttctgttgtagcgtcattttttttagatcaattcttgactggttaagcgaaatttgattttaactagagtattagcggatgaaatggactgatggagtgatgatcttttggtcgcaaaatgcgtgcctagtcagagatgttggttgaatcgtggactagttctgtcttggtcgcgttgcttttcatcaaagacgtggtgtttaaccaggcgattgtaaattaaaatatatgattaaatcttcgttggtcttgtgctgttcgtgaggggcaaagaaaagtttcctcaaacgcggagtagtttaattttctttcaaacgattcgtggcggcaaaattgatctcgttcttccccgtccgacgtggcgccgacgaggacggatagctacgtcggtgattcggattcggatattctcccagctctgtgtgtaagaagtcttctccgcgatattatttgatgttctctgtgtgctacctggttgcattgccgttgcgattaatcttcaaatttcagattattgcggcgattaatagttttataattgaagacacacatctttttcgatgtgaagctttggccatgcgtgtgcaggccgtcgttaccatcattcatatcccttttgacatttgagacagtaataaagggtcggtaaatccaaaaaccttttcgtctttactacgttaactctgattcgtagaccatttcagaacaactgcattttctgatctacctgcaacttgtgaaatccagaactatcacctcggcaatatttgtatacagcaattctagctctgtgatctacacatgttctgtgcaattttcacatgggaataagaaaaaaaataacaaaaatttcagcgttccagacagggagtcaacaatgttcatcaaggtcttcgttatccggaatgaaatgcccacgtccttttcgcccacattttgcaggtttggcgtgccacacggtcacctaccattgaagcaatccaaatcactaacacgcccatgtttgaagaacgcggcaattgataagagaataaagaaagcgattagactgcactagctttggaatatgaccgtattaagcatatttagactacgaacaattagtcccgggattggactacagggtcagaggggtatggtctctctccatggggacacgtgtcctgttcatgattgaaaccttcctggtgaattatccttaaatatcattttcttccactgtctaatctcacatggaaatcctaataatcattttgttcttatatatccgaaggttatccattccgatggcctctgctcttaattaatttgtgcagttcttttaatccctgatgctgttgcatcgttgatccgttgccaaatggaggaaacaaaacacacagcaaaactattttttttcatgctctgtttttgtcttcatacgtgtgcctgactaagaatattctcccaaatggcaattaaatatggcgttgattaactcaggcaacatgtcagaaaaacacggacttctgaaagctgaaacttggaaaatgttggactgcaattcaatttctggaagtagtggataacctaatcctgtacgaacaactgctggatatgaatctcttgtcggtgtgctgattttccattagttaattgaataattgagtcggtgttttctttaattatggtttggggcatgccgcattgccgccctgattacgcaaattgtttttatattttttgtctcgtgggtttacgaatcggaaga

SEQ ID NO: 37378 - DNA, 1143 bp, Oryza sativa
tatgggataccgctggacaagagaggtacacatacagcactatggttttagcttcttccaatcttgggataatggcatgctgttggtgcattagaagcattggttttgtgagaaagttctagtagtatgtgttactgatttttacaattgatccatcttacgtgccacacatgcatatggtttttctcaatcaagaactcattggtaccagccaattttaggtatgctgccttggcacctctttactacagaggagctgctgctgcagttgttgtctacgacataactagtccagaatcatttagcaaagcacaatactgggtgaaggtatgctatcgccaaattatctgcttttctgatgtctggttgattgattactctttctatcttttactatgagtttgtattttttgcccgaaactgttctagtaaaattttatatcatactgtaagattgctgctaaaatattataaatgtgttgaagcttatgctcaaagattaccctgactagcgtgagaagtgtatataatatgaacacttgcatttaatcttaaaatgcaccttctagatttatttcatcaatatcaattgattcagtgagattgtaccatgtcgactattgtgaagtatgttatgtttccacttcttttttcaggtatgaagcactttcagattgttttttcttatattgcaggaacttcaaaaacatggtagtcctgatattatcatggttttggttggtaataaagctgatctacatgaaaatcgacatgtatcttctcaggtcagatcttgtgtgaagttgtagtaaacatagtatcacaatatgctgcaaaattgttttgacgatatggtgcacattctgaaggaagcacaagagtatgcagagaagaataatatggttttcatcgagacatcagcaaagacagctgataatataaaccaagtatttgaggtatgccccctagcatatgaagctatttgctttcacgatgtccaagaagcaggatagctaacaagagaacatgctattttatttcaaattaatcaagctgaacaaaaacaccaaagcttcaaattcatggaaatcctaactgtttcacccacccccttacgtgtaagcattgaatggacagctactg

SEQ ID NO: 37379 - DNA, 13124 bp, Oryza sativa
ctattgtgaagtatgttatgtttccacttcttttttcaggtatgaagcactttcagattgttttttcttatattgcaggaacttcaaaaacatggtagtcctgatattatcatggttttggttggtaataaagctgatctacatgaaaatcgacatgtatcttctcaggtcagatcttgtgtgaagttgtagtaaacatagtatcacaatatgctgcaaaattgttttgacgatatggtgcacattctgaaggaagcacaagagtatgcagagaagaataatatggttttcatcgagacatcagcaaagacagctgataatataaaccaagtatttgaggtatgccccctagcatatgaagctatttgctttcacgatgtccaagaagcaggatagctaacaagagaacatgctattttatttcaaattaatcaagctgaacaaaaacaccaaagcttcaaattcatggaaatcctaactgtttcacccacccccttacgtgtaagcattgaatggacagctactgcgttaggccatcaatggtcatcatcatactaactcgttatggtatgatatttttccattaacaggtcaccgtttttgcattattaattaaaaacagaaagattcctgagttagttagaagaggtttggggtatggaagaacagctctaacctcatattaaactctcactaagtcactagcacatatatgtgtggataaacaatctcagcacaagaatcagtgattttctctgatctcgcctaaggatcaccacagatagggacagcctaatgtgggcattttaacaacaaagttcaactctacacagcctacgccctacggataaacacttcgttgcattttcatcagtcaggttcctggacattgtccacatgcactgtcaccttcatgttcttttcctattgatgtttttatcctcttatgtttaaatcttttgctacactacatagctgggaaaagaaactttgtgaacgtcgtcctcataacttgatcatgttccttgtacaggaaattgcgaagaggttgcccaggccaacggcgtcttgataattagcttcggtgtttgttgaagtggaacacatacaagctggtaatgtgcatgtaacatgtctgtcagggcaaaaactgctgtatggtcgattgtttggaaaacaaaggatactgtacagtttatcccattgtgttcaatcgtatcgtattgtatatgttaatagtgccgtcgtgtaacatcttagtttactaaaacaatctaatatcggtactaaaaaaagttgcttagttgctgtgcctgtgtacacccaccacaccgaagtttcatctaaacaagtactccgtgtacaattgcagatggctaacctcaaacagacagaaacttttgccttttacgctctacaatttgtgcagtataatgaattaatgccacgatcgcatacgaacacgggacactttccttacaatcgaaggcagcaaaagatgcgaaacttctcttccgagccgaacacatgctcctattcctgcacgagcaggcacaagtgaacaacaactacctgatacactgacatgtcgggcccacactctctcaactcggcacggggccccctccatcttccgggacccacctcatccgaactctatgtcgcgtgggccacgggcctcgtgggacccacatgtcatggacctccggggactcccgaaccgagcccaacccgtaggacggtaggaggtcgaatcccaaaccccttcggcaagaaaggagctatttaaggtagactaatcccctcgtcttcccccacaatcacttctccccccggaatatctccgccaagagaagagaagagacacccaacaacccaaaacctagcgcctctgcgctcgaggcccccccgaatccgcgaatccgccgactcccatggcgagccagggagagccctcctcctcctccgatccgtaagtttccccccttcctgatctagccttttcgatctggtagattatcgaatttttgcgatttttttgcgatttttttgggtgattttaatgttcgtggggtggtggtggtgttgtgagcaggaaggggaagaaggatttctcgacggcgatcctcgagaggaagaagtcgccgaaccggctggtggtcgacgaggccaccaacgatgataactccgtcatcgggatgcaccccgacaccatggagaagctccagcttttccgcggcgacactgtgctgctcaaggtttggggatccttgcctctgtaattcttctgttaagcttcaattgcgagggtttgaaggcctaatctgtggtgcttgtcctggatagtaggaactgatggtctgaattgtgaatatgtatgaaaaaagaacttagctttcttgtctctaagcttaggtttgtgtgtctactgttttgtagaggataaattattagtgaggttgaatgtttgctactttctagtttttgcccctgatgttagccttggtgtagattatttattcagattacatatggttagattatatgtattcatgactcatgactctttagcttccttagtactaggttgttacagtaattatgctgtgataagtgatcctctaatttgattgggtacagcttacaatctgtaattatgtcaagattattgcagttaacttctaaactgtgatggctattcactaggtagcttcacaacagtacttatttagttttataatgccatgaggtcgggaacttgggattctgttttgcattgtatgataattcttgtgtcatcaaggcatattttattatttgctgctgacattttggctcactgcatcacagggtaagaagagaaaagacaccatctgcattgttcttgctgatgacacctgcgaggagccgaagatcagaatgaacaaggttgtcaggaagaacctgagagtacgacttggtgatgtcgtgtctgttcatcaatgcccagatgtcaaatacggcaagcgtgtgcacatacttccaattgatgatactgttgagggcatcaccggaaacttgtttgatgccttcctgaaacgtaagatttctttatcactgaagtattttgatttttctcttatagaaggttctagatagagaattttagagctttgctgccatgttctaaaacagtattagccatttcatttgaacttgcttgtttgatacttaattatgtcgaggaaagtttttgtggctcctaatttccatgaactgtagtacctatattacgatgtacattataacattaactacattgttgctaatattatggcaaatattcaaccttgatatgtttaaacgtgctcttgcaacctctagtgtcgccttcttacatcctgctgatactgtttttatttgtaacttttcagcgtacttccttgaagcataccgtcctttgaggaaaggagaccttttccttgttaggggtgggatgagaagtgttgaattcaaagttatagagactgaccctgcagagtactgcattgttgcacctgatacggagatattctgtgatggtgagcctattaagagggaggatgaggaaagacttgatgaagttggttacgatgatgttggtggagttaggaagcagatggcccaaatcagagaacttgttgagctcccattgcgccatccccaacttttcaagtctattggtgtgaagcctccaaagggcatactgctttatggaccccctggctctggaaagaccctcattgctagagctgttgctaatgaaacaggtgctttcttctttctgattaatggcccggagattatgtcaaagctagcaggagaaagtgagagtaatctcaggaaggcatttgaagaagctgagaagaatgcaccatcaatcattttcatcgatgagatagactccatagcaccaaagagagagaagacccatggagaagttgagaggcgcatcgtttcacagctgttgactcttatggatgggctcaaagctcgttcccatgtcattgtcatgggtgctacaaaccggccaaacagtattgatcctgctctcaaaaggtttggtaggttcgatcgggagattgacattggtgttcctgatgaagttgggcggcttgaagttcttcggattcacaccaaaaacatgaagctggctgaagatgtgagttatcaccactacagtctagatgcaaaatattctttattggttgcatttttttttaatagttattacattgttgtcgcaggttgacctggaacacattgccaaagacactcatgggtatgtgggtgctgatcttgctgctctttgcactgaggctgctctccaatgcatccgtgagaagatggatattatagatcttgaggatgagaccatagatgctgagatacttaactcgatggctgttacaaatgatcacttcaagactgcactagggacaagcaacccgtctgctctccgtgaaactgtgagtatttttagtatgatctatttgcacattaccaggatctattcccatttgtttccgaggcttacatctagctttccttttaaattcaggttgttgaagttccaaatgtctcttgggaggatattggtggactggagaatgtcaaacgggagctgcaggaggtacttattgctcttttctttcctcacttatgagttcttatttgtggttaacatactttaaaaccttgcagactgtccaatatccagtggagcatcctgagaaatttgagaagtttggcatgtctccgtccaaaggtgttctgttctatggccctcctggctgtggtaagactttgttggccaaggcaattgctaacgagtgccaggctaacttcattagtgtcaagggacctgagctgcttaccatgtggtttggtgagagtgaggccaatgtgcgtgagatttttgacaaggctaggcagtcagctccttgtgtcctcttctttgatgagcttgactcaattgctacccaggttagttatctcttctgaacaaacgatttccatggttttttcatgataatctttatggctgattactttcaaccatatttcagagaggaagcagtgttggtgatgccggaggtgctgctgatagagtgctgaaccagttgttgactgagatggacggcatgaacgcgaagaaaaccgtgttcattattggtgctactaacaggccagatatcattgaccctgccttgctaaggccagggcgtcttgatcagcttatctacattcctctgcctgatgatcaatctaggctgcagatcttcaaagcttgcctccggaagtcacctgtggccaaggatgtagacctgaatgctcttgccaaatacacccaaggtttcagtggtgctgatattacagaaatctgccagcgtgcatgcaaatacgccatcagagagaacattgaaaaggtaacataaatatcttcaatattatttagttattaattccaaacatacttctggcttatgcttgcgtgctaacggagacttgattttgatttcaggacatcgagatggagaagcggaggaaggacaaccctgaagccatggaggaggacgaggttgatgatattgctgagatcaaggcggctcacttcgaggagtcgatgaagtacgcacgccggagtgtgagtgacgccgacatccgcaagtaccaggccttcgcccagactctgcagcagtctcgtgggttcggcaccgagtttaggttcgctgaccagccagcgtctggcgccggcgccgccgctgaccccttcgcatccgctgccgccgcagctgacgatgatgatttatatagttagatcgctgtgctatttatatttaacctccgtgcttttgttcagtatgtctatttcgctttggtaaactttatcatatgtaacatacggggaaacagtgtactatttttaagttaatattttgagaggtactgaaccgaattgcatgtttctgtatggatgtgtcgtggatgagcatggttgcgggttgtattcatcgattggagcatggatagatttgcgttgtatgtttgtgaggtttatagatgctcctgcaaggctggaacttgttgaagtttgtttttatagtgttaatccgaggcttcatttggtcggcgagacaccaaccgacaaaaaaaaacaaaggtcagagggcagacataagttgacataagagattactccgtttcttgataattgataatttcggcgttgacaactaattgcttttgaattgttgagaccaaattgaaaatattttgaacgtaccacacatctataacattaccattttgtactgtttgaaaatattcaacaaatatatgaaacggatacaaatagtccgatcaaaactatttgtaatgcgtagatttgtccctaaaagtacttaaataatatcacagattcattggaattctaaaaattctcaaatcttctctcgcattctctcctctttacctcctacgtaaagaaacatcatttactcccacttcatccatcaatactgtcggaaccagaaaagcatgcataacacggtgatgccatctaattaatactctctccggaccgataatacttgtcattttagataagggtgaggtccaactttaaaatctttgattatgaatcatttttaaaatcattatctttcaaatatggtgattacatgtatagattagtcttaaaaagtattttaataaaatcatatatttgttaacacttttatatatattataatagaaaataatggtcaaagttattttttggagaccgtgttcttgtctaaaacgataaatattattaacccggagggagtacgtaggattgagcaaatgcacattctgctattacatctaaaagatttggcgcaacgcgcgttttgattttacactcgatatgccaaaattctgtcgtgctcatgtagacacaatatgagcacgccgatatatcgtttgtatgctacgacaaaaaaaaaactactttgcctcgcccacaaagctcagctctcaccggatgttcttcgctttttctttttccttttttcagccccatctgacctatccgatcgtcttgattgttcctgcctgatctccatcagcttcgctcttgcatctcggaagggagcatctgatctcatggccaacaattcctagcagaagagggatttcacatcaaagttaagaactagtagcaagagtttttgatggaaaaggagtttttgatggaaaaggcggaatcttacttttatatgatccattgcagcaaggttgaaacctatagcatccttgcattcctaaaggatgaacatcacataaatacattaccaggttgctgcgaaaggtataacgggagataacaaaagtaaccaaaagttacctttactctactgtaaagaatgcctttcagttctgtaagtatcgatcttgcagatggtgtcgtagttaattggctgtggtgtgtttgaagcagcactaggcaaaccctacaaacaagctcaacctgcagcgtacaacagacatcaggatttgtgcagatgagggtatggaacaattaggtcaatataaaatagagtaacacaaacgtgtggaactgaattaatcaacaaaatccatgaagccaccagtgatgacccaatatctctgtaattttttaatgtaaacagtagcttaaacaacttccatgaatcagcgtaaacctagccattatggactacacatttttttacgtcctgggtattcatgcacataaaaaaactcacaattttgaacttgaagagagacagctagactgctagttatgaaatggcttgtgataggaatggtgcgattctagctgagaacaaagaaagtggtttctgacaaacaacactcgaaaactcgcagtaaaatgaactagaatggaatgtctattgcagtcataggattggaaactgagaaagttgacaggtaaattacatttatgacataactagtatagagagcaatgaagtactagcattttaccttcaaaggaaccatagaccactcctttaagtaagacatgatcttaagtgcatctgagaatggcaatgactgttgcagggaaaacataaatatataatcaaatgatgaatgattaatatacaaggatgaatctgtttagtggttttttaaatatgctaacgaacacaatcaatatgcttgacaatatggttatgtactaaaacaacaaggccagattgaacaaaatcaaagaattgtgttctatactaccccagtagggcatgacactttatggttccagaaagcctttcttacgtgtgcagtcttgttgaagttggaattcatcctatcagttgaattttgtttcctttgcaataggggcaatcatgggccactttggattgatgccaaaatgtgccatgccaatttttttggtagtttgaatagtaaatatgatggtttggtttgaagccaaatggatggtaatgcacatgcttaatttggtataattctaggactttcttcaccataacataaaatttggcttctaattggtatcaatccaaacacattacttagaactccaccctaccaaattattggtagtgccatatgcctagattttggcactaccaatgttttggtatggcactaaaccaaacaagccctatatcagtgagtttcatccatatcttccctaaaaaaaatctacaatataccactcacagcaaggttgccagatggccctgggcccacatgtcagtggggcatcggtggaatacgtggacattagatgatactcaatgcataaaatggatcaccacactacaaatattggctagtaatttactataacaacaaataattgatggtggcttttccctgaaagccgttctgtgagaaatacaggacaaaactaaaggaatgatgtcatccattagggaagataagggaaaaacttacaaggagagcctgttccaagtcatttggacgaacatttgaaactacattcaaaacataatccgatggtgactgcccttgcattataacattgggttgaaatgtagttccattcccattattttgtccttcctgaaattataataaatgtatagctgaagtaaatattccacttggtgagtcatcatttaacagcagtaacagaatagcaacaagggttgcacattatgtttttagtttcactttttaatacctggtgctgatcaaggcgttttacttcttcctcggcagtgtcaagtgcatcaataattgcatcagcagcagttactgtctctttggttttcctaccaggaacacctacagaaccctcatcaggagcaccatctttttgcccatacttgtggtccatagcactatctaaatcagcctcgaaagtttcctccaaccttttctcttgctcttcctgcatttatttttgtgggtttcagagctaagaaaaatctaagcaaagatagcaaacattcaataacaggattccattaaaacaatacaatcactgcatacctcaatgaagagttgttcttcagtacgatcccaacgccgaatagagcggtcatgagaacctgttacaataaaatcaccacgactgctgatggcaagacaccaaacttcagcatggtgtccttccagtgttaacaacaactcgaatttatcagcatcccagtactttacagtgcggtctttcccaacactgaacatataatgtgttttagaaacaaacttaacatccatcacactgcaaattgaacacgtgagaaaaaggtgtaaggattgtgccaacagtcaaatcacaaagaaaacaaaagggcaagaaataacctgtccgtgtgggcaaatatagacttatggcagtcaccaaaatccataccccaaattttcaaatttttgtctgcagaaccagtaactattagaactccatcggatgatatatccatgcagagaactggaagtttgtggccataaagggtaagggcaaacttcagtgagtccatagtgaagacctgcaaacacacagcacaagatgttgaggaaattgatgaaatcaaaaacttaattctagattgcatttttatttccatgtttgcaggatgccaactggcacctcaagatataaaaaaagttcagtacaagtgcttactgcgttaccaagtttgcaggatgccaagaaaatattaacaataatagctttgcccatataaactgactggcggaaaatagatatttgcttatgcttgtcctgttctaaattagaaaactaaaaattttatggacaaggaagtaaagaatcatgctctctatctatatacacaatacataatcataaaaataagccccaaatttgtgttcacataaaggtccccactaaaaagaatgtagttcattttctagagaagttcaaaaccatacaaaccttgactgcgccatccaagagagcaacagcaatatgattcccagttggactgatggttactgcaaggacatcgtcattcattttcaaagttttgacatttgttacgctcagctgcttagagtcctggaacaagatgagaaaacactaaagttattctaaaagcctatgcagacgatatttatgatgcttatcagattaacattgaaagttcaactagaacagatagatcgatgatcttgcgcattcattacatcaaaaacagtgcaacacaagaaattctttgacattgaatttttatatttctgtgtaacatcatttagaaatttggcaaaacatgcctcttcatgtggagaactggttagtaaacttgcaggcgcaaaataaaccaaaagaatgtcattaagagatgcatcacaataaattgttgttcttcttggcatataaataatggagacttggttaagaaaaacagacacttctgtagagtcataggagaacagacgatgccaagggattagacagaagactcacattatcagatttctgcatcaattggtattcccagaacttgacatcatgatcagcacttccagtgacaaaaccccatgcaccagcagttccatcctcgtttggaatgagtacaattgatcgtatggaaccagcatgagcttctataacctcaatagagcttccactattaatatctataatctccaaagtaccactctttgtgcctacaagggcataccgatttccaggaacaaatgcactgcacaatccataatcagaatcaattgtccggagacagtcgccagtactaggattccatatcttaacagcattgtgacttgttgacatcaggaggttgtcctctgagttaagtgcaagactcctaatatcagaacggtgtccatgcatctcaatggaatacatattcgacacattctcattatccactgagtatgtctcaagcatgttattattcagagatagagacaaggtggcaaggcaaccttttggtggattgtttggagaaaatgcgacagagcaaattttcttgttaacccgcaaaacatggagaagcttaaatatatcggtgacaacaggagtgggattctgcaagtcttgagccgacaaaggatctataacagtaccattcccttcagcagccatggatttggccaaagccttctccttctttctgtgcatcctcctcttggccttccgtgctgcctctgtttcatcaagaaccctataaatatccaccgtcttcccagccacctggcatgccacaagattaccgttcttattgaacttaacagtcgctaccctttccttgctttgccttggaatctcaccaaatagcttcagcatatcccacttgctccaatcctcaccctcctcagcagatttccggaccgtaaacacccgcagctcttgatcggccgacccagacaccaaaaacctctcgctgggatccacatcaattgaccatatttcactgcggtggccaccaacaatctgaaggcagtgctgcgtgtcaaggtcccaaacccggattaacttatccttggagcagctcactagtttcttccctgaatccagaaacaccaaacccgtgacctacagcgagtaatcgccagattagtatgactgaactttgctacccaatagagacagagaagagaagcacaatgtagtatacctgatcacggtggccacggagtcgataaaggccggcctgtccaactacatcccaaaggataatgtcacagtccttactgccagaggcgatgatggcgccagaggggccgaatacgagggcggaagccgcagagcggtggccatggagggtcgcctcacaggagccggtctccgtgtcccatagcctgatgctcccatcggcgtgcccactcgcaatctgaagcaaaccaacacagcgcacgagatgatgaaaccagctcaaaatgcggagagattaaaccgcaaaaggggaaagggaggaaggttcagcgtgtgataccgaggaggcggaggcggaggcggcggaggggaaggtggcgaggcaggagacggcgagggagggggacggggcggcggtggcgaaggagagggaggggaggccgcgcttgaggtcccaggcggcgaagcggtcgagggcggcggcgaggaggaggcggccggaggggtcgtacgcgacgttggactccggggaggcgaccacgccgaaggagatcgccggctcgtaccggaggtaggccttcaccatggcgcccggccgccggcggcgtggtggaggaggaggtggagtgcgtcgctgcggttagggtttatggcggcgcgtgcgacttcggtcaaggggggtttaaaagccaacacactagacaaaaaaaaaaggaaaatagaaaaatagatataaaagagtaaaattcataaaaatttcgaggcatatctaacataaaacctaaattattataatttttttcagtgaatctcagattttaaggtaaaatatcttaagcttatattattgtttttaatatatttatgtataataattataagataataataatacgagatattgcagagtacatatcatttttttcgattattggtagtatcattagtttttatatatataagcaaccggttatatatttgtattgtgtttttt

SEQ ID NO: 37380 - DNA, 2267 bp, Oryza sativa
tataatttttttcagtgaatctcagattttaaggtaaaatatcttaagcttatattattgtttttaatatatttatgtataataattataagataataataatacgagatattgcagagtacatatcatttttttcgattattggtagtatcattagtttttatatatataagcaaccggttatatatttgtattgtgttttttcaattgtataatagtaaaggaaaaaatgaattatgccggagggatgtgtattttgagcttaataatgtaaatatatacttaaaatattataactattaatgaaattatgagcatgtgatataaatatggggattcttcaaaaacattttctcttagtatctggtattttctaaaataaatcataatatatgggattttatattacatagtactccttcgttttatattatcgttagatttttttccttagtcaaagttatatatgtttgactaaatttatagagaaaaatagtaatatctacgacagtaagttagtttcattcattaaatttaacgttgactatattttaatacaatatttgttttgtattataattcttagtattgtattttgatacaaacttaaattatagaaaaatgattaaaaaattcaatcgaggtataatatgaaactgaggaaatgtgctttaaaatctatagtgttttccaaaatttactccagataaaaagtcacacaaggggggggggggggaaatctctccatttgccagtcgccacatctccctatcgtctccgccgcaagcccgcaagcgaagatggcgacgccggcgaacgccaccacattctccggcgaggtgtgggcggagctccgcctggcggactccagcgacgtgccccacatccacgccctcatccaccagatggcggagttcgagctcctcaccgacctcttcgccgccacccacgagctcctcacctccacgctcttcccctcgccgccgcgccctcccttcacctccttcaccgccctcatcctcgacctctccccgtccccgctccccgcctccggcccctccaccatcgcctcccactgcctcgacctctccgcgtccccgctcgccgacccggaggccgccgccttcgcctcccctcgcggcggcgggcgcgtcaccgcgggcttcgtgatctgcttccccaactactccaccttcctctccaagcccgggctgtacgtggaggacatcttcgtgcgcgcgccgtggcgccgccgcgggctcggccggatgatgctgtccgcggtggccggcaaggccgccgagctcgggatggggcgcgtggagtggtgcgtgctggactggaacaagaacgccatcgacttctacgaggggatgggcgccgaggtgctcccgcagtggcgcatctgccgcctcaccggcgctgcactcgacaagtacaaggggaaccaggaggaggggggaggcagcaaggcggcggagtagatcggccatggatggaaacgtcgattcttggctgtccaatctcgagtgagtgattagtgataataaaggtagtggattttggttccacttatctgctccttgtggtgatgtatttcttgatagtgattcagtgcattggatcggttcttcattgctatgaattacagtgatgttttagcttgattatgtcatgaacttgatctgaaacatttcggtatcaaattcttgattgaaccacactgatttcggtatcaaatttctcatagggtgtccaagttgattcatcagagttcagtaacacatggcttcagtgcaatttgcctcccatgtcttattcattatcatctaagctattttcatttgtgtcctgaatccctgatgcttccatcctggcaaggaaacatataaaagaaaaatggaagaagtggagtaaaagctccaatggtatatgaatgtcttagctgggtcatgtattcatgttgtttaaagatgaacgaaaatgtatgtgactgcggcacatatgctactaaaatgttacacatcatctgaccacaacacagatattttgattaagacctgcaactatgtacaacagaagtaggagctgaaacaacgctcctgggatgtgttgaacagttttttacaattactggaatctacattgtttctaggaacatgtaatttcttcccagattgagtttctgaagcaagatctttctgcaaactgtctagtaacagtatcattctagctggattggcttatacattcatcttttgtcttgt

SEQ ID NO: 37381 - DNA, 6119 bp, Oryza sativa
  unsure (1)..(6119): unsure at all n locations
tgcaatttgcctcccatgtcttattcattatcatctaagctattttcatttgtgtcctgaatccctgatgcttccatcctggcaaggaaacatataaaagaaaaatggaagaagtggagtaaaagctccaatggtatatgaatgtcttagctgggtcatgtattcatgttgtttaaagatgaacgaaaatgtatgtgactgcggcacatatgctactaaaatgttacacatcatctgaccacaacacagatattttgattaagacctgcaactatgtacaacagaagtaggagctgaaacaacgctcctgggatgtgttgaacagttttttacaattactggaatctacattgtttctaggaacatgtaatttcttcccagattgagtttctgaagcaagatctttctgcaaactgtctagtaacagtatcattctagctggattggcttatacattcatctttgttcttgtcgggaccacagccatcaaccactgtttgacgaaactgtattatctaaatgatgattgaatcggatgcatattgcatgaggctttagggcctgtttagtttgctaaaacaaaatttttggacgtcacatcggatgtttaaccgaatgtcggaagggattttcggacataaataaaaaaaactaatttcataactcgcctggaaaccgcgagacaaatcttttgagcctaattaatccgtcattagcacatgtgggttactgtagcacttgtggctaatcatggactaattagactcaaaagattcgtctcgcgatttcccccctaactatgcaattagttttttaatctatatttaatgctccatacatgtgtccaaagatttggtgtaatgtttttgagaaaaaaatttgggaactaaactaggccttaatgcaagctgtattcttgttcggacgtccagttagtcagattggttgcaaacatcgaaatccaattgatgacagtataaggtgcatgtaaaattgatcagcaaagacatttaagccaaaacgttcttgtataatctactacacattttgaccccaacctgtatggcaagttttctatcataaaattgaaatattcaattctatcatcctgaaaactttgcgagtaggcaaaaatcatgagaagaggtcacccgccggtcagcccattggtattttctttctttcatgaaaagaaagtttttcttccgtaatccgaagatgatagtatgattaatgattctactagtaattgtgatcggacggtggctttgcctttgctcgccttctttcttcttccctactccaaggcttattaccgcctctttttcctctccacgccttgctgctcagcttccttctcaagaaaaacactaccctataaaatgtaaacgacgccacctctcccaaatcatcgtagcaacagcgacagccaaaaaacatcatcaaaattcttcggggggagagagtttgatggaggagaagggtgcggaggcgatgacgcagaaggcgccggagaaggaggcggcggcgatggcgtgctaccggaggacggtgggggaggaggcgacgttcaaggagagatccaaggacctgttccggcagttcaaggacgcgccggcgggggatcactgggtctgcctcaagaacaaggtccgcgccgccggcgagtacgccaccctccgtactcgccagggcatcaccatgttcggcgagccaaatgtcggcgacctcttgggaagaaccaaggatgacgactccaagaagacgccttccgcgtaaattatagaccaagattgagtggagaagcagtagcattcttgagggcgaaccatctaagtttgttaataagtgttctctctatggttaaatgattgattagttcgagttttactccgttcgtgttgattagtccaggctttcgaggtgtaatagaatactgcaacaatagaagtgtgtttctttttgttttggttattttcccttcaattcatcaaggacacgctgaatttcgcctcccggcttacacggttacacctataaaaacatctggatgaaagcacagttcatataccatcgcccaacaacaatagttgtcatatcgtaagccatattattattagacagcaatgtgctcactgagaccatgagacattaacacatttttcaaatggtacttggaagttatccaagtgatctgtattcataaactttacggactgaagaaagaatgaatgatcccatgtaaatgggaaagatcagctgcttatgaaaatctacgttgatgcatcagggggtacaatccttaacccccaactatttctctactttctacactaaacacattgctaacgaaggaacaaacactaggcctatcagacgtcaggtggttaaatacgtgatctggtacaacaagcatggcctcaacagctagagcttttgcccccagctgtgatcactcatcagtaacatgaaaagtggcaacctatcaataatgattaaacttctttctatggcgactataatctgagacatatctgaaactctggccacagtcaggagccgagcacttgtacggtcgctcgcctgtatggactctgatatgctcagtttgcgcccacaaccacttgaaagtcattggacaaccatcccaggggcatttgaatggcctctcatctctgtgtacacactgatgacgcttcaggtatttgtgagagctgaagcgcttgccacaagactcgtcggtgcagatattgcgttggtgagcacgaagttcagctttagtctcaaatgtcatgtcacaaaattctatgtcacactgaaatgcttccacctttgccttcttcctcttatttgcagttgaagcttctgcagtttttgtttcgtttgtcatgtcttcaacaatcgcaggtctagtccttggtctcaagctttcacatggagagcggacaaagctccccaagctttggggactattaatattgaactcagatccgctctttcttttgtgtttgcgtctggcataacatatgatatttgttctgtttgaacttccaatgcttctagacactatgtctgatgagcagaagccatgcgacggatcagtgatctctgcaacttcatcctgagttacatcatctgcagattggtcattgccagccagtgtcatcaatgtcaaggaagctttgccaacctcatcctttccagaagagaccttagattcatcggctagaactccaagtaaaatatcaattgaatttgactctgtgtgcatggatgttccattttttctgggaattgcagttgttgaagcagattgcgcaccttctgaaatgatgaaatcactgcttggagattcatgaggtaattgtgtggtatgaatgctattgagcttagcacccttgacatcagtcaaactggccacaacctcagcctttgaattatggactgcctgcaactcactgcccatcaaatcatgagccatagacagcttttcgcttgaaaaggcagcatcagtggagacagggcagtccaaggtcagactgcaacttctgtcactgctagaaatcatctggtcacagctcgactttggtgttacaagaacaacactacgatcacatgtttcaggttgatcatctgtatcaggttcgctgttctttaatacagtgtcagaacagtaagacgtattaccacagctatcctcattttcaagggttgatgatgctgcccccccatgtaattctcctgcaaccaattctgtgttgggattattacaaagtaccatggccaactgatcttgttgaacttgcaattgttcatctttgcacactgaagttgcattgtcagattctaagtgctcatgattacttatgaagttcatgctgcctccctcagcgataagcccattgtccaggaactgttttacagtactcaactcagttgattcagcaccacattgttctctggtaggtttgccagctgacactgcaacagttgtgggtgaatcctgggaatcaaatgaacagatagggtcatcacatgcactcacacttactggacgctcacaaacttgatgcatcataggatattcagcaacagcaattggaatattaataagagaatgtccatcctgatcattcaccttgggacgcttgcacatatcagctacatcattggattcttgcaggacacaatcttgttgcagagtttgttcacttccaatgttttcatgagcatttccagaagtgtctatctgagtttttgtaactgcgggcttaactttgtctggagttgccacaacatcagggctggaagcataaccaatgaccttatatggagtccgtgctttcctgcaaagccatttcaagtttgaaacaactgaaataggtgatggcttggaaaataatccccaaaatgataaaggaggctgttcttgactctctggtgtttctttcctaatcttggaactatgtttgaggtttagacccatccgtgatgtccaatctgttccctcttcctcatatccctcatcatcaattgaaatattaattagatgcaaattagacttggacgcatttgctagtgcaacatctttatagtcaaactgaaactcaatttcctcagctattgatattgcaagtgcttttagtttgacataatctgcagataatggagggaaaaaggttatcactgaattcaggggacaaattaatcaaataatcacagttaaaacaactacattgattttcaatcatgatttaaaaagttcaagatatttggaaggaatcaaaagggcccataatacttaaatcccctcggctaatatctcttattttcagttaacttcagctgacaaaaacatgtcaaataaacaataaataaaattccacatccagtgtgcaggattaatacaatctacgggagttacattgaatgtgacaacagaagtctgcatcaatcgtacctgcatggcatatgatgagggcatgaactccacctttgctcgcaagcaactcctcaatctcaagggcatgttgtaagcaaaagatccgaggccgtgcaaatgcacagcctgtattccagctgatagtttcctcactaccttcgacatctggtacattaacatcacctctgcctgattgtttactcaactctgagccagggcaatcacttggtattttcttctcaggggtttctgtgtcaccgtaaggatgaatggtattttcactgctacaagaacaggaagtgccaatatgtttccctagggttccattaaactcctttcccatcaaagaaatgtcacttctaattggcttcacatcctgatgactgaggttagcattttccacagggctggacgatctattggcgatgagtgggcatcctgatacatgggggagaaacatttgtcaagtttttgtacatgaaaagaaaatagaacaaatcattaaagttgaaacatagaagatgctcaggatgatggatggaaacccatgcacttcagtaatacaaataccaagagctcagctagacaaaagtctggctatctctaacttattgacgaaaaagacagttatattaatcttgtgtagtaatcaagcaacaacgcacactgtacaataaaaattatggtactaaacctagttgcaggcataacataaacatttgagaggattacagatttgagtccaaatgatcataatacccttgtgtgcattattatacgttgctaaggagtcgacattcattatcctccaataaaatatatgttcaagtgtatgacaacagttccctcttgccgaggtttatcataacaaaagaatctgcctcactgtagctcactgaaggccactagaacaacagcaacgtgaagtacacacactgggaacgcaattaatttattggacatagaaaaacaagacacttgaagaatatctaggtcttatgaaaaaaaaagatctacaaccatcatacaaattcactttatttcctacatttataaataaggaactaaaacacaaaatcttcaaagataataaaggcataccggagctaccatcattaggagagcacggaagcacannnnnnnnnnnnnnnnnnnnnnnnnnnnnnnnnnnnnnnnn

SEQ ID NO: 37382 - DNA, 713 bp, Oryza sativa
  unsure (1)..(713): unsure at all n locations
nnnnnnnnnnnnnnnnnnnnnnnnnnnnnnnnnnnnnnnnnnnnnnnnnnnnnnnnnnnnnttctccaggttctattctcaacaactgaagttatttgttttgtacatgtatcattatttcttattgatcgacattattcttttttggcatggaatggtggaattgttttaactttcttattagctaggattcttcaaactgtctcgattaatgcaggaagccaggaacagtcatatttatatgctaaggcttatatgattatcgtgccacattgtcacaatcatttttgaacagattatgtaagacatagcaccagtttttgtatttaatacatgacatcaaataggtcatgtataacaatatgtgtttgaacactttcactcactttaatattatccatccatagttccaggtagtttgccatgttaaacgtggacgacaaagataaaggcatttttctatcgtgctagataaattgcataaaaaactgcacaaatgggatgaagtgttatagttcatggtgtactgcaaattgaaccaaagtgcaccatggttcatttaatgcttaagcttctatgtccatattttttttctcaattatataaaaatatttgaatattcattagtggtcccttattgttgcagtatgtttttccatactaatgcatacatgtttattttgtttatacctttacttacaatatgtgcaaga

SEQ ID NO: 37383 - DNA, 1327 bp, Oryza sativa
  unsure (1)..(1327): unsure at all n locations
aatgatcataatacccttgtgtgcattattatacgttgctaaggagtcgacattcattatcctccaataaaatatatgttcaagtgtatgacaacagttccctcttgccgaggtttatcataacaaaagaatctgcctcactgtagctcactgaaggccactagaacaacagcaacgtgaagtacacacactgggaacgcaattaatttattggacatagaaaaacaagacacttgaagaatatctaggtcttatgaaaaaaaaagatctacaaccatcatacaaattcactttatttcctacatttataaataaggaactaaaacacaaaatcttcaaagataataaaggcataccggagctaccatcattaggagagcacggaagcacatttgaacaaatctctttttcacaactcagtttatatctttccttatcaacaagggaaatttcttccagtgcttttctggaaggttgcaaaatcgccataaatggatagccaagaatcccacatgcaacacatgtcaatgaaccagaatcaatgctcaaatcaaaaggcaggtcatctccgtcatcggtatcaagcttttctccctcaggagcttgtttgctatccatagacaagcctttagattgtgtcccagtcatacatgcagtaccatcagatgagctgtcatcttttgagctggattgggtagatccaattctgggaccatcttcacccttcttttcaggagcttttgagcaagacgagcaggggtgtagagcggtaagcgatggcagcaagtcaggctcccatagaacaacattatcaaccgatttttttccaagaaatgaacatataagttcattttcactaatcatatcctgcaagaattcctgtttgaccaacagttctcggtcttcttttttacgatctcttagacgagaagttcggattccagacagtagttctctagggttcctgaaaataaaatgaatccagcagactcataagtgtgtgctatgataatgatttagcatacttgttaatataaatgggcacagaaagcattagaggtaatgattaaaatatacaatcaaatgagtgcttcaatattaaacacttcgaataatcaatgaaattccaaaacacaaggcaatcatgtgagcaacaaatgaacaatagaagctttcaaaacaaaatgaacaatggataaaaaaggcaagtaatttgtgtggatgcagacagccaacattctgcttgttagcttctctttggggagtgaatattgatggcttccaannnnnnnnnnnnnnnnnnnnnnnnnnnnnnnnnnnnnnnnnn

SEQ ID NO: 37384 - DNA, 2092 bp, Oryza sativa
caaaatatatgtatgaaggtaaaaaaacatatacaacttatcatcaaaactgttgtgcacaaaaaatacatatggaaactatgaatgcaaatttcctattccctagggactctagaagccttagcttcccatatagagttgggcaatctagaatccaaggtgacttaagagaggagaggagagagagtacagcttaggggaggggatgagggagagggtggagaaatgggctcatggactgggtagcgggtgggtgtagcggcttgagtgggttttatgcgctacattttccatttgccgtttatatttccatctgatatacttggaatataatgtgatttagttgaagtctagcttacacctagcattgtggtgatcctgtaatgcggcgtctcccaggagcaccatgacaacttcacctttgcggttatgcgtaatccttctgtatggcagacctaacaagcatctaacccctacccactagctgtagcatttggtttgttggaggacaaaggtaatatattttgtttcatcaacctattaatgaggtgcaaaaactaaaaagacactttggacagcacaaaaccaaactccaaaaagaaaaagaaaaaaaaacctggatataaatgaaactgctagcaagtacaatagttgttgatgggagagcattggaagataattcatcacagcccttcgaactgcagcctctttagcaaacttcaaccattggggagtcgcaaaattggcagcttctccacaattgaatcctgtattatattacacgaacattagagttgccgatagcatgcatagcaacaaaataaaataaggaatctactgaacatgacatgctgctgactgcattggatattcagtttctacaacataccacaatctacaaattgtttcttttggttccacaaagtaaatgaatctcatagataggttgactctcagatataaagtgagatccttaagaggatctcaagtgttccataaaactatgaacgcaaataggttaatacgaagaagcttgaattcttcaaaaaattagtatgaagttgaaaaaaatcaaactcaccaaactagttaagacaacggtaaaaggatcaccataatcttgcttcaggaaacaagtatgaaagagtaatttgttttgccattacccattagtatcatctgaataacctagtttattatcttgaattatgattcatgacaagacaaaacagtagcaaatattggttatattataactgagtgtgtattactaccacggctccatcacatcgacaactgcacttcatgcctagatctatgcagccacatgcactgtgtattgtaaaagatttgtgttcattgacaataccataaagaaattaaattaaagcatacaaggttcagatgatttaacaactagcacatactgatgaatcaaataacaagtattgtgagttcaaaatatgtatgatttaacccaccatggctaaacccgacatggtaagcccttgggaatgtcaccacaaactcaccaggatattgcaccaatctgaaatacaatgcatgtcaacacataaattaattaagattggtgtattgattgctgacggtttcagaacttgtacctacagcagggcacaccattgtctataaggacctctggggacattagtgttgttttctcaccaagcactgctagtgacgctgcagaaaccaaccagaactcatatcattcgcaccatcgcgtgagcacaagatctggataaagaaacacaatataagacaaataccgatccgatcagtgttgcctccatagccatgtacacggataacttcctcaagctcaacagccctatcaccaggaaccgcataccacgtcttaggtgcgccagtgtggaggaagttgagactatgcagatcatgatcctccacatgccacgcaaaccagctgaacagcatgccaatgtaaaccattggagaagtcaccccaggaacatcgtcaggcataaaccgtgtgagcgaaccaggagcccgcgcaattgcttgcaggttccatgggctatttgacagcctccagcctgaactcttctcc

SEQ ID NO: 37385 - DNA, 1402 bp, Oryza sativa
ctatcaccaggaaccgcatactacgtcttaagagcgccagtgtggaggaagctaagactatgcagatcatgaacctccacatgacacgcaaacaaactgaacagcatgccaatgataaccattgtagaagtcaccccaagaacatcgtcaggcataaaccgtgtgagcgaaccaggagcccgcgcaattgcttgcaggttccatgggctatttgacagcctccagcctgaactcttctcccattcgtccatcggggcagtctctcttttctgcttcttcttgcgttgcaactgcacgggtgcagcaaacccagagccagggacatcattggcgtactcaatatagataggacggtccgccgacgccttccagaagagtgattccaccgcgagcgcagtcggttcgtggagtccagcgaggtgcgtctttgagaaggcgcgggacttggactcaaactggtcgagcgtgtaccgctccccactctgccacacctgcttaagcacctgcggcgtcgggcgtccacgccgcgggttgccgagctcctggtgccgtgtcgtgaacaccgcggcggagaccggcggcggcgaggaggaggatggaggaatggacgagtcggaggcggcggcgggagagggcgcgggggcgtcgcaggaggagacgagggagcggttgaggtgggcgaagacgaagcggcgggaagggcgcgggtggggcgggatgaccttgcagatgccgtaggcggcggcctcgcgctccacgcgggagaggaaggcgatggggtcggcgaactcggactccgtcgggcggtactcgggcgcgcgggggagccccctgagccaagccgggacggcgggatccggggcactggccgacgccgacgccgccggcggaggctggggcggcatcagggggggagcgcgcggcgagagggctagggttttgggaggcggggacggggagcggaggggagcatttgggttgggggggtttgaggagaggaagggaagggaggattgggcagccgaccaaaggagattgcgaagacggtgtgcgggggaatcgcgtcgcgggtgtgggtatgaggggaatggggggggatgcgggcggtgtgtactggagtttgtgggcggtggctgtggttgcgcgcggtcgtcggcccgtgggctcgcgtctcaaggctcagggtgggggccggggggtgagttttgctttctgcgcttgtcgtggatagggactgcggttagtttttgcccgcaaaactaaccgcccttctctcgtatgcctccgcaagaccgcaaataccaccgctgtcttatacaagtaacattcaacaacagaaagaatacggtgtcaataaattagaaaagtgttatgaaacctatttttattataagccgaatta

SEQ ID NO: 37386 - DNA, 517 bp, Oryza sativa
ctggatgctcttctgtcacttctagaaacatcagaaaataccacaattcatcgagtcacagctggtgctattgctaatttggcaatgaatggtaatgcctattccaacctctcatgagatttattttccacatttggtcaaaaggggctattatttcattgtatagttggctcactgctgataatattgcagcatggaagtagttgttaaccggtgtgttctatagtctttcactaaatgtcttccgcacatgccaaatggcccagtcattgactgaaggaaaattccccaataggtttccagcatgagatattctttttacatatttgaactatatctatattattagtcaaatttatattgcgatatttataaaatgaacaggcaataacttgagtattaagttagatccttgtaagtgcaggatcaaaccagggactaataatgaacaaaggaggagctcgattattagcaaatattgcgtcgaaaactaatgatccccaaactctgcggatgg

SEQ ID NO: 37387 - DNA, 760 bp, Oryza sativa
  unsure (1)..(760): unsure at all n locations
nnnnnnnnnnnnnnnnnnnnnnnnnnnnnnnnnnnnnnnnnnnnnnnnnnnnnnnnnnnnnatgacgttgagaaagagtggatatgagatatcgtacgacaaggcttggagggcaaaacagaaagcattggagatgaggtttggaacttatgaggattcttatcacaatcttcccccactattggaggtgatgcaggcaagaaatccgggcacacacatggctattctcgatgaggtgaatgaatatggggagaatgttcttcgtcgggctttctggtcatttgggtgcatgatagaggcctttagaaattgcattcctttgctctgtgttgatggcactttcatgacaagcaagtacagaggaacaattctaaccgcgatcggagtcgacgcggatagccatgtcgttcctattgcttttgcatttgttgaaagcgagaacacatcaagctggctatggtttttgcggcacattaaaatgtgtgttgttgaaaacagaccaaatgtgtgtgttctgcatgaccgacacgccggtttgctatcagcgatacagaagcttcaagaagatgtcacacagtccgtgccatggccagatttacatagcagatgatgcatgcgacattttggggctaatttttatagacaattcaggagtaagagattgatggacctgttcaagaagttatgcaagcagaatcaacaaagaaagatggatgccttatgggatcaactggatcgtctgaccactacacacatggaa

SEQ ID NO: 37388 - DNA, 613 bp, Oryza sativa
ggtggggtgaatggaagttgcatctatttcatcaatcggccacaatgtacatgacagatctattccctgacatcataccccaggtaaactttgtcatcactaaatttcataacggttagctaattcattacttgactaatcttttgttcctgttttgcagacaacaaagtcctcccctccacatcagagcaatagtggtagaaacattgaatatgccccaggtctgattcctaatggaggcgaattgtctcccccaaggtctcaaccctcctccaaggcgccattagggaaccaaccgatgtaaccaagaaaagaaaaactagatcatcggctatgaacaccttgactctagttccaaagaaaaaaggccaaatctaagaaaaccaagccaaccgacgacctgcctgctttggatccatccattgaacatgctctggatgaagaagatattgaggatgatgttgatcaggctacagccgaagcaagtgatactgaaaaaacaccatcggcttcgcctaagcagataccttcaactccttctgcccccactcacttcttcagagtaaaacatctttccttgcaaacccttttataatcattatttttcagctga

SEQ ID NO: 37389 - DNA, 583 bp, Oryza sativa
cgtttgtcaggttgctgtacgcgtcggcggtgggctggaccgtccggctgctgcccgccccctccatctcctcctcgtagtcgtcaccgccgacctctccgaccacgccgagtaccagttcgagaccagatcgacaacgacgacagttcccgagtgctcggagccccatgaagatcttggcggcgatggcccgccgccgccgctcccgcctcttgttgttctccctctccttccacgtcggcttcctccccgccgccgcggccgccgccccggacgtcatacccaccacctccgttcttccctcacctggtctcctctcctctcctctctccacttggtgaggccgatggcgaggccgccgccgccgcttcagctcccgcggtcgccgccgctctggcccccgaccgccgccactccagcttcagtcgcccgtgctccctgcggccagccgaaggggagagaagagagagaaagaaagagagaagggaggaagaggggaggaagaagaaaggcagagagaggatgacatgtggggtccacatgtcagtgagccccacaattttttgtgtgtgaatgactaatg

SEQ ID NO: 37390 - DNA, 292 bp, Oryza sativa
gtttttctctctccttatttatttttttaaaatatatttacagctggcttatagcctactattactgtaactgctctgaagataatcaaatccccaaccgcccgcaccacgcgtgtgagccgcgcggtagacggcggccagcgcggacgcgagtcgccgctgccacctccacacgggatccgccgtggccggccgcgggccgtacaggtggcgctcgctgataggtgcagtgcgatgggtcggttgttgccttttcatggaatagaccctggcttctgaaagaatggagcgg

SEQ ID NO: 37391 - DNA, 778 bp, Oryza sativa
  unsure (1)..(778): unsure at all n locations
nnnnnnnnnnnnnnnnnnnnnnnnnnnnnnnnnnnnnnnnnnnnnnnnnnnnnnnnnntatagtctgaaaggcagcgaagaaaaagcccctggttgcgtgtttgtttgctcgacaaactagaggccgcttgtggggctagtagtgccgtcgtggtttcattgtgtatgtatacctaaatatatgttacataatgatcttgctttcgtcgactcgagagtcgagacagtgcctccatttagtccatattgtactatgcttacatgactgccctgttgaagaaatagcctatacagctgcactgttattttggttgttgatactacctgataataatatggcgtgtaccaaagctttaacgtggccatgttcagcagttcaggtcatcttcgttgctctctggtgcagacgagctacgaggtatgagctgcctgatgttggtgatacctgacgaaaaatccgtccgaacggctgtgatggatatcagcttttgctgcctcttcctcctgactttgtttcatcggctcatcgccatttcgcctttcgtcaatctctaaccctctctcctttctccttccccacgctgggctgcgaagaggaagatcgatgacgcgtggaattccatgacgcgtcgcttgtgagcccggaacgagatctcaatacccgtttatgacggcccatataagtggaacgggattgccgctaacaagcggcccatatgtgttggtggaacacgacgtgcggcccaagtccggaggtggaatcagatggacgtggtcc

SEQ ID NO: 37392 - DNA, 721 bp, Oryza sativa
  unsure (1)..(721): unsure at all n locations
nnnnnnnnnnnnnnnnnnnnnnnnnnnnnnnnnnnnnnnnnnnnnnnnnnnnnnnnnnatttgcgtgttcattggtgagtttgtagtgaatattgaagaaatctgttgatcaaaagattttatgtttatgttgtaaaatggaaataaaaaaatgtgttctatttctttactattattttaataaaaacaagtgaacgaggtggttttttaaaatgcgaatactaagatttgaaaaacgtgtcttgcatactagtatgttctataagggactctcattgtaatgaagtattgatagggactctaatcaggcctcctataaatcgttattgatttgtcaaaatatctctggaaaagaattactactacctgccggcgatcacaacaccgatttggacaggttttattgtttgagcacgacgcgaaatctaacaaaagctgctccacacgaacactgcttgtagaaaatgacgataaattcacaggctcacagtgcagtggcccatctctttggacggagagggccaccggagacaggaaggcagaaagaaaaaatggcgataggatggcataggtcacagagcctggcgtctgcagggctcgggctgcacgtcctcctctgctcgtcgttgctgctcaacgccgtcttcatcgcgcaccaattcctcggggcctcaccgccggcaacgccggagcggatcggcgacgggctgagctgggcact

SEQ ID NO: 37393 - DNA, 467 bp, Oryza sativa
cacacacgcactttggatgagttgtttttaactaaaaagttgttgcaaaaatatcaaattgcttttcatgctagtttgatgttgaacatgatttctgctaaaaagttaaaacaacctcatgatgttttggattgctcaacatgtaatttgaataagttgaaattgagggatgctttaggtcgtgttgagtacatggaagatgttgtgaaaaacaatgaagtgctttcttgccctaaatgtcgtaaaagcaaaggtgtcatggtagatagtgaaaattgtgctaatttggaaaaagagatttcttatttgaaaagttctttgctaagattttatgatggtaaaaagaacctcaacatgattttggatcaatcaaaggttagcacacataatcatggtttaggttttaatccttatggtcataattctagacatcctcctattgtgttaggtgctggtgctagaagtgg

SEQ ID NO: 37394 - DNA, 690 bp, Oryza sativa
gtatcttctgcagcgagatccgggtggaccgcgacacgacggcgttgagccttcgccatcggctcctcatcacgtcatagccgaaggcgaagatgtcctccttgcgtgcaggttggccagtatcacctttaggatcttcagcatccggagctgggtgtcccgggacgcgcccatgatgctctgctctacgtacgaaagtgctcttttcgccaccttctcgtcccttatcagcgcccatctgcgcaacgcacagcacggtatgacgtatatgtagtgtacaagtttttgcgtcgttgtgttcacgtgtcgcttgcaatgtcaggcttaatttgagggcgtgtacccgaatctgctgccggcgtggccggagagcttggaagcggtgaagagcatgacgtcctcgtcggcgggcgccgggatgtgcgtcaggtgaggccagtagtacgcgtggtcgacgatcgccgacgagccggcgaggacgggcttgcgcaacgcggtgtcggggttgttcggcgaggtgacgaactcgatgaagcctttggtggagtttcgcgagccgttgtttgaccacgtagcggtggtgccgtcccatctgtactcccggccgtcaaacatgtcggtttgtgacttgtacgcctacacatatcatcgatcaaagcagttcacttcagcacgacttaataaactgag

SEQ ID NO: 37395 - DNA, 702 bp, Oryza sativa
tgatggccgatgctaattgcgagtaggatggatactggaaatagcggatgaaatgtgagaacaataattcctcggagacttcagaaaagcatcgcaattcattacataaattccccgatgtacttggtgctcatcctagtcaaaagctaaagattccagaagtgctctcttcctcaaatgagaattggtcctcaacctctgcatcggtgaaggtaagagctctctgcaactttttgggacagaaaacctcaacatcggaagtgtacacagctgtcacagggcggtgatcggatagcctgatatcaactgtcctgtaggcctgcagcctcattcccttgccaaaggaaagaattcggtcacacctacaaagttaaacaatatttttttttgttagcacgcatcgctcatcgcaacttagagatttcctcatacacaacctcaattcttacaatacctcttattaaatagtagtaatgaggtgattaatcgtgagttatgaggaccaattctttcctcttacacaatacctcttacaatacctcttacaccttcatgagttatgaggtgattaatcgtgtaaacaacgaggaaaaatgttactacctccgtcccattctaggttgtttagcatgtattagggttagaaaaaaaatactacaatacctcttattaaatagtagtaatgtataggtggatctgaga

SEQ ID NO: 37396 - DNA, 462 bp, Oryza sativa
cccgtggcgtggcggtgccgggccacgctccctaggagagtgaggctcggtggcgtggtggcccgtgccggtgcggcggagacgccggtggccggctccggggaagccgggttgctgttctccgagaagttccccttgcgccgatcccgaacggtaacttgttctgctctgttgttgtgatctgcggcgaagctatgcttcgttgttttttttttgttggtgatggggtctgtggtgttcaggtggaagggaaggcgtgggtgagggtcgatgcggagccggatggggagggcaagtgcaaggttgtgatcgggtgtgatgtagagggaagtgggtgctgcattggggtgtctcctacgatggtgagcagggaaggtactcgctgattctctctccgagctgtgtctctgtttgcatgatttatgaactatgagtgcatccttgttttgatcatccgtgggg

SEQ ID NO: 37397 - DNA, 1009 bp, Oryza sativa
  unsure (1)..(1009): unsure at all n locations
aacaaatgcaccccattaaaaaaaacaaacgtttgccatcagggttaaaggccagcacagaacggagattcagaactgattttcccacttcattatcaaagtaaccatgaatgctacccggtaacacctctgttcatctgcataataagtctccacatctgtgccgcttgagcaaactttcaagaaaccttccttcctggcttgtccaattccccactcacgcaacacatcatgaacttttattttctttatccacccaatgtttttacttctttcttcaatttggatcatacatctctgtgccagctcttctacatatctgtaggcaacttcttcttgtgtatatcctcttatatttgggacaaatccctcagcaatccacatctttttaagaacatgaactgtgatagggtagtcctcgggaaaggatgcagtataaaggaagcaagctttaaggttatttgacatattgtgataacttagagctaatatacgtccaacatcgccctcctttttcatgatttcccagtctacactagcaaccattttctcccatgtatgaatattgtggtttcgtgaaaggaagcaacctaaaaccactagagcaagtggcaagccattgcatttcttggagagttttttccccaccacctcaagttctgtgaattgcacatcatgtggaaatgccttcttctggaaaagttcccagctcttgtcttcgtctaataggtcaggggtatgaatttgcactttagttttaggatgttgtccaacttccatatcacgggtagtcagaattattctacttccatttcctttgtcaggaaatactgatttgatcttgtcccaggtatctgttgtccagatgtcatccaaaacaataaggtagcgctcttccttcagaaaatcaaaaataagttttgaaacctctgtctcaccatagaaatttaaannnnnnnnnnnnnnnnnnnnnnnnnnnnnnnnnnnnnnnnnnnnnnnnnnnnnnnnn

SEQ ID NO: 37398 - DNA, 760 bp, Oryza sativa
  unsure (1)..(760): unsure at all n locations
nnnnnnnnnnnnnnnnnnnnnnnnnnnnnnnnnnnnnnatattactaaaagtgttaccttgcatgccactttatcaccaacagacaatgccttggaaccttttgtaaatgagcccatatgcagcacatacccagcaaatacttgaacattagttacattgaaagatccgaaagacccttcaattttcccagtgtcatatatctgatgcaagaaaaatcttgtcatgtttataatgtacggaacagtgactagcatacactgtgttgtttattattactaatgttcaattagaaatttatttgggaaaatatattgtatatttgcatgtgctcttaacaccaccaaatcacaatagctgaaaaatcattggaagatgtactaggatgaaatatcaggcataagcaaaagaatattgcaggattgggacagggtgtacaggttgctgttaagtactacctccgtcttagaacttatgggattttgcccatataatccctcatattctcagacagaggtagtacaagtgaaggactacagctgattgttaggacgacatacagttagactgcttcagattgaagggacaaagtagaacaaacaagtggggattaactacaagaggactactgcagctaattggcatgacatacaaatgaagaaacactgaagattacaacgataaagtaaaataaataacccaggaaccatattacaaccacatgagcattatatagtccacagtaagaatgttgtacctgac

SEQ ID NO: 37399 - DNA, 685 bp, Oryza sativa
  unsure (1)..(685): unsure at all n locations
nnnnnnnnnnnnnnnnnnnnnnnnnnnnnnnnnnnnnnntatgcgtatgtgactctgtatatgcatgcaaaaaatatgactgaattatccttctaattgaaatccttccatgacttgataatggcaacttggcaatctaccctatagttcaacaaatactttcactcattctttcattctttcattcatcgctcaacggtctagattatccctgtgaaatccaatgctccagattcaccctccccacaaacgagtgcccccttcccaccccaaccgcgcccaaaccgtgatcgctcctccccagccctaatctctctcttctccctctcacgccgtcacgcgccgncagctatctttaccatcacaccgcctcgccacgattgacgtcgccgctgaccccagcttcccgtagaacgctaaaccctaacctcttctcttttcccgccgctcgaggtcgcgcgctcatcgctgctgctcgtcacccggagtgagcgatgcggtcaccggagatgagcacaaccgctggggcaccacgctttctcgatcggaggcccacaccatggaggagggtgcgggagagaccctgtcacaccctggtgatccgggttcttgctactagatcaagatgcaagcccatttttttcgaaatctgcatgtaatcctaagggtggaagaaaagcactgt

SEQ ID NO: 37400 - DNA, 713 bp, Oryza sativa
  unsure (1)..(713): unsure at all n locations
nnnnnnnnnnnnnnnnnnnnnnnnnnnnnnnnnnnnnnnnnnnnnnnnnnnnnnnntgcagctcttgtcacgtgtgtcacatctcctgaaggttggacggaacaacttcaggcctccacccaaggttgattcatcggttgttcgtatcgagcccagaaagcccctacctcctgtcagcttcaaagagtgggatggacttgtgaggctttgtttcaaccggaagaacaagacattgggtgccatctttaagcagaagcgtgtccttgaattgttagagaagaactacaagacaatgcagtctctacagctcacctcagatgcagaaaaaggtgaggagaagatgtcaccagatgatgttgcattgctatcaagtatggtcgatgacatgaacatggaaagcagctacgagaatgatgatgatgatgagatggaaatggatgatgccgatatggtagtagagagccgtgcatgtttcaaagaaaagattatggggatattacagcaaggagattttgcagagaagagagcatcgaagctcagccaggttgacttcttgtacctcctgtcgctcttcaacaaagctggtatacatttttcctgaagaaacccgttatggtctagctagaaaagagtattttctttctttcttagtacgtcttgaaaggtgtgaaggcactgcgagaattttgttctaactatatatatttttattt

SEQ ID NO: 37401 - DNA, 960 bp, Oryza sativa
  unsure (1)..(960): unsure at all n locations
nnnnnnnnnnnnnnnnnnnnnnnnnnnnnnnnnnnnnnnnnnnnnnnnnnnnnnatggatggatacatgccctttatcaaagtcatacaactcaatcagatctacacacattataattgaaaatattttcatttcacaaaatttacatgttataaagtgagatatattttgaaaaatgaaattttgaattcttcaaacaacatcggatgaagatattttctatgtaaaagttataaaacacgatgagatctataactatttagttgataatattttcatttgaagtcatttagggcgttaaatatatgttaaatgattcagacaagcatagacaaaataataacattgggttagtagtcaatatgtgttgagtaggtgagttggtaagggagctctatatggaggttgaggtcttgagttcaaatctcacttgtagcatacaagttatattgtgtgaaaaattgagaatttataggtagtgatgtgtaaccatgtataggatggctagtaaaattcaaaatatttttttgaggttttttgttgcgtttaaaattcaaaaattgtatttcttgctttgccatcagtgacgggtcgtaagttacaacccgtcagagatgagtcatcagtgacggtcaggtagttacggcacgtcactgatgactcatctgtgacgggtgacaagttttaacccgtcagagatgatttatataccggtcagagatgggttatctgttacgggtgtttcatccgtcacaggtgattttgtcatcagtgaccactaatcactgaccaagaccaaacccgtcaaaggtgagggtttgggcccgtcagagataacctggtccggcgtagtgaagaaaactactaaattaaattttaagattcgtattctggataaccatcagcgaacaataggatgacataggttcagttcgttggtaagcccctcgcgccagatat

SEQ ID NO: 37402 - DNA, 23788 bp, Oryza sativa
gcctctctctcctccccactcccccacgtcggccggcgaatcccgccgctcccggccacgtccggctccctctccccctttttaagcatcgccgttctcctctctctctttttccccatttcgccgcactctcccgagctctccatcgcctccgcgccgtgcaaccacccgccgccgccgcttttgctactccggccgccgctagccgccgctaggctcgccgccgtcccgcgccgtcgccgccgttagcttcgcgcggccgagatccacctcgtccgcccctcctccgtcgaggttcgtcgccggagccctctccccacgcgcacgggtgagcgccgcctttgccgccgcctcggccatggattccggtcgccgtggtctatctccctctctctaatccctctctttttcgtccttagggcacgccggagctcgtccgctagccgccgccgttctcccgtggttcgccgtcgccgtccgccatcgtcttcccgcgcgccggccaccctcggtgaggcatctcctctcctctccttccccgtttcccgtgcgtggccgccgcccgcgctcgccgtcgctttgggtcgttgccgccgtccgctgccgccgcctccgcgtcgcctccaccgccggatgccgtcgccggcgccgcgacgcgcgcgcgccgccgtcgctagccccgggtcggccggtcggttttgacgccgacccgagcccgagggctgccgccgccgccgtccgtccgatcggcccgagggcgatccgggccgtcggatcggccgccacgtggcgtggccgcccctcctctctctcccccgtgtcgctgaccggtgggccccgcatgtcggcgccgcgccgccccgcgctgacgtcagccctggttgatattgcgcaataattcatttaaggatttcttttatagtaataaacacagtgaatcttctaaaattcataactaattcatccgagctccgtttaatcccattcaagtctcagtaaatcaagaaaaatgtgtagaatccattaaaaatggttttgttctctgtttcagtagtcttatagcctgtttgcaatgtttgctttgtatgtcgctagattccgatcccgccgacgctccggtgtacttcgagatagtcgccgaggtccctccagcagcagagcaaggcaagtcatgcttgtcacttgaacatgttgatcctatattgcaaatgctctattgtttcctttcaaatattgcattgttttataatattactatgggatggttacctattgttatagccatgcttttggatatcatgctcctttgttagcttgggttataacctgattagagttaggactagggtttgcttagccatgcttagttcaactagcacacattggggaatctcatttaaaacctagactataggtgataatgttggtttaataccaccgctccggtgttggttaaataaaatgaatcacatggtgggctgtgggtgcatggttttgctggtcgcacccatggcagttaaggaccggttcgcgggatgccctggaagaatttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgtcgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctggtcagagtaaaactattcgaatagccgtgctcgcggttatgggcggtcaaccagattcaccgtgattagtctcaccttagtataatcctttaatttgtatagcataggtggatggttgggcctgttgcaacgtggtgtagcgttgaacagtggatgattaatactgctaaattattacaactgttttcgcattcaaattcttgtttataaatgccagtatttatgcaaatgaacctgtttagctatcccttgttgaatccatgcatcataccctccattccagtatgacttgctgagtacagtgggtagtactcagccttgctctacttttcccaacctccagagttcgagttcgggtcagatgaaggtttctctgaggagtaggcttcgtccgtgccgtcgaggatgcctgtggggtggtgttcccgctgcagcttagtcaaggcttagcttcagtttctttgttttccgctgcatttatgtaagactttatgatgtttgtaagacgtggatctgtatgtcaacattgtcgtttgtgtaccccggctggtcctggacggggattttaatgcacattctgcttgggattccattcgggaatttctgggcgtgacaagtacctcctctcccagatccggtcggagggtggacaggggagggcgtcggcggcggcaacgacgtgggcgggtcccctcccctccactcccctcccagatccggccggagggaggccgcgggagggcagtggcagcaaggcgattttttttattggattttcgcaggcgggccattgccccgcctgcaaaaatggatgattttcacggtcgttggtttgttggcggtcctctcctccgcttacaaaaattgcttttggccacttgcaaaaatgcttttgtccttgaaaacatattaatcgcgactgatgactgatgaggccttgacgtctttgttttttccccctggcccgtggggtttgaggttaattaaatgcacatgaagacaggcatcgcgacttgcacgacgacttacccttacacacagcgatcccagatcccccggctggcggccatggagctcctcctctaacctctctcccctaccagagaaacggaaagattctgtagtttgcggccattgagccatcagccatggggtaagtaaccatccttctgcagcttgtatgtagcaccctgcaatgtagctttcgttggtaggttgtatctagcaccctgccttaatgttgctttggttgggtttggtttggtcttgtagcattatttcttatttttaatgtggttttagttctatttatgaagcaagatttggagaagcagctgactattagccaaaatttgagaaacagaaaaagctatatttcttagcttttgtcttttagtttattttcttgattacatgactatatattcttagcatagttgctaaatggctgtgctttgctacggataaacgaaaatgtatttaaatctattttttattgctattcatttagttttgatcttttttaatattaagaagttcaaagagtagctcgcaaaatttacaatggaagtagatgatgcattgctgtgaccatcgttacctttttatggacaatagatggatctgtttgagagagtttgagattctagcggaatctgcaggccactagcgggctaaaagctcttcaaacagatcttttgcagctttcgtagtgtactagatgcctgccacatatatgatttatccatattactgatatattatatccatacaaaatgggatatggaaaatatgttttcttacataaattgcaattgctagctctcacggtcataatctgtcatatgcctaaaattatttccttttggatgaagaagaatatattgacccagcaaattattagctaattaatttcatcgaacagctcttggtcaagaagaattagttatctcaccattcctaattgactcatattacagaaaatactttgcatctgccgtccacgcacgggccaaaactccggattaacagcctttgtagcttcctatccactccacctatgcatgtggatacccatccatgcatgcatataataattttcaaaatatttttcttctaaactaatttttcaatctatgctccgatcacatcattatatttattataattaaatctttgcaacaagatatcaagttattatattccaaagaaagaaaaaacatatgtttcaaaccgttaaaatgcaacgttttagacatggtagcgatatgttttatgtgtgttttaaaaaatattttaataactgaattttttgtttaatgtttcactagtaaccgacaaagtatcagatgttcatgcatctactctctcatgccatccgacaaagtatcagatgttcatgcatctactctctcatgccattctagtggctctctctgtattccatggatgcatacatgtatgtatttatgtatttagtgatctttaaaataaattttctcataaactacttatccgatcaatgattcgattacaccgttgaattcctaataatcaaatctttacaacaagatatcacatgattatattctgataaagaaaacatatgtttcaaacagtgataacttaatttttcatacgtgaaagcaatatgtttcaacatgtgaattaccgtgtttcacaaaatttttgaatgtctcagaggctgattgttttgtttcactatatataacttaatattgcacttgcggtcagctaaaacattttaccatatgatattttgaaaaagatcggatagctccccctcatattacatatcgagattaattttggataggaaaatctctattactttaactctttaacatgtgttttattagggaccagctaaaatgagatgttccttgaaaaaaaaatgttttctaatctgggtttgccttgttcttttctccaaccaaaactggataaacttttggatagaagtggcacgcttttcgaactgctaaacggtgcgtttcgtgcggaaactttctatatgaaaattattctaaattataagattaatccatttttcaagtttgtaataatttaaaatcaattaatcacccgttattaccacctcgttttacgtgaaacacttaatatttatgtttatcttcatcttcatcttcaggggatttaaacaccaccaatatcagattgttctacttaatccccttaatcataatcaagtattctacctcctaatttgcagaaattggttcaaataacacatagagtggtattgcttgcgggagcaactcgttgatgtattttactgaaaccaatctagcatctttgtttctctctaatcaatgaacccggaattacatgttgacattgatgtgctttggttccgagagcatcttacttgttctttttagaaaatgtgaaaatactgaaacaaataaaaaacgtatgagtggaatatcatgttcattaaactagcacggtggtccgcgcagattgcgcggctagcatcattatattttctctcgtacaatagcatatatgtttccttaatgtattattcaattatattaaaatgataatataattttaaattttgtactaattttacgaactactaatgtgtaatattcatattgtattttatatttgtgttagttattaattatttttaatatcaacttttagttatttgtaaattatattcttatatgaactctagagtcatctttcaatatatttttaattctgaattttcgttatctgtaaattgtatttccatatagactctagtctcttcttctaatattatttatttctaattttgaaatttgtattacttctaattgtatttctatgtggactctaaactcatcttttaatatttttaagttttaatttcaaatttcagttacttctaaattgtattcctatattgactttagactgttcttctcacgttttgtttaaattctgaattttagttatttgtaaattatatttttatacggactctaaactctacttttaattttattatgtttaattcaaattttagttagttttaaattcctatatggactctatactctacttttaatattccttatttttaatccaaatttctattatttcttaattgtatttttatatggactctatactctacttctaatattccttatttttaattctgaatttctattatttattaattgtatttctatatggactctatgatcttcttttaatattctttattttttaattccgaatttcagttatttataaattgtatttctatatggactccagtctcctcttccaatattgcttatttttaattccgaatttcaactatttctaaattgtatttctatatggactctagtctcctcttccaatatttcttatttttttacttccgaatttccactatttttaaattgtatttctatatggactatgtttttctttttctccgattaatgtgggaatttctaagccgtgagaacgaacgtggaggctcatttttctattcctttaataagttaatagatttctattaagaacttaaaaaataggtaagttataaattatcatatgaatgatatacaaggaaaaacgtagtaacctcatgtttattctcttccaaaaaacctatagacaatggaatttgtaagaatcaatcttttgttttaaatgactatatttttttccctataataggacacaattcctccaaccaaaggacaagccaaattcattgtcgtgttattattctcactgtagtccaagtgaccaaaaccacctacaaaatcatcacctgtttcatactttggggtcagaatttttagattttagtcctaccagatttcttttttaaatgttttttttaataaaggtggaatacaaaggaataccttaatccatatgagttttgaagggaaccaaatatgacgttcaacctgattaaaaaaaactcatacaagcctttatctctcatcaaattcctaaccctaaattttgtcacatttatgtcaaaattctacatttgttcctctcatatgatttgccaaatttctacatttggtccaatcatatattttaaatagccttcgagccatcgagggataattagaatataaagttaatcagagaatttttatctttgcatatatcagtgggcctggtagtcagtcacatccaggtgaaaatttcggtcaaattggtcttaataaaaaaaaggagaaaaactctgttcttcctaacatcccatttcaatcggtcaatcccctcgaaaggagttctaaaaaaaaaaaaatcccctcgatggttcgcccgagcttccctgcactgcacggcggcagcggcagcccactcctcccggcgtatggccgcggcggcgctcgcgactcgccaacccctctcgcggctgcggctcttcccgatccggctgtaggattccaggtaccttccccctttgctgctcaatgaagtcgcaggactgctgcagaaatttcttccgattccaaaatgcgtttgtaaattttgttcgaaacttctgtagaattttgaaatttcgggtgaccgccgaaattttttacgataccgatagtgttaataagtgttaacccgttacccctgctatcaatagacttgtatggactcttgtgtagaaggcattgtatcgcataaatatcacacacgaatatgtgggtgttaaaagcttatgttttggtgtgtttgttgaaacagtttgtgtgaggaaactcagtaatctctaagagggaagattttatggttcaatcttagcagggattttttttttttggggggtggggggaggggggaatctcaacaggaacatctaaaaactgatatgaagttcaaactgtaaaaatgcattcaaatttttcataaaacgtttttggaattattctccaggtagttgcatggcttgataactactccctccatcccaaaatgtttgacaccgttgactttttaaaaaatatttgaccattcatcttattcaaaaaatttaagtaattattaatttttttcctatcatttgatttattgttaaatatttttatttatacatatagttttacacatttcacaaatttttttgaataagacaaacgatcaaacatgtttaaaaaagtcaacggcatcaaacatttaggaaatgagggagtagtttgattgacaactaacatgggatttttggtcctttgatccagtttagtggcgaatgcccagcagttctggaatgagtgggagatccagtgccttgtgcttgcgagctttagcttgcaagtgttccttcacttcttctctagcattcgcaagggtaacacctcccggttattaagctcgctgctttggctggcatacttgttagccgactacgttgcaacattcacgctgggtcgcctgacgctccacgttgatgatccacgccatcagcttgtgctcttctggacaccgctcctgctgctgcatcttggtagccaagagacaatttcggccttctccattgaggatgcaatgctgtggaagcgtcacctccttggcctcgtctcccaggtggccctggcaatttatatcgtagcaaagtcatggcgtccggacaagcaacttttggggcccttggtgcttatgttcatttctggaacaatcaagtatgcggagagaacatgggcacttatgactgccagcagctcaatgtcgccagggagcgattccatggcagatcatgtgctgggggtacaagacgatgttatcttagacgctaaatcctattttgatgagttgcatagtattttccctgggaagaatgtgctggacattgaaggtcacaatggaggaagaagaacagatgacgatggctatgagggtctggtgatggctgctggcaagggcttccggttatgccttgattttctgacagacatgacccctttcctggtatggtctaacacagacactataattgatagtgccattaagaagctccgtacttcaaatcctgaaacacaagtgcagatggcttataaactggtggagatccagctctcacttatctatgattacttatacaccaagtatggggcacttcagttccgccttggccttgtcagcagcggaatcgagcggctcattacatttttctcaactttggcagccctaggcttgtttgtgggtgccaatctcaaggggccattcaactacagcagagaagatgtcatggtgtcctacgttctgctagccggtgcaatcacactggacatatcctccatcttcatgcttatctcgtcatattggctgcagttacaccggagaggtggcttgtttggctgttctttcagtcttgccaagtgtgttcatgcagggagcaaaccactgtggtcagagaagatagcgcagtataacttgattgatgcatgcatccaagaagaacgtggtggcataatatgcggttgggtgatgaggaggacaggcattgtgtctgacatcaatatgagtaatacagtctctcctgaactgaagaaattggtactggacaaactgttcgaggtagcaagcacccggagtgtaagtgattactgggactgggatttcagcaagtaccgtggcatgtggttgcagtggtggctgcaggaggggagaatccaagctgacatagctcaaggaatactaactgatggcataaccgacactgacttgtattttccaatgacagtcattgtttggcacatcgcgacggagatgtgctggttcgccgacgaggatgactattccccatgcagggccccgagcatggagctgtcaaggtatgtcatgtacctcgttgcaaaacgggatgtgatgagtggcagcaatggacactttgagcttggcaaggcacgccgccaggtgaagcgcatccttgaaggacggggtatcagtgatgagagggggctcctgaagtatgcacgacaggcaaccggccaggtgaccgaaccatgcttcggtcgtggccgggcaatctctgagcaccttctcaaaataagcaacagagctctgcgctgggagctaatctccatgctgtggatcgagatgttgtgctatcttggacccaattgcggggctcagttccatgccaagcatttgagcactggtggtgagtttgtcacgcatgtcaggatcctactggttgttcttggcattccttttctcaggtctgacatgaaaccagggaaattctgagaaagaaactaatgattgcgcctgcagctttgtttcgagaaaacccctttgtatgtgtgtcactatgtatttatgttagcttgggctgtttgttccagtcgtatgtatctttgcataaacctaagtttcagaaaatgcctgattttctattatctaaagtatttacttggttctgttgatttgttgtttgttgtaagttcaaatcttgtgttccttatgctaaagctgctttcctcctgtctgatacgtcttagaaggtacgaatgattactctggcagtagaaaattttcactgcaaaattttagttatatctatagataatttttcgagttatggaaattaatttgtattctgtatcatctaggagtctctctctctctctctctgtgtagtgctatgtttaacttctcatggttgatctatttagagtttggaggatgttgaaacagatatgcaaacctcatacctgcaaactgtattcgattttcctgattctgtagattaacaaagaaatatgactgaatggagcatggctcactgttcttcgcctttttatatttaactaatccctctacttctccaaatagagggagggaagagacaagagtcgatcgtatgccaaaacattgactcttggcacgaaatgcgagagaaaacatacacagagccatcgtttggcttattcgtggaataagcgaaacgacatatttacaaacgaaaagtaatttgtgaataaaacttttatatacgtgtccttaatgatctaaaagcaaaggctgaaaaataaacttcgatgaaaaaaccttaaaatcagctctacatttaaggttgaaaattcaaattttagtcgataagtataaacataagcgaaaagatgatggccatatagtcctgcatagtagtaaaaaaagttaattagggaatagataagtgtgtgttttgagttgttaacatatttgtggatagctgtttgatgatgcgtactaattaagagctcaaatcaagctcaaccgttgaacatgcccttatcaggacgaatgttgcatatctactctctccgtctcaaaataaaccaacctctcgtacggtcgtactggatgtgacacatcctagtaccagattcaccatactaggatgtgtcacatgccgtacgatgttggtttatattaggattaggatgttggtttattttgggatggagagagtaccaggcattcgttgacaagatattgatcgatcacggtcctgcagcccaagagtataagcacagtacctggtgacagtctgtcagaaggaactgattttccagagaatcaagcttgagtgtacttatggcgtactttggtggcagtaatagagttctctgatccagaatgacctttttgattagctttgtagtatggcgtgagccggacaaaaggatcggaggttgttaaggcgtgagcaggagggaaggaagatgctactacgcagtagcactggtatatgtaatcggaagatccatcaattggcactaatctttcatcctagctaatcccattcctctgggtataatctcgcattctccaattccctaatcctccattcttgctgtaatctgcctcggagtctttgcataatttcgaccatggacgacgttggaggttagtcgatttttttttaaaaaaaaattcgcaggtgaattgtgaattaaatgtacgtcctgataactacagctgagaagcaaagacagcaacattctactggtcctaccggctagctcctcctggtcgttcctctcgcagagaccgcaatagcggctgacaagttgtagcagcgctctggttgcagtcatgagcggcatgaggtgatattccatctttcttagtactagtacattgttactccctccatctataaagacatatattattgtgaacgtaaaattagaaattagaaaatatactagtgaggagcactttttttctcgtaaagataaagattttacctcggttttcgttagtatgcttttcaaaccacaaaatgaaaacgttttatatgaaagttcctttaaagtatcaaatatatccatttttcacgtttctaataaataaaactcaattaatcacacgttaatgactttctcttttgcgtgcccgcttttaatcttcatattcagaagatttgaacgggcataagtctttaagatcaaaatctaactaaactaaacaagtgttactccctctgtcccaaattataaggactatatttttttacacggtcttcaataacatactttgactagtattttatttcattctatgatcccaacaaatatgaaattatagcatcatatgaaagtacttcaaaatatgaatctagtgatataacatgcataatactaagtatacatatagctagtatgattattagtcaaaagctaccgagtttgatttttcttaaaaaaaaggcgctctataatttgagacggagggagtatgatgggtaggtgtcacaccttatgccctagaatatttttggagttgtcaacaactgcttgaatagattggaacataaaaagactgatccatacttcaatggacataaagatacttagagagacaaaaaaaattgcacgaaaatatttggaatttctattaatgcagttgtacagtttctaaacaaagaaactaatgtagatctttggccctttgatcagctcactggcacgtgccctgcaactctggaacgagtgggagatccagtgcctggtactagcgagcttcagcttgcaagtcttcctccacttgttctcaagcactcgcaaggctaacacctcccgtgttctaagctttcttctctggctggcctacttgtcagccgactacattgcgaccttcacactagggcgtctggcgctctacgttggcgatccacaccatcatcagctcgtgctcctctggacgcctctcctgctgctgcaccttggtagccaggagacgatctctgccttctccattgaggatgcaatgctgtggaagcgtcacctcctcggtctcgtcacccaagtggccctagcgatctacatcatggtcaagtcatggcacccggacaagcagctcttggcgccattggtgctgatgttcatctctggaacaatcaagtatgtcgagagaatattggttctcatggcagctagcagggcgatggagccaggaggtgattctgtggcagatcatgtgatggatgtacaagatgatgttatcatcgatgccaagtcctatttccgagagctgcataatattttcccggggaaggaagtgcaggatctagatgtccgtgatggaagaataagagaagctgatgaagcttaccagggcctggtgatggctgccggcgagggccttcggatatgcctaggttttctgactgacatgacccctttcctggtatggtcgtctaaagaagacactatcattgagagaaccgtcgagaagcttcgtagttcagatcccgacacacaggtggagatggcttataagctggttgagatccaactctcactgatctatgactacatgtacactaagtatggggcgcttcagttccgccttggccttgtctacagcgtaatcgcccggctgattacgttttgctcaacctcggtagccctaaggttgtttgtagggaccgatctaaaggggccattcaactacagaagagaagatgcaatggtgtcctatgtactgctagttggtgctgtcaccctggacatatcctccatcttcaagctcatctcatcatattggttgcagttacaccaaacaggtggcttgtttggctgtgttttcagccttgtcagatttgttaatccatggagcaaacccctctggtcggagaagataccgcagtataacctgatcgacgcatgcatccaagaagaacgtggcagcataatatgcggatgggtagtgaggaagacgggtatcatgcctgacatcgacatgagtaagacggtctctcctgaactgaaaaagctcgtattggacaaattgactgaggttgccaccacccgtagtgtaagtgactactgggactgggattccagcaagtacagtggcatgtggttgcagtggtggctgcaggaggggagaatccaagatgacattgctcaagggatactaaccgatggcatcatcgataccgtcttgtattttccaatgaccgtcattgtttggcacatcgcgacggagatgtgctggttcgccgacaaggatgatcgctccccgtgcagggttccgagcatggagctgtcgagatatgtaatgtacctcgtcgtgaagcgtgacgtgatgagtggcaccaatgggcattttcggcttggtaaggcacgccgcctgctgaagcgcatcattcgagcttccaccgtccatgatgagaagacactcttgcggtatgtgcggcagtcacccggggtgactgagccatgctttagtcgtggccgtgtgatcaccgatcaccttctcaagataagcaacggagctcagcgttgggagctcatctccatggtgtggattgagatgctgtgctaccttggaccaaactgtggggctcagttccatgccaagcatctcagcactggtggcgagttcgtcacacatgtcaggatcctactggttattcttggcattccttttctaaggtcggacatgaaaccaggaaagttttgattaaaccaattcaagtttgtttcgagaaattctcttgtatgtatgtaactatgtatacagtggtggagcctgctagaagtttatatgaatggagccacacctatagggttcaactctattttcttacccaaattctctacaaattcatacacttttctgaaatttatatgaatggatctcaggcctagggtttgagccatagctgtccaaggcctggatccgcccctgtatgtgtatatgtatgttagctcggactatcgctgccagcgccatttgcatcttcatataaacttaagtttcagaagttgcatggtttctattatctaaggtatttccttggttctgttgatttgtttgttaattagtacaaaccttgtgttcttatgctaaaactgcttttctcatgtctgatattttgtctagcaactttctatcaagaattctttcgatcattttgcaattgaattctttttcaaattgaggttcatattttcttactttcttagctcccttttgattattgatgcgaggcaaacaaaaatttttcttttttcaaagtcatatgggctcttagcagcctagtgacatgatcttaagacatatggcactactacaaaatcgattttcgcaggcagtcagaatcgattttcacaagcggctagacggtccgcatcctggagtctacccgtgtggtcagcacaaccgcatttttgcatgcggtcaccaataccgaccgcacgcgaaaaaaatttcagcgaaaaaaataaaaattccaaaacaccaaatccgccgaaaccctagcatgccgccgattgaaaccctaacgttgccgtggccggcaccaccgccatcgtggtgctcaccatagtccgctactgtcgacgttgtcgccgtagtagtcaacgaggactggggccggggaggcggatccgcccctcccgagggcggcggcgctggatccgctgtccgtcatcgcgcccctcatggggccaaggacggcaccaccctcgccgcctgcagttgtcgtcactaattcctttccctagggcgtcggatccgtccctcctgaggacagcggtgacggattgaccgccaccgcctccctccaccattgtgagtgtgtcgtcgtcactcttgccgtagtcgccgccggcgccattcctgaaaaagcccatcaccgccagccggaggtgagaagataaggatgaggatgcgagaaggtgagacagagaaggtggcttgaaaaaaattgaagatgttgatagggagggggaaattagacttgaatcgggtatttaagagactcgcctgcgaaattgcattattgcatgtagtcgctaaagaggtctgcctgtgaaaataaatctatttttgcaggcaggcctctttaagtggctgcctgcaataatgcattttcgcaggtagccttgaaccaatacaatggggagcaatttttgcatgcgggacatttatggtctgtctacaacctatagggggcctagtccacaaaaatcgataacatagtagtgtggcttgctaatgtaaaaacaaaaaaaatgtgttacgaccgacctatttgaacaaagtacgccttgagtcaagttgttgcagtaggaggctctagatcgctccaatttgtcaaactatttccattaccgcaatttacttttcaaaatattatatagtcgcttagctcacatggaaaggcatgcggtctaaatttgataatgctgaagcacttccagcttttgaccaagcaagtaaactaacaggtgatgcagataatactaataatatgatgacaagctgtcattgcaagaaaataaatttggcaacacatagtagcatgtaatcagcatcccccatcgaccatttgacacaggagggtacataaagaaaataataatttagcccgcagcaataactcttcaagttctcatcttctttggttagagtcatctgcaaatttagaaaaagagtgaaatgcactatggaccactcctttttacaagttttccatatttgtattagcgtgtatcaatcttttctctttgatctcacattaaaccagatttcttcttcatctctcctctcccatttttcttcattgttgagatgagccattgccgcccagctcaagcacggctcgtgtggccgtgccactcggaatggcacttacgttcaaacactgttcaccttcggctagatttggaaggagctagtaaaagaagaaagtattatgctcataggggatgaacagcagatgacaatgatcatccccaacttgagtggctcgatcagtcaatctgaaggggaggaaaggctagaaatgatataggatcttcgataggaagcccaatctcacctttatctgcatcctagagctgctcgagcatgacggcgtctcgtatgaagtgcaatctagcaaaacgagtggcttcgagtccaaacatgatatccatgtggtgacgagcaatgctacgacccttgtgtcgtgtgggcaggctgacggcgatggctgggtcgaggattgatcactagtgtggcagtgtctcgtgcattcgagattcggcctctacaaagaaaaaatcttccgtggccatcgtgtttggccaattggttctatggagaagatagaatgaagaggagcagcatagccatgaggagagggacatagaccaaagtgaaaccattggcaaagctaagtaagataaaagtctaggttgaatcctagcttaatctgcagaagatgtaaaaaataggttacctaatgtgcaatttactctttagaaaaacaagaaaagagtgaaaaagatgtttctattttagcaatgcaagatccccacaagaagaaaacatactctacatatagaaagaaggaaaaagtctaaatatccccctaaactttagatagatgtccgcctagcaccctaaactttaaaaccggacatccaacccccataaactttgcaaaaccgttcatattaccctctatagtggtttttatctcattcgtatacaaattggatgagtttgatcacttgacatacacattggacatatatattaaaatctccacttaaatctttctttttaccagttgttagctctcacttacaaacaagtaccaacataataatagtacggtgatatgtatagattgatgacttacaactgatgatatgcaaatatgttatattagttatttaaagttgttcgtttaaggttttaaaatatgaaaaaccaccatccaaaaccaccttagggggtaattccgcgctgggtttaaattctgatttgaattgtggccggtgtttgggggtgggccatttgaaagctaactgtcctgggcctttgtgctatcaggcttgctgtcttcttagtcacttggctcgtttctgccatgccctttaaaggcccaaaagaaagaagatttatctattccgaataatctgtataatcggagtaattttgtttggagagctaaaaaggttcctaatactactgcaagagtttctcccattatctcttcacctaccaaagctgttcttcctcaagtttccaatctacagagctcttcttcaccgccggagatggctaatgtcaaccccaaccctcaccgtttcctccgacaaggccacattgttcacttgggtggtaatcttagagttccacgtgttgatcttactacccttgagaggcccccttgttgtcatgaagattgactttgctcctttagtggacagagtggagagaaggctaacagctagctcagcattcttaccccagggtggtaggctgacacctatcaactatgttctttttgcagtccccacatgctatatgtgttctcttaaattgcctttaactatcattaaggccattgatacaacaagaaaggattgtttgtggagaggaaatgacccaacttccaccagaaaatctctagcttcctgggagctagtgtgtaggccaaaggacaagggtggcctaggggtgataaatctaagaacacagaacattgctcttttgttgaaacacttagacaagttctacagaaatgttgatcttccttgggtggatctcatatggaaatcttattacacctcaaagcctccccactcaattgccaacaaaggttcattttggtggaaagatattgtctatcttgctgatgttttcagagggattgttcagtgcacagtgcaaacaggaacctatgtgctcttttggagggacctgtggaatggggaacttaaatgatataagtttcctaatctttttttggcagcttataacaaagaggaatatgttggcatggcttgctcaaggcctttagaagatgctttcatgcttccttttaatactgaagcttatggggaatttttagtgttgaaatctgatcttgacagtgttcatttaaatgaggggtttggtgatcattggagttatatttggaatattgataagtattcagctcaaagattatacaaaatgaattactcatgcctacaaccctcaaggctgcttgtttggatctggaagacaaagtgtgtgatcaaaatcaaagtgtttgcttggctcctctctttagatagatttaatacaagggacatgttggatcgcaggcactgtgctaaggagaatgatgatctcacatgtgttctttgctatggggatttaagagaaacaaaactgcacatcttctttgcttgtccttatagcctccgatgttggcagcttttgggtttccattggtttctcaatttaaatttcttccagatggttgttctagcaagaaatcgctttggtatgaagggctttctggagatcttctttatagctgcctggtacatttggaaacaaagaaatggcatgatttttcagaatgttcctctgacttttcatggatggaaagttcagttcaggaaagaacttcttctacatatgtgtagaatgaaggagcctctcaagcaattagtttttgattggttacaaactatgtaattattttgtgggttcctgcttctccttgtaagatgtaaatattttccaatttttataaaagctatattgttgggctaatacctggcagtaatttatgtcaagaaaaaaatgaatgattttacaaagtttagggggttagatatatccggttttaaagtttagggtgctagacggacttccatccaaagtttaagggagtatttggattttttcctagaaagaaagtatttttttctcatcaattatggatattagtcattggccacatggttggttagacagatggactctcatagtatttggtgatagcatatcctcaaagccacttatatgctagtgagaaacttaggtgaacataatataaggcatcaaatttctaaggcatatggcatccttcaataccttcaactcggttttcttgctccacctctcgatgttgggagtttctctggttggtggtgttcaatctcttaaaatgttgtcaaacttgtttcttgggtgttgtggacgcaccgcaattatgttgtcttcatttctgtctttcctgattcaaatcaagtattgtgggcagttaaagagaatggtgccttgtggtgcactgtgggccgggtagggctggatattgagctagctcggtttgagctagctcattaggataacgagctggttcagctcagctcattttcttaatgagctaaaaacctggcatggctcatctcctgtctcgagccaactcatttagcccgcgagccaagtgatgcagatggtgagatggcgaccatgacgcttggcgaagcaaccaggaagctagcgtcatgatgatgttggagttggtcatgtggggatgtggatgagtagcgatggactccggcagctggtgctaccgtggtgcttctacgagtggtgctggagcctagggcgatgggccgacgatgaggaagcgaggaagagtcctagcaaagggcggccacgatttgttgaagtgggacggttggaacctagaagcgggctaggccgctagtgctagcggcacaaacccacgaccgcattggcgccaacaccaagagatggcggcaacgctggggagggacaagggaacatggatcgatgcactgggccaacgcttccctcctgccacaccattggctgcatctctgccaaccgtcacctccctactcgttgctgacgaattcccctcatgactgccattcttcatttgttcattaggtgatgccactcgatccggcgaccacaagcttgatggtgaacttagcaagtggcatgccagtgataggagatattagcgaggtgtttctttttttctttcttttttgtctgaatgttgtatttctttctatgcacaagcaacaacccgggtagataagggaaatagacatactatgaactagttgggccaggttggtggcgacctatgccacagccttgatgtttgtcctgggttgtggcttgatgttttttttttggatttcaaagggtttctcccacccaaaaaattagccaatgaggtgaggggctaacaccccacaaataattaggggaaaaagagaaaacaaaaaggaaagagataaaaagaaaagagagcaaagctagctagtagtccagcccacagcagcaagcagcccagcagtagtagcagctcgtgacattgtaacagcctgaaaacactatagcgccgagtataatagctaaggagcagcagcttataaggtggagatgcctgagggctattaactccaatccagattttttgcgtgaaagcggggacgaaaacgcaagagagttgatattgtaggtgtggtccaactggatgagatggactcaataccgttttcgcgccctgggtgtcacagatggtattagagccgacccttgcagctatacgtatatttgaacatgtacgcaggcatacaggatgatccctaagtggtcgtatgacatgacgtatgtgcaccgaaaattgtatgtatatacgtgctactaataggggaagttcctggttaaatttgaagcctaggtatagaatgagtttggcggggacgtcgaatctttgagtatggatgtatgtaacgccccacaaataattagagttaaaagagaaaagagaaagaaaagagggaaaaagaaaaaaaaagagcaaagttagctagcagcccagcggaagattgaaaactcattttgcttctcactaccttttgcttctgaggctcactaaatgtaaagaggcacttgccaccaccgtagttaccaatcgatggaaaggttgcaccaatgatctgcggcaccaagcaagggccattgttcaagaaatcagtggtgaggacttttgggttaaagttgagaatatttttactatcacagagcacatatatgaagtattaaggttcaatgatggggaacgtccaaaaatgggtgagatctatagagaatggattgtatggttggagagataaaggatatcataatgaaagatgacaatccatacaaaagtttcttccagaggtagagaacatagtcattgaacgttggaaaaagatgagtgttcaacttcactgtttggcttatgctgtttgcccaaggttttatgatcaagattatcttcaaaaacctgctcccggtggcacaataaggagagcaccgaatcaagatgttgaggccatgacaggtgtgctaaaagcatttgagagaatagtagataataaagatgaggaaaaagtccttcgcgagcaactcaatgactttattatgaagaagggattttttgcactagaatctgtgtaggtggatgcagaaacgatggaactagttgagtggtagagcagctatggatccgagacatcagaattgacagaggttgccaaaatggttctcttgcaacctattagtggttcatccgctgagaggatttgggccacttatcagtacatccatagtgcaaagagaaacaatctaaatgccacaaacgcggataagcttgtgtcaatccactcaaacttacctcttctatcaagatatactcaaagctataaaggagggcctaacgccaagttggatatagatcccgaagactccacaatctaagtggttggaaatgcacagaaatcataagttaactgattgtttatttatttgtttttcataccttggtaataatgttcatatatattgttatgtgtttacatgaacatggaaagatcatatgagtgctaccgcagaaaagaccttcatggtgatgttgtggatcatgatgcttgccgccagcaaccacccacatctataattttatatatatgaagctcaatttgtgatctttctcctttcatccactgctagagcatattggtttatatactttttcattgtaataatttattctgagaacttctattacactttgctataaacttgagttaagttacttgttaaaaaaaatgattggaacaatattcttgactagggttccacgttccatgctattgttccaacaaatataggaacatattcctctagtagggtataccgttctggattatcattccgaacaacctagaaacatgttccatctatagttccgtagagttttggattatccttccaaaaaacctaggaacatgtcccacctatagttccataaaattggaagaggtatacccctctcattccatgattttggaaaatggcgtcccccgttccacgtttcagttcctggatccatcgatccaagaacttttgtgacttaggcctagtccacagcagcaagcaatcccaccagcagttgtagcagctcgtggcactgtagtagcctaaaaacactgtggcgtcgagaataatatctgaggagcagctgttataaggtgaagatgccttagggctattaactccaatccagattttttgcgtgaaagcgagg

SEQ ID NO: 37403 - DNA, 3090 bp, Oryza sativa
tagggcggtcaggagagggaatattccacgaatatgttggatgagtgcatgtgcttctggtcaaattgggtagatgaggatatccacccttactagtcttgactgttagtaattaatcagtgataattactatattctgttgttaattagtaattaacttgtcaaaaatagtgttgataagatataattagtctattttatggccaattagtatagtttggggtaaggttaacgataactaacatatgtcattgttacttaatagtttattgttttcattctattcaccctcattcatctaaccatacaaaaactagatggttgtatccactcaactaaacaaaatatggatcaccatatccctcaaatatggatcgccattattgtatccaaccttgaccatcaactaaaagcaccctcagctcatgagctactcgcaagccagctcaagatggctcgagcaaacaaaccatgagtttttcatccagccctagggccgaggtgaaataacttctaagttaggggtccttgaacttgtttaggctttgctggcaagtggtctaggtcattttgtttgctagcaagttcattgtctttctatccttttgtttatttttgagttttgtacttttttttcctattctttgatgaaataatatgcagttctcctatgtattcgagaaaaaaggtatagaaggaaaaaatcacttggttttgtttttgtgttttaaccaccaatctggataaaacccatctctcaactttctcaaattagttgatactcatcccttatacttccattattcttgttgacaatggttttcttaccactgttgaactaatctaaataaatttgggcaatctacatttctagcccttaaattttgctcaatatctacttcttattctaacctaaaaagcaggttattttttgtccccaattttctgaactagacaaaataacccctcagagtatttttaagtagttgtgtataaaatggaggtggttatacttgttcataattttattttgttgacatatgtgtgacttaattaattcacaagcattaaacttacctaattaaagttcgccttagcataaaattcactattgtaccaatcaaaattaccataaatgtgtttagggtgtcatggccccaactttttaaactgacacatatcttgctaaacttttcgtgtaaagcaggatgtgatgttgagtagaacagaaccatggaagaagtagtactatatgtgggactagctggatgatgatgtgactccatggaatcctttcttactataaagttgtaacgcactaattcctaaaacttaacatgcaaagatgccacatcataaccctttaacaattattatatttaagcatcatgcaagcatctacgttacctggatactcctctcaggcctcgtatccgtatcggatacgaggccggatacggatacgtatcggatacgccccgatacgtatcccgtacatatcctctcttttcttgattttcaaataaataaaaaaattcccgatacatctctgatatgttcaaaacctaaatccatcgatcaaatccccagcctgcatcgagcgaaccaaattccacagtccacaccaccagcgccgcctccccaagccctgattctgctcgctctctcctgcgtggctgcgtcgtcgccggctcgccgcgtcagcgccaccgtcgtccaccgtcgccgggccgcgcctccgtcgtccgcggccgccacgccgcgcttccgccgtcgccggcttgccgcgtcggcgccaccgccgtccactgtcgccgggccacgcctccgccatccgcggccacagcgccgcgcttccgccgtcgccggctcgtcgcgtcggcaccggcgccgccgccgtccaccgtagccgggctgcgcctccgccgtctgcagccgtagcgccgggcctctgccgtccgctgtcggctctgccaggcgcagctctatcgtgaagggaaagaactcgatgagcattcttcctttttctttcatgtgaatgagatcttacactctcgatgggcaaaaaatagtactcccctgcattgcttggcacactcactaaaccccaataaagttctaattcattttgttttttttccatatcttgtaatagttgctagcagcttgattttttttttacaatgtgtaggtattattgtgaaacttggtcggaggatgttccaactagccaaggctctcatatggatgcagagattttagaaatgagaaataaatgttttagaaggtatttctctgaggatgacttaagaaggatcaaacaacagtttgcagatttttcattgtctgagagtgggtttaattcctttgactcaattgaagatagagcccataatggaatctgatggttggtcgcttggtgttggcatgctctgctctgctaattgtctagtttactcttcaattttttttgtattttttaatatatatatatatatatattaatatatatatacgcgtatccccgtatcgccgtatctgggttactgggtaacataggcaagcatatgctatattatctataattttataaaagcttaacatgcaaagatgccacatcattatccactaacaattattacatttaaacatcatgcaagcatgctgtattatctataactctataaaagcctaacatgcaaagatgccatatcatcattcactaacaattattacatttaagtattatgcaagcactctatattatctataactttatagtttattaaattttagagatataaaatgtaagcatgttaaatcattccacataatttacataatatttcaatatatctctccatcatttttttaatattctatatatctatatagtttatcctcacttggttaaatattatttctcttttctctcattaagccataccacatcaattgttttagcccttggatatatgcataaattatcttccttctcttgttctctcataaagccacatcatcttacttttaaatttgaatcatcattctatatactatttaaatttaaatcatatcaacttatgtaaa

SEQ ID NO: 37404 - DNA, 13567 bp, Oryza sativa
  unsure (1)..(13567): unsure at all n locations
nnnnnnnnnnnnnnnnnnnnnnnnnnnnnnnnnnnnnnnnnnnnnnnnnnnnnnnnatgggccgcacgaacaatatgcacgagacgttcgtagtctaccattttataccgaaaataaaaacgaaacgagacgtattcgcccacagtaactgcctgacgatgggcctcttacgtcgtgtaagcaaccgcaacgttcgtcccccaaaactacacccacagtccctgaccaatggactccacccatccgggaaccatccgggcccaccatgtcagtgactgcctacgacacccccctcggagaaaaaatccctcgcacacggatcgcctccggcgaggagaactagttgctttcttccacctcgtctcctcccccccctcccctctctctgaacccgtcgccctcgcctccccgtggaccgccccccgagacgccccccctccgccgcgccgcccaccggagcgggcgcgcatcggacccccctcctagcccgcggagttcaccgtcagccgggccaccgcgatgtcgcgcggcggcggcgggtgctgcccgtcgatggatctgatgcggtcggaggcgatgcagctggtgcaggtcatcatcccggcggagtccgcgcacctcgccgtctcctacctcggcgacctcggcctcctccagttcaaagacgtacgcaccgctcgctcgctcgctcgctttcgatttcgatccatttttgcgcctctggacggtgtgtttctcgatcgagggggtgggggatttgttagggtttgtggcgtggtgttcctcctcctcccgcacggatctggcgtggatcctctagggttttggggctccggtaccgtgatcgcctagccagaatgagtaggacggtaattaaggtttctgatgcgccaattagagtccaggaggtgaatggatggatgtgtggatgctatttgtgaaatacggtgggagtttcgcaaattggtagtggtgatcgcagagtagttagttagatgaggtgatcttaagtggcagtttaacatgggcgatcctgttgctaattatagggtgactcttgatgagctaaagatagcaggtaggatgcttcaaattgtcgaaatggttaaaacagttttgtgacagttgtacgaattatttttctgctaaaagggatgtcttgacaaaaaccaaattggaaacatttctgcagaaaattaataataataataagaattccaacagttactttgctattacatttttcatattccatattgatgtaaatcttgttagtagagatcttatatattgttttccctaactgatttaaatgttttaggtgatgcaagatatatagaatgatatgatgctacgaatgaatataaatatcctttccaaaagatcaattgaaacactaatggttttcaagttaacaattacctagtttatgtcccaatgatacatttacaatacattaaaaatttgagataatggtttgacacatttttttctggaaatcctttcatggcagtcctatcatgtgaataataataaggaatctaaggcaaacttactttattgttgctaccaataatacctaaaacctatgggcacagggtactggaaactgctattgggtcatgccatgcctttctagttctgttgtatggtggtttagcctggattgatctgacatttgtttattgcttcagcttaatgccgacaaaagcccattccagcggacttatgcttcccaggtactcttatcttctgtgtttgttttgtcttctctctgatgtcatgctgtgttttatgatcttatatctagctggtttatcaatagaaacgattgtttgaatacccaaaaaagcttgtagtctattctattttacccagtcatgaaaaaatgttttggacatcgacatggtttaaaaatgaagctttgaccactatttccattataacatatttatattactcaataaaactacattactctgaaaatttgagacaaaaatacacatgattttcatacatccagcctaagtaagtttggaaaaaaaaagcccagagcatgaaaagtatagttggatgccaaagtttggaaattgcatgtcaaaaagacatgttttcatgaccagagggaatatatacttcagtgagagtgctgttgttggaaagagtacctattgtgaatgcctaactttgagcaagtaatgagaagacttattttgctatcaatttctatcatcaattcaatttttaaaactaattgtaagatttgacccctctatatattccactatgtctatttgcaatcaattatgcacacacgaaatatgtccacttgaggcaccctagacgtaatcgtcttgtgctggttgacattttttagattagtctcttgggaattgactaactcttttactttatgttgtgttgcaaatcttaacattttgttttacaaatgcatgctgtcctatgaatatttaccatcttactgttctgcctatactttacaccctgcaaagatcaagaggtgtggtgaaatggctcgcaagttgcggttttttagggaacaaatgtcaaaagctgccatagcaacttctacacaattttcagggacttctttggaaattgatgatttagaggtatttagcaaagaaccatacaccattatcttgtgcaaattgtgtataatgaattttgctctaaccttgtgaaacaaacaggtcaaacttggagaactagaagttgagctgactgaagttaatgcaaataatgacaagttacagaggacatacaacgagctggtggagtacaacattgttctgcagaaggtttgattctagctaatagcatcaattcttagttagtgacaagtgaaaagagctaggttcttaaaattatcattaggtggaactctggaaagcacaaaaaggaaaaaaaaagtgcatgccagtaaaatcttgaataaaggagaattgttctgctcataccactattcggttcacatatttattttaaacacggaaaattagtaatatacactctcttgcaatttgttcttttacatgtcttgaagtttagcagctgatcttcgattataggtagaaagctacaaagataaaatatatagtcactgatgtgtctttctccaaaaaccatctcattattttgacaagttttggcacatggttcaattttttttttggggttctcattttctaaatcaaattttaactttgcctagaagcaggtcccagagtgcttttgtgatgtagtccaaggctatttctcttaactacatgttcccacccagccagtttgcgatgccttgtttgccttactatgagtttccaggcagtccttgtctccttttctcttccatgcgcggatgtgcctagcctttaacctaagtatgtatcttgtgatttttactacactggatattagctcgttctcttttatgatggatcaaacttgatgctcccttttgtgctgctttttgtacttgcacatgttcatggtgaaggatatttttcaacattactataaattcctccttactgttttatagcacaatatacatagttaaccatactttaaccattcttggaccacttagtactgtgtttttgactcttgatatttgctttcaggctggtgaatttttctattcagctcaacgaagtgcaacagaacaacagagggaaatgtcagcagatcaatctggcgattcttctctggagagtcctttattgcagcaggcataaaccataactctagaaagcaatatcttagatttctttctgtgttctcctggagccccccttgatggtctttttccttatttcaggaaatggtgacagatccatcaaaacaagtgaagcttggttccctgagcggtcttgtgccgaaggaaaaggctatggcctttgaacgcatacttttccgtgctactaggggtaacatgttccttagacaagaacctgtcgatgaaactgtcactgatccattatctggagaaaaggtcactatctctaatatcccttcgctggaaatttatggaatatttctaatattttttaatattatcctgtttcccatttttgtttctgcattgaagacagctgtaatcatttcaatcattttaatgagtgaaagatgcacctaatgagcatactatagggcacactgtaaaaagcttaagtgacatgtatctgtaaaacattagttttacaaatttatttttcctgctagttttattattctgaagttcagttgttctttctctcttttgaatgcttgtactatattgacaggtcattaaaaatgcatttgttatattctactctggggagagagcaaaatccaagattgtgaaaatatgtgatgcttttggtgccaaccgttacccatttccagaagatctaggcaaacagctgcagactattcaggaggtatgacacgccacacttgttgtcttcattttgatcttgttgcagtagttctatgagattttaattttctttttgtgtctccaaaatgtaagctgtttttttctcatctgaaaaatagttgattgcttgctgtagcctgaaacttgaaagaatttcatgccagatgattcttgatgtgggaatttctttatgtattaatctttcatgttggatgagatagttcctcttattttgtttattcacactattcatgcttaaattgatctctttttgtttccaactgcatttttcaaaacatatgttttatagcaattgtataatttaagtcagagttattgtctgttctgaaatatttgcaactctgtatttttataggtatctggaaaaatatcagagttgaaggcaactattgaaataggtttagctcaccgtgacagcatacttaaaaatatttcttccgagtttgagcaatggaacaccctggtaagcttgtattattcaagatgttttctgtaaattccctaccccacaaattttcaacctatactatttgaataacttttacgtctgtatattttcttttgcttgaatttaagttcttttgtgttttttatacaaatgtgccaggtaaagaaagaaaaagctatttaccacacattaaacatgttgagtcttgatgtgacaaagaaatgcttggttgctgagggatggagtccggtgtttgcaacaagtcaggtaaccagatgcactctcatccttctgcacttttttcttttgtctattgacacatttttagttttctatctgttttctggttttcattttctttatttcagatccaagatgcacttcagcgtgctactgttgatagcaaatcccaagttggttcaattttccaagttctcaacacacaagaatctcctccaacatttttccagacaaataaatttacttctgcattccaggagattgtggatgcctatgggtaagctcaagaagcatagtgctgagacacttactcttatctattccatgatttggatgatttattttgtctttatatttttcttaaaaaatattttagctttttataatacatttcttgattccttagagctattgtgtatcgttgctgtttatttcaggggtgcagtttccacacataaatcaatcctaaatgttataattcatgatacactcatagtaaacatctcaaaaccattgtaggttgcaatttttttgcttgtcattttggcaacttttgctttgtacttttaaaaatgttctttattaacttgcatgctacatgaagtacataatgagcatatacagatataaacggattataaatgtgttgtgagttgtgactttaagttataaaatctatgccaatacaaattctgctaaaaatgtgaattattctgatgtggtattattataattaaagagatagctagttttaaataatgagttgtgagttgtgactataaataaagtaaatttttaccttaaactaatatttttagttttactccttagtcatcaaagaaagatattcatggcttattagcagctaccaagaaaaaaaaattagttcttttacaatactaccctttgaactcacctccattgggaatttgggatcataacttgctgtattgaatacctggtgttgtttacttattaagaagtgcataataggggcctaagtggccaaatccaaacaaagttttgtgtactaaggccctgattggtacagctccagctccagctctagttccacctctcttggagctggagctcagccaaacagtttcagctccacctaaaatgggagcggagctaggtggagtgctctcacaaaatgaactagagatgtggagctgggttttggctgctctacaactccactccagacccaattcctggagctaaattttggagttggggctctaccaaacagggcctaagtgagaggcccccaaacaacttcactccttacaggagggagtatatgatagcataaaggactcaaatcatgtactatacattgtttgtatactaatattatgttaaaacattggctgcaggattgccaagtatcaagaagcgaatcctggtgtctttaccattgtaacatttcctttcttatttgctatcatgttcggagactggggccatggaatttgtttactacttgcaacactgtacctcataatcagagagaagaagctagcttcacaggttctcttgacagccttcattataattttattactgtggatgtcactgttactattaccctgttgaaattatcttagggattatatatactcccctaaagattaattaattaagcctaaagagaaagattaactacaagaagacattccattgctcctttattttctgtcagttttggatgcatacgtatcctggaacttagtttctaataactttgaatttggctttccagaaactggatgatataatggatatgatgtttggtggtcgctacgtgattttgatgatgtcactcttttcaatttacactgggttgatatacaacgaatttttctcagtcccatttgaactctttggtaaatctgcctatgcgtgccgtgatccttcttgtgggtaaggagcttttgaactgctaatttgcaaaccttatttgatgcctttctaaaatttaatgttctgccattgttttatagagatgctactacagaaggattaattaaggtgaggccagcatattcgtttggcgtcgatcctgtatggcatggtagccgcagtgagctgccttttcttaactccttgaagatgaagctgtctattcttattggagttgcacaaatgaaccttggaataatgatgagttactttaacgcaaagtttttcagaaatgctattaatgtttggtaagtaagaatcttctatggaatatgccatgattgagttgtatgacaataagattacatatgatacatgatatttttttagaactattatattgttttacttaaaacagtaggccattctcattcagttgtgtaactatgtaacaggtatcagtttattcctcagctgatattcttgaacagcttatttggttacctttcactcctcatcattattaagtggtgcacgggctcaaaagctgacctttaccatgtgatgatatatatgttcctgagtccaactgatgatcttggggagaacgagctatttcctgggcagaaactagtgcaggtttggccataatcattttttgctgctatatgttgattgtgttgtacatgcacaccgtattctgaacattttcttaatttcttatagcttgtactacttctgcttgctctggtttctgtgccttggatgctgattccgaaaccatttttcctgaagaagcaacatgagcaggtatgtgtttgcttgtctcagttgtgttcttaactgacttcccaccagagtttataaatacccggcttaatttctgtttttgctctgtattagaggcaccaaggccagcagtacaccatgcttcaggccactgatgaatcagtgacagagctagaagaacaccaggatgaccctcaccaccatgaggagtttgaattcagtgaagtctttgttcaccagctgatccacacaattgagtttgtgctcggtgcagtctcaaatacagcctcttaccttcgtctttgggctcttaggtacctctgaacttacatgatacataacaatgccacctcttaatgtcacatggaagaaattgacggttgagtaattctattgttcgtgcagtcttgcacactcggagctgtccactgtcttctacgagaaagttcttgttctatcatgggggtaggctgctctctattctactgttccttttctctctcacacaagttcgtgcgcgcacacatgctgacttgcttgctttctctgcaggtacaataacattttcatcctgatcattggagcagtgatctttctctttgccactattggtgtcttacttgtgatggagaccctaagtgcattcttgcatgctctgaggctccactgggtggagttccagaacaagttttacgagggtgatggatacaagtttgtaccctttgctttcgcatcaatcatcgaggaggaagattgaatctgaattgttgtatgtaatctagaatgtaaaatcgtaagagtccttcccttgaataatcattgtttatcaccattggtgaagattcagaaaaccccagttcgttgtgtctgagcaggggatgccaaatcattcttttttgcctacacgattagccatgctaggttattctgtatattatgatctgttattactttgagcggtgacaggagcggctgggacgaagttgcaaataagtctagtgcatagcataactgcctttttacatggtgctatgttaataaaagttctgtactcatggctgtgacacgagtgatgtgtcttttgaattacacttgtggaaataaataagttccattctttgtgattattatttcattgtagtggtttatcatccattgaccgtgaagctaaagtactaggactctggatttcactagaaatttggcgcacctgttggtgcgcctgttagatttagcccgttttgtattatttagagttaatatataatgagctttatgaaaatcattgtaaatcttgtaaaaaattatacattttatttaaatttcagcaaatagcttatatttatgtgttattttttgttgttaaaaatattattatttttctttcaaactataaataccataccttccactgtgtttgtagttctactttgtgattatatttcaacttctattgtacttccactgtgctttttatggaattaattcagctcccattgaatttctaccaagacttggaagaaacacttgatgggttattaatttgtaacttaacatgtataatagtagatttgttgaattgaaaaacctcaagattccctttgctagctctcatgagtctaaatcttggggttggatcgattggggcaccttccatattctggctcccatcggatggcctattcagccaaagaaaaagccaaattttgaatttttaaacttaattttgacattgattttaagatattttcaacgtagtttctttttcagcattggcttttaagtcaccgagaacacacatataaaagttttacctacaaatttatttttattttctaataagccgttttggcttattaaaagaaaagccaaacgatggggccctcttattggagctagtgacattcttattggagctagtgacattcttctagatcgcatctgttgccattttatatatgtagatctccttcataatacaatagcaaaacactaaatagtaaaataattagtgaagggaatttagcttccaacttaacctatgataaatcgaggttttctcattatccctgagaaccagaaatcttgatatttcccgtattaaacatattctattttttcgcatgaaagatacattataattttcaatagatttttttagtgatgtatggaacatagagagtttagtttatcttcatacatacagtgttggattcattttgtttctttcatcatctctaacgtaaagaagtagataaaaatagcttctatatgtatgtgatttattagatgtgatattagtaattttctagacatattacttaagcaactaaaaaaatatatagcgcaatatttttttttcttttgatattcttttgtccacttcaattgggaacttagtagaagttgatggggatgtgttgttgttgttgaagtcaaagaaaggaagaagtgcgagagaagagtatttgagacttttagcctagaaccctctagaagtttgtgctctcaaaagattttttttttcatatatgatcttatttacctgcaaatttagaggtgccaagtggtccaataggcttgcaggaaacctgccagctttagattagtagatttattgcagatgaaccttatgtgcaagaatcgtttgtcgactagactgaaaagatatcagagtaaaatgtattccttccatttcaaaatatagaaagttggataattttagaacgaaggtagtaattgtgattctcacaaaatgggtagaaattcttctgcaatcaaaactattttttttaaagaaaaaaaaatcatttttactccctcaaactaattcgatggatcacttaactccctgaacattttatcccccaaattattaaaaatggtttgttttactagaactactattagagcgcacttcgttcctagtattccgttcacattattatcggagtaaacgatttactttaataataaaaacaacttccctgcttcctattacaccccatgtctcgtcatcttgcttctagtattatcggagtaaatgatttacttcgataaaaacaagttacctccttattgtattttttcccgtacccaacttaacactcgcccccactttattttttccttttttttatctgaatcgatccaccatcccagcgcacagatcggtgatgcaccatggagtaggacgacgacaccgtggcggttgatggcagtggctagcggcggttgaggcgaaggcgctgcttcgggcctcgcagtcggacgccggtcagcaccttaactagcaaggaggtgctaagagcaacaaccgacgactgctccacgtcggcgacattgacaaaacaagcaagtgaggaaatgacactctgatttgcatctgcatactatccttcaccttcacgcatgaagctccaattttttttttacaaatcaaattaatgtgcaatctccaatattacttgatttgaattgatgagctactcaggtcctacatttgcacatcgtgcttcatgtggctgggtgcagaggatagggtggagtccgccgtgatggaggttgtttgctacttttcctttgctcgtcgtctctatgacatgaacaagaatgctttttgcatttttttttgcttgctagatgaaggatggctgctactgcgcaacgtcgagcccatctctataccacgctgctacatacttccatgattccatcattgactacagctcaccacccggttgccctctctactaccaatcacaagagacagatcaacctctttatccttattgcaaggtctagcaaagccaccaggatccctgtttcacgatggatttttggctgaatcatttttttcctttttggtttgattcacttgagagtaattttatcacttgtgcgtgattgtgcctgtaattttttttcatttgtacggccattttgtgatacagattaacaatattctcagtattagtttttactcctatactgtgacatcagtaaacatattactacacagtgactacgagatcatgggctatatcgagaggaacatggtaattgttttattcgtagaccacaaaatctaaataatatttataacattggtaaaataatttactactctctctgtccctaaatataggggattttggttggaagtgacgtattctactactataaatctggacagtgcacatgtccagattcatagtactaggatacgtcccatccgtccaaaaatcatttatattttggaacggagggagtagcgttctaagctggtagtaattttttacgaccatctaggaatggtgccgtatgatgtgggagtattcatgcaagtaaatttgttacttttgaatgagtagatgatggaggctgggagtaatggaaaactccacagagtaaattcgttacttttttgaaacgtgggagacactagaaaaatagaaaacttggaaagaaaaactagacggtaaatattttactaaaatgcgaaaacagaaaaattggagagaagaaaccgaaaaggaaaaggtggggtggtaaaaaagaggaaaaccggaaggagggagcgttgtgtggcgctcgaactaatatactgtgcgcagcacgtggatgagcgctaccgtcattttactccttaataacaattctctctttttgttactctttgtataagttttattttaagctgaaatttattagaccatggatggcacaattaccaaagttcaaaaatattttgaaatttttcatggcgtttgctcgaactataaaattttgatgtttaaatcagtttgaagtgctttcaacatatgtaaatagtgagaagaaaaaaaaatcaaagaagaatgttgatacgtaagttgtggatgcatctatattctaccaaaatttcaatgcaaaatatgacttatacagtgagaactgaagaagatgaatagagttaatggggttaagtgaaccgttttcagtagttcgggtgtaaaatgaaaaaaaatgaataatttaggggggggggggttaagtgctccagtgaaatagttcgggggagtaaaatggtgaggccataatcatggccactttatatattatcaacctaagttgcaagctatgtaaaaattgcatgttatatatttgaacaaatattgttgcatcgactttttatgttctcgtttgtaaaagtttttgtttggtaaagggaaagagaccgagcgtgggaaatgcacggatgatcaaagcaattgattgagaaccaaacctatacttttcccaagtctactcctatatcattacgtcacttttgatcaatagaaaacaaaagatgaaattctgcacgttttggattcggatttggaccccctgacagcatcatcttcaaacggactagtcactatctagaagggttttcgggggccatgagtacttgttagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 37405 - DNA, 859 bp, Oryza sativa
gcttgcccttgatcctctcgacctcctcggccatggaagatttcttggcgcgtcggagctcctgctcgtcgcagagccgaaacacgtcctcgaacggaatgtcgcggcccgcgagctccatggtggcgaaggcgatggcctcgtcgagctgttcggctcccatcgagcgaaccatctccctcaccgccgccgccattgcctctccgccggccatggcaaagcacgcgagatcgctcagattggagcaatgcagcttttggtggaattgggaatggttggcgccaaatttatagggaggaagaattgtctcttcttctccgattcgaattcatggcgaggaccggactcggactccgactccgattcggattacgctggaaacacgcacgcagtcgcgtccatgagttcgaaatcgaatcggagaaggagtacaagtatttcccccgataaatttggcgccaattccttctccgcgctcatccaagaaacagagacacgagtggaagcagagcttttgcttggaatcgatctttctttcgatctcgcttctcgcatcgcgttcgggttgctgccatccatggcgggcgacggcgaggcgatcccggaggcgtggaaggagcttgttcgctccctgggaaccgagcagctcgtcggcgccatctacgtcgccctcgacgacttcaacgcgcgggagcgcgacacgatcccgcccgagctatggcggcggctcggcgaccgcagcgccgcctacaggaaccctttcgtgagcgatggaggatcgagctccggctccggctccggcgaggttgagaggatcaaggtcaagctcgtggccgtgggcggggaagacggcagcggc

SEQ ID NO: 37406 - DNA, 5608 bp, Oryza sativa
cttgagcaggagcagcagcaagccgccgacgccgacaaagaccgcctccgcacccgccgcggctgatcacgccaagaaggcaaacacggcggcggctggccacgtcaagacgccagcggcggcgccgaagacggcggcgtgcagcaagcgcaaggaggcgcccgcgccgccggagatggacgaggcgaagctggaggcggcgaggaagaagctgagggagcgttacacagaggaagagacggcgaagaggcagaggaagatacagatcatcaacaacgcgccggggaaggcgaagcagcgccccgccgtcgtcgagcagcggcggcgcgtggtccgggacacggtggtcgccgtggcgagccgtgctcctgtgcgttcctctctccggatgtaggtggtggtgtagttttagaatgaacatattattactcgggcactcagctctctgtactgtacatggttaatttatttcatcagttatctggaatttttcagagcaatgttggtggaaataaaactattcagttgtactccctccatactcataaaggaagtcgtttatgacaatgtttaagtcaaaccttgggaatataaatcatgaataactcttacgttgttgaatttgaaaatataaaagttatatgaagatgtcttgaaaaatactttcataaaaatatacatatatcatttttcaataaatatttttatagaaaaaagaagttaaagttgtgttttggagaccgtgtcgctgtcctaaacgacttcttttacgagtacggagggagtatgtaacaagtcaggttatatgaattaatagcaatgctgatgtaatgaataaagttcagttaatggtcaggtggctacactacacaacaccatgcatgcgagaaataagtatggaaagctttatcgcatcctgtttcagaagcaactcatgtgtgtattcagaagttcagagaatgtagtcttgcgattttgataaaacatgagcatgtctataactggttatttggctacaagaagagtaattttacagtccttgagagatatcgggaggtaccaacatttttagtttaagttataacacctcctcataccagagatactaaagttagactaaaaaatatgtacctcccgatacctcctcaataaccataaaatcactcaactaagaacgtgtaaatacgtggaactgatagtcagagccagagctcgagtgtgtctaccatttctttttggccatatcatgagcatgttcaggcctgaactattttgccataaccttggtatataatgtatgtctgcaagacaggatgacacatttggcaacctcgtaccagggttcaaaatttcgaatcgaaatttcggaaattttggccacccccgatacaaatgagcaaaccgaaacattaaaccctgcacggtactattcatgaacctatggattttatggtattttcccttaatttctaccttggaaaggttgagtctcggttatatttactctgatgataaatttagttttgtttctccaaatacttagaagctggcctctcaaaggctctggggcgacctatgtggtggtgtaattattgaaagaggtctggaacacagagtaataataatgtaatgaacaaaattcagctgtatgtatgaatcaggtggtgtgaactgatagcagtgcccatgtaatgaacaaagtttattaaagttcagttgtatgtggtttccgaaaatgctcatggtggtggctataacgagctcacgcgtgtgttcagaaattcagtgatcgtatgaacgagctcatgccttgagagaattaatgtacgtatgttctgcaaaaaaaaaaaaaaaaaaaaaaaaagaaaaactgggcacaactggttattaggccacaagcccacaacctgggcatgtattggctcaaatgctgggcatatggcctgggcatggaagcacatcattagccaacgctgtgtatgccatgtcgatgtgtatggctatctttgtggacggcaggtgccgagtaagacggcacgcaacagtaagcacaatgaagaatgacacacacgacaccaatataacataacatatggaacatctccgaattaagccactatgcacagataattaacataaagttacgagcacacgcattcggtataataacaagttaaatttgccattttgataaaccaatacgattaaatgtggcccgtacagaagcgtatcggtatttggtaacatcaatcaaccttttttgctttcacgtttcgacatgatataaaacttctgtaaggagcgaaattgttacaaagaagcatcaataggaaaaaaaaaagaacagatggaaactaggtatccaaaagttagaccagcttcattgaagctatctgggtagcaacctccatagcttcctttagttgagaggcctcagttccctgcattgcataaatttacatattttattgtgtgatataatcacaaatatttcacctcgggtacttatgtggaaaattcaagatttgaagggtacgattgctcacctggccctgggcaattccattcttgccaccacctccctttcctttgaggggcgcaatcgatggtgtcaaccaatccaacaccttcaagctgttagcagcgctgggaggcacaccagcataaatgactgccttattcgtggcttcatccgtgctgaatagcatgattggcaaatcctgtacaagacaaacccaaaagttcaacagcacatcctacacttgacaatggaaataaataatcttagaaatgcactctgttatagtagcacattttcccacttcagagtggttggcaccctagctaactagttatggacagcacctacatcattgatttgttcagcgcacctatgaggaattcacaactataacattgacatgagcaccaatttgtggtcgacattttagcaaagtagtagtggattttggctggggagacatgaaaaaaggaaacagtatcttgcatacagagtagaaaagaaaattctcctataaaacaaggcaagacgaagaaaaaggcattgaattcaaggctgtctctgctacgcattgttaaataatatagcatgtggggcacattgtaggaccattattataataggaagtaggaagtttgcatatagttgtctaatagatggcatatcaattcatttggataaacagccccatcgtttggcctaaacagccaaagaataagccaaaatttgaatttttgaacttgattttgaagttgattttgaaatgcttttaacgtaatttttgttaatgttggcttttaagtcgctacgaacaaatctacaaaagttttacttataaattaattttaattttctaataagccaaataagccattttgggtaaaatggcaaccgatgggagccaaagcatgttcttgcaacagtcagatgaaaacataagtcctgaccttctggtccttgactttgataactgcttcccgaatagcacttgtgtcaagacccacatctacatgagcaacacagaagcgctttccttcagaaagagcagtttgggcggcatctattgcaaacttcacggccttctggatgttctcctcgcccattttcttcttggccttcctaagttcatcctacaacatccaacagctgcaataagctccaaaatcaaccaataatggaataccaaatagccgaataccacatattgttctgttctttcaaggtaacagctcataaagaacatgtacagacctccaacttcgacacccggcctttaagatcagcttttcttgcagctggaattaaagctgtatcaagcttgctcttgatggaagcaatcgtctggtagaaacatcacttttagatggtgatccaatataaaatagatcagcagaaacaactccagtgcaatcaattttaactaccctttatccatataaagagtagaaaaataatatttctattggagaagacttacatcagagaatatttaatgaatatctagtgcattaagcaccaacaatgcaattgacaattgaaagatacaaacaagacaaaggcatataataccttttccaatatagctccctccaattttgatgcttcattgatttcagaatcaatagatgatgcatcctttatagcatcagaggcatgtttagcagtaacagctgtgatcctcctaacacctttagcaataccctcctcggacaacagggcaaatgcttctgcctcgctagtgtttttaatgtgtgtacctgatacagttaagtttaataaacataaccatgggaggtaatacattccagacagaagaaagtataccgccacacagctctgttgaaatggatagccattctttgctttcaggattggcaagtagatcttccactttgcgaccaactgatacaactcttaccggatcaggatagatctacaaatttcaacatgtgaaataaattacaggaaataatcaacaggcaaactttgtgtttcatcatgttatttcatgttttagccgactaacaaaacttacttcaccaaacacagctcgtagaccatttatgcgcttcgcatctgctaattttatttcacgtgcaaatacttccagtttgtcttttatctgttgattcactatagactcaattttccgcaaatcttctggctgaacaggtttccctgttacaaacaaacagttttgagttgcgtggctgagggaatacatgtgaagaaggataagataagaaccacataataccatgggagaaatcaaaccgtagcttctctgggagaacaattgaacctttctggtcaacatgatcaccaagtatttcctgcatttaaatggtggaatcatcatgagggtggaagataaaagtgcaaattttttcgataagcttaaattcaacatacccgtagagcaaagttcagcatatgggtacatgtatggtttggagcaatgagagcacggcgagcataatcaacctaccaatggcaacatgaacattcatatctgattaagcgaatatcagagatcaactaatttgatgtagagattgtattactaaaagtgttaccttgcatgccactttatcaccaacagacaatgccttggaaccttttgtaaatgagcccatatgcagcacatacccagcaaatacttgaacattagttacattgaaagatccgaaagacccttcaattttcccagtgtcatatatctgatgcaagaaaaatcttgtcatgtttataatgtacggaacagtgactagcatacactgtgttgtttattattactaatgttcaattagaaatttatttgggaaaatatattgtatatttgcatgtgctcttaacaccaccaaatcacaatagctgaaaaatcattggaagatgtactaggatgaaatatcaggcataagcaaaagaatattgcaggattgggacagggtgtacaggttgctgttaagtactacctccgtcttagaacttatgggattttgcccatataatccctcatattctcagacagaggtagtacaagtgaaggactacagctgattgttaggacgacatacagttagactg

SEQ ID NO: 37407 - DNA, 1051 bp, Oryza sativa
ataataatcagtatccaaatgtgttctatgagcaacgtaagaacagctagagagtggccaagtaaaattactacattgaatattataagcaactgcacctaatagaagtgtaatatagctaaaccagaacaaaaaggaatctggcaagccaaacttaccttataaccatacttcgggctatcatctgtactagcaagcccttggttgcgcagctgtgctgtagcattggcatccaagacaatggaattttccccagcctgcaaaaagaaatatacattataaaaaggaaaaaaaataggtagcaactaaattatttcttacaaaattaaacagaaccactgttatcgagtcgcccgactagtcatagataaagtcagtcaatctagtcgactagagaaccacgactcaaccaaatagaaagtcgtgcgattagtcatggttagtgataaaatcggtcatagattagtcgtagcaaatcaccaattcaccatgctaattggcttattgtgtatttgtgtttagtactttagttttatttcatcttgacttattttgctgctttgctactccatagtccatagtttatactgtatacattgcttagaacagtagtatatattgcatcccctgtagcatgaccaattcgtggactagttgtggacaagtcgtcgactagtcgtggactagtcgaccaagtcgacgagtcggtccaggggtaccttgactcgactttacaacttgacaaccatgagcagaacgctggcccaatataatgaaataccagcagcatatcacactatcagagatatcaaacggagaaaacgattcaggattaacttctacacttagtaagaataaaagacaaccttgaagcgtgcattcctagccttctgcctcgcttcttccattgcagcatcaaaaccctcccgatccacactcaagccatagtcaactcccatgacctatggaatatgaaataataagaaacagcataaatagaacattgaagctttatagatctttcaggtcagaaaaaggacagctaacctca

SEQ ID NO: 37408 - DNA, 6247 bp, Oryza sativa
  unsure (1)..(6247): unsure at all n locations
nnnnnnnnnnnnnnnnnnnnnnnnnnnnnnnnnnnnnnnctgcatttatgtaagactttatgatgtttgtaagacgtggatctgtatgtcaacattgtcgtttgtgtacccggctggtcctggacggggattttaatgcacattctgcttgggattccattcgggaatttctgggcgtgacaagttggtatcagagccgactttgaccgtaggacaagccaaatggaaaaacctaagagccctctgaatccttttcattgcatatgctctttgcaattggatttgttccgggaaaattgggatctgttcttgtggttcaagggaaaaatcttggtcgctcgtttaagtgagatttttcaaaacgagtcagtctagggttttagtaaaattattgggatttattcgtcagtcagttgaggtttgaggggtgaaatgcattaggtcctagctcaggaacttgggttgccaggtatttatgctttgttcgttattattattatgtatctaatttctcattatttcatcgtcatgtgagtctgtcttatttattcgctctcatgtaaaatgatctatgcataaaattttgctcttatttgatttcccttatttgagtcttttattgctttatttaaatttggatttgagcatgcattgatcctactcctttgtcttctctagatggccggtcacccacccaaccaccgcggagaaggcatgatcgatttcgtggcagagttggcacgcatgacattggtggtgggctaccccgacgcgccggagtacacgaccatcccaccgctcagtggcgagcttcctcaccgtgtccgcttggaggtccatggttacgtggggacttgcctcgctaacatggcggtcgaggcgtcaggaggcacagcagatcatgcctgtcaggaggcagcctacctgatgatggccagactacgggagcgccacaactacatcttccacgacacggcgtaccgctaccaccccagtcgagcccacggtgatggcgtcagctccttccgtccgacagctggcgagaacgacaccaccttcggtcacatgtgcgcggtgatgaggggtctggacaggatgcactcggatctgcacaaggcgactaaggccttgaatgatgggaagctcatgaggatcgtcgctttgaaggacgagatagcgcgtctgaagaaggagaacgctcagcttaagggtctcccagcgccaggaggagtccggatccgcactacgccccgcaagactacgaaggcacccgtgcgcatccagctcgcgcccaggaacccacctccagcagcagctcccgcagcacctccagttccgcccgcagctcctgcagctccagttcctgcagctccagctccagctcccgcgttcgttctctccttcgccccagcgtcagccgtcagaggtccagccagtggcatcgggggttggttgcctgctacccccagtggcagccgcgatcgcagctccagtggctcgcagacgggcagcagcgagacgtacctgccaggctccaggagtcgttcagagggacctggtgatgaacaggaggacgctttcgactccaccgaccgcaggagccgttccgagcattaggctcgtttccccttagttcagcgactgtctagtttctgcttgttagtttgtgtgtttaggttgcttgtttggggtcagtcgacggtcgatgtcatgtgcctatgatatgactgtcttaataaggatatttgcttgctcttttaagtgtttttaattcagatcagaacaattacagttttaattcctttgtaataaagtttagttcctgagtatctgtttttcttcttttccccgtctgctcttccctccagatggtcaacaccaggactggcaaccgcacgacaggcgagggcagcaacggtgaagaacgcgttgatggtatgcaccccaacggcgatcccggcaacggtccgccaccacttcccgagaatccgacacttgcccaagttatggcgcatcagactcagatgatggcagccatgatgcagcagatgcagcaacagcaccagcagatgcaccagaggatgatgcagtacgctgaacagcagcaccagcagtttggtccccctccccctcagtccaagttgcctgagttcctacgagtcaggccacccaccttctctagcaccaccaaccctatggaggcaaacgactggctccatgcaatagagaagaagctgaatctcctgcagtgcaatgatcaggagaaggtcgctttcgccacacaccagcttcagggtcctgcgtcagcttggtgggacaaccacatggccacccgcccaccgggtacggaagtcacctgggcagagttctgccgtagcttcaggaaggcacaggtgccagatggggtcgtggcacaaaagaagagggaatttcgcgcactccatcagggcaacaggacggtgacagagtacctccacgagttcaatcgcctcgcgcgatatgcaccagaggatgtccgcaccgacgccgagaagcaggagaagttcatggcgggcctggatgacgaactgaccaaccaactgatatctggggactacgccgactttgagaggctagtcgacaaggcaattcgtcaagaggaccaacgcaacaagatggacaggaagaggaaggccgctcagttcagggcacatcagggaagtcaccagaggccgcgtttcactcccggacagcagggtggacctaccaccatgatcgtccgtcagcaccgcccgttcaaccctagcaacttccaccagggcaccagtggcagtcagaaccaccatggaggtcagcccaaccgcggtgcagctccacgcccaccaatggccccggcacagtcaggccagcccacgcaagccaagaaggagactggagcaaaaccagggtcctgcttcaactgtggcgagcttggtcacttcgcggacaaatgcccgaagcccaggcgtgccgggccaaggtttatccaggctcgtgtcaaccacgcatctgcggaggaggcacaagcagcaccagaggtcgtactgggtacgtttcctgttaactcaatccctgcaacagtactttttgattctggtgcaacgcattcgttcatctcaaagaaatttgtcgggatgcatgggttaataagagaagaacttagcacaccgatgcgggttcataccccagggaatagctccacttcggttcaattcagcccttctataacaatagaaatccaaagatcaccatttctagccaacctcatccttctcgactccaaaggcctagatgtcatcctcgggatggattggctgactaagtttaagggagtcatcgattgtgcgaatcgcacagtcaccttaaccaacgagaagggagaaaccgtggtgtacaaatccctagtctcgccaaggaaaggggtctcgttgaatcagattgagacagaaatcccagtggacaccgtagagaagaactcgagaaaattggatgatatacccatagtctgcgagtatccggaagtgttccccgaagacctcactaccatgccacccaagagagagattgaattccggattgacttggcaccgggaaccgctccaatctataagagaccgtacagaatggcggccaacgaattagcggaggtcaagaagcaagttgatgaacagctgcagaaagggtacatacgaccaagcacttcgccttggggcgctccggtcatttttgtggagaaaaaagataagacgaagaggatgtgcgtcgattatcgcgcacttaacgaggtcacaatcaagaataaatatcctttgccgcggatcgacgatttatttgatcaactgaaaggggctaaagtgttttctaagatagacctgcgctcaggctaccaccagttgagaatccgggaagaggatatcccgaagacggccttcaccacgcggtacgggctatatgagtgcacggttatgtccttcggacttaccaacgcacccgcattcttcatgaatctgatgaacaaagtgttcatggaatttctggacaagtttgttgtggtgttcatcgacgacattttgatctattcaaagtccgaggaagaacatgaacaacatctccgtctggtactcgagaagttgaaggagcaccaactatacgccaagttcagcaagtgtgacttctggttgacggaagttaaatttctgggtcatgtcattacagcccagggtgtggcagtcgacccatcgaacgtggagtcagttaccaagtggaccccaccgaagaccgtgtcgcagattcgaagttttctaggattggccggttattaccgccgattcatcgaaaacttctccagaatcgcccgacccatgactcagttgcttaagaaagatgagaagtttaaatggacagctgagtgcgataagagttttgaggagctcaagaagaaattagtatccgcaccggttttgattctgcccgaccagatgaaagacttccaagtctattgcgatgcatcccgtcacggacttggatgtgtcctaatgcaagagggcagagtggttgcatatgcctcgcggcagttgcgtccacacgaaggaaattatccaactcatgacttggaattggcagcagtggttcatgctttgaagatctggaggcactatctgattggcaaccgctgcgaagtatatacggaccataagagtctgaaatacatcttcacccaaccggacctaaaccttcgacaacgaagatggttggagctaatcaaagactatgacatgagtattcactaccacccgggtaaagccaatgtggtggcagacgctttaagccggaaaagttactgcactgccctatgcaccgagggcatgtgtgaggaattgcggcaggagtttgaacatctcaacataggaattgttgaacacgggttcgtagccgctctggaggcacggccgacgctcgtggatcaagttagagccgctcaagtaaatgacccggaaatagcagagctgaaaaagaacatgagagtcggaaaggctcgggatttccttgaggatgagcatggcacaatctggatgggagaaagattgtgtgtacctgacgacaaggaattgaaggatctgatactcaccgaggctcatcagacccagtactccattcaccccggcagcaccaaaatgtatcaagatctcaaagaaaagttttggtgggtcagcatgaggagagaaatagctgagttcgtcgcactctgcgatgtttgccaacgagtgaaggcagagcaccaaagaccagcaggtctactccaacctcttcaaatcccggaatggaaatgggaagagattggaatggattttataacgggactgccccggacatcatcgggacatgattcaatctgggtagtcgtggatcgactcaccaaggtggctcacttcataccagtacataccacctatacgggaaagagattggcagagttgtacctcgcaaggatcatgtgtttgcatggggtacccaggaagatagtatctgaccgagggagtcagttcacctcaaaattctggcagaagttgcaggaagaattggggacccgtttaaatttcagcacggcctatcatccgcaaactgacggtcaaaccgagcgagtaaatcaaatcttggaagatatgttgagagcatgcgctcttgattttggtggagcttgggacaaaagcttgccatatgcggaattctcgtacaacaacagctaccaggccagtctacagatggcaccgtttgaagctttatacggccggaagtgccgcacacctctcttctgggatcagacaggcgagcgtcaactgttcggaacagaagtattagcagaagcagaagagaaagtcagaatcatcagggaaaggttgaggattgcccagtctcgacagaagagctacgcggataaccgtcgaagggagctcacctttgaggcaggagattacgtgtatcttcgtgtcactccgctccggggagtacaccgttttcagacgaaaggcaagttggcaccacgcttcgtgggaccatacaaaattttggaacgaaggggagaagttgcctaccagctagaacttccgtccaacatgatcggcatccatgacgtgttccacgtatcccaattaaagaagtgcttaagggtacctgaggaacaggctgattcggaacacatcgatatccaggaggacctgacctatgtgga

SEQ ID NO: 37409 - DNA, 238 bp, Oryza sativa
atgaattgtgaaataaagttgagtttgagttgttttgttgttaggtatttgtatgaatcaaattcttatacctaggtatatactcacaatttgaaaatttttaaaaatttgagagaatttgtgtgttttataccttggagcccgggcaccatggagtcccatatatatatatatatatatatatatatatatatatatatatatatatatatatatatatatatatatatatatatat

SEQ ID NO: 37410 - DNA, 504 bp, Oryza sativa
gagaaggtgggtggcctgactcgtaggaactcaggcaacttggactgagggggagggggaccaaactgctggtgctgctgttcagcgtactgcatcatcctctggtgcatctgctggtgctgttgctgcatctgctgcatcatggctgccatcatctgagtctgatgcgccataacttgggcaagtgtcggattctcgggaagtggtggcggaccgttgccgggatcgccgttggggtgcataccatcaacgcgttcttcaccgttgctgccctcgcctgtcgtgcggttgccagtcctggtgttgaccatctggagggaagagcagacggggaaaagaagaaaaacagatactcaggaactaaactttattacaaaggaattaaaactgtaattgttctgatctgaattaaaaacacttaaaagagcaagcaaatatccttattaagacagtcatatcataggcacatgacatcgaccgtcgactgaccccaaacaagcaacc

SEQ ID NO: 37411 - DNA, 597 bp, Oryza sativa
cccccaaatctgcaaactgtgtagtatgattttccacgattttatttctgttgatccacaaacaaagaaattgccattctttgcggttagtatttttaactactgttatcatttctactgcttgcttccaagttggatgtttggctctccttgagaaccttttgcattggatgcgtcccagctgcaagtagtccctcttaacttatttcttttgaagaaagacctctttaacttatttctctttgaacttagtcttttacccagcgggctcacatattagtgactcaaagttagaaataaataagttagaggaccctctcttccttgtagcagaggtttgttgcagacgaggttgaatggaacaggagaacaacggagacgaagagatgcaacgcacgcaccagctactagactcgcttccggtgctttactagacttgcttgtagcattgtacattttgtgtgtgttatttttatctaaaaaaaaatctcacttatatatacaagtttaagtaccattttgaacatgggaatctgaaactgtttggaatgaaggaattttcaagaaatttacctgcagaatttatatcatttgtca

SEQ ID NO: 37412 - DNA, 713 bp, Oryza sativa
ttccttcagaaaatcaaaaataagttttgaaacctctgtctcaccatagaaatttaaatgcatgctctttcgctcgcttatcttcccagtgccccttatctgtcgcacgagatctcttaatacttcaagggcagaatattttggaaaaatggatacccaaccatatttgtgaaaataaccttcagttatgactgaactataagctagttttgcaagtgtggacttcccagcccttgcttgaccaacaatcgatataacagttagattcatgttattttggtcaagcaagtaactcttaatttgtgcaatttcatgatcgaatccaactatatccattccttgatccaaacccggcggcacaagcctttgtgcatagaaatcctcatcctccctaaaaatgggctgtgcttccgttgaagtgctagaattaactgcgttgtatctgttgtaccgctcaaaaatctcactaatttcctttcttataacttgtatgtttttgccaacctcacggaggtcaatggaatcaccaaagatgtgagtatattttgatacagaagtctttctcctcctaaaaatgaaatgagcattgtcaatacctcttccacccggtatgccacgtcttgaatattactggccagatttttcatcatgctgtttccttccaaacatttggcatccacaacatttaagaagcattgcatctggctcagttc

SEQ ID NO: 37413 - DNA, 1079 bp, Oryza sativa
  unsure (1)..(1079): unsure at all n locations
cccctcagcttacacattttagagcgcaggcntaattcgcggttttcctctccttctcatagaatatccggattttagaaggggctaaacgtaaaatgccagctcagagggactgttagcgagggacgccggacgaattacgaaaaaacggagggcttttttgcaaaaataccaccccgcgcgctgtacatatactgtagaaaaatccttacgtggcacacctcctcgcccgcccaacctgcgcccctttatggccctctttaggcttataagccaacttataagtcgaaaagtctaggcctaaacttttccgtttggcttttttgaagccataagccactctaacactattaagccaaaagctaggttggagaagcttttttggcttatgtaaggtagatgtatgactcaactactaaacttaggacattaaatccaccggcttataaatcatataggccaataaactgactagtccaataaagagggcctatgtactccgatgacactcagattatgaaaaatgaaaaaaattcaacaaaatcctatgagaaatacagtgtggtcatgatgcacctgcacatgttttgatatatggaacttgtatatcattcgaatggttaaaaaaatattaaaaaatctattatatacttaaaaatccattaaactttctataaacgtttctaagccgccacttagcactctaataaattagagaaatcaaagaaattctaaaaaatctatccattgattttcatttaaattggtagacccaatattttagatcattatattaaatctattaaaatatttccaactaataaggatccgatgcatacatatggatggtacgtatgtacgtactactcgtaaaaaaaagaatcattccttctaatatggatccgatgcatatctatgcagaggaaggtatgtatgtactactctacttttaccgtatgtactactctacttttacaaacgtaacgtaaaatacgattggaaattaaaagaggataaagcggataaaaccataaaaaccataaatacttttcttccctctttttcattcttttctccct

SEQ ID NO: 37414 - DNA, 20951 bp, Oryza sativa
agctccatgtcatcatggggtacatcaacacctatacaaacaactttccaaatacttggatgcaaagagattagatgcaacttcatcttgtgcttccaagcggcgtaatgtgtcccatcaaattgaggagcacgcccggaaggcatggagacaaagttgtgaggggaatggtaagtttgctgtaatcaaaaggtatagtagctcccttgggtgatggagttcccttgctgctcgctccatcttcatttccattttctccgttctttccacctaagtccgacatcgtggatcactcaaagcggtgaagcttgaatcaagagcaccttgctctgatactaattgaacacgcagatgaagtctagagggcgggtgaataggctggccctgaaaacttaaaaacaaatcgcggcggtaaaattcaaacagacccggaacttcctggtaaggaactccggaacttccggcctcccaggcccggaactaggaggattaatgcactttcaagatagactaaaatttgcattttgcggtgaacaaagatgtactaattattaattattagacagggcaataccatctatccatttgctcgccatacggtcaatcggggatatgctctgcaccatcgtgacactctcgctccttctgtccagtacacacagaaaaacaaaaaaaaaaatcagaaaaatgaggattgcagtcaagagagatgaggaaagaccaaaaagctagattagtaaacaggtcacaaccgatggaaatatgcacaccacagcagtagttgaagcacaaacatgggtgtggaggtggtgccgttgccgatgcccaccatcaacgaggccatggcttcctgatccacggcagcaatggatccgctcgcgcgaggatagagccagacaaccggcgacgcgtgaggataatggtggcagcaccgagatgcacccctaaaaagggtattaggagagccagaaactcttttctatactcttttctatcaaacaaaatatagaagttcatttaccccaacaattgtagtagcaaacaagcgttcaatttaaaacaacactaagtctgtcaatcattgtaagcgatgtgtacttcgggaatttcctaatgattttacattacagcagcatggaaaagcctaaagcatttctggtctgctatagcagcaagtaaattgcatatgggataaaatcaatatggacataccagtattcttttttcataaagatacatagacagcattctatgtataacgagcttaaaatcaccgaactcttgactcccgttgtcagataatagctttcccatgattactgtaggggtatatatatgtccagccattgcctcaattatttctccaacaaaatgtgaaaatacactccgcggtgcattcaagctcctctggtaagctgaaatccttgtttttcacccgaatcctttgtcctttggctgtctactcgatgattcactcccattgggcctgaaaccttttccatttacatccttgtttttcttttcttttctgtattggtttttgccggtttcccgtttaattaaccgtgcttgtttggttttcgggcccgatttcccttattaactgggccaattctgttcttctataaattccggcaggagattctcctgccgttggttcctaaaaaaaaaaattacatccttgcttccatttaaggggctctgagaagctgaattgataacataacaatattgatgtcaatacatctaccagaacacaagacggatatctttgtatgaccacagcaagcaacaaacgtgacaaatcacacgactgtaaagaaagccttacgcaattccaatactataggttgatttatatccttttgaaagtcctaattaatctaatgaaaatttatcataaaaattaaggccttgtttgaattttttttgtctgaactcacaatggacaaaaaatgaaaaaagagaaagatgatattagacaatataacagtgagaaagagcccaccccatccacgaataacaacaatatgattacttgaaggagttaatgtacgcagcggctgacggcgtgtgaagaggcggagcccctcgtccaagtgtccaacacagcgacaaggtgcggatggcggcggaaagggtgattccggctggtggcaggacaatggttgctccaaccacctaaccatcgacagccacgagctcaccgccatcagatcaggcggccttgagttcgtgccatcagatctggccactgcgatggcggcgagcggctaggccggccagttgacgacgacggcggcaggttgacaacgatgacgatggcggcgaggcacagctcctcgcaggcaaaggagagacgagagtggaagaggagaggagcgttctcctcgtcgctttctccgcgtccgcctcgaagtccgcactccgcgacgacggtgacgcgaggggggagaagaaggtggaggcgctcaaagacggcgacggcgacgtcaacggcgccgaaggtgtagccggcggcgctaggggaagacggaggcaaaggcgtaggtggcaaagacgaaggcgtcggcggcggaggcgcgagccgattcagacgacgatggcgacggcgcgaagcggaggtggtggcgcgaggggaaagcggaggcggaggcggcggcggctgctagggctttgggtagtgggtgccgttttgcgaaaaaacccctcagcttacacattttagagcgcaggcctaattcgcggttttcctctccttctcatagaatatccggattttagaaggggctaaacgtaaaatgccagctcagagggactgttagcgaggcacgccggacgaattacgaaaaaacggagggcttttttgcaaaaataccaccccgcgcgctgtacatatactgtagaaaaatccttacgtggcacacctcctcgcccgcccaacctgcgcccctttatggccctctttaggcttataagccaacttataagtcgaaaagtctaggcctaaacttttccgtttggcttttttgaagccataagccactctaacactattaagccaaaagctaggttggagaagcttttttggcttatgtaaggtagatgtatgactcaactactaaacttaggacattaaatccaccggcttataaatcatataggccaataaactgactagtccaataaagagggcctatgtactccgatgacactcagattatgaaaaatgaaaaaaattcaacaaaatcctatgagaaatacagtgtggtcatgatgcacctgcacatgttttgatatatggaacttgtatatcattcgaatggttaaaaaaatattaaaaaatctattatatacttaaaaatccattaaactttctataaacgtttctaagccgccacttagcactctaataaattagagaaatcaaagaaattctaaaaaatctatccattgattttcatttaaattggtagacccaatattttagatcattatattaaatctattaaaatatttccaactaataaggatccgatgcatacatatggatggtacgtatgtacgtactactcgtaaaaaaaagaatcattccttctaatatggatccgatgcatatctatgcagaggaaggtatgtatgtactactctacttttaccgtatgtactactctacttttacaaacgtaacgtaaaatacgattggaaattaaaagaggataaagcggataaaaccataaaaaccataaatacttttcttccctctttttcattcttttctccctgcgtatacaggtgagataacaattaatattagtgataataaattttaaataattataattcttacaaacatagagtatatatatcatcatatgactctttcaaaaacatcattcctccgtttcgtaaagtaagtctttctagcattgctcacattcatataaatgttatatgtctagattcattaatatctttatgaatatgagcaatgctataaagtcttgcattataaaacggagagggtacataactaaatttgctctataatgttcagtgataaagtttactccctccggttccataattcttgacgttttgaacatttaaacttttataaattgaactattaataactttaaaaatattaaagatttaatggcatgcatacgaggattttatgtggtattgatgatttgattcttttaccacaacttttaattgtacatccaatttataatcggtttcaaccactgtatttctattaattgaatgacaattaaagacctgtattgctgaattgagtcccaaattaacataagctgaattgttttcaaatatgaacataaggatatcacatacatgacactaaccacatttatcattagtttaattattaatcaacatttttggacaacgcttatttctaaatctataaataaatattcttaatatgctacttctattggttaatgggagatcaccgttaaaaattagtcatgaatgtcccctcttaagaggtggaaatacatgtctttatggttccgtatcaacatacatgtgcctttcaaggacagcgtttagtgcaattttaacgcctaattcactatcagcacctttacagatgattgcatcagtaagtagaaatttgaacactattgtcaacggtggtttccaaaagggctacctcaactaaaccatatatatgcccctactatacttgtaaaagcttctcaattccctttagagaaagcaagaaaatatggatgtaatgaaaataattcttcccataaaaacatagttgtttttttcattttgtgtagacataatttgtttgtagtattaatcagtactacccgtttatggtatagatacaacattctcttttgttaagtgaggttaatcattaaaaaaaaggagagaatctattctacaccactgagtttgttcgagttcaacgatttaccatcaacattgtctttttttataatataccggcgactttatcaattgttctacgatacgccattggactggacaatcttttcaaaaatacccaaaatacccttagagacatacaagattaacaattgatttatctcatctgaatattcaaaaaaatatgaaaatttctatgtggcctccttacacaatatggaagtttgtatacaagtttcaagttttttctgatatatttagttttttgaagaaaatatttttatgtggaatatgagagagagtttgctaataaaagagataatagcacaaaaatatcttatgtagtatgaaagatgatttatattaaaaacaacaatatacaagtattttatgtagcatataacagataagttatattttttataaaaaaatagaaatgtaacaaacttgaaacttctatacaaatttccatgttgtgtaagaaggccacataaaattttcatattttttttgaaacttctaatgagaaaaatcaattgttaactttgtatgtccataagggtattttgggtattttagaaaagaaggctcaacccaatagcatattgtagaataatggataaagttgccagtatattaaagaatgcgacaatgtcgttggcaaatcattgaaatcgaacaaactcagtggtataaaatagattctctcttaaagatgtatcgctaaatagatatatgaccgtaaccatgttcagattatcatatcactaaatcacatttatattttgataaagatctatattttagcgtctggtttgttttcatcacctcttgttgataattgcatgaggcacctttactaattttaaaatgtatttattttccaaaatatgtacaataactaatttgttggagcgcacttatagcatacattcatcaactatcaactatcaattatgccatattagaattcctcgactataaaaaaatatatcatgagtagtttaatgcacatgttatttgttggtttgttaccaaaccaatttggcaaagagaaaaatgtttggattaaggggccgtatagcaagatcaatgcctaaaaataccaatgaaatagttctgaaaagtctaaaaaaacatttgagaatattagtctccatagattaaaattaaatcatatataactgataaaacataatgttgttttgttttcacacatgtagatttcagttagtgttatatatttgtcaaatggtatttgacaccataaaatatgatgtgaaattatttcaaagatatgacgaaattaattattataagttgcctaaattatttgaaaattattataatattaattatgatacgtcagctccatgtgttgtaatgtatttagcatcataatataactatgataagtcatcaacatttgaatacaacggattatagtttgagcttatgatttaaaaataatttaaaatgagtgtataaatacctttgatttgatatttatattgatctagtttaacttgcatatttggagtaataaattttgttttatagcatagaaaatcctcaactgtctatattattttccgatggctgtaccaacgtacatatgtattttttgaactttatggcttttttaaatggtatgtacatatatttctttgttttttaatcaaatatccggtaaacagtttctcttgtatacgcaagagattaagaggaagcgggctaaggtaatggtgtaaaataataggttcattaatttatgtaaaaatcgatggtgaaattacgtagtatcacgtggtggtctacgagcgcttgtagaagcaccaaatgatcatatttgtagagtaataattttatttttatagtatagaagatcctatttaaaaaggctttgatggttataacattgtacatatattttgctttaggctttaatcttgcgtacattggtacctatcctttgttttttcacgggtgaacagtatattattttttgtcattatttttttagcgtattttcatgcaacgtaacgaatgtaactatttgcatgtaggtacgtaaatatttccagtaaacggattatcttggatatagaaagcataaaatttttaaatagatctaatccgacggtatagaataatggatccaccaatttaaatgaaaatcaatagtaggattgtagaatgccacacggcggcctaggagcgcttgtagaaaagccacgtggcggcttaggagcgtttataatatgtttaatggacttatagtatataatagatagatagctatttttagggcatgtttggtttggagccaaattttgccctaccaaaattaattttgatagtacctatttatcaagcttgaagcatttagatttacatttcctcaaaaccccaccacctgtttatcaattgctttcaactgaattgttaaattcgaaaccctatattggaaaaccgtttaaacgaaattaaaaattgaatgcttgaaacttgtggtacgaggagttcacctagggctttctctacacaagaaatagcttgatgttgccgttgacccataatgcagcttgtgcttggtggctagggtgggagagagaactaggggtctgtgggatcctttgcagggaagaaaaggagacttgagagcaagatagactcaatgcaatatattgatctcagtgtgcagagtacatatataagcacgtcctttcctaaccactcaaccaacttatttatgtagaaacagaatcgggagagatattggctagatagcaagagatgaagcatgccaaaatacaaaagatactaaccctctcaccccagtcattctattaaagagaagttccagtggtggattagagatggtagttcggtgcgattgttgtaagacccttggctcggtgggactgcaccggatagaaggcccggcgggtgtccgaacattgagactggaacggaactctaagaagatggtactagacaaacccttggtgaagatatccgtataatgtgacatcgtcgggacatgaacacacaaacagatccgacagcaacatgatcatgtacaaagtgtagatcaatctccacatgtttggttcgctgatgctggactgggttggtatgaatccttagctagtttgcatatacaagaacgaagtatgcttgtgagataaaagaaactgatcgagttattctctgtgtatggacaaatccttccattgataaaataatgcaaatacatggaatatgttagactaactacagatgtaatttggtgcaaaactcttgttggaccttgtgtacaatagaagatgggtgaagtgttgaggttggcacagggaacattgaaaggaaacatatccttggaaactaaacctgctagctagccttgattggtaagtgatcaatgatggatggatgggttaattctggttctgggtggcagccggccttgggacatacttgcggagccagatctggcgatggcggatggagatcttgacgagacgctctccgttgagcaccagctgcacaaatgcctcgctccggaagatgattcgcccgtacattggctgtgagcctcccgctgtcttctccatcaggacacgcaccacgcagtcgccccacttcctgcacgtatatataagtcgttgtcaatgccaatgcatcaatccatcctgcattctgcattctttgctatgggacctagctgcgctatggggaggattgcagactcactgcctgaagtagtcgaagatctcttcacggtcgattggcgctcccctggagaaggtgatgaacatggagcggcagtcctccggcacggcgacggagaggcagctataggccgccatcagctccggcgggttgccgactaggccggtctggtagcggcggagcatcttgttgaggtggttattgaagatgagcgagccgacaccgtctaggatgtctgcgacaccacgcaccaccaggtcctggtggaatgtgaaaaagcgcgggtccacatcgccgtccttgcagagcgcggagatgagcgggatggccggcactacgggctccggcccgcggaggcagtccaacaccgagttggcctccgcggcgacgaggctgacgacggtggggctcagccctgggaggtgctggatggctcggacgttgcactggtccagccacaccagcagcgccaccgcgttgcgcgcctgctccgggttgctgccgatgccgacgaagcggtcgtaggcggtgcgggcgtcgctgtacatgtacagcacgtcgcggacggtgaacatctgttcggccatgatcagcgtcgtcgtcgccttccggaagctccgagaactagatagcttagattcttgtgctgtgtgtggtaggctgctaggtagcaatagctcaggatgatggagtgctgaatggggctagctgaggcctgtatttgtagccggtggtcgccggcgagtggttgcaaggagcagttgagcaaacggatgtgttctcgctacctgcctcgcatggcaacctttggcctagcttagcaaaataagcaggaaacgaaacaggtatgatggtttgaaccggttgcagcgtcggtctcctctgcttaacgattcgtgcttctctggcctgaagcccattttgtttcccatttttttccctgtcctttttagatgagcttcctcttttattccctagttgcgctcaaactagcagctatatatgaatggatcaacgggatagtgctatcgtatgtatattttggcggttaattataccttgatcatgcattgttgctaagtatacctttatatatcgtcctatctttgtttcagttcatatgtatctttggctacaatcgacttaatcattattacttgcctttatcaagtcatggcaggacatcaattttgaagggcaattcgatcatattgtttgcatgcatatacacattgccacgtacacgtacatatatagatccaaccagcaagacaaacgttcaaacttcattactccctccgtttcaggttataaaatattttgactttggtcaaagtcaaactgtttcaagtttgactaaagtttatagacaaatatagtaatatttgtaatactaagttagtttcgtcaaatcaataattgaatatattttcataataaatttgtcttgggttgaaaagttactatttttttctacaaacttgaccaaagttaaaacgtcttataacctgaaacggagggagtacatatgtaaatccatatatgctatgacctattaccaaataaacaaatcaaattccaatttaaaataaatttgttaaatgctccacacactgctctagaaagccacattactaacagttgaaaatggcaatctctaacaatttgttgaaccgctatatagacatttggttacgcttgagttggcgtgaataatctctaaatgttcttgaactactactgaaccaatgatatctaactgttcacaagctataaagtattacatttcatattgggacaattaaaaagaatgcaaaagttacgaaccggtaagatttgcttgtcgtcgtttgtcatgctcagctggttgatcttgacatcaccatgccagaggggagaaacaagagcaccgagcgaggacatcttgacccatgcaatgtcatagtcatctcaccataccttcctagatctagaatcatagagcttggagtgcatctaagattaccatctcaccatacctttccagatctaggatcctaaagcttcgagcttggaacgggtagatatagcatgcaccgagcttggagcggctagagccattgttttcttgatcacacaagagcaatgaggagaggaggcctcaagccatgctctgttgttgccatcatagtggccctccaaagatgtcaccatcatcgtacgtaccatgttcgatccggtagcccaagctagaagctctagatcgacatggcattttaagctcgccaaccgcatcgaagcaaggaaagggtaatggtggactctgtgtatctcgctgaacaaggggagaagaggcaatagtgcatgactagcttggattagttttttttttttcggggaagagctgggaattactattgctcaaccgacagactagcttggattagttgacatcaccaaaggaggtagcagctaggatggcaaaggattgaaggccagcgtgaacttgggtctggcaactagacaaggagtggcggatgaggggcaaatgatgcaaaatatggcaaagctaggagtggaagatagatgtgcctcgatccggagcccaaggaacgggtctatgggaggatagaggcgaaatgtggtaatataggtggagtggttggagtgggagcacgttgatcttacctaatatgttgttcttgatatgaatccatgacaaatatgatagggttaattggatccatgctattataacgttgccacttttgagaaatgtcactactattcgttaaattagaaacatgtcattatgaatcagctgattttggaaccatgcttctctctgcaccccaagcctcttttgttgacttgaatagacatagttgcccctgggtgaatcataggtcgatggcgatggcaaggtggggaagacgacggtgaccacgatgaggagatctggcgaaagcaaggtggggaaagcggtagtggcgaggtcgacggagacggcaaggtggggaagtcgacggcgatggcagcgagatctggtgaaggcaagttggggaaggcggcggcagtgaggtcgacggcgacgacaaggtgggaaagatgatgacgaccacggagaggacggtagctcaggaagacgacgacaacgtgactacggtgagggctggagcttgggaaggtgacgatgacttctcggggccctagattcgccggcgagcaggctggatctagccagcggcgcggtgccgatatgggagaaaagctacggagctacaccggagaagcccgctgccaagctcgcgcttgccgctgccgtcgccgtctccaccttgccaccgccattcctgaccttaccgttgcgccgagctcacgcctgctgcagacgttcctgacctcaccatcgccggatctgctggcgagcttgcgctgctgcttcacgccccgtcgccaacgacctcgtcaccggcgttgctcgtagctccgccatcgtcaccatcgccgcactctctggtagggatagggatataatatgatgcaggggcattttagtcaatacgaatatacggaacaacaaatacggtcaacaaaggggcttggggtgtagagtgtggcatggttccaataatcatcatataggtttatgcaccaagaccaagaataatttaaatcgcatcaatcaaaacaccatgcaaatattctcccacaatgcatgcatcaattaaagcaccatgcctagcatgcacacattctcccatgctacatgaattgtattccgataaaattcgtgttcatgcagttatacgatgatcaatttgagaaattttgaatttcattataagatgatcaatttgggaaggagggagtaggctctacttgaaatggtgttcttgtgcgctatgtggaaattacttagttcgattgtcattatcatgaatagattattttgctatagaaatatggaaaaatcatagtgcaacattataatttccatatgctacctcttcattagagaaatataattgagatttgaaggtagaagggggaaaatgccataaaatccttaggttcatgaatagttctggtcgttctcaaatttgtcatctggtcatgcaaacaaacattatacctaggttatgacaaaaaaagttcaggcatgaacatactcttgttatggaacaaaaaatagtcactcacattggcatatacacaagctctggctcttggactacgtatttacatgctcaggccgtggccaaataaccagttgcagtagatatgccagattttgagtaaaaaaaaagaagcaaagatacattcaccgatcaaggcttgtgtacattatatggatacacaaaatatgagctgcttctgaaacaggatctgacaagttccacggttatttccttacgcatagcctcccgaacattttctgaaacaaacgcacaactgaactctgatcattatacaacatcatgttagatcgtaaagggcctttccaactctaaaataggtccatccctttctacaatcaacatgaaactattcatcaatctccatcttcacatatttatttctcaaccgttcaccaccccttcaccatactccaacggtgccttgggtgtatggctccgcaggccgcagacacctatagtccattaggatttgacactagtatctatcaggttaaagatattgaactagctaggctcttataccaattataaaattgtaaagagcatatcctacacattagtattaattcttataacgagatttagtacatattcactaaatcaatattattctcccttgcagatgatgaccgaccttagtacatacatggtgagtgagaactaagcaaatatatgctaatctttaacggttctttgtgttaaaccattatagatcaaactagcaagatcaacgtgctctagctccaaccgctcctatattacgacaccccacctcttttctcccaccccacaggtttctgaggtgacttttctcttcctcagttgaggtcctagctagatctaccatatctcccactatttacctctgccccttttcccctttcccctttctagatctaggctcacacaggacgctcatccatcaccatccccttcgctccctcctttggtatcctgaataacttcaaaccagttaggcattgagagacagagagtccactggcaccccctccatggtacggtgatgcatggtaaatccttggatgggccaatatgatggcgacatcagagatcggattgaggcctcatcctctgcttcttgctctggtgtagactggaaaacaaagactttcagatctgaccactccatgctcggtgcttgctggatctagccactacaagctctagggtcctagatctagcaaggtatggcaggacgacaatatcagtgcacgaatcaagaagtccttgctcaacgcccttagtcgtggctccaacatggtgatatgacgagatgaactagctaggcatcacaaacaacaataagcaaatcataccggtgcgtattttcttttttgcatttttttaattatcccaatatataatataatcattcatagtctgtgaaaagagaaaattgattcagtagtagttaaaaacaattagagattatacatcccaatcgttaaccaaatatttataatggttcaagaaattgttagaggctatcattttcaaatattagtaatgtggttttccctttatgcgtggcaacattaaaatgtttatttttaattggaatttgatttttatttttgatagcatatgaatttacatacatgtggtgtttgaacgtgataggtaaatctatatatgtatgtgtatgtgactgtgtatatgcatgcaaagaatatgaccgaattacccttctaaaaattgtagtaatgacttgataaaggcaagtagtaattattatcgattgtagccaaacatatgtaggaaccagatagacaaagatggggtaaagataaatttagcaacaatgaaagaaatataattaacagccaaaatatacatatctcatagcactatctcattgatccattattcatcgctgctagtttgagcacaactaggaaatcaagaggaaactcagaaaggaaaaaagaggaaagaaatgagcaccaggccagaggagaggctgacgcggcaaccatttcaaaccatcatacctgctttgtttccctcctaattttggctaggtcagaggttgccatttgaggcaggtagtgagaacgcgtccgtttgctctcaactccttgtaacggctcgccggcgaccagccgaccaccggctacaaatacaggcctcagctagcccaaatttggcactccaccctcctgagctattgcaacctagaagcctaccacacagcgcaagaagctaagctagctaagaagacgacgtcgatcatggccgggcagatgttcaccgtccgcgacgtgctgtacatgtacaccgatgcccgcaccgcctacgaccgcttcgtcggcatcggcagcaacccggagcaggcgcggaacgcggtggcgctgctggtgtggctggaccagtgcaacgtcccggccatccagcacctgcccgggctgagccccaccgccgtcagcctcgtcgccgcggaggccaactcggtgctggactgcctccgcaggccggagcccgtggtgccggccatcccgctcatctccgcgctctgccaggacggcgacgtggacccgcgcttcttcgcgttccaccaggacctggtggtgcgcggcgtcgccgacatcctcgacggcgtcggctcgctcatcttcgatgaccacctcaacaagatgctgcgccgctaccagaccggcctggtcggcaacccaccggagctgatggcgacctacagctgcctccccgtggccgtgccggaggactgccgctccatgttcatcaccttctccaggggggcgcccattgaccgtgaggagatcttcgactacttcaggcagtgagtcttcaatccctatagctcatccagctcccatagcaaagcaagcaccatggatgcatgcattgacattggcaactacatatgtacacatgcaggaagtggggtgactgtgtggtgcgcgtcctgatggagaagactgcaggaggctcacagccgatgtacgggcggatcatcttccggagcgaagcgtttgtgcagctggtgctcaatggcgagcgccttgtcaaggtcaccatccgtcaccgccagatctggctccgcaagtacgttccaaggccggctgccaccgagaaccagaattaaaacatcgatcccgtccatcatcggtcattgccgtccatccatcaatcaagggcatgaataagctagctagtagcttccgtggtgccaacctcaatatttggccaatcttgcattttacacaaggctaatccttcactaaattacatctcagtcaagtctgacatacaccatgtattagcatacttttatcaatgcatggatttttgcatacataggggaacattctgacccatctcttttgtcatacacaagcatactttgttcacatatgtgttttatgctacattaggaaatccatctcaagatacatattgctaaatatgtgatccagattcgtatatatgtgtcatatcccgtactagtttgttttttataggacggagggagtaaatgatatgtctctagactggcgtagcgtatccatttgttttgctgcaagagcaatacagttgtttaggtattgggttctaagccgcacataggctggctcttgaactcctgttagaactttattggcaaatttcaggaggagagcagtgcgctgttggttctaaatctgaaatacccagacctccctgttgatcttgtgaaatggcagtatggtaagctacaattcaatgtcctccctaaatcttgatttcgccattccatagaaaggatcgtctaaggttgttgattgcctctatagactttttggccatttgcagcaagtcataaagtatgtcagaatggctgagagtgctgagtttagttaccattatcaatatatctccttctgaaaatagactcggtatccaacccaactaatctctaatcgatcaatccttgaaatgattggcatcaacatcatgtgtgttatcttggttgttgatggtggtaatcccaggtagttgcagggtaaagagctgagaagacattgtagaacttgagatataccaaggaagctagcctcttcctaggtcatataaattggaacaactgtactcttgtggtaatttacttttaatcccgagaagctggtgaaagactcaagtatctgttgtagaattaatcatggcttgctttgcatctctatcagtgtgttatcggcatattgtagagtgggtggagctccttctattcgtagtgggtggggaagtacgtcttctattctcataaggttattgaatcattttttttttaaaaaaacaactgccataagaatgaaaagtatagatggtgataacgagttaccttgacgactgaatgtgttgacccgttgtccccattcattaaaattattgtctttccagtacatatacatacaggcgctttcatgcattcacatccgtatgcgtatccatatccgtcggatttctaaagactcataccataacgtcgtttcgaatggattcgaagcggatattatctgatccgttttcacagttagattcagtagttgttcaagaacaattaggattagtcatccgaatcaaaaccaaatgttagaaattgttagtatcattattttcatctgttagtaatgtggttttctctagtctagtagtgtgtggagcatttaatggctttattttttaattttcatatgtatttacatacatgtaatgcagttttaacggctgccctgctagctagatctatatatagatatgtatgtgactgtgtatctatggatggaaaaaaatatgaacgaattaaccttctaaatttaagtcctgccatgacttgataaaggcaagtagtaattattaaatcaatagtagctagccaaatatacaaatgaattaactgatcacaggcaaagatagaataaagatatatttagcaacgatattgaatgaaatataatattaaccaccaaaatatacatatgataatatctcactgattcatttctacatcgctgcttgtttgggcacaactaataaagaggaaactcatcttaaagagaaagagaagggagaaaggcaaaaaacggaaagaaacgggatcaggccagaggagcaagaatcacacactagatgccgacgcatggcaaccatttgaaaccatcgatcaaacctgttcctccttattttggctaggccagagggttccatgcgaggcgggtagtgagaacacgtctgtttgctcaacgtactactccttgcaaccgctcgccggcgaccaccggctacaaatacaggcctcagctagccccattcagcactccttcatcctgaactatagctacttagcagcctaccacacagcacaagaagctagctatatatatctagctcttggagcttccggaaggcgacgctgatcatggccggccagatgttcaccgtccgcgacgtgctgtacatataccacgacggctacaactgcctcctggtggccgtgctggaggttccagaggggcgcctgacggaacggagggggggaggggtaaaaagaaatttttttattacccccatatatggtgcccaggtccagcaggccaccgtatgctcccaattcagttcggctggcccatctatatcccgtgtatgtacacaaacaattggagacgcaaccgcaggagccgcagctgctcggcgacgtttcagcttcgcatcgcagaagtccatccgtgactccgccgcactggtggcaccgcggcattgccatgtgccgactacaggtgctgcatgctggcatcatcggccggcggccgcggacttgatggaggacaacatcaacaccgacaacatggctgactgctctcatgttcctgttcctcctccaaatcaaaccaatgtaagcaggccctatttccctaatccatatcaaaccaatggaagatggatttttaagagattgtttggtactttatattgagagagagattgcaacgaaggtgacgacagatttgattatggacgatttcaatacagtgaagactcgtgccgtgaagtttaaatgaacatgtaagtatattgcctacttttgcaaactattcgcttttatgtattgctaatgcatgaaaaaaaaagagaaattgccaattttttgaactgtcaaaagccggctggcccccctttgattttctgtccagctccgccactggtgcctatccaccacgaggagatctttgactacttcagacagtgaatcttcaattctatagttcagctagcactattagaaaaaacattttcgcagatgttgggggattttttttttccaggtggatatgatcctcggagctaaatggccacctcggaaaatgtaaaccggggtagagctaacctttcgcctacgaagatcaatttttccagactgaccacttaagaggtctgcctgaaaaaaatataatttttgcaggcagaaccttatgtggtccgcctaaaaaatcatgccaccaaaaaatatctaagtttcatccttatcctctcctccaccactcatttcccttccactcctctctctctctctctctaatttggtcaccaccagcagcagaaatctgccgccggctcagctcctcgccgcctcagccattggctgcgatggctcccctcctcgccgcctccaccgctggacaacttgtaattaaaaaaagaatcacgcatgacatgagaaaattaatactctctccgggctgataatacttgtcgtttcagacaagggtgagatcaaactttagaatcttttattatgaaacatttttaaaatattcgtctttcaaatatggtgattacatgcatagattagtcttaaaatgtactttaaaaaatcatatatttgtacttttatacatattataatgaaaaataatggtcaaacttgttttttgaagaccgtgctcttgtccaaaatgaaaagtgttatcaacccggagggagtaactaaataggctttgctggaaatgctgttcttatgtgctctgtggaaattacttaatttgattgcccttatcatggatagattattctacaatagaaatatggaaaaaatcatagtgccacattaaaattttcgtatgctaccttcttattagagatagataactgagatttgaaggtagaagggaaaatgccattaaatccatatataggttcatgaatagtactggtcatgcaaacatacattatacccaggttatggcaaaaacttcaaggcatgaacatgttcatgttatggtccaaaatatagtaaaacacctgtcatacataagctctttcttggactatattcgttcatgtatttacatgctcaggccgtggccaaataaccagttgcagtagacatgccagattttgattaagagaaaaaagaagcagcaaggatacattcactgatcaaggcatatgtacattatttgaatacacacaacatgagctgcttctgaaacaggatgtgtgataagttccacagttaattatttccttacgcatagccacccgagtattttctgaaaccacataccactgaactctattcattacattaacattatgtatgatcataaagagcctttcccattctacaaccaacgtgaaactattcagcaatctcccctttcacatatgacatccctcagtcattcttcacaccttcaccgtacaccgacgatccctcgaatgcatggccctataggcacccatggttcatcataccttcatactttaatgtccattgggccaactatgttaaactagtcagactctcataccaatttagaattataaagggcttaccctagaaaaaaaaattgaaaatatacattgtttttgaagtttttgtgactatatacatgtttttagaagaattgtaaaaatatgcgcgtcccgcgcaatggaaacggtggactgactatttagcgcaacatcaaaacgcgggaccgatgactgacactatcccatagtacccatcgatcctgcaggccagttgcgcggcactgcgcgctcccatagagaggttgtgcgccactggccaaatacatg

SEQ ID NO: 37415 - DNA, 974 bp, Oryza sativa
ctgactatttagcgcaacatcaaacgcgggaccgatgactgacactatcccatagtacccatcgatcctgcaggccagttgcgcgccactgcgcgctcccatagagaggttgtgcgccactgccaaatacatgctgccatgcatgcatacgtcatgcaactgtccagcgtgagctgctgctggtcacgcgatgccggctgcgagatcgacgtgatctcgcacacccctagcgcggggtttatccggccaccagtgttagacttctcagtccttaatactattgtatttagctatcattgtattgttgggcttgattgtgtggtcttggcctagccagcccaaacctgagatgtataagatacccctccaggctggaaaggggatcattgagtaagaaatatcagaccaactacctatctcctcttccccctctgcgctgtttcttcctcttgcaactatgaaatctcgctgactcaaatcccccaaatccttgtgcggttcgccaggaacccagagttcgtaacaatttggtatcagagcacggtttgtgcacatcctggcaaaaaagaaatctcaacccacgttgacagagaggatgttggtggcggagggagagatcgagtcgctgggtgagcacgtcatcgagctcaccaccaacatcaacaatttgttgggtactatgtaagggctcgagaggtagatcccaactgtggatgcggggatcaaggatctacagagcatggtggatgggatcgtagcgcgggtgatgaacctcgaaaacaagcagtcgacgtcgtctaccatggcaacgccaccgtccggagggcaccgcgtggaagagtgttaccagggtgttgcattcggggccaatttggtccagaagccaaccctggtcgagggcaagccttcactccatgctacagctattacttttgagttgggagagtgtcttagcggggagtgggtggatctct

SEQ ID NO: 37416 - DNA, 522 bp, Oryza sativa
tcatcatccttcctccctttgccatagccactcttgcaaagaaagtgcttgaatctcatgacaataaaagccatctctttatcttcactttcttcacaacttgactcttcttcttgttttgccttcaaagcaacttcttgatttttgatcatggcggcattcttcactatttgcctcatttcacgagcttcctcttcttgcatctcatgagacacaattcttccaagaatgtcacttggggtgagtctcttgaagtctttcctttcccgtatcattgatacaagagtaggatttcttggaccaaatgcacggagaagtctcttgaccacaaagtgatttgtcatgtcctcactcccaagtcctttaatcttgttgacaaggatcatcatcctatcatatatctcttgtggtgtctccttgtcatccatcacaaatcttccaagccttccttccaataattcaatcttggcctcacgaacggtgggtgatccctcatgagccaattgcaaagcatcccatatc

SEQ ID NO: 37417 - DNA, 553 bp, Oryza sativa
cggcgggaggagggagacgggaccgacaggtgggccccacctgtcggcgaccccgagaggagggaggcgggcggccggctattgggctgggcctcggcctgcggccggcccagcaaggaggaggggggggagaaaaaggaaatgggccgacggcccatttcgcaaaaaggaggaaaaagaggggaaaaagaaaaagaaaaagaaaaaggaatttccctggaattaaaattgcacttgctccattttaattggttaaaattatttctagagctctgaaaattccactaaaaatcctgttaatgaatttcgacatgtagaactcaagaaaaattccacatgtcaaatccgattattaattgcattattttcttagggttttctcctgatttcaccaacattttcttagggtcatttataaaattaaaatttggctagggaggaaaacttcggggtgtgacagccggggagccgtcgccggaggggagccgtccacgtcaccgccgccgctgctgccctcccccggcctccctccagccggatctgggaagggagg

SEQ ID NO: 37418 - DNA, 740 bp, Oryza sativa
ccccgaggggttggaggagtagataagtattaaagtttttttatttttttgggtaggtacgatttttgcaggcggaccacataaggtgcgcctgcgaaaatagattttcgcaggctccgcttaggtggaccgcctacgaaaatcgccgcttaagtggtccgagcgaacttcaccccgatttatatttttgtaggcggtcatttaactccaagggtcatgtccgcttgcgaaaaaaagaccccatgtcgggaaaaatgctttttctagtagtgcgtgactattttatcgatcatggatatcctccttcactctctccctattctaagtatagggtaaaagatacaataaaagatacaatagagcatattgtaatttagctcaacttggtgtgtgttggaatgaaggatgagaagtccttttatagcttgagaatgacggttgaggccattaattccagtataaccgccattggaacgtcagttacaaccatcattggcttgggcctaggccagcggagctaggccggggtcggtcgacccccggtaggcctccccaggcaggcctccctggcccagtcctaccatttggaccacatttaatggatcctcagcccagtggcatgatggttgggcccattttctggtatttcaaagagtttgtgggcctaagactgttgacgaccaaatttggtaagatgtgaaccaggttcgacattgggatcgaggcagattcgataaaaa

SEQ ID NO: 37419 - DNA, 10981 bp, Oryza sativa
  unsure (1)..(10981): unsure at all n locations
nnnnnnnnnnnnnnnnnnnnnnnnnnnnnnnnnnnnnnnnnnnnnnnnnnnnnnnnatcgaggcagattcgataaaaatatcgattcaaagagcagagtatgcatcgcctgcgaaggcatcagctggagtatgcatcagctgagatggatcggacaaaagacagccgatacagccgatggaggtgatgcagccgattccgatgaagatggtttcaaagctgtttccaaaatcgttcaaagtgcttcatgaggatttccacgatggagataaagctctcggataaggcaactgtatctattaattaggatatttcatgtaatttccttatagatatgtttgggcaaaagtctgccgcaaagacttatggtatcttagagtttgttaggatatttcatgaggttttccggcaaggacatattttgtatctcaggtataaatatgacccgaacccatgtaatcaattaacaatcgttcaatacaatctcagcacatcgccacccttttactttcgtttatttcgacgagttcttgctttcgggttgagctgcatagattcgatcttcaactagaggtaaaacttgttatggcggcttgcgttctcggggttaatgcttccatctttatgatactttcaccctgtttacgtaattcgtcaagttatgatatacatgttgcaatttctgttagttatactatatataacttgttatcggctggttcttattgttaggaagcaatcggtagagttatattttgttattaatctagattgcatcgtgtatctaccatctcttgtaggttttcatcatcctgcctagatctcatacttatctttatgcttaatgctgcatcggttaggttcgatctattaagtaatatttataattgtgatatctggcttgttttatgatcatcgagagagatagtatcggggtctcagccgatcttacctaatttagctttatgttttatatgcttaattgatatgctaagtctgccctttatattaagatcttatcgcaataaagtatattaggcttctgtttgatatattctatctgttttaatatattaacatagagtggtatcggagtactggccgatacatgctagatctatctgatcggctatgctataagcgtttataatctttatgttaatgtatattcaatctaagtgatttatattgtctcggcatggcgaccgatctatcccaatgtgacatctcggactagggcttaataggattaatagaatactcatatcaacaagttgcaacttcttttccggaagccgatctctaaagaactccaaggttaagcgtgcttggcctgaagcaatttagggatgggtgaccgattcttcccgagtcctcatgagtgaggacaaagtgtgcagaaaagacttgtgttggtctgtgaggcagtctatgacctatgaaagctgccagatataagcgggctcggcctgtgagaggcgggacgttacacccaatcacttggtttaaatatacgtcgacagaaggattatatagcattaatatcaataactgccgatcaattcacatatgacatcggctcgagaataaatgatatgtcatcggcggctggccgattggctatcgtttatgaatttaaccacggtttcttttgtctttctttcttgttgattgcaggatcaaattaactggcacgctcatgaatctaaaagcaagattttggacctgcactgaagttaagcagatcttccaggccagtgtgtgtttttcacatcaacaaagactcaataggtgaaattctcctcctcttttatgtgtatttcatatcaactttggtagtttgccacctgcatacaaatatacaccaacactcgtgaaaattgttaaaattaaaccctaccactatgttggatgttttatattttcagatttctgcagatattggtgacgtaaaattggtatagccgccaacagccgtgtcctgaacatcaaggccgttgtgcccatcaacctggacatcaactctgggaactacaccaagtggcgcaggcttctcctcgtcaccctcagcaagtacgccctcgccgaccatgtcctcaccgacatctactggtcagatcgctctggctgaatgcgcatggattgtgttgtcctctcttggttgtacggcacgatctccaccgacttgctggagttcgtcatgatgcacataaccacggctcgactcatatggcgtagcctcgaacatcagttcatcagcaaccgcgaaactggcaccctcaacctcaatgtcgagttctacaacttctatcaaagcgatttatccattactaactattgtcgtcgtctcaaagttgttgatgagaaaacacggcgacctgagagttctgcttagttccagtgcaggtccaaatcttgctcttgggttcagggtgtgacagttggtttgatcctgcaaccaacaagaataaacaataaaatcacgttagaatatgataaccgatcggttggagggccaataacatttcgcaatgacctagccgatgcaatctggtcgaattggttgtgtataggataaataaagtaagcaagcctaaaacatgttacatcggttgtagatgcaatcaatcatgtaatccataattcaatctttctctaaaatataaacaaacagtataggtcgaacctaatcaagacagtatggattgctcataacttagatcagatgaattaaagattacatgtgtttatatcataaccaatgatacaatatttaggttaagaaagctaacatatcggctattgctccgatacaaccttatgcaagaatattgatctaagtaaatataccaaacaagcacccatcccccaatatgatgatttggccaagattaaatacaacattgatatatttaaataaggtgatatacttatataaggggcggatataacatgaaaagcaggattaaagatattaaacaaagcaaaatagttatatcaggtaagatcggttgaaaccccaattctatctattggcaatcaagaagcaggttagttttaataactttaaacacgacttagaagatcaaactcaattaatgcaacactcagtatggaaagaaacataaattctaaacaataaaacttttgactgattttcaaggtggtggataccttggctaatctaaactgacaaaacgatttagtcaataccggcaaaaccctagaaaaggcctggccgataggagtaaatcgtcatcaaattagattaactaagatatatgataactagcaattgcaaacgttagattaagacgtctaaaacaacatattaaatcgccgatgcaaacctctatgacaagccatacctctcgccagaagatcaaagccaatgccccaactcgaagcaagaactcatcgaaaaagttgaaaacgaaataggtggcgatacgctgagagttattgaattgttgtggtttttcttacaagatcccatcatatatttatgcccatggtacaaaacttgtctatataggatatgactcaaattttacaaaataaacacaccggcctattgtggactctaacatagatttctaaaatataaaaaggaaaaattgactcttatcttaattaataaatacaattgtcttcttcggactctattttgaatccttaatccaacctcgacatgaactcaaaacctgtctgtattggctaaccgaatccgaatccgactccatatcggccgatacagactccagccgatgcgctgtgccgttttggaaaccgctttatcctcttcaaatccgcttcggatttatatgccctacaatttttgtgcttcctatatatgaaagaaaactgattcgcccatgtgagcaggtgtgtgcagcttgggacgacataacggaaatgacacagggcatccacggcgccaccccgaaataacaacggatttaatttttagattgtaatggcatgtacaaagctagagtctaatatgggctctctatattaattaatgtcaatagagactatcctcctataatagtagagaaaataagatttttaaaccattaatacactaaatatttttttattatacttctttccttttctataccctcatgcaacaaactttccgttaataaatgagagttgaatctgagccgttgtcatgcgtagcaacgatgtttctcattccttccctctctttcttccacgtcactaaatttacttgcataacaacgaaatgtcaccaaatttacttgcataacaacgaagagagcccgttattagacaccattgcatatgccctaatgtagtcagcaggtggttgatgacagtacaagcggtagtaatctgtatgcctattccatcttggaacggggcagtttcttgtactcataggaattgagctgattcttgcaaaggtcacatttttttttcacgagctcgaaccaataatttcctccaaattttgtaggaatttaactgacaaatgatataaattctgcaggtaaatttcttgaaaattccttcattccaaacagtttcagattcccatgttcaaaatggtacttaaacttgtatatataagtgagatttttttttagataaaaataacacacacaaaatgtacaatgctacaagcaagtctagtaaagcaccggaagcgagtctagtagctggtgcgtgcgttgcatctcttcgtctccgttgttctcctgttccattcaacctcgtctgcaacaaacctttgctacaaggaagagagggtcctctaacttatttatttctaactttgagtcactaatatgtgagcccgctgggtaaaagactaagttcaaagagaaataagttaaagaggtctttcttcaaaagaaataagttaagagggactacttgcagctgggacgcatccaatgcaaaaggttctcaaggagagccaaacatccaacttggaagcaagcagtagaaatgataacagtagttaaaaatactaaccgcaaagaatggcaatttctttgtttgtggatcaacagaaataaaatcgtggaaaatcatactacacagtttgcagatttggggtttgcaatgtgtggccaaagcaaacaatcattcagttttaacatccacaacatttcaaaatcaaccatgaaaagctaaacaaaacattacagagatagaggtaggcaacattgaattaaattactttccatactagaaataaaaatatatatagttagaacaaaattctcgcagtgccttcacacctttcaagacgtactaagaaagaaagaaaatactcttttctagctagaccataacgggtttcttcaggaaaaatgtataccagctttgttgaagagcgacaggaggtacaagaagtcaacctggctgagcttcgatgctctcttctctgcaaaatctccttgctgtaatatccccataatcttttctttgaaacatgcacggctctctactaccatatcggcatcatccatttccatctcatcatcatcatcattctcgtagctgctttccatgttcatgtcatcgaccatacttgatagcaatgcaacatcatctggtgacatcttctcctcacctttttctgcatctgaggtgagctgtagagactgcattgtcttgtagttcttctctaacaattcaaggacacgcttctgcttaaagatggcacccaatgtcttgttcttccggttgaaacaaagcctcacaagtccatcccactctttgaagctgacaggaggtaggggctttctgggctcgatacgaacaaccgatgaatcaaccttgggtggaggcttgaagttgttccgtccaaccttcaggagatgtgacacacgtgacaagagctgcacattcacagagagacggcagtagagactatctccaggctgtgctacaagtctcatggcaaattcacgttgaaacataatcaccgcacacctaaagattgggcggtgtgacagaagcttgaatgtgaggggagatgaaatttgatatgggatgtttgccacacagatatcaaagtatggaagatcacatttaaggacatctccttggataacctacagaatgattgaccaggaaatgacatcttgttaggaaattattttttgtattagtgaaattgcaaagaataggggaaacaaaaatgtagtgacaaatacagttaaatggactggatatgccccactgttgttttcttgctacatttgccttccaaaactgttaagcctaactgattatagtcattgctgcaatcaaatactgtcattaatgtatagccaccatagcctcaagtgtcaacaaagtccagtcttcatatcacaccaacactccctcatttatgatacaaactacttacactggaagataaataccgcaatgtactaaggcacatgcaaactccattgcactggaagagagagtattgtgctccatatatcatgtaaaataaaatgaccccaccgtaatacggcattcggcaaattccatcccaccccttctgtgattgttctttgtccattcatgttggatgaagtgcgtatacgcatatcactgttgaaaatttttatttgtggtgatgataacatgattttttttattggaaaatagcatcagtcattaaacagtggtatgtgatacaaaggctaacgtgctgagtttctgacaggtcaaagatgtcaccagtatcgggctaagaaacccacgtccatgggcagcgggaaaggggtaaacctcgcagtactgtagcatcagttaagagttagggacaagattttacatttagtcttactcagggattaagtcatacaatctatacaaggatgcgagtgtatctatttttcattaggctgagtttctgacaggtcaaagatgtcatcagtatcaggctaagaagccaacgcccatgggcaactaaatacctggtgggaaaggggtgaacagtgccctcgtattactgtagcatcagttagagtcagggacaaagattacatttagtcttactcagggatcaagtcgtacaatctataaaaggatgggagtttatctattttcgttaggcagtgaatcagaattaatttaatccctccctcaatgttcttcacccccaacctaagtgccttcttggtcgcaagctgccatggccgcccaactatcctccggcagtgtttacccatcatggatttggaccatgacaggagatgcatcaacagaaacattgtgcatgttagcctcacatttgatttccaaggttcaagctttatcatcttactatggataattatttattaaaacatccaaaactaaaccatcctaaaaaagtaagatcactactttgatgattattactagctaaatggtcatgacttaagtcttaactacagatatcatgcgatcatgcatattttgatattgtccaaaacaaaatggttgttacttttccatcaaacttgtctttcatttttttcacagttacaaggagcatttgatagtgtttgcagactctactaacaaaatcagctcatacacttacatatatacatggcaatatggtcatcttgaaccttttggtatgaaattggaattattctatagtgaaataagagaagatcatatgaaagggaccgtttctatattgaagaatagaacggacattcataaaaatgcactgtagaacatgtgagttggcagattcacaaccaccaccagcactactctcttttaaaggagtaaatgtatcaatgtttgctgattattcttaggtattttgtttagttctattacctttcctcttaacaagaaatggtatgtctacacagggaatgtagccaggaggatggctgggaggcatccgctgctaaggatggcatttagactttgtggagaagaacattgggagggattagattaattcttcttcatttcttaatctaaatgacaatacagtacatccttatatagacggagggaaggacccagtttaatcctatacaactatccaacagactagaactgataaccggctgagctatggtactgtgtacgaggtgaggatagcgttctctcgaccggtcctgggttacccttgggctgacctgttggcccaatgccatgacagaatacagattgaaaaagggcactaccattgttggtctgtccaaacaataccattatataaacagtaaaagaaccaaacacttgcttagttctttaaatgtattgtacaaacacaacaacagtactgtcactttgcagtgttggagcatagacaattccatcgtctagttgtacagttctacagtagatgcttgaccaaggtttctttgttttctattcatgttattcctttactcctttaaaagaaagtagtggtggtgctgattgtgaatttcccatcccaccgcctaatgactgacatttttatgatccccttcccccaaccacacgaaaaaacaacacccaaaaaaaatatgaaaagaaatcccttttacaccctcaaaactaaccctactgccagcacattcagtttattcttaaccaaattctttgccaatctagagatcttcaagattcccactgcaatcaattcaaccagatacacaccacaagagcctacattttttctgtcaaaatttcctaggctatgggaactttggccccaagttgtacatgagggggagctgctaacaatgtctatgggggcctgctttttgagacgactgtatactcagtcttggcacattatatttcctagaatcttgaaaagtatccatataaacagaacatcaatgaagcatgcaaaatacaggcagccccacaacacatgggacacacctactcttccagcacttaccaattcagatcattgaaaaggcatcctctcacactgaagcaaataccatgcagcattttaacaatccaaatcctaaaactctaacccgttaccaaaaacaagaaccaaatactgtaaggtacaatgcgtaaagaaactcagcagaggaaacttcactaatagatctacactctaagcacaaacattacaccactctgaattccccagcatcctcagaaattcaatctttttcaatctgaataatacaaacgagtgaattgtgcattgggccacgtacttttacccatgttgcagcttggactagggctcaatcttttcaatttggacaggtaactaaacaaaagtttcgaattggactagtttttttctccatctctcctctccctttcttccatgttgagatgaagatgcttctgttcaacaccatgaaatctctctaggttgcttgagttctatcctgatcctcatttgtattcaagcttggtcagcccctgtgtcgaccggccagaggtcgagtttgagcactgctctcaccctgagaaaggatctggaaactggaaggatgtagaaacaaaaaagcattattcttatacaggaagagtactatcctacgaagcaacggtgctcatccatgactccagcattacgaattggatgggaataagagcaaggtgacatatatacgacagctgtggttatgagaaatgctgcgactctagcatggatttgcatctagagagcctgctagcgaggagtaaattggaccttgctgaccgctcatgccttcggctctatgtagaaggaatcaccggtgactggtgcctttggctctatggagaagaaagaacgaagaggggcagatcaaccggaacagatcgatggacatggtccaaagtgaaaccatttgcataggacaagcagtccaatgtgaaaatattgtttccaccctggtccaagttgcaacattggtaaaagtaggtagcccaatgttgtaatttactctaaattacagtgcaacccaccaccgaatcccctgaatcgctgtcaccgaaccagactacaagcaaattcaagatgcctaagcatccgtattattattaacaggaagtagcactagtccttgcaaagttaacataatccaatcgttccatcaatcacacaaaactggagagaaaaaattaaatgaagagaggagaccatgagaattttaccttgaggcgtgaggcaaaagggtcgccctggaagcggcggttgagctcaagaaccatgcgggggtcgagctcgacggcgacgacggcctttacgccggcctggaggaggcgcttggtgaggttacccgtgccggggccgatctcgaggacggtgtcggtgggcttgaggccggccttctcgacgatggagtccaccagcgccgggttccgcaggatgtgctgccccttggacttctcgaacgggatccctccctgcagccgcgcgcccccgcccccgccgccgccgccgccgcctgctcctccgccgtgccgcttcttctggatcttcccgcccgccatggtgatgggctcgcgcgtcccaacgccgccgccgccgccggaggaggaattgggagagggcggaggcggggagagagaagtggcggctagggtttgggaagaatggaagggaggggtcttagctttcgccttccttctggggctaacgagattacgccacgtgtagatgcacggatcttgaagcaactctcgtgtccgccccgacccagcactcagcactcccgggctcccggccggtatatggagggagtattaaatacagagtaatagattatttatttaattatagtaataaattaaatattttaaaaataaacttactaaatggacgtgactacacagctagtggtctaaactagctaccactctatctataagagacaccatctacatatacttcaaatacaattttctcttaaactattcattcaatctacgatccgattacaccgttatattcgtaacaattaaatctttacatcaaaatctcacatgattatattttgatgaaaaatcacaaattacttttatgatatgtctaa

SEQ ID NO: 37420 - DNA, 1413 bp, Oryza sativa
  unsure (1)..(1413): unsure at all n locations
caatggatttacttcaaacgaacatacaaagttacattcgttttgttctaagttacttctataatatatgtaaagtacttttaggctttactgaatttaattttgtatgtctaataagtaatttagtgaaatctaaaagtaatttaggcatatcataaaagtaatttgtgatttttcatcaaaatataatcatgtgagatcttgttgtaaagatttaattgttacgaacataacggtgtaatcgaattatagatcggataagtaatttaagagaaaatttcataacaagaaaaaaaatatgcataacctaatagaaaaactacttgcatgcatgtatgtaacgctactagtacttctcacataattatccgcgtcgctcgttaaatctaaattgagatgcctctcgaaatagattttgcgttactaaatactctcttcgaattttaatacaggacattcttgacttctaggtatataagtttaaccattcatcgtattcaaaataataatttattttgttaatttaagcatgacttaatttgcatctttacagaaagaactgaataatattaagaaacttaggaaacgtatatatattctttaaaacgtgaaacaaataaattgtttcgataattcgatcaataaagtgaaaataacaagggccggagtagacgcttggcttctctgggcttcaaccatgtttggttgaagggactaaattttagtttatgttacatcggatgtttaaacactaattagaaatattaaacatagactaatggcaaaatccatttcataaccctgtactaattcgcaagacgaatctattgagcctaactaatctatgatagcctatgtgatgctacagtaaacatatgctaattatggattaattaggcttaaaaaatttatctcgcgaattagctctcatttatgcaattagttttattattaatatatgtttaatacttctaattagtgtctaaacatccgatgtaataaagactaacatttagtctctgatccaaacaccgccttatccaaacaccgccttagctttcatggcctatcacttaaccctttggtggaggacggtgagttttccgaatgctctcgtctgatagtgtctagtgacaaccgagtttcaatggattaagttataggtaaaatttaaattttaaacttaattttaaattaatctatgcgctttttcattcttttctattacattgcaaaaagcaaaagtataatagctttatctaaaattatttttcctcatttatttttctttacagcttatcacgtggaggcgtgtagctaatcaatatgcttgggtcatcctcaatatctggcgcgaggggcttaccaacgnnnnnnnnnnnnnnnnnnnnnnnnnnnnnnnnnnnnnnnnnn

SEQ ID NO: 37421 - DNA, 3117 bp, Oryza sativa
  unsure (1)..(3117): unsure at all n locations
nnnnnnnnnnnnnnnnnnnnnnnnnnnnnnnnnnnnnnnnnnnnnnnnnnnnnnnnnnnnnnacctcaacccccatatagagctcccttaccaactcacctactcaacacatattgactactaacccaatgttattattttgtctatgcttgtctgaatcatttaacatatatttaacaccctaaatgacttcaaatgaaaatattatcaactaaatagttatagatctcatcgtgttttataacttttacatagaaaatatcttcatccgatgttgtttgaagaattcaaaatttcatttttcaaaatatatctcactttataacatgtaaattttgtgaaatgaaaatattttcaattataatgtgtgtagatctgattgagttgtatgactttgatacggggcatgtatccatccatgtcatttgaaaaaaaaactcaaaattttgtttttaaaagtagatctgatcacttgtaatgcatgttcggggatgtaaacgatctctaatagaaatgttgttagttataaagttgtggatatcattgagagctacaacttttatataggacatgtttcaatccgaggttttttgcaaaatttaaaaatttgaattttcactcatcactgacgggtcataactaccacccgtcagagataacgttatctgtgacgtgtgttagttaaagacccgtcagagatgagtggtctcttttgtgatggttcataatactacacccgtcacagatgacttcacatctgtgacgggtcctccctggtagccatatattgaagaggatattttttcggcccgtcagagatgactcatctttgacgagttgcgttggcccgtcacagatgacccgtcactgaagcccggatctgtagtagtgcttaatcgtagattattttgtggtgtttacactttttaatcagtaaagataaggacatgcatataaaaggtttacctatatttttttattaagaaaaaaaatgtaaaaatttaaaaccataaataaaacgaaggcaacaatactgctctcactcccttcatctcaacaccataaacactagagattaaaaaccctagcattttccagtttcaccaaagatcatgaattgagaaaattctagttctttaccataagacaaacccatgtataatgtacgaagaaaaaaagacttaatgtgatagacacatataagagatttcaaaaaacacccattcaagaactcatcttttacaccggttagaaatccccattaatcccggttataacaaccctgacatctttagtaccggttgaaagtatactaagttaaaaaaatgtggaatgcaagattcaaaaaaaatgtggaatgcaggattcaaactcaagatctcctcagccctcatacgtgtcaccatcccaagtgcatccgacttgaatagagatgttgtcttttttaactaaccctagagacgtctttagtaccggttggtaataccaacggtaactaaaaaatgtttctagggacttgaacttttagaaccagtaataaagatgtatttttagtactggttgttaacactaaccgggactaaaaatgtttttagtgacttagacttttagaaccagtactaaaacatctttagtaccggttcttaatctagccaaaatatttatgattttgggtaccacgacgaaacatttgcttatgagaagacattggcagagaactcatcttttataccggttggaaatcaccattaatcccgggtataacaaccatgacatctatataataccggctgaaagcataccaagtcaaaaaaaaaatatgtgaaatgtgggattcgaactcaagatctcttacctcatccctcaagcgcattatcatcccaccttctacatacgtttgacttgaacagagatactttctttttgaactagcccgggagacatctttagtactggttggtaataccaaccaggatttaaaaatatttctagggacttggaccggtactaaagatgtatttttaggactggttagtgttactaaaagtgtttctagggacttggatagtgtttctagggacttggattttcagaaccggtactaaagcatctttagtaccggttcttaatctagctaagatatttgtgattttaggtaccacgatgaaagatcggttctccagtagtgagagactgtcagaatctctactaatagaaagataatgcacgcattagatcttaaccaagaatgcacatactatgtcaagaaataaaatgatcaccagagaaccagaattgatagtactatagagttatataaaacataagcttgcattaaagttcctttgatttaattatcatataaaacttgtataagactgtaggaaattattttaatcgcattaaacatgcaaaaatgaaagcatgaagtctctgttccaaatagtgtctggtccactttctaaatagtgtctggtacacttccaacttcattcattaatttctagtgaaatccaattggaagtggaccagatactatttggaacagagacttcctgcagcggtaaatctaattggagaggcctctccaattagtcttaaccagagacacccacgtgctagtactttaggagttttggttgctattaatccattgagcaagtagaggaaatattcctatcatctatgcttcaaataaaattctcttaaattactcatccgatttataatccgattacaccgttgtgttcgtaataattaaatctttacaacaagatctcacatgattatattttgatgaaaaaccacaaattaattttatgatatgtctaacttacttttagatttcactaagttacttattagacatataaaagtaaattcagtaaagcctaaaagtaatttacatatattatagaagtaacttataacaaaaataaagtaactttaattaatgtcttttttcattgaacagattatcatatatactcccaggagtatgtactccatcttctctattggataatccattagcgtagttcaaaatgatttgtgctgaaaaataagtttttttttatttgtagcgtgcatgcccagtttttcggtgggttcaaattt

SEQ ID NO: 37422 - DNA, 3574 bp, Oryza sativa
taaattcagtaaagcctaaaagtaatttacatatattatagaagtaacttataacaaaaataaagtaactttaattaatgtcttttttcattgaacagattatcatatatactcccaggagtatgtactccatcttctctattggataatccattagcgtagttcaaaatgatttgtgctgaaaaataagtttttttttatttgtagcgtgcatgcccagtttttcggtggtttcaaattttagaatcatcaacgacactccaatcaacacgcagtacgtttttcccttagcgggatgcatatgctgtcttttacgtggaagtatgtactgttttttagttggcaacagtatatactgttttttaggaagcagtatatatactctttgcagtgatcagcagtacataccttttgttttgttgtagcagtatatacttttttttagtagtagtatatacttattttttgttagtagtagtatatacttatttttaggtagcagtggtatgaactgtttttttaggatatggtatatacttcatcccaggttggagtagtatatactgctttctttaagaatcctgtatatacgtagatctctgcttggatccggcatctttcacaaattatatgctgtgattttagaagcatgtactgatgtctttcagaaattgtatggtgtgattttagaagcatgtactgatttaattatttcagaaattgtatgctgggatactacatacttattgcacagtagcatgatgtgttttagtagtacttatattccgcatacagatcagaactaagactgggaggagattttaaagaacaaaatagttgttttacaatacccgatttagaataaattgaatcatattatgttcacaatagaatttgcaatccaggcagcatatggattcacatgatacatttagccattctgaaaaagaaataaatgaatctacaatatacccaattctcgaactgcacaagctgctttggacagaattttaattaatactggcaaatcggcaattcatatactgtcgggcgttggccaccatcgatccttggtatatgtcacgcatctgtatggagcaaagttaggtaggggcttcatatatatcattaggattaccagaggaataaaaattgaatagaaacatgcatcaggcctactgatcatcgaattgaaggaggggaaatggctacatgcacatacggatctaacgacatatacaaagttagtcctcgatctgcaatagtaatcaatagtaaaatggaaagataactacaggatgaataaggattaagaacggcatggtttaccttatgcaagtctgttgccgtgtatggattttagtattcaccaggctcgtcggagaaacccagatggctgatcctgcatcccgcccgatcaaccgtcgttcttcatcgtatcaacaccggtggccaggagtcatagctagcggtgcgccgtggtgcagttgcctcgctgctccttcggctggcgagtgtggcggtcgccgccgccgcgtggacaaaggccgtgccgcagcaaatcgccgatcgatgaatgccgctgccgtggtcaatcgacaatagtagctctcgatccgaatacggtggagagagtaaagctgttgccgtcaccggatggaatggaaccagggatttatatgttctgtttaggtcctattagtccggcataattaagtattatgaaaaatattttttcacgactataacaaaaacgggtttagtgggtggatccggtaagcatgttgttgatcgtggctggttgttgatcaacggtggatgggagcaggagtacgtacacccaggtgcatagaatcatttatatatatatatatatatatatatatatatatatatatatatatatatatatatatatatatatgtaaattaattggtgctacatagagtatgggctccaagattcaaattgagtatatacctaatttgaatgagtatgaaatttttttaaatgtttagatatgaacattaacttctttactaacaagttcaaacaagtttgaactgagtttgaactttttttttgttagattttggttctaggtatataacatccaaacatataattcgttaggtatgcaataatgaattgtgaaataaagttgagtttgagttgttttgttgttaggtatttgtatgaatcaaattcttatacctaggtatatactcacaatttgaaaatttttaaaaatttgagagaatttgtgtgttttataccttggagcccgggcaccatggagtcccatatatatatatatatatatatatatatataagttatttttagatttgattaaaatacttcctatacattcataatgctctgagatgattacttttattatttttttagttaatttcataatttgtgctgattaatttaatttctagatagagtcatgtttttatctttacaacggatttacttcaaatgacatgctaaagttaccttcgttttgttctaagttacttctataatatatgtaaattacttttaggttttactgaatttacttttatatatctaagaagtaacttagtgaaatctaaaagtaatttagacatatcataaaagtaatttgtgatttttcatcaaaatataatcatgtgatatcttgttgtaaatatttaattgttactaacacaacagtgtaatcggatcgtatatcggatgagtagtttaagagaaaattgtatttgaactataggtggatgatgcgtcttatagatggagtggtagctggtttgtactagctgtgtagttacatcctacatgcaggtatgctctctaatcatgtacaaatcatccacaaaatcatgcgcaacaaatcatccataattcacaagcccatcacaaaatcatccaagttattcacaaaattatccccaaatctaaaaaaaaatcgacaacaaaatttaacaaatcagttaaaatagaaccgaagggactatgtgctaataactgcttcgtttttaacgtcggaggaaaaggttcacaatcaaacaggatttagggattaatgatcagatggatggcgatgcgtcggcgctccgatgatctgacggttggtatttattgagaacatatggcatagccgtcagacgagacatcgtcggaatcggaggtcttctccgacttccgagttgccaacgggaggcgcgcgttccgcggccataaataacgcggcgccaaagcatcaccgcgtccatccaatcgcgcaccaacccatcgcagcctggatgccgccgcgacgccgaggcgcaccacgcggcgcggccgccgcccgtctcgcgccgtaccacaaaggctggctgtcgcgacggcgacggcgaggccggacgaacagacgcgccaggaacgacgacagagacggcaacggcggcgcgttctcggacgttccggacagcgtgctcgccaacgtcttcacccgcttccctgacgccgccgacctagtccgctgcgccgccacgtgccggcggtggagccgtgtcataaccgacgcggccgtcctcc

SEQ ID NO: 37423 - DNA, 8485 bp, Oryza sativa
  unsure (1)..(8485): unsure at all n locations
cgggctcaagctctgtgtctggaaccccatgacgggggacgtcgtcacgctcccgcctctccatggcgacgacaagccgggagcgtacgcgtgcgccttgctcaccgccgacgacctcgacgacccgccgtcgtcgtagccaaccttcttacgcgtcgtcgtcgtctacaaccggcgaacgtacaccgcgctccgctcctactcgtcggacaccggccgctggagcgcggaggctagacgatcatcaggtcccaagatgagcagctacacgctccacaaccttaggcagagcgtcgtccatggcggcgtggcctactggcccctggcgcacacggcattctccgtgcgcgccgacacgccggagcccgaagagatgccgatgccgtcggccgttccaaaggcgccgccgcacgaccatttgctcggcatcagcccggacggcaagctgagcttcatcgtcacctcaaggtatttcgacggctccgccggagtgtcaagctgctaccaccttgctttcggcagcaatggcggttgtacgcgcgaacaggtgagcgtctgtacatggcgcgtcaggttgcatgagttgagagtgcatcgctctgacgccatgaacctgaggtggttttgcgagaggagtggcttgctcttcttcacaatcgacgccaaagggagcagcactcctggtgcttatgtgctcaacattgcaaccaaggagcttgagaaggtggctgatgacatcgactgtaggtcatggacgaacttcgttggatatgagatggatcaggcatcttattacctatcttccgtagcttgctagctattgatcgactttgttcgtatgcggtctgtgtaggcatagtttaactacgggaccgactgaccgtgaccgtgtataaccattgctttttatgttttttcttgataatagaaaagatgaacgtgcgttaatttgtacatatgtgttgatggataaataatcacaacccatttattcgtttaggtgagaaaaggaagggggttgagagagagagtgggaggggctaacatgtgggtccgaaaaaaattaactaggtgtgaccttcactaggctttgttcagattcaacgggtaggaactaatccctcccgcacggaaaacggaacggtccattagcgcgtgattaattaagtattagctatttttttaaaaaaatagattaatttgatttttttaagcaactttcgtatagaaactttttgtaaaaaacgtaccatttagtagcttgaaaagtgtacgcgcgtaaaacgagggagaagggttgggaacatggggttgcaaacacaacatgggtgttggggtatatggcctaaatgtgtagtgcttatgtggcatctagggctagggctactctaatgagcgaaccgtactgtgaatgtccttagcaattcccgtggtttgcttgggggcttatggggccttttatggttccattgtgctttaagctttgggagagagctacaaatcggacgtccgatgttacagaaaaaaatggacggtcaaatgtttcagttgaccgttggtgcaacattaagttatacatggtgaaaaaaaaatcaactctgaaacatagagaaattttgtgaaacacaataagaacacacggtgaaacttattgctatcacgtatgaaaccattaagttttcattgtttgaaacatatgtttttcttttatcagaatataatcatgtgatatatttttgtaaagatttaattataacaaattcaacggtgtgatcaaatcgttcatcggatgagtagtttagaagagaagatatttttaagatcactaaatacatgcatgcatgcatagtgtgggaagaaagccactagaatgttagaagagagtagggacataagcatcccatattttttcggtcattggtgaaacattgagttatacatggtgaaataaaaatttcagttattaaaatatttaatttttttaatgaaacataatgaaaacacgcgttgaaacatattgctaccacatctgaaacattaaattttaacggattgaaacatatatttttctttcatcatatatttttctttcatcagaatatatcgatgtgatatcttatagtaaagatttaattataacaaatataatggtgtgatcatatcatagattggataagtagttcaagagaaaaagttattttgaagatcattatagcatgtatggatgtgtaaagtgcacacggagatatatagtagtttgtctatttgatttttcatgttatgccaaacgtctaatccgaagcatttccataagatttgtgctatgcaggtggaaaaacacgcaagcttgtactggttagtaggtattccaacatagacctcgtttcaaaggactagaggaggtgcatgttaccattgggccacaaatgtttttattagttacacgcaattcatagtacaatctaatttgtagttatattatattagtcttaaaagtttttttttaccttaaaactgattttaaaccaaactcatataaaagattcgaaaatggcgccaactccacaagagaagtggcgcgaaacaaccgtcgctaccccttttctcccgccacgttcatacgtgtcacgccagtacgccacacgtnctcatccactccccaatcccatcacgtattcacgtcgcccgcttcacctttcccccgaaaggccgaaaccatcgccaccttccaaaccgaaccgcgccgcgcgcagcgaagagatgggcgggaagaggaaagcgcgggcgcctcccgccgcggacgccacggcggcggcgctggactaccgcctcctcgcccacatcctgctccgcctcccgtccccggccggcctcgcgcgcgccgngaccgtctgccgccgctggcgccgtgtcgcgtcgtcgccgacattcctcagcctcttcagccagatccaccacccgccccctctcctcggcttattcgtctgcaacaatgggttcgccgtctcgaggtcgattgccgacagcgagctcgtcggcgaggtggtcgacccaaccttcctcccgaggctcacgccgaggggattcctcggcgccgttaaccgctgcatcgacttctccctcgactccctcccttacgacgagcactgggcgcttgcggacacccacgatggcctcctcctcctctgcaccaagttcgccgaccgcatggacatcccggacaacttcgccatctgcgaccccgtgtccggccgctctgtcctcttgcacgtcgccccggtcaccaacagcgcgtatctcggcgccgctctgcgcaccgacgacagcgacggcggcggcgtcgtctgcagcttcgagttcgagatcatcctcgtgacctgctacaacatgtgggagccgcgtctgtacgtcttctcgtcgcgctccggccagtggaccgtgcacgcctacatccccatgttgccaatgctcagcgccttcagcggcgacatgcacgccaacgggagcgtctactggctgatcgacgacggcggcgacggcggcgcgtacctcctggcgctcgacgcccgcaccaaacagttctccatcatcaaactgctaagcagcatgcggacgcgctacgacgggaacatgcgcgtcatcaggtctgacgacggcgagctccgcgtcgtggcgttcgcggccgcagcggcgcggctcgaattctggcacctcgacaagagcaggagcagcagggggcggtgggtgcgggagtcgcgggtggagctggcgcacgtcgacggtgtgatggagctctgtgtggacgccgatgacgacgtcgcgaggatcatggacgccggcgagggcttcgtcttcctcaaacactatggctctgaatgggtgtttgctctcgacgttcaggccatggtgttgttcaggctgcctcacaggaggtactactttgggccggctcttccctacaggctggtgctgaagccgccattgccggcctcttgcgggttgatcaactagacagcaatcatcattcaccaatgtcaaggtagaagaacctttcatgtaatttaaccttgctgaaattctgtaggtatttttgtgttaacgctgttacttacattgcttagtttttctgtatttcgtactgtggtagtaagattatacaaattctgatttattttcccacaaagttttacacaaagttaaaagtttctgttaaatagatacacaacgttgaaatattgcatttcaatctccctcaaaacgaggctcataaaaaatgcaaattctaagactattaataaaataaaaagaaaaattcgagcgatgaaattaccactccctaatatccaagtttatagaacatttagaaaggattatctagttccgtagttgtatttgttggagtagtgtatttctattttatggttagtgtcgggaaactcttattggcacacgtaacgcatgggaatctgccgaacagttcgggccaaatcttgaagaaagcgggatacttaatgtgttagctacagcactgcacgggttgagtcgcacaacacctagtatccatcgtttacagctaggactactgagttctctaatcccatttgctcgcaaatttaccaattatgagttgggcgctttaaccattcaaccttggatgcttaacagggatcgttgtacatcgtaaatgctttcgcttctttggttggtactcttctatctgggactgggaaagatctgttgcatttcaatttcttttctttctgtattttctgcatagttaattttttagtcatgcacccacgaacaaaaaatgcctaatgcagataccatatatatgcaggaaaagttaattcacaacacttgattttacattgacgccatgatcagttctcttttatctgttcaacgggctcctatttgcttgtttagtaacagagtatccttttgtaataattaagtgtttaacgttttatgaacactagttaagcctattcaacttttcttttttagtttttgataactggttttagcataatttcaagagctgttggtatcataattttggtgaactactcttggctgtctggtactttgaactatccgccttgaaaacatttttcagttcccttttaactctcagacttcatcttcagtagggatggttgaatattagattatttgttcactagccaagtggctgagaccaaatatttactttcagaaattgtctaaaattatgctggggattatgataatgttaataatatatatcacaggttttgttggaaatacaaggttgtcatgattgataatcagggtttattatattcaagaatcttttgtgcgtcccttctgtttggacaaagtttctctcaaggtaagagagaattaggggatttcaatcttgtattgatttggccctaaatgacatatatgtacacaagagaggggaacacaagagaggggaaagtactctaatacccttgacatactactacacttaacacccccactcaaatgcaatgtgtatgcaataacattgcatttgaagggtaaactaaacactaggacacaaactaaatattagcctatctccaaagtcttgatgatgtcgtcaaagtgtgccaattcttggatgatgacgatgaagaagaaaaagatccatctcctcttcaatgaagtggacctcggagccttcacaaactgttcttcggccctcggtaccttgaagccttcacgactcgttcttcggctcttcattgattcagagacgttgacgatgatggaaggcccttcacaaactgttcttcggaccttcatagatctgataaaggaccttcacaaattgttcttcagtccttcattgagtgatgatgatgtcaactccgatggggagatggtgatatgacagaccagctccgatgtggagctggtgaagtgatagaccaattccgacggagagctgatatgaagctggagatcaattggacggattgaagaatatgcaatggacttggatggattgaatggcaactagtaaatgacacaatgatactaatagatatgcagcaaggctttaatggataaactagataggatcataggaaacaaaggaaatcaatttgtagaggacattgatatgctagcaaaagacataattgtggctgccaaggaattgcatattaactgattaattctatccaatttggtagcagagagaagtagctgatgaagatggacaggagatggtaatgagagaccacgaatactttcagtaaagcaccaaattggaaaggcaaaagcatgaccacaagctgggagcaactctttgaagcattttgtcgagcaccttgtgtgcagcatatggacttgtgcagtttacaggcaatagccaagactgaaggatctgccggcagcggcagctgcttgctctgctacaaacgggtgacagggcctgattggcggagaggaccggcgccacgcaaggggttacgacaggcagcgaggtgtggagctggtgaggagatgcacgccgcgacgagcggcagtgacagatgccgttgacgagcgctgcgacgggcaacgaggacgacggctggtgaggacggcttcgcgattgacgacgagccgcagcggggacgacatggctgacagcttggacggggttgccgccggcggcgtgcactgatgcgtgtggatgaggaaggacgatgctcctgactgctgcttgacaggcttgaggacgggacgacgaacaacgatgctaccaacaacttgacgaagacgacggtagtacgagacaatggctcgccggcggcgaccgccgccggcgtgccgccgatgggaacttggtgggtaggattagcagtaaggctctgataccatctcaaggtaagagagagattaggggatttcaatcttgtattgatttggccctaaatgacatatatgtacacaagagagggggaacacaagagaggggaaagtactctaatacccttgacatactactatacttaacagtttcatcactgtcgcgtagtgtcaattttgtggttgtaatgaaatatttgttcactacatatggagcattgtgattcgttgaaatggtaacataccgagtatctctgcgatagcacatcacctgctggaatgatttagcttttaattggttattcagcaatttgctggactcttcaagattcgatctcttgtgttttccagtgatttttattgtctgttattttgtaggtttattgtctacttttcagaagagaggagaacaagaagcctttgatactcgacagcatggatggtgttgactaagaatgtgattggaaatggctggaatcagtcttgaagcacacaatccttcgttgggtcaagtagtgtggtagactggtagtgcactgaactcttgatgaatggtgctagcagaaaaaaaaatgcttagtcgcgctttgcgtgactttgagcgttagtataacctacctatataattagacattgagatattgatcctgatattaattgaaggtaccggtttcgtaagtaccctaatctttgttctcaaatatactccattaattcctatatataagtatttctagtttgtttagtaaagagtaagattaaggaggaatgatctctttcggttacttactatcaaattttgaactactccgattggctctttccgaacacctgattggctaaaaatgttagatatgcattgaaatattagtgtcctagaaatgctttatatttgtatataaaatttgtcgtagaaatacttatttcgggaatgacgcagtagcaagagatgtaaatggaggaatgttgtaattgattgacattacaaagtagacgaagaaattaaataggatatgactatgttggttaagatgagagagtagatgtagaaatagctatagtttatgataaattttgaatgttaaaacacctatattttagaacggagacaataataacactaagtgctcctaagtgtaaggtgtgcgtttgtagggactgttttaaaataaaatggtacatagtgtatgctacttagttgttgtgtgttgctccaataccaagcaatcaaaagtagtatacattatagatataaacttgcatataaattcaatacaaatttacggtaagacatcatattttttcctttatttagtcaggacattaattaagcaaacatatatatagtgttaaaaagactttttttaacggtagtgttaaatagactaaccacatgagttctctgctttttgaggtctttagtctggaagcatccggattggtccaatgtgtttccactgtcatagatgagcatgatgatccaactgtgtattttcatttaccagttcatccaacggtccatacattgtagatgatatggctcatcctcctttcagaaagcttgttgctttcatatatttagattttactcagggccttttaaatgcttgaa

SEQ ID NO: 37424 - DNA, 16009 bp, Oryza sativa
gtcaactactagctccaaaaatcatatatagtcaatttaatagttaattcatataatagttatatactacactattaatacgtggtctcacctatcatacacactgcgtcttggagtttgtgctacagctagctacaaatctctagcccgctgctcttctctttcctcttttatcttcttaaaatatgtttatagctggtttatagtgtgttattgtactgctcttaggctgtgtttagttcagcgcaaagtttggattttggttgaaattagagatgatgtgactgaaaagttgtgtgtatatgacaggttgatgtgatggaaaaggactgaaatttggatccaaactttggatctaaacacagccttagagtgtgaagacagatttgcttttgaattgcaaaatatttctttaaacgataatatacaattcacaatcaatgcctctcaattaaactgtaattaagcattaggtaaaactccaaataacccagttttatagttgaatattgtttggaggttcagcatgttttcgcaaagtttttaaaggtttttatttttagtttctgtattttaaatcccaatttttgagggtgagtacattttcaaaatgacaccaacccctgtgctttcagtggtaggcgacgtacccgtcgacagcgaggcgcctatggtgacttcgtcaatctctccagaatttatcggcccagtcttcgaagatgctcataggggtagggtttacgtatgtgtgttcataggggtgagtgcgcgtgcgttgtgagtatttgtgttgtactgtgtaatttaaaaaaaaaaaaggcaccaaccccaaccctgtgaaaaggagatcgtgcatatcctcgtaacgggaaatcgtgcatatcccccacgatcaatctctccctcccatctcgccgcccgaaaccatcgccatcttcccaaatcccaaatcccaaaacccaaccgcgcattgcgtttgagtagaaaatggccgggaacgggaagaggaaagcgcggtcgcctcccgccatggacgccacggcggagctcgacgaccgcctcctcgccgtgatccttctccgcctcccctccgcggccgccctcgcgcgcgccgccaccgtctgccgccgctggcgccgtgtcgcgtcgtccccgaccttcctccgcttgttccgccggctccatcgccacgcgcccccgctcctcggcttcttcgtctgcaacaacggcttcgccgtctcgaggaaggtcggtggcgagctcgtcggcgaggtggtcgaccccgccttcctcccgaccttccaccccgtgccgagggaattcgaaggcgccatcagccgctgcggccacttctccctcgcctccctccccgacgtcgaccgctgggcgctcgccgacacccgcgacggcctcctcctcctctgctccaccttcaacgaccgcatgagcatcccgcgcaacttcgtcgtcgccaaccccgtgtccggccgctccgtcctcgtgcgcgacgcccgcttctaccagctcgacgcggagagcgcgtacctcggcgccgcgctgcgcatcgacgacgacaacgacggcggtgccggcggcgtcctctgcttcgagatcatcgtcgtcacctacttcatgcctgggccgggcctttgcgtcttctcgtcgcgctccggcgcgtggaccgtgcacccctactccgacgccggcaccgccatcatgcccatgctcggcgcattcagcgacgacatgcacaccaacgggagcgtctactggctgatcaacgacgacgacgacgacgacgacgacaacccatacctcctggcgctcgacgcccgcaccaagcagttctccaacatcaaactgccgcgcgccatgtggacgcgctaccgcgggaacatgtgcgtcatgagatccgacgacggcgagctccgcgtcgtggcgttcgcggcggcggcgctcgacttctggcatcttgacaagagcaggagcagtagaggccggtaggtgcaggagtcgcggctggatctggtgcgtgttggatattctttggatcggtttggcacaaaatggaactacaaattggaatgggattgaatcataccttgatctcccggagttcccatttctctgttgtttgttcttctttcttttcctctcgtttggaagcacagagaggattgtgtctcggttcttccctgtgtttcagtggcttgcttgatcgggtagctagagaaatttttcttagggtttaactcttaggtattgatctctatttatagccactgcacatagggggaaccggcactagggttaaggcggtaatccccccgatcggggatgttcttgaaggggcgatcactgtagcgattgccctaaaaaaatctttcttgccgactttggtttagccgatagatcacatttgtgttcacactaacattctcccccttgatcgtgaggctaaacttataagtttatttctcaataaaatagtataccaagacaaaagattacagtgaccaatataaaacatcacagaatccagtgactatagcatactattatactttaaaacaaacttctttaatcttacgagctctttgaacttattacattaggcttatacaaacttatggactcacttttcaataaaacagtacatcaagacactagattacagtagtcaattaagcaccactgaaccaagtgactatggttcctatttaatttcaaaatgagtccgccttagttttatggggagtcagtgccatataggttcctatttattccaggatcaaaggcttttctaccaaacccatgccggcaacatgttctttaaatacaatgggtggtaggccttttgtaagtggatccgctaacatcaacttagtgttcatatactcaacgcttattgtctgatcctggatcatttctttcacaacatggtacttgatatcaatgtacttggcagaagcacttgatttgttgctactcgtatagtatactgctggtttgttatcgcagtataatttgagtggttttgatatgctgtcgaccactcttaatcccgggataaagtttttcagccatattgcctgtccagtagcttcataacatgccacatactcagcctgcattgtcgacgatgcagtaactctttgtttggagcttttccacgatacagctccctttgcaagggtgaatatataacctgatgtggatttcttatcatcaacacaccctgcaagatcagagtccgaataaccaacaacttcaaggttttcagactttctatatgtgagcatgaggtctttagtgccttgtagataacgcaaggtcttcttagctaatttccagtgttctagacctggattagattgatatctgccaagcatcccggtaacaaaagctaaatcagggcgagtgcacacttgtgcatacattatgcttctgatagctgaagcatatggtatcgacttcatctgcgcagcttcatactcattcttaggacattggaactttccatacttatcacccttcattataggagcaggcgaggctgaacaattatgcatattatacttcttcagtaccttttctatatatgctttctgagataaccccaaaacaccatttgatctgtctcggtaaatctctatacccaacacataagtggcttcaccgagatctttcatttcaaacttagaggccagaatttctttgtttccagtagcatatttctgtcattactggctaagagtatgtcatcaacatataatattaggaagatgaacttactctctttaaacttagcgtatacacagtcatcctttttatttgctttaaaaccaaattgtcttatgatttggtcaaactttagataccactgccttgatgcttgctttagtccataaattgatttctttagatgacatcccatatgttcttttcttttcataacaaaaccttctggttgtgccatgtatacatcttcatacagatcaccgttcaggaatgccgtcttaacatccatttggtgtaattccaaatcataatgagcaactagtgccataataattctgaatgaatccttagtagacactggagaaaatgtttcattataatcaatcccttctctttgtgtaaatccttttgctacaagccctgctttgaacctttcgatatttcccttggggtcacgtttagtcttatagacccatttgcagccaactgttttggctcctttgggaatttctactaagtcccagaccttatttgtactcatggatttcatttcgtctttcatagcttttagccattcagacgaatgttcactcttcattgcttctttaaatgagatgggatcattatctagtataggctcattcacctcttcaatcataggttcattcacctcttcattcatgtaaatgacatagtcacttggaatcgctgactttctaactcgttgtgatcttctgacgggctcgttattttgctcatctatcacaatctggggctgctgagcatcctcattattctcaccatttgatacactactagaagtagttgcaggagcttcagcaggtgttgcatcattatttctttctattgaaggtgcaacatgagtatgtgttgagaaaacgggttcttcaattataggcattggaacataattccgcttctcttccagaacaacttctctgggtgtcatactccccttgattatgtcattttccaagaacacagcgtgtcttgtctcaatgaactttgtaaactaatttgggcagtagaatctatatgcctttgacttatcaggataaccgataaaatgacaactgattgttttgaggtctaattttcccatatttggattgaaaactcgtgcttcagcaggacaaccccacacaagaaaataatttagggttggtttcttcccagtccataattcaaaaggtgtcttagggactgatttactgggaaccctgttaagaatgtgtgtagctgttttaagagcttccatccataactttaccggcagagtggagtgacttaacatacttcgtaccatatccataagagtgcgattacgcctttcagctactccattttgctggggttcgcccggtgctgagtactaggccttaatgccactttcctgtaagaacctcgcaaaaggtccaggaatttgaccataagtagtatgtctaccgtagtattcaccaccacggtcagaccttacaattttgatctttcgatcatgttgattctcaacttctactttgaaaattttaaatttgtctaatgcctcagatctttctttgattggatagatatatccataacgagagtaatcgttggtgaatgttatgaatgaatcgaatccatccactgacttttcattaaatggaccacagatgtctgtgtggatgatttccaaaactcccatacttcgatttgcacctttcttgatttgcttggaatattttcctttgatgcaatcaatgcagtgaacaacatctgcatctgagaagtccaaaggataaaggatgttttctttaatgagacgctcaattctccccctcgaaatatggcccaaacgatagtgccataatttcgaaaaagtcttattatcgttatgttttcgtttggtactgatatttgcatttgaggaggagtccacattataggtggcatcgcacacagagatttgataaagttgttcccgtccaacggcgagaccaacctctttattatcatgcataattatacatctattgtttccaaaagtacaatagtaaccaccgttatctaaacgtgaaactgaaactaagtttcttttcatagagggtacataaagaacatcatgtagctgaagtttgaagccagtatgaagtgtgagagtgaagtctccaatagcctcaacttcagtttcaactccattagcaactctaattcttctttcccctcttcttagggtcctcctcatagcgaatccctgcaaggaatttgcaacatgaattgtcgctcctgagtcaatccaccaagaattggtggcataatcaatattcagggattcatcaacaaaagaaataacatcagtacctttcttactgagccatctcataaacccaatacagtctttttggcggtgtccactctttccacaaaagtagcacccatccttttctttttccttttcttctgtatagggatttcctccagatttattctgctgggattgactcgaagattgccctttttctttaaactgaataggcttaggcttcaaatactccttcttaaatttcttatactttttcttctcagagtgtttaaatagatttgcatgatcaactctttctgccttaagcctttcctcttcttgtacacacatggctattaattcatcaatgccccacttgatcttcattgcattataattgattgtaaatggagaaaactcctgaggcagagatgacataatgaaatggacaagaaaaccttcagagatttccatttccattgatttaagcttagaagccatatgacattttttcataatatgttccctcagatttccagaaaaatcatatctttcattaaccaatcttttaataagagtggtggcataaaccttagaagagcctttaaactgctcctcaattttagcaagatattctctagctgtctgagtatctggaactgctactcttattgcgtcaataatggagcttttgataatcataaggcatttacggtttgaaatatcccattttgcctttacttcatcatatatcctttttagggtctcataattctcattttccggtctaggttcaactggaggatcattatggagggcataatcaatatccaacatagctagagtaatttccagcttttctttccatgaagcataattacttccattaagttgttcaatatttcccattattccggaaatttgtgaggcataagatgctgcataagagagaatcaacagctaaataagtatcttcttttattgatcaaatccaaaacagctttggccagagaaggaaatgaacaataaaattttgtgaataagtatttattaatcagctttggccagaataataaatacaaaccacactttattaatttgtttaaaactccttttattaattcaatcaaaacagctttggccagatttgaattgaattaataaaattttgtgatcaaataaaagtcaatcagctttggccagaatgacaattatttgtcacacttaattgtaatatttatttgtagcggaaataaacttcataatgcataaaacaacaataacaataataattttaactaataaatataatatgatcataaaataaataaataaatgaaagagaattttatcacataacaaaatcacttattattcttattatcattaactaaaacataataaatatcttcaatgtttaaacacaaatatcataatcataatcataattcatcaaaaaaggaaaatttaattgtaatattatctcagcccaatctttttaattaggcccattactatgcagcccgttactatgcagcccataacaatttttttttatctgggccttcttccctgaggcaggccgcattcagcctggcctgttacggccgagccgcctcccgcctgggctccaggcccaaaaacctgggcctgggctggcgtttgccgcctcccgcgtggcctcgtcatcccgcgtcgggagcgagccgatctgagccgtccatctgatcggacggccgagatcgctcccgcgcgggacaaaaccggcgcgcgactgccccccgcgaaaccctagcccccattttctcctcccctctttctctcacacccgcggcgactgtgagcgagacgacgacgacggcgaaacggcgcacggcgggagtagtgatggcgccgccgagccttgctcgtcggggctgcgtgccgccatagctggcgcgcatccctgtcgagcgttgctcgacggtgccctaatgcacccgccagtcgcacgcgcgaggaagatccgcggcggcgacggcgagacggggcggcgacggctacctcagcgaggcggcgtcggcgaggaggaggagccgggccggcacggcgggtcgcgaggccgctcggggaccaagtcctcgggcgcgcgctcgcctcttattgcgtcggtggcgacacggaggtcgccgccggccaccatgcccttaggtaagcccgccgcactccttttctccatgattttagggttagggtttcatgatttgggaaattttgaggtctttactgtagctagggtttcggttcttggggatttgtctgagatttccatgaacttttgcttccccttcttctaatttcttcaagccgaaaccctagaaggcctaattctacttcttatgctttgggattgcatgatttgggcttaactcaacttgacagaggggtttgggcttgaacataaagaacaatttgaacatgaacacttattgagttccaatttgaggccaacccggtgctctgataccattgttggatattctttggatcggtttggcacaaaatggaactacaaattggaatgggattgaatcataccttgatctcccggagttcccatttctctgttgtttgttcttctttcttttcctctcgtttggaagcacagagaggattgtgtctcggttcttccctgtgtttcagtggcttgcttgatcgggtagctagagaaatttttcttagggtttaactcttaggtattgatctctatttatagccactgcacatagggggaaccggcactagggttaaggcggtaatccccccgatcggggatgttcttgaaggggcgatcgctgtagcgattgccctaaaaaaaaatctttcttgctgactttggtttagctgaaagatcacatttgtgttcacacttatagtgcgcgccctcggcgcgccgctgtttttgacggacgccgatgcctaccccccgaggatcatggacgccggcgagggcttcgtcttcctcaagccttacggctctggatgggtgttcgcgctaagcctcgaggccatgatgttcatcgatctccctcacagaaggttatactttgggcgggcacttccctacaggatggcgctgcatccgccattgccggctcttgctgattgatcaacaagacagtaattgtcaatgtccaaggtagaacatgttctcccatttaatcttgctgtaattctcgatctagttgctttaattttgatgtttttgtgttaacaatgtttgtttctagtgctgagctttgctactttccgtatcgtggtatcaaagttgtacaaattcggattagtagtctagtagaattctacacaaagttaaacgttctttaaatagacgcacaaagttaaaatgttgctttgcaatcttttttcttaccctgtttactacacacattttattaattcaagggtaatgcacccatgaacacaaattgcctagtgcactgtaaattatgtgacactagaatacctactagtatatatattcagggaaagtcaattttcaacagttgatttttgcagtgactagcactacggtgaagccaccatgatcagttctcttttccctgtacattgggctacatttttcttgtttagtacattgccgtgtatcctttgtgaataaagtgtttgaacgctttctgatcactaatttaagcccatttaacttgatattttttatttttcgaatgattgttatttaatacaattttataaaattcttggtatcagaatggagaacaattgttgcatgactgttagtttgaactctcagacatcagacttcatcttcagtagggataggaaatctgttgggagatgaattttttttggtagttgcatacttgcatgactggtagtttctcagtttggacaacacatacaaggctgttattgttcaattttgtggtagtaatgaagcaattgttcgctatgtagcactctaacatagtgacatggccttttaacttacccattatccctggaatagcatctcacttgggctgtgtttagatccaaagtttggatccaaacttcagtcattttccatcacatcaacctgttatacacacacaacttttcagtcacatcatctccaatttcaatcaaaatccaaactttgcgctgaactaaacacagccttgttggaatgatctagtttgaactggttcttcagcaattttctgcactgttgaagattcggtatagatcttttttttttttttttttgcggggacggtatagatctgtttgtgtttctgaaataattaagttatcagtccatctgcaaggtgatattaaatgtctgttattgccttactggttaggtttatggtctattttgaagaaaggagaacaagaagcttttgacacttgacagcgtggatggtggtggttaatcatgtgtgcaggaatggttacaggcggtcttgaaggtcttggaagcacacaaattttagttggatcaatatagaagtgtgtgttaattgcatttgttccatgctcttatcgaagtatatgtagctagcgtactgaactgatgttgatgcatggttctagcagaacaatttgtctgtttagtttttgttttactcaggaccttttgaatgcattacttcgttaatgaattggagggcttgtcctgctataaaaaaggtggcatgatgacataattagttcgttaggagttagttaattacaaactaatcagctatacttagttcttctcttttgctactcaatgcaggttgataaatactacctctgtttcaggttataagatgttttgactttggtcaaagttaaactgcttcaagtttgactaaattgaagaaaaaataataatatttttgacctaaaataaatttattatgaaaatatatttaattattgatttaatgaaactaatttgataatataaatattattatatttgtatataaacttagtcaaacttaaatagtagttaaaacatcttataacctcaaatggagcgagtagttagatttagagtcagcctcctcaggtctgaccatgaggctcctggtcagattgaccacatgctaccagctggatcagtcttaagctaccagtcgacactcaagcacttgggagtactgagtaccccattatgtgggatcttgtccatggctgcttcacccatggtggattttgagagatccactggacgcctggtgaaaatggagatggttttggctacggttttacctggtgcagataaggtttgagagcggaaggggaggaaagtgcaacagtgctgcaaacagaactctcaaataaatcttgtaagtggattttataagccacaaatgatgcttcgtgtttgagaaagaacatagaaattttcaacaaaagtttagttgttttctctttgtgatgtctgttttttttacctcaatccaaataaaaaaaattataacattgtcatagtcaaagtttcaaaagttcaaaaaaaataaaataaaaggacatatttgtgactagagggagttctatttgttcaataaaatattagtcttgtttgtgctctagcaaacaaaaatcacctatgtgtttgatgaaaacaacaataaattcacaagttgaaggtagatagtatctacatctatctacacatcctacaagaaaaccaggaatatcatgtgaattttcttgattcttcataccatgagtggttcagaatttcagaaccaaacagcccaattatttcttcgaagacaaatttcttcaagtagccacatttcctgcgatgctaaagaaggacgagataacaaaattaaactttaataatatctttgcactgggttcacatcctctgctataatagcactaccattacaggcactgacgtgtggagcaataggaagttggaacccgcatactagttactatgatggtagtgacgttatggtagacgatcctcacccccaccgaacatcggtgtttggatcattggatgacaaatggtctatccaatgattacccattgcagagcaccatctgtcatgacatatatatataagctctgttggggattatacctttcatactttagaagaacgccaacaacattttggccaggtataaacataacccatggttctgaattggcactattggtgcatagaaaatcgatccattgtagccaagttagaagcccagaattcaatccaataggcgctgaattggtaactttctaacgccggtgaacaatgaccctactgatgctgtactacatttttcataggtaatgctacaacaataccatgctagagaggcaatactgggataatcgttgagagaactagtaaatttattttgcgcctgacacacaagaaaatacaaatagactttgtagaaagtgatgataacttcttacagctttgcaagacaaaataatacacctatccgtttaactagggacttcatcacagtattcgagaatcatagatcgtcttcgccaacatgttgctaattccgtcaaaactaatgtataactattatcgcgaaaatctgctagtgaaaaatttatttttttttcgagaaagagagggattcctctcccatttcattaacaaaatgatatcagattcttacaagagcttcttacagttcttaacacgacctactgaaagcatgcaaaagttaaattagttgagtacaaaggatcgtaatgtttgaaattgtaagaagtttctgagttgtcataaatgtttccataacaagttaagaatgtcaaggtaatatttggcaaagcattggatcagcgaaacgaaatagatcaaatgcaccaacgaacaaaacaatagtgttctttttcaaaacacccattggggcatagggctttacttagggtcctcatacgaacctggcactggcaggctgctggcttggtagatcaatgcatgataccagattgccagggcatacgtagtataaggcaacgaaaacaagagaaatttgatatagacgaaaagttttctagcacaaacaaactcatgctattctcatcattttcaaaatgaatcataatatttacgtcatactgaaaacaaattgcaacagcaacagtaattttaagtcaaaactgagagatgattaagtagggagccaatgacagaaagataaatttgctaagtcacaattttctaaggttcaaattcaaactctcagcttttatgaaccagagcaaaaaaaaaaaggggccttgccaaatcatcaatccatacttaacgtaagttgtctgtagtgcttggtggatcctagtcggtgggttggattagttaacttgtttccccattataatcaagaaagtagcctgcgcattcgtgcaggcatgttttttaatgataaactaagccacgacaaaataaataattattctaaaaaaacaaaataaataattattattaccttttaaatataactaaatggtcaaatgtgcgtacaaaattcaacgacgccatccattaaaaaccgaatgtattacactttttcaaaattattctttagcgtctttgcttatttttaaatctatttgttagatacgtatgtttatagatcactccacattctgtcctaaaaatatacgtttgttttattttggaacggtctttaggatactactttgactaataatatttatatttataaaaaataaattgttctagatagaagagtgacattgtatttaatatcatttttatatgattgatcttttatttattttcactataaataattaaagttaaaatgtttgacttagcacttttctaaatatgtttatattttaggatggaataaatgtatggtagcataatcaacatattaaattgttctataatatttcacgattgttggtagcatgcaaagtgttagaatatatgctttttccttagaatttctttgatttctctaatttattagagcgccaagtggcagcttagaagtgtttgtaggaaatttaatggacttgtagtattataatagatagataatagatgtgttttgcaatacagtactctgacatggatgatggtgtatataccaacatgcacaaatgcagcatggctatgctgagtttacaggggtagcgttgccaaaaaaggaaaaagaaaatccacttgtattatgatatacccagaaagatgtagggttttcttaggacaccaagaaaatagaaagtgatagaaagtgtaaagtaagttaaattgagaagttagagttccgtcgacatgatcaatggctctgtttggatccggagggctattaaatagccctccggaatcttgctatttagaagtattaaacgtagattaatgacaaaacccataggctattttacgagacgaatctaacgaggtatattaatccatgatttgctacagtgatgctacagtaatcagtcgctaatcatggattaatatacatcattagatttgtcttgcaaaatagcctagggttatggaatcggttttgtcggtaatctacgtttaatactcctaaatagtaagattctacagggctatttaatagctctgaggatccaaacaaggccaataaaaaaaaacagagcctcgttggatttcttacatgaaaattgcaacaaatacaaaggacaaatttgtaattttggaacatatgagtggtagcgtccagaaggaaaaggaatatgttcgtagccccaccactactgcttatctgtctccatgttcggcactttttatccttcctgtactgatgcttgaaagtcgacgactgtagcccagctccagaacgaagtcaatttggggcttttcagttcctctctccaaatcggtccaatgtctcttcccccagccgcaatcccctctcgctcaaccatggatatggtaatttctgctctctattttaaagattcagtttcttcactctaccaatgatgtgctgtttcgatgtttaagtttcagcaactattttcttggtaggattatgctctaaattttcttgaatctagagggtaataatggttgttaacgacctggtctgaacgagaaaagaagtaatccagcaagattcaactattgatgaagggtgtatagtataatttcgtcaataatactgaaggggatattttctgtgttccttttctgcttgaccatatctgtattccgtaagctttttctcttactttgtaccaccactcttcgccacgctgtttgtctccttcatgattttccatgcccacattcgaagaaaaaaaaaattctgctggaaagttatttatctccattgagcagagcagcaacttctttctaaaattctctccatagatttaactgagattgttatttgactttgccctagggaagatatctattgccctctcattaatggatgtcaataacataaggggatctcatcaagtactattaaacaataaggacagaacaggatgatatttactggctatgcaactttctccatctaaattcatggtggattcattcagctaactaagcatgacagcatcagtagtttcctcagttttgcagaggcttggtgaccttgtcatccaagaagctacctttttaagtgatgttcctcgacaagtatcatccatgaaagcagaactgagccagatgcaatgcttcttaaatgttgtggatgccaaatgtttggaaggaaacagcatgatgaaaaatctggccagtaatattcaagacgtggcataccgggtggaagaggttattgacaatgctcatttcatttttaggaggagaaagacttctgtatcaaaatatactcacatctttggtgattccattgacctccgtgaggttggcaaaaacatacaagttataagaaagggaattagtgagatttttgagcggtacaacagatacaacgcagttaattctagcacttcaa

SEQ ID NO: 37425 - DNA, 8232 bp, Oryza sativa
aaaaaaatgtggattgctgagggatttgtcccaaatataagaggatatacacaagaagaagttgcctacagatatgtagaagagctggcacagagatgtatgatccaaattgaagaaagaagtaaaaacattgggtggataaagaaaataaaagttcatgatgtgttgcgtgagtggggaattggacaagccaggaaggaaggtttcttgaaagtttgctcaagcggcacagatgtggagacttattatgcagatgaacagaggtgttaccgtgtagcatttcatggttactttgataatgaagtgggaaaatcagttctgaatctccgttctgtgctggccttcaaccctgatggcaaacgtctgttttctttcaatgggttgcatttgttgagggtgcttcatttttgcagttccttaaagacatgtaccttgcctgaagaaataaacaaattggtacatctgagatacctgggtttggaaggtagtactgttttcatgttcccttcttatatgaaaggtcttagaaacttgcaaattcttgaagcaagtacagctactgtcaaggcacttccaagttccctctggagcatcgcagcactaaagcatgttcatgtctaccaagtactgcattggaaagcccaggagattagaacgaaacgaagcttgcagactctttatgtattttccataatgcagtgtgatgctctgacgtggaaaagaacaatcaggtctctgcaaaaaatgagccaacatgtttcctggtgcttagggatagcctctactaaacgcgtgaaggaaaaagagacccaagaacatgaagaatacaatttagatataagggtagatgccttagaatccaaagttgatggtttagaattgtctggatgttttaaagagcgtcacgttctgaatgatgtgcttccacatcataatctattcccaaactttctattgcagctcaagatatcttgtcccaatatactaaatgatgatccaatgccaattctggagagacttccacgtcttgaagtgcttgaaattgttaactcatcatacacaggaaagagaataacatgttcttccgagggattccttgcattacgcagtttggtacttatggatattggtttggaggagtggaatttgcagcagggatccatggcgtttctcgctgttttgactctcaagtgtaccatgctgaggagcatctcaaatgtacttcaccagctggatgatttggtagagcttcgcttgatttgcatgcctcagctctctgttgatgatcatgagccagctagggggaggggatgccgtgtcatgatttcagttgacgaggaacaaacttctgatacttgaatttgtaagtgaccccatgcttgaactaacttcattgccatgcctctctagtttcagctacaagaaagcttatattctttccccattttggataaattgcaattttgttattcctgaggatgcatagcaactgacaacatatctgatctatcttcttatatgttaaaccagagggtttcccagcaaaataatctacgacgtcatcttaaacacaaagacttcccgatctttcattctggccatataggctgtttgatcattcatatacgcaaaatatattcagcggccttcatagaacttccatcacttgcatttgcaaccaggtctatctctttctctcctgatgtactatctcccactccttcctttccacacttgggatgccgcctcctgttccccacaaagcatcataccattcccaccccttttggtgaggtccaagatatcgaggcagaactgcagcagaatttccatccacaatcaccttctaaccagacaggacgagttttatttcttcctcaagtaagcagaggaattccattttctgtaagtttgtgataggttgtttttttcttgaccagagaccaaagaggctagctttttgtagaaagcagtatagtgtacataataggatgtgtttaactcaattgtatatagtgttttagttctgtatcgaaagagttcttatgcatagaagatgccccttaaaaaatacatgcaagatatgccatcctgacccacatgtcattgactcatgtgggtcctacatatcattgagataccgatggcatatctcaaactttacaaaattataatggcatggttccaaattacccatactagggaaaattggaactatgctatatcggggtggggctttctatcaaaaaagcaatttctcaacagtcaggtttgtgtgatccaaattatgggtatttttaaagtttctaaatgtaaaaggagcagtttatggattatggttagcaatattatggattatgcttctgccatttgttaagaatattgaagacgctgtgtatatagccaaatatatttatatattacaaagcagtgtgtcacctagtttagtttgtgcttctactgttcaatgtctgctgctcaactggcttgaatggacgcctagttggccagggttcagaatttcataatgaaatttatgaaatcaggtcttccgatctcccttaggatatcttttccccccaaaatagaaaaagttgtttaaattcagtcaatgttagttcaattttaattgtattttttaaatattccagatatttctgttctatttgtaccccaaaatgtttttatttccgcaacttgggatgaattttgcagaaagaattaaataagccatatttcgttcagatttcaatttttttgcccgttttataaattattttagaaagtttcatctatatggtcgcaaagtattgctaaccattacttagtagtaatatgcccgtactaacgctacggcgatatttagtaatgtgaattaaacaatcatatgctaaaagatacatattttagcaaaataagttcaaatgtctcaaaacctgaaaaaccaaacaatggtatatatattgttgtaatatatttggtctaaaaataatttcatattcctgtaaattatcgtacatgttgtagtaacatggtaaatttgaatttaccaaacctaagggactgtgatgccaggatctacaggaactctagcataatgttcatatcaagcagaacatggtgaaattcttcaactacttgcatacacaaagtgctcaaatctgttgattacttcaggtgatggaatataatcacggaaaccacaaatctaactgtagatgcctaccaacaagtaaataattgattgtttaaagaatctcaagaacgtgtgttagcttgctattcctctatagcacatgaaatttactatgatggtgggaacaaaaatcatgaaatttatttgtcgcagctctaatttcctaatgaacatgtacatccatcaggtattttagttgatgcagacacacatggaacatatattactcccatagatatgcacctacatagtgaaagtagtagaaagaactatccatgtgacaatcattaaaaccttgagaacaatctaatcctaactgataatatttctggtcatgcaatgcagtttgaaaatcattatctaggcagactttagtattatgggtagcagcagcacaggtatatcaagatagtgactaaattagtacaaaatccctatctctgaaggacacaaaagacaacaataacctgaaaaatatcttcaagatattttctttggcttcattagaattgaatcctaaaaacccacacagctccttgttcaaatggtattcacatagacactacttagaattgattatccgacacaaattacttgtgcctgaataaagtaattcagcaagattcacttagcataatgccatagtagcatgaaatgcaaattgcggttcatgcacaatccaatcatcagacttgcagggtacaccaactctgactctatattctttctgtttctgctctctaattagtgatagtgaaagcctctgttttgaatattatacaattgctaaatctagcaaagtaatcctgcaaatcaaacggcacaaaagttaatcaaaacaaaacgccattcctccatcagaattaataaaaatccaacagggagattgatcaatttgtcatagtaattaaaaaaaaagctagctagcaatagaacagagctattcacctattcttggcccctcgtctgcatcggcatgccggcaccccgtctccactttcacctctccacagtgcctttcctccaaccctaggattacatgcagattacgaaaaaaatgggactgcatcctgatctagtagcaaggaaccggatcaacagcgtgtgacagcgtctctcccgcaacctcctccatcgtgctggcctccgatcgagaaagcgtggtgccccagcggttgtgctcatctccggtgaccgcatcgctcactccgggtgacgagcagcagcgatgagcgcgcgacctcgagcggcggggagagaggagaggttagggtttagcgttctacgggaagctggggtcagcggcgacgtcaatcgtggcgaggcggtgtgatggtgaagatagctggcggcgcgtgacggcgtgagagggagaagagagagattagggctggggaggagcgatcacggtttgggcgcggttggggtgggaagggggcactcgtttgtggggagggtgaatctggagcattggatttcacagggataatctagaccgttgagcgatgaatgaaagaatgaaagaatgagtgaaagtatttgttgaactatagggtagattgccaagttgccattatcaagtcatggaaggatttcaattagaaggataattcagtcatattttttgcatgcatatacagagtcacatacgcatacatatacagatttagctagcacggcacacattcaaacaccacatatatgtaaattcatatgctatgacccatcaccaaattgttcaatcaatcaaattccaattaaaaataaagctgttaaatatgaccacacactaataattgaaaatgatagtctaacagtttcttgaaccactataaacattgggttaacgattgggatggctaatctctaattgttcttaaactactatggaatcaatgatctcaaaaactatgaactattgcattattacattacatattgtgataattcaaaaaaatgcaagaaaaaatacgcctttataagattttgcgattttgcttgttgtttgccatggccaactagttgatctcgtcatatcaccttgttggagcgtagggcaagggcattgagatagaacttcttgagccatgcactatcgatattatttcgccttgccttgccagatcaatgacccaagagcttggagtggccagattcagcaggcactaagcttcgagtggccaaattcagtaggcactgagcttggagtgaccagatctaaaaggcttcatcttcctgtcgccatcatagtggcccatccaaagatgttaccatgcatcggcatactgtgttggattcgataacctaagctcgaagcacttgatccgcttggcattttaaagcgcgccaaccatgtggaagcaaccagagggtgccggtggactctgcgtctcacagtgcctaactggcttggacttactcacaacaacaaaggagggagcgaaggggatggcaatggatgagtggccgctgtgagcctagatctgacaggtggaaaaggggggggggcagatgagaggcaaatagggcaagagatggcatagctagctaggacctcatgtgagaagaaaaaagtcacataggaagcccgtggggtgggagaatagaggcagagtggttgatcctgcctaatctgtaaattgttctctcttcttttttctttgagaaacatagtacaaacgcaggcactcataaaacacgtatactcacctctatgaacgtacacatgcacatcctaccttatgagcacctccagaaaacttggtcggcataccttgagattgacgaagtcaccaatatggacgcctcgctaccgacggctacatcgcctaccactgaaagaataattaaccataaatgcgagtaggcgtgtctagacttgaaccagggtaggttagttctaccacaaggaacctaaactacaaataataaataatgttttttttatcaggaagtattaaacatcggattcacatttttaaccgttctcaaatatgaccattcgagtttgatctctaatggttcaatgataatattaagaaccgttaaagattagcatatgttgctttgtgcttagccaccatggaaggagagtaatattgacgtagtgaataaaatttagttgtatgtactaaatctcgttatatgaattaatgtgtaaaatttgaaaatataccttgtttttgaagtttttgcgattatatacatttttttgaaagaatggtgaaaatatatgagtaccgcgatatgaagacgcacgactggttgtttcgtgctgcgtggaggcacgagactagttgttacgaactctgggttcctgacgaatcgcacagggatttgagggatttgaatcaacgagattttagagttgcaagaggaagaaacagagcaagcagaggaggaagaggagataggtagttggtttgatagcttcttgtttcagctgtcgtaggttctcccatgtcgccagagtagcaggaagaccagtccatattgcaccactcataatgtacaactgccttgccacgcttgatcaactgtcggcgaaggatggcttcgggctgcacaactgtagaatcatcaaagcagttaaggggaagatctgcgctttctggtgtgttaggcttcagagcttttttcaacagggatgcatgcacgactaggtggatcaaactcccttctggcagttctagatgatatgccactgctccaacatgagctaacgccttatagggaccaaagaagcgaaagctcaacttctgacaggatcgtcgagccattgtcatctgaacatagggttggagtttaagatacatcatgtcacccacttcaatttccactcagatcaatgtttatcagcttgtgccttcatttgttgctgacctctaagaagttgttggtggagtatctcattgaggtgtgctctattctgtaaccaaatctgaacatctggcacagtacctcatatcaaccaagccaaactgatttggttgcctggcaaacagtgcctcatatggggatttgccaagagcacagtggaaagatgtattgtaccaatgctgggcttgtgccaaccaatcagcccatttgtgaggacaagcatgaactgtacacctcaaatatgcttctagacattgattcagcctctcagtttacccatcagtttgtggatgatatgaggagctcatattcaacttaacatctgccaaacgaaacaactcttgccaaagtgcactggtgaagaccctgtccctgttagatatgataacttgaggcatcccaaagacatcatagatattatgaatgaaagcctttgctactaacaaggctgtgaaggggtgagtcaggggaatgaacttagcaaatttggtaaatttatctaccaccgctagcactgtatcatagccatctgacttgggcaatccctccacaaagtccatactgattgtatgccaagcatgcagaggcactgggagaggttggagcagcctaggagttttgcaatgttctgctttggcctgctaacaaacagggcatgtctgaacaaaagtaatgacatcctatttctgacctggccaagcaaaaagattcttaactcttttgtaagttgcatgtataccagagtgacctccaacaccactgctatgtaaagacagtagaacaacttgtttagcttcttgatggtttccaagccaaaatttccctttaaacctgattactccatcaacaagagtaaaattgtacaatcctgcaggctgaagggtaagtttctgccgtaactgttgagtgttagcatcctcatgataactttctatcaccacttccaaccacctaggctggcttactaagatggcctgaagcacttctttttgcgatagggatggcctgaagtacttcagtctcttcttttctagataaagcatctgctacactattgtcttcccctttcttatacctgatttcgtactgcaatcccatcaatttataatgaatgctttatgctgcatgttggtggtcaatctctactcatctaggtg

SEQ ID NO: 37426 - DNA, 1812 bp, Oryza sativa
ttcagggtctttaccactgaccactcctgtactgctttaatttttgctggatctgtggcaacactgtccactccaataatgtgtccctggtactccaaatgttgcaaggcaaaagaatacttaatgattaatcaaaagccgatgctgctgcaacctagacaacactgccttacaaacttcttaatcatatcagcaaaaaatctgttcatcacctgttgaaaggtggctgaggcattagttagcccaaatggcataaccttgaattcatacaacccttggtgagttctgaatgcagttttatactcatcattctctatcagtagaatttgatgatacccagacctcaaatccaactttgtaaaccactttgatcctgacagctcatccaacaactcattcacaactggcattggatacttgttcttgacattgatgttgttaagagctctgtaatgaacacaaaccttcaagttccatctttttccttcactagcaacacagtagaggcaaaggggctgaaacttggttgggtaattccctattgcagcattgttttcacctgtttttctatctcatccttttgagcatgtgcatacctgtaaggtttggtagtgacaggtcttgcattaggaaccagtggtatcccatgatcaaaatctctatgtggaggtaatttttttggctcttggaagattgactgaaattcttgtatcagctcctaaactaggagtggcactttttcacaatcatctgaacttccagaaattgcacacaactgcactagctgagagattgatcctgctttggctaaaccagttaattgcttccctgatatcaacctacactggctagttagatccttgactccagtcagagtaatgttgcttcccagtgttcatgtaaaaacacggtagcctgggagatctgcttaactccagtgcaggtccaaggctagccttgagtgtataaaggacgtgccagctaatttaatcctgcaatcagcaagcaagacaaaatagtcagccgatcggccgataggctgatagcgtatcgttggtggtctcagctgatgtagttagactaaatcggctatggactggatatatcaaagaatattaaaccctaaatacgccttattggctgtaacactgtctatcaagattgataaagaagcttaagacaatattatcaaaatagccgatgtaatagtatctagagcaagaaagaaaatgtactagctaataccctagtacggacttatataggcaaatcaatctatataaatatatcaaactgtgatcagtttgtagtttagataactcagccaataccgatctagcctgatatagctatatggaatgatatgtctatatatgtggcaaatatatataaaacttactaaagaagcatgaatattaggtaagatcagctgaaactccgatgatatccttaattataattgtttccaggttagtttctagggttcaataaaagactagagatgatgcatcacaaagtagataaagaaacctagagtctaaacaatcaagtaacaatcacttttcaggatggtagatgccttaaccaatctaatgtagtaggaagatttagctgatactggcaagaaccctaaaacgagaaccagccgatagaggtaaatctagatactaagactagattagctaagacatatgatagcagatgaccatgataaaaggattaaaatatctaaagcgacataatagccccgatagcacaagccatcgagacatgttacctcttgtgaagcgaactcgtcagaaagtaaaaatg

SEQ ID NO: 37427 - DNA, 1427 bp, Oryza sativa
  unsure (1)..(1427): unsure at all n locations
aaagaaacctagagtctaaacaatcaagtaacaatcacttttcaggatggtagatgccttaaccaatctaatgtagtaggaagatttagctgatactggcaagaaccctaaaacgagaaccagccgatagaggtaaatctagatactaagactagattagctaagacatatgatagcagatgaccatgataaaaggattaaaatatctaaagcgacataatagccccgatagcacaagccatcgagacatgttacctcttgtgaagcgaactcgtcagaaagtaaaaatgaaaagggtggcaatgcgctgaaattgtattggattgtctctcatattacaatgctagggggttcatatttataccccgagtacagacatagtctattataggcacgactcaaacctttctaaagatgaaatacaaacaagaccatctacgacggtctcttacgaaatctctaacaaaccgacataacctaattaatagatacaattgtcttgcataagctctatttctgattggcaatgacggttatcttgatctaggcccatgtcgagcccaagttataccgtatcggctgcctgccatatcggccaagtcaagcttctgtccggttatcaaccgatacaatatttaaccgatgcgcagtccaactccagattcaactcgattcaacaccaaattcgtttcgatcttcttccttcttctccgaatctgacgcaaaattccattgttaacaaccaggtactgaaacctcattcttttccttttccaatcaatccacattgggctgaatctctctaactagtccattcccagaatcgtgtcatagcttcccaaactcagcaccttcaggtcacttgagaaactctgcccttgacaccaccattcagcatttggaaccatccttgtacaagacaactgcctcctatcagctattgtcactttagtggaagcaatatcctagatagccaatttcaactcctcaaccagatgctcagctaggaaactgctagaactccctgagtcaactagaatgagtaactcctgattctatatgagcccgtgtagtctaatagttcttttacccattgcaccagtgggagcacattcagataagaccaactcttcttcactgctttcatcttcttccaccattgtagactcttcttcttgattttaaaatacttccaaaagttcctccagcacctaaagttgcacagattttggacacttgtgccttgggccaaatttctctccacatttaaagcattcacctctggctcttctagctgccttgagtgaatcaaacctctcttcccacttgggcttttcttcaatcttcttattctcttcagggcttgctcccannnnnnnnnnnnnnnnnnnnnnnnnnnnnnnnnnnnnnnnnnnnnnnnnnnnnnn

SEQ ID NO: 37428 - DNA, 635 bp, Oryza sativa
agctacaaaaggtaataaatggctaaaagctctcgtttaaataggaacaaacatcctgctacagttcaaaaacgttttggaatagcaaaacagcataatatgcaactcctaaccatgttttcgctactgcgtaccattgactcctgtaccatgattttttcgctacttactgttttttaaccatgctttagatgatctctctgcggagaatatcttcagaaaatgatcatggtacagataaattagacaaatgttcagctaaaatgagaaatagaacaccatatggaacagagaaaataaaaaatgtgatgtcaagcaaatgggcaaatatattatctactgaagttaagtaatagaacagcagtgcagaatccaccaatgtcctccttcaatgagaaagagccttaccgcagcttatcattgtccaactgaagctaagcaggtttgtcaatataaatattgatttcataataaaaaaatcatgcaagggaaggtcttttatgcgtgttaaataattcatagtggaagtctgaaagataagaaaaaggaagcactttagtgagcccaaatgctacttaagctattaaatctttaaatcaaatgatgtaattccctttcaagcagccatgacaacc

SEQ ID NO: 37429 - DNA, 12827 bp, Oryza sativa
  unsure (1)..(12827): unsure at all n locations
tattgcaaactctgggacatatactcttaaggaacatctgctcgttatttgtactagatgctggggcacgccaatggcgcgccgcctgcatatagattgcttgattagtgtagactaatcatttgttttcaggctgaatcaatgattatgtaagaaaaaaaaacctatgaatacatttgcagtgaatgccgttgatgagtaattttccatacattgttttacagattctgctgagaacaaaactcttacactttacaatctaaagatgaagcaccaatgcatataaaaaataaaatcaaagttttacataatgatcagagtaatgtccatggtgatgatacaactatatttgatcatacaaatctaccagtcaaaagaagacatattgtggcaataacattctccgctgaaaggttcacatccggagtattaattgcaatggacctgtccaagcacaatccatcggtattagtgagtttttttaaaaaaatgtttcagaggatatcttcaaatcagtatcagtgaacatattggaagctcagaagacacttattaattggatttaggaagtgtggcaacataattttcattttacctctcaatacagatagttatatcaagtgatacaacacgagactacatttgtatttattacatgaaaatgcagtgagagcaaaagaactctagaatttagattgatatgaaattaaacatgaagggtaagaaatttacaggataatcaactaataattatccttaactttttcctacactaaggcaaaagaaaatgtgtgtaaattaaattgactgtcactgtgaagatgatattctgtcagtcgaaaacgctaaaaaaaaatgcaatagcaatgcaaaagtaaacacctttcatcgcttgagttgtctcaagttgaaagccattcaagatccagaaagtttgaatcaccagaatgaaggcaactttctttcaacggctggaacatgatgtatctgaggtaccatgggtgtacctgtagcaaattttgagagaggaattaaggtttcaaaaacaaaaatggtagtagtccactatttaagacaccatgctttttcatgatttcctagtaaaatacttgtatgagaaggataaaggtcaaccctgaacgaatagaaaccaaccttaattttgatacctcactttcacagctcaatgaaatttcattgccatgtactgaattagattccaatactggaaattgtgacccacttttaacatgaaggcaaccactacatccagatatggatgtatttttttcacaaagaatgctgccatctgatctcactctttttattgtatgtggaattaaagaaaacagtataagaaccccttactgtttacagagtgcatatttcaataaggactatttttgttttattagaatgtaaccagcagggaagctacaaaaggtaataaatggctaaaagctctcgtttaaataggaacaaacatcctgctacagttcaaaaacgttttggaatagcaaaacagcataatatgcaactcctaaccatgttttcgctactgcgtaccattgactcctgtaccatgattttttcgctacttactgttttttaaccatgctttagatgatctctctgcggagaatatcttcagaaaatgatcatggtacagataaattagacaaatgttcagctaaaatgagaaatagaacaccatatggaacagagaaaataaaaaatgtgatgtcaagcaaatgggcaaatatattatctactgaagttaagtaatagaacagcagtgcagaatccaccaatgtcctccttcaatgagaaagagccttaccgcagcttatcattgtccaactgaagctaagcaggtttgtcaatataaatattgatttcataataaaaaaatcatgcaagggaagttcttttatgcgtgttaaataattcatagtggaagtctgaaagataagaaaaaggaagcactttagtgagcccaaatgctacttaagctattaaatcttaaaatcaaatgatgtaattccctttcaggcagccatgacaaccaacggatatcacttctccctagaataacccaattaaaccattgttcctaatttaatccatgatcaccacagagatgcacggtcacagttcaagtcagaaccaaaaatagagggaatgccatccagagcaaatattcaagattaccagaaccacttttaagcctagaacattcagaaattactccctaattaccaatttgcttttaaaggcagacgaattagtaatgaacatgtgcggaggcttgatgtggacggatcgaaaccaccgacttttaagcaactaaattaaatatacatggaacaccgacaaattccacgccattacatcaacataaaaatgcctagaatattggagtcccaactcccaaactaagctcaagtagtagggaaaattgtaaaattaatatatggtgcctacataatgttggcccaaacactgccaggaacaacacaacgtttaagtactatgttccaggtaaccacaggggtgaagaagagaactctgcaaatgttattaaactcaataagctatatagtactgaaaactgcgtccaaaccacaaatatagtcaagttgacattggcacttctcatatagattaagcttcaaaattagagttcgaaggacaataaacatgcccacgaaccaaccaaattgtccaacttggtagtataatttgaaacatgccaaaactctccatcccaagtttagatttgcaaggtgttatgtaacaccagtaacataacaaactgaactgagtgcagtcctgctcgatgaacaattattacaaaacacatcgagagataatccagaaagtattttctaatccaagataaatcatgcaatagcagtcctgtgaaatgcgaatttttttgacactgttcctagtggcaatgcaaaatgttgtatgcatggaaacacctctgccaccacccatgttcacactgtcaagaatggcaatctatacaacaaaaggaaatgtgcaattttatagccaaaaataaaaactaaatgaaaggtttaaaaaaagttcaagaccatgctgttagagcggcttcaagtaggtgtctagaacatagataaaactatacaaagggtaaagaaaatccttacactcgttcaacttacctagtagtttgataaataaaacaaggttaatacggaaggaagcctttggaaatgaaaagaaaaaaaatagttgcctgtgtatataaaagtttcaagcggcaaaataaatttaatttatgcactacatctagccaaaactttgctccaaacagctcaattaaaatgactggtactcaggtttcagcatcaagtagcaccatttgcatctctttgcaatgttgctatttccttcagcaaattattaaacagtagcataaccacattttcttggaatattttttagagtatagctaccacgcagtgaatatgctgataactaaatggcttgtatcaagacttgtaccaagatttttctggtctgaaatgtgtagaattcatccggacaaaaagcgagatttgtgcatcaggagagatctagctaagttttgcacttctgactggaaactaatcccacatatcatttgaatgtgcaggcaatcattcacagcaaactatcgagaaacagtaatggataaagaatttaatatagagtcaaaaggaccaaaatttgaaaataataccagcaattatattgttttatttgtgtagcaacaacatccatggtagatgcagattcctactgctcaagcacttcacgtatgcagtgacctttaagccctgagagagtggaaataaccattagatgttattatgatacaagtaatcatctgccaattagtgatcaaaataaactttaaaagattatttgggcgacatattgcattaagatcaaatngactgtcactaagtagccatgcgaaaatttcagtgagttggcatttatgatgatagatcaagagttcccccattgtgccaaagacataaataaacaccggtaatcgaactttgttagttgaaattatcatattcatcgactgctgatctaatacaggaaagtggcaagtctgctcgcacttgaagctcccaacgtctagtggagatggatgaggacttaccgatcatgcaccttgacaaatatcttcagctggagaaacctattgatagagatcctgtgcttggtggagtactcatcaagcacacactccttcatggccgcagcggtcaccgacggcggtgaagatgctaacaacaactctagtgtgtcttcgcgagcggcctacagaacaagcgaaacacttatgacagcaacaaaaaaatggatcacatagctaaggtccgcagattagggacctgagcgcaggcaccatcaacgcgacgtgcacgccgttgccgagccctgaagccgtttgtattcccctttaatccgtcttaacatttttgtgaacattgcagctagatttctgctctagaaaccaaaaactactcatttttgtaaataaaacagggaggatacaatataaacttctaaactaccctaaaatttagatgcaaagaaactcaattttcagatgctatattacttgcaaaaaaaaacttgagatgtaaacctgagtgaatgaagtgcataccgggagcaggcacagcggtcacggtactgcaaaccgcgcagcaaaccgacgttgctctggctggacggcacccaaagcagacgagctggctttgggcccctgaaattgcacaattatggctcttcagagttcggagactgactgaatgtcacatttcagcagctaacattttcattttcagacaacaaaagaatctaccatgcattaatttcttttaagacaacaaaactcagcagtaaaaaaacttccattttctcaacagggagttctctaaactttcaggatttctatgagcagaataaactgcaacctctgaaccaggaacaataacactatggcgaacactatggcatgtacatcttgggaaagattcaattttttgaatggtcgtgagaaatatcaaataacacttaggccaacatttctaggtgaccaaccaacatcagggaaaaaaaactcaaaaaagtagctgtgttcttgcagtgccaagttgtaatccataccatcgggaggtgtaaatggaacaagaggagttggatatggaggcaaggggaaccggcattgccgtgccagctgcctgaaccgatggcatcgcttgtagatgcttcgcagattgcggcagcagtcaggtaactaaaatcacatttcctttccctacatgaaagaaaccttgcagaaagatgcaagagaagctgatgagaaaacaagatttcagttctgaagaaaccagtgaaagctccaatggaaaattgttaaacatcacttcagtttgcaacaagaagtttcaggactctttatgcaacagaaaactggtttagcaatgcacatcagttgtaaaaaatttcagcttcttggttgaatctctcattaaatctgatgttcaggttctgtttacatataccaaaaaaataagaaccaccccataattcaagaaagacatatgcaaaaaaaagttaattattaaaacagaaatgaacgcgctgatgaagcctagagggggggggggggtgaataggctgtccctgaaaacttaaaaacaaatcgcatcggtaaaattcaaacagacccagaacttcctggtaaggaactccggaacttccggcctcccaggcccggaacttccggtgttctaagacatgaacttccgggtaacagaacagagatgaaattcaaatttaaaaacaggagactaagccaatcttcacaagatggtgcacaggtattctaagaagaggatatatcacagaatcatccacagaaatatcacagaaagagacaagagcgattttttcccaaagttcggatcttgcgatcctactctccgttgaggagctccaaagagctgggtctcgattaaccccttgcctcacttgtgcaaaaaccccagaggaaatccacagccttcaaccccaaacacccctaggcaagtttctagaattgagtgaccaccaagatccaactcaacctacttctagaaatccaccacaagtgtgggttgctctacttggaaagcctctagaatctcagcacaagaacttcactaacttacctcgttccctttcggaggagaggaaatcattcacaaacttacccgggacatccacaatatgcaacggattctcgcgggcgacacctaaccgtctaggagatcatctccaagagtaataagcaccgagatgacagcccacgagatattccaagtgctcacacaagttcctagtcttcacacctccccaaatcttcttctctacctctcaatctctctttctcacaagaattaggctctagattgagtggagaaggcaagaaacacttgggagaggctagcaacagctctaggtttgaaaagtgaaagtggaatggccaaggaacgagctggaaacgagctgtatatgtataacggctaggtgacgacatctagccgttactcataattttgaactggaaactagacaggaagttccggacctggaagacaggaacttccggactacacttaggaaaatctttttcacaagaccggaacttttggacctggaagacaggaagttccggacttgcacttttggacagatggagtatatgcaaaaaagactcctagggaaacttgacacttggttcacactaagagcacttgacatatctcagatcatcacctggaacccctcttaatagtacggtttttcctaaaaactcgatttcaaaagataaactatcctatgcacttctcgagttccggtccgctttgattttgtacttttggggggtctccaagcatccatcttccacacctttggactaatgcacctgaaagttactcaatgaactcattaatcccttaaccacatttgtcatgaatcaccaaaacccactagggggattaatgcactttcaatctccccctttttggtgattgatgacaacatggttaaagcttacaaaagattgaaataaattttgttttgaatagttagaggtgaatgaaactcccccttagtgtatgcatatggaagatatgagtgaagctcatatgcatatttataagggagcaaccgaggagagtttccttcatctctactcattcgtgggatgcaaataaacagtaagaatagatatgatatgcaaaagatacgacatggtgagcattcaaaaggataaaatcaacatcacatcacaatcaacaaataagacactaatagcataaatgaagtgcaatatatataaagagcagctaagagcatctaacagacattacatccacacaaatagagaattattacatgtccataagttcttaagagaagaggccaaaggactgccaggtccggaacttccggataaaaaacccggaacttccggacatgttgacaggaataaatagcgagggagctgccaggttcggaacttccagataagaggatccggaacttccggataaacagacggagtaggcagcaagcagcaaaaacaatattttgacccccttcgattgcaattttctccccctttggcatcaaggcaccaaaagagacaaaatcacaagggaagaagaggatcaagcctcatcatcatcgccatcagagggaataatctcggtgtcgccggagtgaggagagtcgatgtcttgcccggcggcgtccactgcctcatctggatctgtaggtacattctcagtaggtgcatcggactcctgatcatcactgctctcctcggagtgggaggactcctcattgaagaaacgagaagtgccagagggaccctcactactagcaatgtctcgagcagtctcataagcagcaaaaggatcaacaaactccttatcatcagaaatgtcagagacatccttgcctgctgcaatccaatcttccttctgacgcctctctatcttctttaccttcttagctgtcttggcacacatacaaaagatagccctgagagccttctttatgggagaagaagactcagaacgctgtggtgcagcagaggaagaaggagcagctgaggtagaagcacgagttgccctggtagaaggagtagctgaagtagagggagcatgaggtcaaaaaggcttgtgttgattgtccttgaaataacaaatcccagtcttggcctcaaccatcttcatgatataaggagcataaatgcagcccctccttggctcacacactgtctcatagatctcactccagataagcttcataatgctgaaatctggcttgttgtagcgcatgcgactgaggaggagcgcatgcctacctggaagggctgtagcatctcccactttggggagcaaagaccaccttaagatggagtaaagcactctatagtaaggacgcaacccacgagtagtccccaaacaatccttgggagcatccttctcatacaagaaagtagtgctggtcggtgacaaagcatcctcgacaaagatatgtggacgactcaggtcatcatcatctaaccccaaactacagcaaactgtgccatagagaccctatattgctgcccctgaatggtccacttcacaaaatcaagccccttcttggtggtgccaaagaaagcagtggagtagaactgtccaatcacttcctcattccaggaataatgcaaggctaacaaatctgccacgtgcttgcgctcacacaccttgcgtacctcattgaagactatgttgttctttgaggacatgtactgccagtctagccacttcatttctaccactggatgagatcttcccataatcacagagttataccaatcaacctgcaccaaggtcttgaatatgtcatcctgagagtcagcaggcagagtatcaggactcaccattctgtcctttccacacttgagcagattcttcagatagttcactcttggccgtctaggatcaggatcaacagcccttgtcttgtacagcctcaaaggattgctttcagaaccaggctcatcctcattgccaccatcatctgactctgatgcagctggagagggagagcggggagcatcatgaatgacaatgctaccagccctcctggaatagatcggaatctgactctcactgtaaaaatctccaactttttctttgcccaatctccccctaggaccacgaaccggggggctcaagtcagcaggaacatcttgtgaaagcttctgtctcttctcacgaggcatactgaccactgcaacaagagtcaacaaggttggagtgcaatgattaaaagaaacagtagaggaatcaaggttactggctgtctggacagagaccggaagttccgggccaagaacaccggaacttccggcctgcaaaactgaagaacagagggttcaatcaggccagtgcatgtgataaaatcctatagttcggcaaactacaaggtagcaggaagaattctatccaaaatgttttctccctaggttcacatatttagagatcggggcaaaaacatgatgaaccaaaagagaagatcaaaagtgctaccttgagagaggaagtcgcaaatcgatcgtgggatgatcctcctagccaccaatgtggttgattccatggagaggtatcaaatttccatggttgaaagtgaaaatcgccaagatgagtactgtagcggaggctagggtttgggaatcggggaggagaagaagtgaggagagagatggcaggctcgggctccctctgggtatttatacccccgacccccggaagttctggactgggatgactggaacttccggcctgacagaacagaaggcagtcaggcccaagttcaaaggaatagatgagaattcaaaggaatagattagaaatagaaacctatggacatatagagacttatgatgcatatgaccagccaacaatcaacattacataacaatggtcaatatacatcataagaagaggataaaaaccaaattttcgcaataaaaacacacaaaaatttttgcaaattttcacaaaagggtttttggataagagagggaatgtttgagctttattcttggtatcaagaccatcttctacacaagaagtgatctcaagacacaaaagctcaattttttttatatatttttttaaatttacattttagtgatacatgtttggctatgaattagccaaccacccatcacctaatgttacaagagtctaagatattgagctcactcccaaacttcttgagtatgtctttcacgtagttggtttgagagatgaaggtgccctcttgtgcttgcttcacttgtagcccgaggaagaaggtcaactcgcccatcaaagacatctcgaaccttttagtcatgatactactaaattcttcacaaaaagaggcattagtagaaccaaatattatgtcatcgacataaatttggcatatgaataaatcactcttaaattttttagtgaagagagtagtatctgcctttccaatttcaaaaccattcttcaaaagaaaatctcggagacattcataccaagctctaggggcttgcttgagcccgtagagcgccttgtggagctcgtacacatggtttggcaactttagatcctcgaaccccggtggttgctccacatagaccaactctgagataggtccattgagaaaggcactcttgacatccatttggaataacctgaaatcatggtgagcggcataggctaaaagaattctaattgactcaaagcgagcaacaggtgcgaaggtttcaccaaaatcgagaccctcgacttgggtgaacccttgcgcaactaaccgggctttgttccttacaaccaccccatattcatcttgcttgttgcgaaagatccacttggtgccgatgacattttgcttgggtctctccaccaaagtccatacttggttgcgagtgaagttatttaactcctcttgcatggccatcacccaatccggataaacaagcgcatcttccaccgtagttggttccaaagaagagacaaatgagaagtgttgacaaaaacttgcgacatgagagcgagtagttaccccttttcttatgtcaccaagtatgttgtcggcgggatgatctctttggacagtgtgatgtatccttggatggtgcactggggggacttgagcctgatcaatatgctctaaagtgcccgcagcatcgatcccatccacttgtgccgttggcacgtcttcactgccactggtccggaggttccagactatagaacccggaacttccgggcctggagatgtccggatgttccggtcaataggacccggaacttccggctcagcagacacagcacttgtagggctattggatgtcgatgacggaggttgatccctatcttcttggtcatcctgcgtttcgactggtcgtatgtctccaatagccttagtgcctatagcttgacttggatccacatcacctacaacatgtacaacaacttgctctccttgggagccattagattcatcaaatgtcacatccctagtgacttcaacaataccggaggttctgttgaagacacaataggcatgtgcatttgattcatagccaagtaagaatccctcatccaccttagatgagaacttcgatgagcgaggcctcttacttaaaataaaatatttgctcccaaagacacaaaaatatgaaacattaggcttcttaccactcaagagctcatatgaagttttctttaggattttgtggaggtacaagcggttgatagcatgacatgcggtactcacggcctccgcccaaaagacatccgaagtcttgtactcatcaagcattgcccttgcggcttcaatgagggttcggttcttcctctcaacaatgccgttttggggaggaccatagggggcggagaactcgtgcttgattccttcttcatcaagaaattcctccacttgagtgttcttgaattctcctccattgtcgcttcacaccctcttgatagtgagatcatagaggttttgggcttgctttgcgaagcgcttgaagacatcttgagcttcgcttttgtcatggagaaagtacacctaagtgaagcgtgaaaaatcatcaacaatgacgaaaccatacttgttacctccaatgcttatgtaggccacatgcccaaataaatccatatgaagaagctcgagtggtcttgttgtagtcatgatattttttataggatgtggactcccaacttgcttcccggcttggcaagcactacacacacgatctttctcaaaagaaacattagatagaccaagaatgtgttccccttttagaagagatgccaaattcctcattccaacgtgggctagcctacggtgccatagccaacccatagaggatttagcaatcaagcatgcctccggattcactctatccacgttgaaatcaatgagatagagatcaccctttaacacacccttgaatgctatgtaagagtcatatcacctaaaaacggtcacatccacattggtaaacaagcaattaaatcctaacttacacaattgagacacggataataaattgtagcttaatgaattgacaaggaggacattagatagagattgattcttggaaatggcaatcttaccgagacccattacctttcctttaccatcatctccaaagacaatatcttcacgacttccaccctcctcatcaagacttg

SEQ ID NO: 37430 - DNA, 1124 bp, Oryza sativa
ggataataaattgtagcttaatgaattgacaaggaggacattagatagagattgattcttggaaatggcaatcttaccgagacccattacctttcctttaccatcatctccaaagacaatatcttcacgacttccaccctcctcatcaagacttgtaaacatactcctctttcccgtcatatgattggtgcagccacagtccacaacccaacttgagccaccggaggagtatgcctacaatagaaatcaagcttgggatttaggaacccaaacttgtctaagtttgggtcccttgatgttagtcaccaaagcctttggcacccacacacaagtgcggtactcatcattgtaattcccattaaaataagcaaccactttgccctctgaatttttggaaattacatatgaatcatagtaaagaccctctggccggaacttcctggcattatacccggaacttccggtcagcccctttggcctattagaagcccggaacttcctgacaaaatgtccggaacttcctgtcttacaaggcaggaacttccggtcattttgcctggaacttctgggtgtctgaccagtgaggggacaagtcacctcacttgcttgtggagcttttccttctctcacaaacatcaagcattctttcccatttaccatcacacgcttagacacaggacttccaccagaaaacccgagcccgtgtccatccttgttaggatgagcggtgatgatcttgtaaagggttttttttgaatggtatgtcttcatgcatccatatttcaccaatgtgcccaacctttcattttctttcttaagagcttgcatagcattaacattagtagcataaaagttcaaatcaatattgtaacacctagcacaaccattgctagtagatgggttggaataattagaaaccacatttggttgagaagtgctattccaaaaagtgtcaaattgaacttcaagatctttatgacttttgtctaaactagcaaatttttcttgaagagtttcattgacatccctaaggctagctagagaaccattagccaaattacagctcattagctagttgttcatttttagcacattctttagctaggctctcctctaaggcaagg

SEQ ID NO: 37431 - DNA, 245 bp, Oryza sativa
agagagtaaccgaacaggtgataccgacaagatcgtagtcgagggatttgacgagatctcccggcgagttggctccgtgtactccggcttcgtaaactttggtgggtgtgttggcgatgagatgcgatgcccttagcctctccctaggggtcccttttatatcgtgggataccttgactctcaagtaagacttggagattatgtaaaccgacatgatatactagagattttacccttttcgagta

SEQ ID NO: 37432 - DNA, 9352 bp, Oryza sativa
cttaaatgatctctcaataggcctatcgatgccctttaatgtcattacaaaatctgacagatcaacacatacatgaccaaatctaaggttgccttcaccgtgaactatctgaaacatgaccttacttgacattgtgcctgatgaaaaactaactaggttaactaagttcatatcatactaaccagatctaacgccgcattcatcaatacatactacgccctatctcttcaaaaaacatactacgccttaagttaaagaccctacacataagttgtttgccctatgtctcaaattctaaaaatagggtgtgtgtgctccagatctactaaagtatatggtaataaaactaaaatgcaaaaaaaacctggaaacacatttcgaaggaatatattacctgtgatagagtcaacaaaccagcagggcttcgctgctccccttctcctcccccctcacccctccctctttctcttttttcggattttgagcgaatagaatgaaaaatcagagagggggaaggggttttatacttggaggggctaaaatcgccctccctaagggcggcaagggggccgcttgcaaaatgccaggctgcctcgccgcccttttgcaagggcctccgcacagtgttaaaccgccctccctaagggtggcaagggggccgcctgtaaaaaaagccaggccgccctcgccacccttttgcaggcggcctccgcacagtgttaaaccgccctccctaagggcgcaagggggccgcctgcaaaatggcaggcccttttgctgtccgttacttatgaggcaacagccatctgccatgtcattaaaatcgccctcccaaagggcgctgggcgactagttttgtaaatttttgaaacacaaaattagttttgtaaatattttaataaaaaattaaaaataaaaaaaattgtttcaagtctaactggcttcgccacatgctggtgaagggactttgcttcgccgcttggtagatgcttcgccgcctggtattcaccttcaccactggcaggtgcttcgccctttggtactttgcctcacaacttattgattgttttggaaggttcggttgaaggcacttgtgatatgcctataacacatataaagtttaaatctaccatggatttgagatgtggagttgtgccaaatagtaccacatacacttttcccgttgtctcttcctctcacgctgcaatgcgctcacgacacagcacccctacctagtacctttctcaaatgtcagcgagtctctccctaacacaatatgatacggagtcaacaatctttaaccataccgttattacctctagtcaacagtatatgattcaaacaagccacaaggagaaacaatatcgtaagacaatgtgagtttttaaactaagaatttgagaaattattgatggtagaaatttcaaaagtatagttaaatctagtcctaaacgtcaaatattttagaagcatacatactgttgcctaatgtgacatgaagttacgcattaacatatgacatgaagttaagcattaacatactgttgcctaatgtgacatgaagttacgcattaacatatgaaggtgatatcgtatatcataaattgctacaatgatatagttatcgcctacaaacttgctatgtaaaaactcatttctttaatactatcaataagaatctcttgatttttcaaaagagaaaatttatctcatctctgacatttggcgaagagtgtctcatcattttgttagttggcttaggaagaggatcctctaacttacttccctctgactttgagtcactgagggaagtaagttagaggatctcaatccgttgggttatcaaccatgcacaaccatgatctaaattttaaaaacttaattcaagtttattttctgttttttttcaccataattttttccatcatttaattttaagtccctaaaaatatagttataaaagtttactcataattaatacttttttattgactcatttattattttcatggtttatcattcgtagagtaaacgaccgaaagtgagaagcatacgacacacaagatttatccatgtaacaaaagagtttatcatttatttgatcgatgattctatgcccttgtttagtcctcaactttttttttcaaacttccaacttttccatcacatcaaaacttttgtttagttcccaacttttttttcaaacttccaacttttccatcacatcaaaacttttctacacatataaacttctaacttttccgttatatcgttccaatttcaatcaaactttcaattttaatgtgaagtaaacacaccctatatatcaatgtgttggattaaagctggacgaaggattgaattgtgaaatatacaaaacaaacaacttagctgcagtcaagagtgtgggggtaaaatcgagagaagccaaatttggaagaggaggaatcatcaaaggagtgtccatctcctttgcaagaagcagtgatgtgatgatggtgaaatggaagaagttggcgtttgggaaaaaaggtcgctttcgaggtcgagcagagaaaaaagggaggcctttgcgaggcgaggagagcgagacccctgtgatcccaattaaccacccgccaccgccacgccgccggcgaccccctcctcggcgagatcgagatcgagatgccgcccacgccgccgcctgagctggacctcctcgacaccgagccggagttcgccgaggttgaccccaccgcccgctacggaagggtaataatgccttcttcttcttcttcttcttcttcttcttcttcttcttcctcgattcgcttctcctcccatcctttcgactcattcggtgatgcatgccgcctcttgcagtacacggaggtcctcggcaagggcgccttcaagacggtgtatccttcttcccacgctcgatttctgggctttgacgtgcgattccgtatggttcccgggccgttgtgctgcgtctaagattcgattttggtgcagctcatggtgtttgtttcggttctggatgcatttttttcttggggaggataaataatcttcagagctttttgatgcgctgaattcacattccttcgactttttttacctctcctcttttgggatttgaatactagtattttgttttgttgatttcaatgtgtgtttggcattgcctgctatgattacttgaatcaacattgccaatttgtcatgtcaagctcccattacctctttctagactgaatggatctctttcatttctctcttcttatcgggtgcatttgattggttggctagtgttccaatcaatttacatcctcctatgatctatctcacatttgttctaattcaacaactgatttgagaaatgcacagggaagctgctgtgaatctttggttggttgttttgtcatagtgtgttttagtatgtcactcagaactgtccacgtccattaaggcattaactaccgtcaggattccaactgctcttatatgtaaaactaaactatgttgctactttacactatatatgcagaagggtaatcttcatgatgactaccagcttgatagaataatttcatattatcatcatgtatttgtagtgttatcaaggttatgtacttatgtcgttttcatgtgcacagttcatttacttatgaatgtcaaacctgatacgatagcaaaacaaacttcttcctaggtgtttgcagtattagttcttttttttttaaaagatgtttgcagtatgctcaaaacaaagcatgtatctttgtgaacttctcctgttattttctccaatttcgacatggacttgagatccttaattcaaattttactggcatagctataaggcttttgatcaactggaaggtctggaagttgcttggaaccagatcaaagtgggtgatatacttcgaataatgatgacttggagagacttagatcagaagtccggttgctgaagaccctcaagcataagaatataatcaagttctacaattcttggctcgacaagaaaaacaacaacataaatttcatcacagaagtcttcacatcagggacactgcgccagtttgttctcttgctcccatctgattataactatgctctttgaataatatgaacaaactgcactctgtcgctgacacgtcttatttaacattagttagctgtgtatgtcagtattaagtcaaagaaaatgatacattatcaatgaaagtttgtactggttctcaagttcactcttcgggtcctagcatggcttcaataaccaaaacaggcaaattttgtagagccaaccggcatgctagacacatgcaggtctataggatgcccaaattttctcactgagaattttcctatttctctgtcattgtttaggtaccgtattaagcacaagaaggtagatgttagagcattaaagaaatggtcaaggcaaatcttgagtggccttgtctacctccacagtcatgatccaccagtaattcatagagatcttaaatgtgacaacatatttgtgaacggaaaccagggtgaagtaaagattggagaccttggattagcaaccatcctagataatgcacgctcagctcacagtatcattggtatgcattttattttctttttattttactaggaattgaatttatttttcatataacctctgttttcttgtaggcacaccggaatttatggctccagaactctatgatgaagaatacaatgagcttgtagacatctatgcatttgggatgtgtttattggagcttgttacatttgagtacccatattgtgaatgttccaatgcagcgcagatatacaagaaagtatctgatgttagtctacttatcctctccattgcttttaccatttcttttctgaaaattggatttgattaggtaatgatcctgtaggcttatattgaaggtgtattttatatatatttcttttatcaaaaaggtttattcattgcttaccctataccatcctggtgtaggcagaagatgaatttccattttgagaattaaaagcatggtttaaagacagtatctaggattctttttctcaacgaggattgtgttgaaatcatggtttattgccatacaaattgcagaagtagcttcagggtttttcaggtttttattgtgtaccagaagttgacttaactgtaggttttaattgtattactttgggctgtcatagtgggtccattgataaattacaccatcatatgggtggtgtttgaatagtttttctttgtgacagttactaccttggtcacagtctcacagatacaaattaactataactttcagtagctattccttggaacaccattgtactaaatccattggcaacttaaagtttttgatgaaattactttgttttgtatgtgtcgcatatgcccaaggcaattgatttcctatttgatcaatcatcattgtagaaaatcatgttacattctttttttaaaacttgaatcatgttacaccctattactgtctcaatctcttgatgctggtacaacagggtgaaaagcctagttctctggctaagattgaagatcctgaggttagattttttatcgagaagtgcatcgctaaagcttcacaaagactatcagcacaagagctattgatggacccatttctccgagatgatggtgaaaaaatattctatccattgcagtcaaatacgaaggcatcaggtaatgactgaattggcaacactataaaattgttcccttccccatctgaccttagataaacatggcagatggtgctggcagttcaaactcaagcatgggttacaaatatgacagagatgcatcatctatggcaattcgggagcacacaggtagaagttcaatgacgtgacagtgatgtgaacactattgcatggttctaaaccttctctcctttttacatatcaatcttatgatgaaatgcaggtagttttgcagaagaacacccaagtgataggtacatacacagcaccatggatccacaagcagccgctggtcgaataattacagtcgagagtcagatgaaagatctgaatacgatatttttgaaactgagaattgctgattcaacaggttttttttattgtggattcccattttacttctcattatgttgttcggtgtttgtcctctattacacttttttgaaatgcaatatgcaggtcatgctcaaaacatccatttcccatttgacattgaagcagacacttccattagtgttgcaactgagatggtcgtgcagctagatctcactgaccaggatgttacagcgattgcagaaatgatagatgcagaaatacgggctcatattcctgattgggcattagaagaatcggttgaaaaccaaggagatgaaagagctcattctgagaccgacagttcagaagcagatgatgaaacttctgagttgcgtaatgagcctaatgctacacataatggttttgtccaagaacaccttccctccggacataagtattggtcggactcgcccagaagaaacattgaaatgtctcactccgcagtcgaaccacatattggtggtaatatgcctaatgggatattgaagaagaatgacactgatgacacagtcagcaatcttggcacttctgtggacttgccaaacccatctatgattgacaggaaatctggagtagcttctgtcagcaccagtcctcagtcttttgatgatgagcatattgaagcagatgttagcgagaggttagtgaatttgctagctcagcagcaagaggagctcaacgtgctgcgaaggaagcacaaggctgacatagaagtcatcttgaaaggtgtgcctgaagagcatcgcgaagaaaccttaactaggtgccggctgaaggcagatgagagaaacagatcagacaaaccttagctgcaacacattatcttcaccgtgtgatttttttgtaccggtgccatggagctgtttagaactattgttgtgcaaaaggtggtctcagctgttcactgttcttttttttttcatggaatggaggagctgcaagtgtttgtggaatctgtgaccaagcggtgcaatacatatacgatactgatgtagctgtctggatttttgtttttgttttttgtttcttgaaggcaagacaaaaggtttctgctcaccaaacaaaatctgcagataccattgtgttactgtattcctgaattgttcatgagaagtgcacctccttgtttttctccctctctttttttccttgtaatttgatgatttttggaactaagaattaatgttaatgatgtaatacatcagtgtttgagctgtttcatactactacttgcaatgaaaaaacataagttccaattacttccattatgtttgtgccacatgcttgcccaagtccatagagctgtactatgcactgatatctatgattgtttgtacacatacctgcatttcttattgcaagtgtgccatgcatggaggatggatggagctgtggaagtctccactccatctccagcttcatccactgatgagcagcagatctgaagtggccaatggcataaacaacaaacaatatatatgtgcaacacatgctccagtagcatctctcacatgccccagatttgtgtgtccccttgcatcacatttgctgctgctcttttgtgtgcatctatctatatctatcccattttgtgtgcatctgaatctgtgtacctgaaaacctgaggctccccaacccagggaaggtttggggatcctagctgctgcacacagaatttggatctgtgttgatgtacaaaaagtggcatgagccatccctccgatgcaatattttgggatctattgtatatcaatgaatgatgatcagttcctccatacaaggcagggagatgtggaaacttgtggaccatgaaagctgttcatatatattttttgctcatctgtctctctccatgatatttggacatgtagtgtgtacatcacatatactattgatcctgttacatgttggtgtcaaagggctatagctacatcaattcatggtagcctggctttcaaatatgcataattggctaattgcatttatatttaggcatcatctgatcaacgtaatgttatccatttcaggatcatgtgtatggcaattagaattagttcagtccatgatagcatatggatccagtgcatcaaactgagaaacatgtccaagtgcagttgaaagcaaaatgacaacaccccaatccatgcacgtcgctcttaatcagtagtctactgtttcatttttcacacagatagaaacccaaaccaattaaggagtaaaaggcacatcatcaagaacccaataaggcaataaccaaaaccacatctttgtgcagaaagaccaggtttttacccaaatacacatgcaacttgggttctatatataaaaactatactccatgaatgaatgaatccattcatggtactactacagttgctaacaaggaaaatactagctagtatagtacccaagttgcaacttgcaagcaagtccaggccaagccatgaacaaatactctatctattttttaatatacgacgttattgatttttgacgtgacgtttaaccatccattttttttaattatataaatgccatttatttaattgtgacttgttttatcatcaaagtaattataatactaacttatacttttacatattttatactaacatttttaataaaaacaattagtcaaaacttatgaaaaaaatcaacaacatcatacatcaaaagacgcaagtagtacaagctagcatgtcaatttgagtgaatgaagagataagcaatactaataattatatttatatgcataatctctctgtctcggtcattgctagctcaagtcgattgttcttgacaagttgagagctcatctcatcacccaccctatcattgtttcccatcaacctctgcaatataatgcaaccacctctctctctctctctctcttctccgtgcattggagtatatatccccctctcctctccccgccgcccccccccctctctctctcctctctcttcttcgcctccgatcatctaagctcatcgtcgtcaccagctagcgcatgacgtcatcctcgtcgtcgtcgtcgttgctccttttgtagtacgtagccatcgatcgatcacagctagctagccatgcaggaccacgtcgtcgtgcagcagaggagcggcgaccagccggcgccgtcgtgcgacatcgccgccgacgagatcccggtcaacggccacaagccggggagggccgtcacgcgtcggtctaccgcgccaagatcgccggccactcgcgcgtcctcaccgtg

SEQ ID NO: 37433 - DNA, 3209 bp, Oryza sativa
ccgagcaaaggtggagatctactgggacgtccatgactggctcttcagcgccggcatgcgccccgccctcttcatcttccgccccatcgtcctctccagcgcctcggcgcccgccgccgccatgctcctcgacggtttgccgccgccgccgccggccaccggcttctgtctctacctctacgcctggaagctcgactgatccattattgagctagctagcttctttcattggcggctggctctgataccatgttgattagatcggggattcttgatcgaaacgaaaatgcgaagttgtgagccaaaggggaggaggagtaagaatttttttcgattttgtataatttttttgaggaaggaaggaaacatatataattggatataattaattaattcttctaattaagagcccttgcatatacatacattattgctccattctcttgatcagctcaatgacaataacaagagacatgataaaatagtaatgccattgccaagaggagagcaacctagtgatctcctgttgattcatttgagatctcttgtagtagatcacagtactgggctactgtctagtcaaaactctgtttcacctctctctgatcagttagttcctgccagacaagaagttgatgttttagttatgagataaccacaccacatattcagtgatcagtaatgtacatgctagctgtgcgtataacactttataactaagctgtcttacagttaattgcatatgcaagagagagagagaaatcaaggtttgcattgcaaatgtgcaatgtgtttgttgggtgggcagcacatgggatgatgagggagagtgggttccagtgatgagcagcagcagctgtggactgactcatcagactgatgactactgatccaagaaaaaatatatatattggccaccgcaaaaggtgacagattggatccaccatcctaatcttctttttcttggcccctcccaattgattaattcttccctataatctgccaaatattcacattattaatccagggtatcctaagtgatcgattgatgcctctcaccttttagttcctgatgatgatcaccttctgaatgtgaagatctctatgcatattatccttaattaaacacagtttatgcataatttggttacgaatggtaaaggagtttcatagaaaaaaaaagagatttttattggattctaatattaaaattcctgtttgctcacctgacatgtgggctctaccgaaaatacctactgtactgtagtttagttgcgcaaaatgaaaagtttgaatatataataattccacatgagattgtacctagacagtttgtcatgagaaattgatttgcaaggttgtatcctatttattatcttacatatgagacgtgtgtgtgttggtgagatgccaaaaggctgtaaagattccatcaagggaaaacaatggaggaaaatggggataaacaaactacatccaatttgttcccttgctagcagcttgcatctgttggaagatatagctggtgccaatcaacactttgattgatagaattaacaagattatattctgattgctgccatttgtctccaaggcatttgttcaatccccattagttaatatacaacaaaaggatatcattagtccactggtttaatgtagacaagaggaaatgttaatctttatccttccatttctgtttccagagcagtgactgtttgactgacctagagggtgagttcaatttgtatttttaatttgcagatcaacatccaactaaatctatgtcttgttcaggaatgtgacttgataggagggtacaaattgtatctaaactcctaaatgtacatttataaaatgaaaatattcacaatagctacatgtaacaaatcaaatggaaacagcacctaatctgaaccatcccctttgttttgaacctgcaaaacagttttctgacactccactggactcctgcatttgtttgatcccttttcctctgcacaagctagtttggtcaaaccagagctggttgcctgtttagtaaggttcggcctctgtaatcacaattgacttgtacaaaaaaagctactaagataattaaataattacttactgttactattgtctttctcaagaaagtattctatggagaaactactgacttgtagcagaatgggatcgagcaaaatcaacacacattgcagccgaatgtattagaagaaaaaaaagagaagaagctaattaagaatcaaagacaaatgtagtagtagctaagaaagctatgcttgtgatccaagatattattgtagctagctgcaagatcttaaatttggtgtatgtttgtggactaagtaagcagctagtactactaaaatggtgggtagctaagctagctatagcttggaattgtgtgaaactgatttatgggctagcatgcagctggagtactaatttagtttagagtccatgcgtctgtgttttgttgtgtgcccgggatcagcggacaggggtcttgcatttgaggtggcctgaagaactgaaatgtttttaatccaacaacccatttgcacatgcatttgctagctggtttgcaattgctacatgttcatcatatcaattgaatttgataacaagctcacaggtatgactgaatgcattgtagtgatgtagcagccatgtatgacaacaagctcacaggtatgactgaatgattcaacatgaaattaattattgaatttaaagaaaccttttctttcgttacaatacattctctgaatgactatgcatacatatggccatgcatgtatatcgatagatcttgcgtaggcacattagcaatttgacatgtgtggtttcaactatctccagctccaaatgctcaagtttacgcaaccaacgataactgaataaatacagcttgtgtagcttgtagcttatgcaatctagcatgcttgttgccattcaaatggaattaggtcgtcgatgaaatgcagccagacttcagttttaatctttccccttgttctagtactttaaatattaattcatatgtggctgatacagtgatatggaggaggtattaatttgatgataaaaaaaagaaaagaaaagaaagatgtggaagtgaagaactgaagtaactgaagaagggagaactgaggtagctctacatgtgcttttttcttgggatgcctttgtataaacaaagc

SEQ ID NO: 37434 - DNA, 20133 bp, Oryza sativa
tatatatttcataggtacaccaagaccaataaatactaataactctctcatactatatttactctagcaacaaactcaatgcatgcataatccccactatttcctagccaatagtaaatcaagatattacatgtaggttataaatacttgtctgcatagatgcatgcatcaatgtccatttactccaatacataaataacgaatagacttaataaatgaacacaaatatatagatcatttaggaataacctcaaaaaaactataggtagatcaatttgaaatggagggagtaatatttagaatgtgggccactagtcattataaagcaacagctagtcttaaagtagtaaaatattgagataaaggtgagagtacttgtatagggcttttaactttttgctatttttaaaatatggtaattaaaaatttactactcacagtccatgatacgtgagtcctcatgtgtatatgacatgtgggacctaatagcaaattcttaattcccaaccataatgtcttccccttccctttgtgtggcgtaaaagaaagaagaaaatctcccgtctctttgtctcctccgctccttgcgccgccgccaagacacaggggaggggcggcgatctccatttggcgaggagagcagagcaggggaggggaggggaggggatcctggtgagcctctttctttctttctgattcatctctctctcccccatcgggactggaatttgcttgcgttcgttcgttcgttaaccctagcttctcttcccttaatttcagagccttaaccttaatacaagtaatagtttgtttgttccccgaaaagtcccaagttggatccgcccctgattactccagtgatctggcacacattctatttgcccaaaagatttataacttccctagctaccaataagaaaccctgttcagtttgtgttacaaggaacaaacttgtgagtgtttgtttggctcattgttcttgccaaactcccttttcccgctttttagtaaccccatcacattattacgatttttacaatacaactgtgctagttgggtacattgccagttttgttgctactccactgatatggtttttttgtgtgccaaccaggtcatattttactgcccagagcacagaaaataaaaaatggttaatgcaatcaaggaattgttcatttcttggtaataaagttcctaacacaggttaattcgatcgatttttgtttcctttgcataagcagcttgcaatcccttctgcagtgatgtgccaatggcacagttcatcgaatgcttcaatgcccgcatcagacaagttcatcttgcacatgcttgatccaacgcacatgttcgtccagcctcacgtggcggatatgatcagaagtaagatatcagagttcagggaccagaacagctacgagaaaccatcatgaactatcaaggatcatcctgtcctcagactcccatataaacataccaccgtttgttgttaagcctgtaatgtggagtagtgataagttctgagcatcacatctcactcatgataatcaagaatgattgacattcggtatcagaatgccacttttagagtgatagataatgcaactgtgagattgtaatggaataactgtattttaatatcagaaacaagtcgagttgtgatggtggaattcggccgaataaatcttcctgactgactgtctgtctgtccatccagttcttgtggaattttcagctgatattaaatcttgatgtccttttctcttctctctcgacattatattatatcatctgaactccgaaggatgggattttgagcataattggagaagagagtctgatggcaatgctggtctgttggcagctgaaaaatgcccaggggtcttccggctagctccacaaggtggtgggctagacgacctgggttcaaagcctcacccctcctaattatttgatattaggtccttccctaatattctagtttttttggtctgttggcagctgaatgcctgaatttcttcaattcgccggagcagattgggggggaaggcgacggttattgggccgggatcaaaggcggcccatattacgtggagctgaacggggattgcggcccatattaattagttgggccaaaagggggatatagattcctcgcggcccaacaatgggatggggggtcacgtgcggcccatattagttgcattaagttctgcgtacaattaacatactatttccccagtttcaaaaaaaaaaaaactatttcccctcttctcctgcctactatttccattgtctgtcggaatatttttattagtgacgaatggtaaaagataggagtatatggcatttcacgctcagttagcattcacattgttgatgtacagttgtacactagtaatttcaagtgaaaattcagaagaaagaaaaggactctctgttttttactagtaaattgtatatcaaccttaacagtgagcatacaggtcgtgaacaagctcaaaacaagaacatatttgcattgctccaattcttcagccagcgagtttatattgacttttgcatcttgtgcagaagaaaaatagtatgtcagagaatgatgtatgcacgcagatgacatggtatgatgaacttgatgcccctgttttactccaagtagaaaccatggtccaacagacaacatcctctttacgaaagagatggcattaacttaacaatggcacagagatagaaatcggtcctcactgtctactatcttcagcagatgcaggaaccactatcttgaaaagcacttactgatgcagatcgttcatccatcaggttgcagttggttccatgtacaatctttctttagttgagacttcgcatgcttgcatccattctcgattgctttctttcagccatgttgatgcgcactcagatagatctatctatctatcttctctcaagttgcagctatgtaaccaagaaaagaaaagaaaagaaagccatcttttctgcagctcgatctgcacccagcattcatgcttgaaagcaaagtctcggcctgacattcagagcaaagcttaaagccttggcatgattcggcaaacactcaaactgttctcactttcggagcctttgcttccaagcaaattaaattgcccggatcaatggctacaaataccccatgcattgcatgcatcctctcttcaattcagaaacagtttctttcgtcttcagttaaaaaaagaagaaggagaagaggaaaaattcagacagagatcgacatggagacgaaggtgaccgtgggcgtcgtcctcctgctgctgtgcctgtgcggcggcgccgcgtgcgccgccggccgcagcggcggcgagttctccattgtcgggtactcggaggaggacctggcgtcgcacgaccggctgatcgagctgttcgagaagtgggtggcaaagtaccggaaggcgtacgcgagcttcgaggagaaggtgaggaggttcgaggtgttcaaggacaacctcaaccacatcgacgacatcaacaagaaggtcaccagctactggctggggctcaacgagttcgccgacctcacccacgacgagttcaaggcgacctacctcggcctcacgccgccgccgacgaggtcgaacagcaagcactactcgtcggaggagttcaggtacgggaagatgagcaacggcgaggtgccgaaggagatggactggaggaagaagaacgcggtgacggaggtgaagaaccaggggcagtgcggcagctgctgggcgttctcgacggtggcggcggtggaggggatcaacgcgatcgtgacggggaacctgacgtcgctgtcggagcaggagctgatcgactgcagcacggacgggaacaacgggtgcaatggcggcctcatggactacgccttctcctacatcgcctccaccggcgggctgcgcacggaggaggcgtacccgtacgccatggaggagggcgactgcgacgaggggaagggcgcggcggtggtgaccatctccgggtacgaggacgtgccggccaacgacgagcaggcgctggtgaaggcgttggcgcatcagcctgtcagcgtcgccattgaagcatccggtcgccacttccagttctacagcggggtcagtattagtcctggcttagttctccaacacttttttccaaaaacatctcatcgaatctttatacacatacatagaacattaaatatagattaaaaaactaattgcacagttaagggaaaatcgtgagatgaatcttttgagcctaattaatccgtcataggctcaaaagattcgtctcgcggttttcaggcgagttatgaaattagttttttcatttgtatccaaaaaccctttccgacatccggtcaaatatccgatgcgacaccaaaaattttctttttgcaaactaaacatgcccttagtatatattattcctatcttactctctctctctctctgtaataaatatatttaaaacgtttaacataagtaaatattctgtcaaaaatttaaaattctaactatcaattttatattaaagtaaattcccatttaacaatgcctaaaatatgttatgaacatagaaaagaaaacataccaagccgcacgaggaacatgacgaacaaacaatcacatgagctgtctaaatccgcttcgttcgctatgggcatcttgaattttgcatttacaaaatacaataagtttataatattatggtagtacatttgaacacaaatgtgcgtttaccgtttgttttgtctatcacactaagcatttggaaaactgttaatgaccagaattttaaactcagactaaattttgttataaacgtcaaataattatgtttaggcggacttcttttttactatttatcatataaaaaaatatttatagcatctttagaaccacatatttgtataccattgtatgagccaaatggatgatgagcaagtgatatttattagtagaattatatgatgatcatggatggtgatatataaatgcagggtgtgtttgatggtccatgcggtgagcaactggatcacggtgtgacggccgttggatatggtacaagcaagggccaagattacatcatcgtgaagaactcatggggcccacattggggcgagaaggggtacatccgcatgaagaggggcactggcaagggtgaaggtctatgtggcatcaacaagatggcctcttaccccaccaaggacaactaaactcctactactaaataactcaattgaatcaacacatgaggatcatacatatgatggtccttcaaagtttctctcttctcctcttgttttattagcctttaattccactgttttttcttctttccaaagatttggaggagagagagagagagagagagagagagagagagagagaagcacaagctgtttgtttgtattcgattttcttttgcgcgctttgaaatcatcgatgaaataataaatgtcagaagcttctttttaagatactgtctgttccaaagtcattcataagggtgcttgtttggtcaagttttgtgtgcatttgatttttgctcctgatggtttggttttgtatgcaataacgactgaaatgtgtaggacttagtccaagtcacttagaggtacataagtacgaaaactgaaaacacatgggagacaatataggatcacgcgggagaaaaatgtcatgaaatcgacattttgtacaaagatgcgtgtaaatcttttacgtatttctaaacaatgaaatcgacattttgtaatttgctgcatacaagctatactcttactccattcgttaaaaaaaaaaagttcaattatgtgttcagattcatgtctaaaattaaatcttattttgacggaggaagtagagtcagcatcttgttttgaagacttggtgtcagcatctgagcccatcatggtcaataatccatgaaaaaaaatgcaagaattattggaggacaagtgcccatgaatgcaagtagagacactgtagcacactgcacgcactcaacttatcaattagtagtactgtttcaacatttttcatgtttaggccaagtgtgaatcattttaacttgttcatattaagggtaaaggtgataccgtgaaccgacgcccacggtcgtccacgcgcgggcgaccaggggcgaaccctactcctcggccgccgccaccctccccttctttcccccacctcaccgccgccggagcgcgccgctggaaactgcgcggctcgccgggatggcggcggcggggctaaaacccggcggtggcccgtctccaacgcaaggagatggcgcggcgtgccgggaaaccgcgcggtggcgccgcgcgtggctgggagccggtgccgccgccgccggtcccgactccacgcggttggatccggcccaccgccgttggatctggcggccgacaaggatggcggcccgggcgttggcagtggccggccgtcgggagacgtgaggaggcggcacggcgtgcagggcaacccggaatgtcggcggttggtcggcgcgggcacgcgcttgcgaatgccggggagccggcggtggcggcaacttccccgaccagatccgggctggctccggccggatctggcggggcgcccggagaccggcgacaggcaggggcggcgtcgcggtgggcgggcgtcggtttcgcggctggcaacggcggctcgctcgcgccgagctcgcgttgtcggcgtcggcgtccgtccgcggcggcgcgtgacgacggatgttgcggcggcgcggacgtcaccggcttgcgaggggcagtgtcgcggtgcgggtgatggagccagggcagccggttgcgcggggtggctgcgtgtggtggcgttgcacggctcgggtgggctccggtgagctcggcggctgcgcgacgtcgcctacgtgagctccggcggggttgcttgctggcggtgagcctcctgctcggtagggggtttcttctgccggtggcgagtctcgtgctcatgtgcggcgatgtgcggatgtggagttggtatggctgcttgtgagacgtcttggactaatctatggtcatcgatgtgggggtgcttgtgtgggtgatgtgaagatgctagtgaaagccttgccgtgcctttggccagttcgacgaccacggcgcccgcgggcgccgtttccctttttggaggcgttgtcatggcgttctttcatatccccgcaatctccaggtgtaaacctagttccgaattcggacaagcggcggcggcactacgcgtcgtgtcctccttgggggcgtcgcttcggagaagttccaacgcatcgacgactattgatagtctttttcggttcaaaagctttcataccttagttcggcgaggccttcgccttcttgggtccgtttctttcttgtggtcggtgacaagctcttcggttgtttttgctgatgaagtcgaagctgctcgctgatagggtgcggcgatgcttggcaacgatgacatgttgcagtatcttccaaggagttctggtgttggctgtgtgaaggaagtggctcctcggtggcttcgctgatgtccattgttggaggtcggagctgcttttcgctttggcaaccttcgtgccttcaatgtcgctgcggttgtgaagtcggcgctgctgggtcgcttgggcggctagctcggcaacgataacacgtcttctacgatttgggagctgttgtgtcgcttttgtgtttagcctagcagcgacgtcttgcgtttgggctccgctgtcgttgttagatctgtagcggtgggttttagccggttttcctttaattaaccgtgcaattgtacggtttttgggtccggtttttcttataaactgggtcaattctcttcttctaattagaaacgtggaacaaagttccgtcctaggtttcaaaaaaaaatattaagggtaaaagccatgtgaaatgttagaaatattagctgaaaacgtcgaccatatactcctaattgactgaggcagtagaggctagacataaacaatttgcagaggttggtttgcctttgaccacagcactcaaatccgggggcgccaccgggaaaataaaattcagccacaaatttcttctaatttttattttgaaattgtttcagttatcctctccctgtcaagattgtccagctaaccttccaaattatgatctactcactccagaagcttctgttgtcctgttaactgatagcatcttctcttctaatgttctgtggactgtgtttaatttagcactagcatttaatttggggcctacttgaatatcattatattatattgctaaaatttgatggtttgccatttaatttgtttgtaagttcactgaatcatgtgtaatctagatagtactaagttagtggtaggtgtgttagctccctccaactgaagaagatgagacatgcaaagcaccctgcgtcatgtacaacccacaaagttctaattaacgttcttaactatatataaaatatcataacaataactccttaatgtgaaaggtaaatagcctctttgagtaatccacatgaagatgtggatctgaaagacaaatgaggatgtagatctgaaaacaattgtaaataaattcataggataagaaaaagacaatgcttgatttgatactgctatggtcactagtcataagagaaaatgacttcaaagttggaatatgttttggattgtcaataggtgcttcaattggactctcagctgagccaccaaccttacaacttttgagcggctaacataatattcctttctccaaataagcaagaataaaaaccagagttcaaatacaattagaaaagattaacatttacttgctcggttttacgattccaaaaagaaaaaaaattctactatgttttctcgcatggttattacgacaacgtctaccacatcatgcatgcttttttttcattaacggtttgggtgggacaaatatactccttccgtcctcaaatataagagattttgatattttccttgtactgtttcaccattcgtcttatttaaaattttttaaaattattatttattttatttgtgacttactttattatccaaaatacttaaaccacaacttttcgttttatatttgtacaatttttttagaataagatgagtggtcaaacgttataagaaaatagtgaatattccttatattaggggacggagctagtagcatatattcgattaaggattttaagcagtgacagtgattatagaccaatccctttggaattatgataatagaaattgaattgaaaagggaaaaggtgaaggaaaagaggtgtgggtttagccgtttattgaaaggtgagatgggggtaggtaagctaatataagctctccactcctacaccaacacaacacaaactccgatcttgtttctctctctctctctcccttgtttcagtggctcagaaattttcctcttttcttattattgctttcctttatttaaggaaggagttgggctctctctctttctctgagtctgaatccccacgagacgagaaacctagcaaaaatctcgtctttcgccgcgctctccctcctctgattcctgctgttcttgatcttggatctcaattcccaaccaagaacacacagacagagaaaggaaggagaagaagatgtcgaacgacaacaagaaggtgtataccctggaggaggtcgccaagcacaactccaaggacgactgctggctcatcatcggcggaaaggtctcatcttttgtttttcttttcttttcacgcttttacttacttgtactattcgatttcatgtttcgattcgtttcgttggttcttggttccctatcctccaacaacgtcctgagacctcgatctggtcggagtccacgaccagatcttggccgcggcgcagatctggccctccagccgccggcgtggggaccttgccagatctggtcttctccgacggtggccaacttctcttgtcccttggttgcagccaccaaacctcttcctcccctcctcgatccaaccttggtcttgttcatcgactggccactaaaccccaaataagcgagatagaatttggattcgtttcgttggttattgtttctctgatgctgtgatggtggctagatcatggcagatctgcccagtaaagtcgaattttgtttgattccaccgcacctcctgaggaatcggtccaatcctgtgaattcttctcttctttcctgctgattggattgtctacatgggctttacctggaaacaggggtgagtgctagcagattcaaacatcatggactgactgctcctaaacaagttccatatgaaaacctgttctacatgctttttttcttttactcttcactcgttgtcagtcaaacactgcaaaatttgtccctgcgcctattctgcaagagcttcttgttagtacaactgaagaatcaatcctctgttccaacttggcatctggacagaataatgaatgtttcataggaaaggctcagctcaactaagtaaatcatgttgattggccttaaaacacacttcattaagagtctgttttttttatattggacatgataagaataatatggctgttttttattattaatgttttttcttggtaacagtgcttctattgatgaacctaccctgtttacctgatctcaccagtgttctgcaatactatccaggtatacaatgtgtcgaaattccttgaggaccatccaggaggtgatgatgtcttgctatcttcaactggtacgccttctcaattctcatgttctggccttctgagtagtgaccactactgatgaattaactgagtttgcaatggatggtttagcttacactttgaaatatacatggaccttctgcaggcaaggacgcgactgacgattttgaggatgtcgggcacagcacgactgctcgtgcgatgatggatgagtattacgttggcgacatcgacacatccacaatacccgcgaggacgaagtacgttcccccaaagcaaccacactacaaccaggacaagaccccggagttcatcatcaagatcctccagttcttggttcccctcgccatattgggcctggctgttgcaattaggatctacaccaagtcggagtccgcttagtgctgttctcttagtgttataagagtggaaggtaccgaataagttagcaagagttttgtgtgattcataccagtgtaacatgtcatgaattcgtcgaatgttctgaagatgctgtgggttttgtggtcctgggatgtccacttcggtaaagatcgataagattcaaagtactcgttaatcgttatacattctgatgatggatctgctcattgttattaattgttagaaacctatacatacacaaggtggtgattttattggcgggtgtttctattgaatttctgtttgttaggaatgcagatttaacaggtgttgcatttgcttgttttttgtgtcgctagcttttctataactgatcgataatgtggcttgtgtagtggatgtttactccctccgtcccataaaaaaccaatcgatgttggctaggctagtttgtttgggacgattcattgtactagaatgttggctagactggtttgtttgggacggatggagtacgtaatggctagactatccatccgtaatactggctagactagataatatagtggagtttcaccagatgaagaggggaaacctaaccaagtcaagactcaagactggctgagttgttaaccatatagtcacgccacatgaattgattttgccacaacagagattacatgtccagctttatacgtaaccatttccattatctataaaaaaatatccagctttatcagaccaagtaaccttcacaagcatatttggagtaataaaacaatggtttccgtaacacagccagttggaactacatatcatcctgattaacaacggtcaacagaagtttctccttacattggacagccatgacacgtcgagataactggacatcaccattgtcatccatcacacagcatgttattgtgctatcaagaagaactactccatcttggatgttggtggtgcaggctgcgatttctccactgaaacatccctcgacagccttgatttcaacagtagcctccactgcctctttaaccactgcatatctcaactccacggtgcctaaatccaacttactcttgtcaaaatatatcccataacaggagatgttatgctaatcatattagagacaatttcagtctctcgaactttgctatccagtatgtgagttgaataaagagttcatgattttttttttaaaaaaaaacctaaaccctaaacttaaaaaaaaaaaacctccacagtgcccagcttaccaacaaaagtgttgttttttcaccttaatttcgacaatttatattactctgaatgccatcaatcataagcaatcctttgctgtgcccttttctcttccctcttaatcggtcatccttaatactgagatcaacctcaaaatacacagcgtcttgtaccaagagtcctcgagttggtccagtcatgaatcgtcctgtgaatcaagtaacatgcatgataatgttgtgttactttgaatgcaactgtaataataaatataacaacaatttcaagtagaaacgtcatataaattataaaagctatcaccgaagatgatacaagcatgcgtgtgttcgcatatgctgattcccaacccggcggaacagtaacacggaaaacggaacagtccattagcacgtgattaattaagtatttgctattttttttacaaaaatggattaatatgattttttaagcaacttttgtgtagaaacttttttttttaaaaaatacaccgtttaatagtttaaaaagcgtgcacgcgaaaaacgaaggagatgggttgggaaaaagaggtgccgaactcacccctaggtctacatctacatcttactaatgccacgacatggtcaacggctgacatgtagaactctaacttgtttaccatataacttttcgacaccgacctcaacatcctctccaacctcccttgccggccgccggctgcgcccaacggccccagctcctcccccaccgccgccacccagttcttccctatcgcccgccggccgcaccaagctcctcccccgccggccgagcccgctacatcgtgcccagcctctccatcacgcccatcgcccgtggaaaggggaggggaaaggggaggagagagaagtagaaagaacatgctgatatgtgggacccacataggtcccatgctaagtcagctgccacgtaggataaaaccggatgcaatactgccctaggagctattgtgaccggttttgattagttaagagacgtcggatatctggttttacggtttgagaacatttttataactcgatgacgagttcaggacctgcggtgtactttttccgactttagaagggaacaagaaaaacaatttgggttacgtgatgggagataaagagaaatgaggttaaaatatttagtgtaaatttcacaaaatctactacagattttaagatattatatcacagaactataaatgtagcgctaattttataaaaaaaaactatggattttagaccaagtatcatacaactacaaatttaatatttaggttatcataaacctatgtattttagagtttaaatctctaacactaccgttatattgaagctatgaacattatacttttatgattaaattagcactaaacatgttgtgataaatttattagttaatctgtagttttgtgaaactccatcttaaatagtagttccacgataaatttgatgctgaatttgtaattttgtgattcaacattttaaatctgctgtttgttttagtttgaacaaaatatttttagttctgtgaaatttactcaaatatttattatttacaccaaccaaatattttacagatcatttaattaactattatactaccagtacttattattctaaggttgaccaaacaactttcacacgcatcttgcaaagaccacagctaatctcctcctcatcagagcctctagtgaatggactcaactccaaactgcaacccgagaagacattgtcattctgagcatgaatattcagtatcaacatttcattcactgatactaccacgacacgtcgcagtagttgaataactctgtcgtcaccaactgtggttgaacaaccaacaacatcgctgtcatacaacaatacagcatgatttgggacatttgttgtgcaagcagtaattttcccatgaaaaacttgagcatctgacaggatcttgatctcaactgtaccttccagtgctttcttaacacagttaaatacaagttccacctcactgagcctactttccaaggtttcactcacaatcttaggctgagactcaataaaatagatcttcatatcaacaagtcctttactaaattccctgtctatgcactcttcatcttccctgatcttcagatttatctcaaaaaatatttcaccccaaaaaacaattcctctacttgggcccgtcagaattagatcttcattctacaaggggattacacaacgtcagcaatgtcacgctaattttacgtacaaaagcagatgccagttattcatagaatataatcctgttactatattgaccaccttaacatctagactcagatcaggaactttcttcagattaaattgaattgctatggctgagctcatcaaatgcagtaatttggctgcaacaattataatataatgacaagactaatgaaattatgataccaaaacatgacttataatgatgatatccacaaaaatgtagtagtcacacaagacatgaatatagacaacttaaatatgataacgtcataatcatatctagctttagagtgctttcaaccatacaggactgtaaagaaataagttcgatcatcaaataaaatagggagaaatttgtagtgctaagacatattctatgaaatacctctgaccgaataacttggcaattgtccctattgcgcgggaagatggtgatgcaattaaaatctaatatgtctctgactatcacagtcccatacaaattgataggatagccaacatctgaggacaatatcttcacagagagtacatttaaggagctagtgaattgatggtcctctttgatgatggaatctgcaaagcgcattggaccatgttgtgctgagagaaatgaaaatatagtaagtatgcgcaaggggaagaatagtacgttaacggaagcaagtactgaaatttactgataatgcacaaaaatgagagaagtttgcaaagggtccaagtgtgggttcggtcaaaacagtaggtttctaaatactcctttaaaagacctcaatgggggtggtggagaatttgcccccatcacctatccactgatgtaggttcatgctgtcagggtaaccacggttgtgcttgaaattcacatgagtgatccatcatctaccactttacatcaaaaggtgagccatatgaaccagcatcatccattcacatcgaattccaaagaaaatatgttttttttcaattaacattggaaaaagtaatgacataatttatttttaatttcgttgcaatgcagggcatttagctagtagtatttaattttgttaagcctttgtaaaatttaatcccaaaatgcagaaaactaatgaaccaatcatcacaaaacaaaggaaaacagaataataataagagtaaatttcactttgggccagttttaatagccaaagtttcactatggaccaggcctaggcccatatttttacataacaccaggtaatatgaccttccattgcactttggaccaggctgcattgatttgggccgccacgtcgtcttcagcccaatccacgtgagcagcagctggtggactcagttcacggaagaatcatacggagcagccgagacacgacgcgtataaaactagcgccagcctcatccgctcgagagaaaactagcgcagcagaaaggctgggcgccccaccgccgccgcagctgccaccgccacgagccccgccgccgtcgtcgccgcggccgttgcgtccgccaccatcgccatcgccgccgtcgtcgtcgcgtccgccaccatcgccgtctttgccgcggccgccaccgtctccatcaccaccgccgaggggactacacaagctcgcacgatgggagcactactcagcagccaccaggtgatccaatttaccacccttgatccatctctaatgtcaactttagtgattcccggtgaattgacacctcaagcaggttacagtagcagtggaatcgagcaactcgaattggtcgaatcgaggggtgaatgttgaatcgccgataatctcgtgtgcatcaagcatgtccttgtctgtttcgtgtacagacaatgtgccaatcgattctatgattaggaagatgcaggatacaagggtaagttagggttagggatttaattgggggttgtttaattaggataaacttgagtacgttttggttgaaatagattgatttgtgtgtatttggacggctaagcaatggaattttgtccatattgagtgcaggagtatgaagtcgaccagttgccaaagtacaaacatgaccccaattatcatggcaaagaacatgatacagatttaagatgcttgtgtcaaagaaggccagcccgtcgagttgcgagttcaagagttaacacagagagacgatttctaggctgcccccaaaaggtagtactgtgccattcgaagcatgtgcctttattttccatagcttgtcatattgacgcaaaagtcaattaatgcatatcatagaggaagctttcagtaatgtccttcatttatctattatttgaacaaaacaggtgaaataatctttacttatgccaaaatgttgatccatttgtactttatttaagtcatctacctagatatctaaatattgtgtgcaaaactgattttatcagcatgtgttttatgcagtgggttaagtgccattttgttaaatgggtggatcttgaataggatgagctggccgcaaaaacaattttatcacttagtgagagaaacattgtgcttgagaagtcgctcgatgatgtgaacaaaagctggatgtctttgtacgcgaggaagctgtgcgaggatgacatctggagacgcaagttagccgatgcaaggatcaatcatgtcgatgacctagataagatcaagtcaattggtgatgacctagtcaagatcaagttaattggtcttgttgtgatggtgaccctttttgtaagtgctgttgctaagttgtttgtgactctgtagtctgaaggacatcacgtagagtagttgtttgtgatatggtcctttggtaatgtggttcttttatagtacgatcagtatgctggtgaacttttagtttgtaagtatgaagggatggtgaccttgtagtttgtaagtatcaaggacatcccatggccagttgtgatctgatcgttttggtaatgtgttcttttgtagcccagccttgatagataggagctgcttggaaatgtaatgataatactatggtcaggatattattatctcttgaatataatgtgaacagtatgaagttgactgtgttgtcctcagactaaaccatctttttttttagaacttaacaactttattaagctagaagcaaagtacatggtttaggtaacatctccaaagggattggagaataacatctccattgtaggacaagacgttgaaattttctgaagattatgatctacatgagttactgacagaaggtgagacaaaatgtcttgaatagctgaaaaggaactgattgatccatagtcaaaattaagatctgaaagaaaccaggttagtttggcaaattgacattgaaagaacagatggatatcattctctggtagactacaattggagcatttattctcaatccctgtaatacgaaagttaagagcagctgcagttactgaaccgtgaaggaaaaaaaatcaaccactgagaacctttaatatatgagcaacttaacatgtacacaatagtagcatccaaatttgtaggtgcaagggtgtgcctctaatggtttagatgacacagggagtactcaaattgacatcaaggattcatgactaaagctatataactacaagtccacaaaagtgtactgcattacagatgttgagcaaaatagaaggagcaaacccgcatgaagcactccatcctattttaacagtttaaggttgacaatacaatatagcagagtactattacaatatattagaagtctatagttatataactactaggattttagtttatcattgtaactataaaccaaaaggcctatacaagtactacagcctgcactatcttatgtactccaaaacaaaggccactttctttgctcctagacttctgttgagacaaaataaattgcgacatcactgtgttgagaaccaggtgttcaatctgcctctgcccctccctcttgcacttggtcggccccttgcactacccctaccaccaatcatgccaagagaaggagcctcgtttgagttttcatgggacgaagatgcaaccccacgttttcttgcctatacaacagaaaagattagttgtttatataaaaattggccgtaaaattgataaagtcaaactaaccttaatgtttgagcatgtgtgtccatcccttctacagtttgagcatgtacttgtagtcttcctcgctggtccttgcaccctaggaccctcatctggtcctctacgtcgacttttctttggccttccaacatgtttgtcaaactttggtggatcaatataaggtgaatctgtttttgtccatctatgctcatcagggactggatagataactgcagtatatgttctcatataagcatccttcctaaaataatcagcgacataatcttcaggtgtatgccctgccttgtataaagcacaaacatcatgtttgcaaggaattcctgttagttgccatttgtgacatgcacatgtccttgcacttatgtccactgcgaaagatctatctaagcaatgaacttcccaagtagttaagttagactgataacaccagcaatatcttgcatgattcttctccatctctagttttcctgccacaattggtgtaatctcccactgtgcagcatcccctccttgcctctttaaagataaccttaccattacttttctccttatgtgttcgaccatagtgacaatgggtttgtcccttgcatctagaatatatttattgaacacctcactcaaattattgacaactaggtctgactttgctttaggtgagaaagcatgcctactgaagtgttccttgccaattgcaataagccattcccaagctttcaagttcaatttttttaagtcttccatagctttatcatagtcccacacggttgtggcataaattgcagcatcaacaaaacccttgtatttctcacctctccaacctttgttgcccatattttgcaacaaatgcattttacaatatctatgctcgctgtcaggaaaaacaattgggattgcattcataagaccctacaaagtaataagatcatttttattgaaagaatatcattacttaacgagaaatgattttaatctagacatgtaatgtaccttctgcctatctgacatgaaggtccaaccaccatgttcttctccagatccaattgcacacttcaacatttctaagaaccatgtccagttgtctgtgtcctcttttccgacaactgcaaatgcaattgggaacatgttgttattctcatcccttgctgaagctgccaacacctgtgcaccatttgttagcttcacaaaacaaccatcaatacctgaaatttacagtcatatatatattagtacagaaagacatcatacaaaggtaggtcatcaattacttacaaatactattaactcacttatgaaaggcctgcaaccatttataaagccttctttctgagcactgaaacatatgaatagtccactaaatcttggtgctaatcctaaaacatctctattgatggttgtcaccactgctgtagtgc

SEQ ID NO: 37435 - DNA, 7389 bp, Oryza sativa
aagcctttctaaattgtcctgcgtcggtgaaacacatgcccttgcacaattggcttgtgtccatcatattgctctcgtcaaaataaatcctctgaacttgaattccttttcctctcctccttttccctggtggtggtttgttctcttcgtctgtctcacattcaagtgtgctcaatccaccatcctcactaggtggatcagacagctcacatgacatatcgtctatgtctgcaacacccaaatctacatcagcgtcctcaggggtatacaaatcatcaatatcagtgtcaccttcacaatgggtcattggatcttccctctgcctcttcatctcatttagtttctcaacataatcgaccttttcttgttcatgatccgtgtcaccacttgaaatgctatgttggtcgtctgccacgcctattcattaggggtgttatcaaatgtatcttcctgctgagatgaccctgcaatgacctcaacattatcaatttttagaggagaaaagggtgttctctgtattgccttgaacaagtgtaaatcagccatcttgctcttgtcattctccatgatcatgtccttcacatgtgtttcaccttcaatcttggtcaaagtgccacaatagtatgtatcgctacttgtgaaaaataactcatcacttgcttcataaccctctgtttccaatagcctgatcaagttggagtagcatatattatttctctctatctttttctccaaaatatcagtgtttggtccacgatcatgtttgaaaaccctgagtgtccaatactcaccagccatcctatatcagcaacatatgtatatatataaatgttatttgcaataattgtttaaataaatcataggagaagctaacatatataatacaacttcatttaaaccaatataacatcggaaactatgttataggaaaaaatgtttaaatgattagttattttaatttataagtagtttactagccaattaagataccagtcacttaagttgttttattttgtaggtaagtaccactaaagacaagaagtcaatgcaaggggaaattgtcccaagtacaatctttgctatgttgtggcaataattcagtgtacaaggcctcatctcatctctccatcaggtatatgcacatataccttccctcctttgtttgttttcagtggcaaaactgacagctacatcttactacatagttggttgcaaccttacttgtgcaaatgcacacacattcagaaactaaactaattcattcagtacacaattgcagaacctctgttattagtgcatctatatagtgtgtgcaatttatgtaataatcctaattagtattgcatcgcatacaaagtgcactgattgaactttgaaagatgctccttctgggaccaacacacaggagagaagaagattaaagtagattacctttacaatccgtgcaagaatcaagaatgatggagccactgctgcttgatggctacaacagatgaccaaatcctgattagaggagagcagccgagcggccacagcacactgagcagcgctggcgaaatcctgattaggccgaccaaatccaaatcagggcagtactgcagcctgggggagggagggctgccgtatgctgagtgggtggcgacgctgccggcggtgcggcgctggaaccctcgctgcgtcggtggcgcggcgctggaaccctcgcggcttcagcttcgcgccctaccgcgtgacttcccgcgcggttcctttcgccataaccagagtttttcaggccatctgttttacagagttttccacgcatcgtgtctcggcggctccgcataattcttccgtgaatcgagtccaccacccgctgctcatgtggattgggttgaagacgacgtggcggcccaaatcagtgtaacccggtccaaagtgcaatggaaggtaatattacccggtgttatgtgaaaacatgggcctaggcctggtccatattgaaactttggctattaaacctggcccaaagtgaaatttactctaataataataatacttcagatgtcacgcacatttactgtatatcgctatgggtgaaatattggatatagttaagttcagttcataactatgcttttttttgtgtgtgcttattttctaggtgacgtatattttgcccctatcaactatagccaagtcgaaatcaacccttcactatgaaatcagatattctacaaccctcagctaactgcaatcccacctgtttaatggtgattttcatgatttcgacaaataagtgctaatccgatgtaccttgtacctcatgctaatctggtcgagcaaactcactctctttgtcgaggtcgaaggtggtgaggtcgaggaaccatgcgcgggtgtagaagctggttcctgtcttgggatcatactcgaacaacttggacgacaattcttttctcctcgcccacctctccttcgcctccgtcgacgtcatttgcctctcccgctggggctttaggctttcctcccgccgcttctgcttcgccgcttccacctccgcctcctcctcctccatgaaaaacggaagatcaaagccttcctcctccacctgctgctgctcaggcttcgccatggagattccttcgcggacaccctaatccataaataaaattaaaattgaaaccctaatccataaaattgaaacagatcggactgaaccaggttggaagctagaaagggcaaaatcctcctacctcctcttttccgccgccgccgccgcactcgccctcgtggagaagagggaggttggattgggcttttagttttaggattgggaggtagaggtaaaatggcctttacgaaccaggcccaatttatcgtttccgtaaggaataagttcactttggctcccttaaaaagtctaatatgtgaacctgaaccgcaaccctatcttgacccctactctgttaaaaccagtggttttggagagcagtttcactgacgtgcgtctacgtgaaagtgttgacctgatctgccattgacgtggcgcataggtggcatttgaattgaaaacatacacgtgggacccattcgtcattcacacgaaagaaaatatatatatggggcccactgacatgtggggccaacatgtcaatctatcccgtctttctcctccctctctcttccttatctcactcccccttcggtgagcaggggccagtgatggcggcgcgggggccggagtggcggcggcggagacatgggacctacgcgttggcccgcctaacgagtgcgaggccagcaccttcgcctcctccgaccaaatccaccgacgagcccacctgttacgtatgtcgccgccttatcctcctccttcggttggctcatcccctcctgtgagccgcggcaacggagacagcagtgcggtgctggcctggatgtgagccgccagcccgccaatgccgctattatcgattggggtggggacaagattgggaatcagcgggaagagatggaggggtggtgagagagagaggcggtggcgggacggagctcggtgccggagctcgagggtggtggggacgatggtgacgggagcaaataatctcacggacacggatatgggtaggcactacccgtgcccgtcgcgcccgattgccatccctagggacagcggtgacgggagcaggctggggcacctactgctcaccaaggcggcgtcggcgtcaacctctccgcgacatcgctgtctcaggctcctctctcatcgaccgaagtggggcggagcggcgaacaaggaggatgccgcctcctgctccgggctctccttcctcctcccaactcaccagccacgaagcttgccgcccgcggcctcctcaacgccgctcccccatcatcatcccgctggtgccacagcaggatggcgcaactccgcgctcgtgtaatatgtttatcaaggaaataaaaattcctagatttctcaaatatagatatcagaaataccatcgccaattaccgtcacttgattcatttttattccaactcgtagatacttaaaaagtactccctcggtcccataatttaagggattttgagtttttgcttgcactgtttgaccactcgtcttattcaaaaaaatttggaattattatttatttttttgtgacttactttattattcaaagtactttaagcacaacttttcatttttttttaatatttgcacaaattttttaaataagacgagtggtcaaacaatacaaacaaaaactcaaaatcccttatattatgggacatataatatttatgagggctgctatataccggtataccgttcggacagtataggcctacaagcagtttagccggacgattccttccgttcaattagtatgtcatgtgtattgtcatcgtgtctcaaaaggtgtgtcgtgtcaccccatcaacccatcatttgtcattttgtccacgcgcatacgcaaaaaaatttttcatgtgatagctaagctagttcggtatagcaagtagtagcctacctagctaccaggtgtcaaatctgatactaggtaggtatcacatctgataccgtcggatgagcatcaagtctattatcaggtatcatgtctggtaccgagtgggtgccatgcctcataacaggcatcgtgtgtgataccggttggtatcaagtaccagataaccggatggccaggtatcatatttgatacatggtgggtatcggtcttgataaacgatacctgctggttatcaatcccagtatcatagctgctatataccggaattccattcaaaaacgatatgataccggttagtatcatgcgtttttgccacatatcaggtgatacttacgaggtatcagatgatgcctatcaggtatcaagcgattcttaccacgtggtgagtgatgcttgcgatgtatcaggtcctgatacctagccggtatcgggtgatagctatcaggtatcatgcgattctaccacgtatcaggtgatacttgtgacgtatcagatgatacctatcaggtatcatgcgattcttaccacatggtgggtgatgcttgcgatgtatcaggtcctgatacctatcaggtatcatgcgattctaccacgtatcaggtgatacttgcgaagtattagatgatacctcatgcgattcttaccacgtggtgggtgatgcttgcgatgtatcaggtcctgatacctaaccggtatcgagtgatacctatcaggtatcgagatgatacttatcaggtatcatacgattcttacaacatagaagaggtatcatgcaattcttacacgtagaagataattctaccacactccatagccaaccatgaccaggtcaacaagctctttgcaccccgtcttgtctctttgctcccctgaagcagcagatagataggatgaaggcccggactcgcagcgggatcgacggccggcgacgaaggcggcgactggagagggctcgcgacggagttggggcgctggcgaagggtgcatcggccggccacgcagatggagctggaggtgagtgttaacagcggccccgtggatggtgggcggcggtgctggagctgcaggcagcaatccgacgaccacgtcactgtcggccgcatcctccgccgtcgctccccacgccgggctcgtcgccgcggccacgtcctccgccgtccgtgcctaacgccatgctgaagctcgtcaccggagtccgcgatgccgggggctcatgggggcggccgcgtcggagctcatcgccagcgaccgcgtcctccgtcatgcacacccatgccacgcggctcgtcgccgcggccacgtcctccgccgcccgtgcctcacaccacgctgaagctcgttgccggtgtccgtgatgccgggggctcgtcgggggcggtcgcgtcggagctcatcgctggcgaccgcgtcctccgtcatccacacccatgccacgccggagctcatcgttgacttagttgcagcagcacgcgtgagagagatgttgtagaaagaatagctaggtggaagaagagtggattggttggtgtatatgctatcccgtcgggacggtataccggtatttagcatttccgaatatttatatatacattctgaataaataaattataatatcacgccaaccattttctagttggggggatccaaagtgaacttattccttctcctgtgctagaattgggtctacttcgtgaagggctcaacccatctacagcccatacatccagcctctccctctcgtttcctctctggatcggtcgatctccacggtggagatggtgagggcttcggcggcggcggaggaggagaggaggtgggaggctcttgctatttgccaccatggcggacgtgtttgatcttccattgttcgtggaggacgacgacgaggatgcggcagcggcggcgaagcagaggcggcgggaggagagccagaagccccggcggccgcggcctcgggagccgtggtttctggacacgccggagatgagggagaagtcggcgaggcatagtgctttggcggccaagtattgggagcacgaccccaagatgggaatcagctactacacccgcgccgttttctgcaacctcaccaccttcgaccttgacaaggagagtatgtactctacacctcaactagtatgttgttattatcatcgcatcacactgcaagattactgggatgatgttgttcctataattattcgaattgtatctatctatctattatattattaaaacagttttgaaaggagacaccacgttcgctctgtggaggctagaaattcccacattaatcgtagaaaaagaaaaatatttaaaccgttagatcatagtagatctagattacaacggttgagattgattgtatatatatgtaagtcctattcagattttagaaagatatagcacgaacaatataaatcatgtttggactcctgttcatagtcggattcccagccggacaaagcagaaaggttcttttgagctgattacaacaagctcttaatgactagcacatgctaattttaaaaatatacttgcaagttatatgggttctcttttgctttcaagtttctaatcttaaattctaccaagcaccttttagatattcaaacaaataagaattaagatgtacggccaaattaaatttgtacagacaaatcatccgtgcatttttatatgagcatcattaaaaaaatactcccttcgtttcatatgataaatcattttgactttggtcaaaatcaaactgcttaaagtttgaccaagtttgtagaaataataataacattttcaaccaaagacaaatatattatgaaaatatactcaattatcaatttaatgaaccccatttggtgttttaaatattattata

SEQ ID NO: 37436 - DNA, 4623 bp, Oryza sativa
  unsure (1)..(4623): unsure at all n locations
aaaattataaaaataaaacccatcgagacaataaactattaaaactattaggtcccttttaaaaggtttgatacttctaaaaattaaaaataaataaaccccaatgttaatcatgttcgattttaaaatctcattgataataaagagaggaggtagcgggtgagccgcagaagagtacaatggcaagccactctgtttggcgggacttctagaaagtaaaaaatgatcccaaataataattatgtttgattattaaaatcccaatgacaaaaaagagatgggacaacggacggatcgtagaggagtatagtggcagcgtttgatgggacttctaaaaattataaaatcgaaacccaataagacaataaactctagaaatcataagatccaattttcaaaggttccaagcagaatgaatagaaacaatggtagattgagccaacaaaaaaataatggatgacttttaaaaactataaaatttaaaacacggggatgataaggtttggtccttcaaaatcttaatataacgagatgactatttaataaattttaagtaaaatcatattaaaagtagataaatttatatagatgctagccgcgcaattgcgcgggccacccagctagttgtaataataataaaggtagtatgtggccgtctactaatctctagccatatatattccataaagcaatgcctactacgcaggatcaaattgttgacacctctcaaccaggaaatccgattgaactcacacacagcgaatggcaggtcaataattttcaactacatatggacaggaaacaacgcaataagcaccagaaaaaaattaatacagttcattaaatgataaacattttgttcacattctatcaaaaatagattagacaaatatattcttaccattccaaccctaccatggtccatgtatctgcttgggagctgttgttagtgaagaaaactgtttccttaagattcactatctaggtgggatcctcactaactggggaaaattgattattcctttcttcacatgatcattcccccctccttatgttgcaattgatcacttgaaggcagttgactatttgccacttctggtatgaaatggtcgtctgtcccaattccttcctcacctcccatgcagcatcaaactgcgatggtgactgagaagaaggaatttggttcggtggcacaatttcaccatcttgcccttgatagtcagtgttaggaccaccagctgccatgggccaatccacatgctcattgctaggggccttgtttctgcagtgattgtgaattagcggtgagttgtatttcttcttggagaccttgcactggagggcctagacgctggccatgagctctagatgcgggtgtagaggcataaaatgtttgactgcttaatccagggtggagggtgaggagggaaatcacggtgctgttgtctgcccacgcatgctacgtctaggaacgctatgtcagggatgaagtggaataccaggcggagatgttctagtttgcctcaggtcaaagtcaaacacagataagctgttatatatatgatgaattagacagctcatactggctttgctaagataagcagggattggcaatccaatcataccccttggtggtaaaataccagaatttaacttgcatgcagtatgctattgaagctcatagatctatttgagcaaacggacaggtgcatggtaggaactttctcaaccatggtagattaaaaatggctgaaatactgtcccaactgcaataatttgattcctgaaacagctaaaataattttaacaacagctcaaaacaaaggataaactctatttaccctatgcagacctatgtcctctagagacttttgtactccagagacattatctcgtgtatacttcagttaaattcttccctgttgcaaactaactacattttcatttttctcagcgcaatatggtccaatgcgctttacagattcaattatcagagaagaccacaggttgactggctcgttaaatgtactttcgctgaaggtgaaatcgtcagatgttggttaccctatcaatctatatgggactgtgatagtcagagatggattagattttaactgcaacttcatcttccggcgcaataggacaaattgccaagttatccagtcagaggtgtttcaaagaatatctcttaacacttccaattttccctatttcacatgatacattgaactaatttctttacagttctgtacagttaaggcatactgaagctagctacttttatgctgtctatatgcatccaccgtacccctagtttcatatgaaataccaatacttatttctttttcgtggatttgaatattaagtaacattattgtattatactttcgttagtcatgtcatttaaataataacaatattatattctatggataattctataatttatttttatataaagcattagtatgacatattgctaatgtcttatgtaatttttcttgcagaatgaaaatataattctcacgggcccaactagaggaattgttttccatgatatcttttttgagataaatttgaagattaaggaatatgaagagtgcaatgacaaggaatttagtaaagggttgcttgagatgaagtttcacactcgtaagtctaagattgtgagtgaaacctttgagagtaggctcagtgaggtggaactagtatctgcttgtgttaaggaagccctggagggcactgttgagatcacgattctgtcaggacctaaagtttttcatggaanaattagtgcttgcacaacagatgtttcgaattatattgtactgtatgatagcaatgtttgtggtgcaacctcagttggggatgacagagttatgcaactgctgcgacgtgttgtagcagtatcagcaaatgagatattgatactgaatattcatgcccataatattcatcagaatgataacgtatccagtcgcactttgaggttcactccacttgctagaggggcagatgaggaggtgatcaattgcgatctttacaagatgcaggtgaaagttgtttggtcagtcttcaagggttagaatagannnactcccttcatccaaaagtctaagacctattttatttttttgtttttaagtctaagttatatttatagttactatgtgctatattaaaataattaaatgctagttgaggtggaaggtggtgaggttgcacaagctatctactccttccatctcataatataagtgattattttaaggatggaaaaaaactgcaatacccatattaaatgtgattttggttgtggtgagtgggtagttgggggttaaaataggatttgattggagttgatgaatatgacacaatcttttatactgtagaagtagaagggataatgggtgtgtttggttgcaagtcacattttgccacagtttgccacgcctaaggttaggcaattttgacaggtgtttggttgtagccacagttgtggcaagattcccctccaacaaattgggtcccacgtgtcaatggctcaaaaaagtgtggcaagattcccttaggcttagtaagttgtggctaacaatttgatcacctcaccttaggcaaggtgtggcaacttttgttggcaagtaatggtaaagtgtggctggaaaccaaacagccccaatatctcttatattactagacaaaggggtaggggtagacgtcttgggatgtgttgttgctgcttcctcctcgtcttgctgctccggctccatatgctttctctgatgccgggtggttctgtcatggtgggcaggatatgggccttcaggtggcaggcccaatcctccttttttttttgtgacacctataactcacgtaatctgcacagaaaacagtaatgcatgttcaagcacaaaataaaaaacaaaagtacatatataacactttccatcatcagatcagagacaagtaaaagaaagaaacttacttgcaccgaattaacagtgcatcaacatcatcctggattacattacattacaccatagtacagtacacatgactggattaacaacacacaatgacacggcagacacaacaaattaacaaacagttcagcaaagctgatactaataacttcagcttaaactgtaaaaactaaaaacaaggcttagggcttaggctagttttgtgccctgagtagtactctagttatgttacagcatcaacaacaacccatcactcactcatattgacagctaacagcttcctctctcttttcttttcatctctctagtgctaaataaaatttgtacagcagagtacgtatactcatcttcttcttcctcctcatctttacaacttcttccttccatattggattagcacttgcacacatcactcactcaatccatcatccatccctgctgcctgcggcgtgctcctcaactacataatatacactctccagtgcaagcgattttaagatgcgtatttttattatttctcaaataggccatactggcctacgtttttagttgcaaaaaacgaaaacgtgagtgcaaaccaaacctagccactgttagctgtacagcattgcttgcccttcaggcggcactggtgcatgct

SEQ ID NO: 37437 - DNA, 7024 bp, Oryza sativa
caaattttaagccaaatttggtttgtataagttttaagaatgcaaacttcaaggtgttcactctcattagtggatccaagcatttcactgatcaaaatctgtcgttctacaggattcccaaaggctaagcacttctcaatgacatttgaggcaaacttttgctggctcatttgaactatttgtccaattaacttctcgataatagcagatctctcatgtggttttccgtgctccagtacatgctgtaaagtagtgtgttcaatgttaaaacaaaaaaagagtgaaaataaaataccttcaaactaacataggatgccaagattctaagaactaagactgaaaagtgaagcagaattcaacattagcacactttttttttagataatggaatgcattctggtctttacttcagagaagctacaaccaattcttacagagtttacagggtgaataaccgtggattacaaaattatggcttaattaaaaactagaaaaactactaggaatatcataattgttgtttcaacaacagcagatagttagcagtaaccatccattcatttacatattactgtgacaggacgggtacgatactggaagatcaggaaaaaaacaacctaaagatgctactgcaaaatcagaaaatggtctacctcacttcactgcaagtcaccattaagaaagcataagactagaaatatctaaatcttaagaaagcatcaaacaactagaacacacatagtaattgcgaagcagtaaaatcattttgaagtaattacgttacactatgtaaatggtaaaacaatctagaagtttggttaggttcaaaaggtatatgatacaaatcatacaatttgcaacaatgtcatggggcagacctgaacaacgtagttgccgtattgatcttgagccagcaagcaaacggactggagaatctcatccatcattatttgctgtgttgtaggatcatcacaatgctccagcaccctctgggagtttcacatgaaggatgacaagtgagtttgcatattaacatctgtaaacctcaacataaactgattacacgcatattatatgcatacctgtatacccgacaaccatatggatgagtggataacatcacaacttgaccatagaatgttgagacaatgaaccggatagcatgttgagggatgcattctaaaaatttttgtcctacctggttcccattttgatcacgtacacagcgcatgacgtgtccatccagcttttcaaccattttagtctgctgatctaaaccaacaacctctatagcctgcatatatatcatccatgacatcagattttgccttccttgatatccttcaatcatttatgcattcatacacttaacaaagggtctgtactttgtatagataagagcaagtcatgactacatcaatgcctataaaaatatttcctgaaagtgttccatagtttggtactgttgttattggatgacagagaatacatctgaggtgtcttacatcagaagtgaggaattgtaccattcactgataaaaatacacacaacctcaatcagtcacgacaattttgttttgctctgctcttccaatggttggttctgaccatttatgtatttgtataagtaagcaaaaggagttgtttatggtccttgggaagtattgagaggtagaacaagttttcagtgcattaaatagtaaatgcaactaggacccattcaaaagggcaataacacagattaatcagataaaaaattccaaaaaagcaagaactcttaataacttccaaggttaaagaaaagatccagtaataaccaccttctgtataacccggcatccatacatctgaagactgagagcaagaacacgtccaataagctggtcggccaattcctttatctgggtagggcttccgtgctcaaagaactagtcaaatgacaaactataagaatatttatcacaaagtaacacttgaagagattatgtttttccccttaacccctttaccttctgaacaacataatttccaaatacatcggtcatcaacgtgagagcttgaggcatgatttctgaaaagaccatgtccttctcttcagtactggccgtttctagcttttgctgtatgaatcggcttccatattgatcagcactataagtttgtcaattattagtagataaaccatgtaacatcaataaggacaaaagcgttgtcacaatcatagttaacaagagacagatcagatggaaacagtcacatgtcttgatgtcttgtactaatgtttttacatactgtagcacatgtcaaagcatatctctaacattttcttccccggaaatagatagaaacatgttgtaagaaataaatggagaccaaactagattaaaccaaatcataaatctacccatattattattcatgtcaagccttttttggttgatcattaaaaaaaaactagtcaaaagcattagtagccgcgctgtacttgagtactgcaattcagcaggctatagaagctacaaggttatgaaattgacaagtgtacctgaactcaacaacatgaccagcaatttttgagagctcataagatttgcttttgttgctcttgaattcctccaggagtgaaggcatcatatcgatgttcatctttccacctaggtcaggattccatgaaccaaaggagccaccaaagtttcttatacctgattgcatgcgcatgcggcgttcaccatgcctaagtggactaccaggtgcagcaggggaagagggaagaacaggactcatcaaaggacttccagaataaccaaggccaaatccaaggtttccatagtagccacagttcttctgtgactgaagcaatggactagcataagctttctgaggaccaagtaaatccatataagaacttcccagatggccactggccatgagaggatcatcacagctagctgcgagttgggcagcaatctcagctgcctgaaggtactgaatatatgacggatcaatggctgtttgaagagaagttgctgcatttggacttccaattccattgtaattcagaaagttagatccaccaaccaaattctgccttgaagataaagtcccacctggggacctagaaccgatcctaggagaagcaaagcctgatccagcagacagattgtcaaacgatgtgaaactagcagcattaatttgatttcttatcatagaagaattaggcgagtttgcagagtaaccatcaggtgccttaaaatgtccttgttcgggatgtttcatataggagtgttgctggttgccatttgattgatcaccctgacgatcaaatagaaacttacggacattatcaacatcctggtagagctcagactgggtcacagtttgctgtccactagctgctccagatgatgataaattcatcccagataaagcagctatcagattatcagattcaccaatagcagacgaacttcgacggaaggaagatgaaccaccattgttcttcttatcatcagcactgactttcacaccaattggagggaggcaaggactggggaccctcctaacaagctcaggatctggagatgcgcttctagaaagagatgatcctaaaagagaggcatatgtatgtgctgatgaatcattgttctgaacttcagccaagctttgtatattgctgtcactctgcagaccacccatagctctactagtctcacgatgcagagcatactgtggccgagaagaatccagaaagtcactaatgttgcggtcggcgccctgcttacccatgtccagctgatacgagctctcctgcatagtatgcaacaagttgtacagctctgatcaattaccttggattggataagatgaaactgaataataggaaaccaacagttcacaaaggcgtactaaaatgcttatgatcagcaaaccaagccaaaaaaaacatagaagttgtgaccatcaataagaacaattaagcttattaagtggttgaaccatattgggtaaggtggactagtgagacagcgaggggaaatggtagttgaacacaaaaacattactacatgtagcaataaagtcaacaaatgcacacagctgcaaggtcaagaatatcatctcccatagcatacagtactgaatcaagatggacatatactactgaaaaagtaagtaaaaaaagaagaagaagatgatgagatctttaattcatcaaaagggcgagcaaacaacctggaagatactggagaagctcccctgccgatcgaggtcgatcccgggcaaccccacgagcccatccccttgcgccgccgcggccggttgcctccagccgtcgccgatcccgccgaggacggaggagcgaagacggtgctgcgccgagcgccagtcctccttggagagcagcggcggcgggaggcgcgggttgaggtgcgcattggagtagtagtagctctggtacaccgggtcggcccggagctcatcgtccaggaacacgtcgccggcggccgcggcggcgctggccatcgcgccctccaccgtcggcggcgcggacccgctccggaagagctccatgtcccggtccgccgccgccgccgccgccgcctccccgcgcgtcgccatctccgtcaccatccgaaaaacccaaatcaaaaaagacgacgagatctacagtgtctcaccaagctaaaacccccgccattacagtcgcaagaaagatggccaagatttccacccccaagaaaccaaaaacaaaaacagaacaaaaaatgggcagcagaaacggatcccggttgctcagagcgggcgaatcggagaagaaaggtccatgtgcgggtcgagcaggtgtacggattgcgcgtaatggtgcggatttgggagggattcaagctcccattttagtttatttattcttcttttttttagctaagctaagctagtgagagagtgtgggggaagagaagagaagagaagaggcgagaagaagaagaagagaggaggaagctgggctgcggctcagttaagtacaacggccggagtgatttgggccgtcggatttctggctggatgttccagatcttctggagggtttgggccctagggttttgaggttgccacccttgccattgctgagagagaaagagagaatgtgtgtgcacgaatggtggtagcaagctaggtcaaggcttggttgatttagaaaatggagatttggttgagcagcgctcatgctcttcaacgacatgcttccaagaaaatgctacaacttctttactccgattcaagtacaactcgtgtactgtgtaaatttacgagtaaatttttcataaaataataatatagtggacaaataagtagatttttttctaacttattcaatgttttctttccaaattttataaatcaattaaaaaataaacttttatatacggcaaaaaagattacccacttatattcttttcgttgtttgaatactagaattaaacttcccatgatatattgaacatacatattctatgcaaaagtttatttggctgagtgaaaagatataggttataaccactaacccaatttaaaacttgctttttttaatgataatgtgaaaatcggaataaattgttttttatgaaaagaagagggttgactgggagacaaaagaaatcgcggacaagggaagaggaaaaaaaaggaaaacggtagcacttacttcttctagtactctattagtagtgcctgtttattttgatgtcattttcaactataccattttttcttgataaagttgtcaaaattttagctatatttagtttgttgctaaattttaataagtacatatgaaatcttggcaaaattttgacaaccttactaaattttggcaatgccaaaacttggtaaggttccaaatggtaacaaagtgaacaagcccgtagagtagaggcgatatatagccattatattcgtaaaataaacatttactagttattatattttaagatgaagatattggtatatataatactatagttagagcaggtacaatagcaagctataaatcagctataaccacgtatcgagaagaaaagagaagagagagaagaaagtgggctgcagatttgtagccagctgcaacacggactccaagatgttatgtgtgtatgagaggtgggacagagtattaatggtgtagtatatttttatagttaactattgtatgaattgactattagattagctatagataatttggatcaatagttggctatactattaaacttgctcttattatactccctccgtttcgaaatgtttgataccattgacttttttagcacatgtttaaccgttcgtcttattcaaatttttttatgagatatgtaaaattatatgcctacataaaaatatatttaacaatgaatcaaatgataggaaaagaactaataattatttaaatttttttaataagacgaatggttaaatatgtgataaaaagtcaacggcgtcaaacatttcgaaacggatggagtagttatttagttattggtggtgttcttgttgcacgagtcagcctaagtggccgtggcatcccaaacggatgggatggcacgtgactccatcatctcctccagagacttctttcctttgtgtacctctttgctcaagtgctcatctctctctctctctctctctctctctttctcttactaccatccattccaggccttgggctatcatctgcatctactgcacatcctgtccggcccggcccactagataaattgacagctgggccttattacactgcagtaaagctgttgccgtcaccttgttattttttttccttgtaataatggtgtggccaaatgttgtttgtcgcaaaacatgctagggaggatgagtgtagaggaacaaaaataccattgaggattaatttaccgaggcaaatgtagggaagaggaaaataaagataatcatccaaatatactacctcctcctgcaaatagtttagctcaattttgagctatacaatgtc

SEQ ID NO: 37438 - DNA, 3149 bp, Oryza sativa
accctcactccccggcacagaaaatgaagtagcgattagcacgtgattaattaagtatttgctattttttttaaaaatagattaatatgatttttttaagcaacttttgtatagaaactttttaaaaaaagcacaccgtttagcagtttgaaaagcgtgcgcaaggaaaacgaggaggatgagttgggaacatcttctgccgaacgcagccttaatctttatcttcatctgtatttcagtagattcaaacaccaaaaaaaaagtccatgaattgcattgaaattttagagagcatggtgttagcctcggggatgtaggtgcactttggttttatgcggaaccatgcagagtttttaataaattttctacatataaaaaatgcagcttgcgaaaaccacataagcaatggtaacagtcatcatgttgtactccaaataaatacaccaaatactacctccatattttaatgtatgatgccgttgactttttatctaacgtttgaccattcgtcttattaaaaaaattatgtaattatcatttattttattgtgacttgattaatcatcaaatgttctttaagcataacgtaaatattttcatatttgcataaaaaatttgaataaaacgaatgatcaaacgttagttaaaaagtgaacggcgtcatacataaatacggagggagtacgtgttatatatgaataataataacacaaaaatggaaacacaggcaggagtagtaagatggatcactgcatgctccatcccgccagtagacataatcatgcattacggttgtattaatttgtaagcaaatacacagatacataacatggaaaatggaacacgtacactgaggcaaccgcgatagtacatatatatggccatggatccaagctggcttactgcatattctatgctgatccatcccagtagacacataagtacgcattacgattacttaatttattcttaattaagaacaatgcaagcagtaaattaaattgttaagctaataagtaagcaggcaagggacacatgcagtaaattagtctagccaactctgggggtttcagcgacggtggcgctgccaaagatgcggacgcggttggggcgcagatcccgggtcatcggcgcccccaccggcagcaccacgatgtcggcgtcgggcttgtccttgagaatcgccgccttcgcctcctccatcgtcatccccaccacctccggccacgacctcttcgccgccgccgaacgcacaccaccgcccattctcgccggctaactagtatacgtagctggcttaattagcttgatgatctctctgtctgtaattaatcttaatctatctctgcacggcttgaaagattcatctggttgatgtgtatttatagagcaagcatatatatgaacacgtgacacacgacgatcgagctgatgatatgtatatatgttcatcgagaactttgcgtatattaatcgtagtaactatatatccaacttgctcaacaacttgtgtgtccatcgatccagtagttgatagaaattaaattaagaagcttgctagcacctaatccacatgttcacgtgaaacacaccaacatctaactagttagttatatatacgcagagtatgtattggccgaataggaattttgcatgaaacaaatttgcatggagcaaattcatctgaataaattataccataaatatcagtgtattccctttgtgctaaaatgttactccatccgacccataatataaaatattttggagggatgtacacgaaagtaattaatattgcaatatagtaccacctatttatactatctctgtcttaaaataaaatatataaaaagattatggctaccagtatggacatgttaatttgggacagagttagcttgctaagctgccgtagaaagtgaagctctggtaatattcaattaaaaggaaacatagatggccagctcatatattgctacttgaagttcaggaaatactgcaattaatcagaacatattcgtttgtaataagccgtcgtctctcaactttacgtcgaatttgtacagcattcccagggcgggggagccgccaccacctccgcccgccttagctacctttgcctccgcccaccgccgcgcttgcccgctgctgcggtgaagggagcaacgcctgtgagcggccggttgttagcctcgacgggttccttggcctcaccaacgcctccacctgtcacaccgcctccgccttgtgatgtggtgaagggaggtgagcctccgggtggctgtgaagagagcagcgcccacgagccgccagttgatagccacaatggattccttgggctcaccaacacctccaccgacggcaacgccaccaacaggttcatggctgtggagctggacgcagtgaagcaacgggtatgcgtcacggcgtgctactcaccgccgtcgttgttgccattgtcggaccctggggccaatgacccgccctcgaggaacgccacgaagtcgctcagcgaccgacggtgcgcgcccaccgcgacgcttcgaattcatcggccgcccaagctacgtccccggcgctagccttcgacatcaacggcgtccgatccactgccgttgtcgccactgtggaagctctgcctcgttgtcgggtgcggcggcggtggcggcaacggagcctctcaaggtggccgcctctcccccatttgccgccggcaacctccggagaagagaagaaagaaaagaaagaagagatgttggtttcacttttttttctctcatttacatgtgggtcccacatactttttttttactatataatgccacgtcagcgaaaccagacatctatactgctatgggacctaaattatatagtttaattaggggtgaaggtttctagtattgaggataaaggatgtcaaacaaactcggtgtaaagttgaggggagagaggtgaacttgttcatattcgttttgttgttgggcccattatctactatccagggtagtgcgcatatggcccagcccattaatcacatccaagcactttacaattaatttttgggccttattccaactaaaagccgcttcatcacgaatttttttctttttaaaatttatttttttaatattacagaaatattatgtcgg

SEQ ID NO: 37439 - DNA, 29782 bp, Oryza sativa
  unsure (1)..(29782): unsure at all n locations
atatatattaatgtgccttagctcgatcgatcggctttttcttaaaaaaaatgagagagaaatgccagagagctgcggattcaattaagaacaaaagtaatcgccttttcagttttttgacagagtccaggaaaccacgtacgcatatatgcaagggaagagttgaaaggttgggcaagaaattaattaaaaaaccacattccctttcttttggtttaaaatactagtatcttcacaaaaataagccttgcaaattaattaatcactaattaaaattaattaatgtgattggcatgcatctctagactaatgcaaaaccgcgtgtgacatgtttcataaagtttggtagaggtgtttgtgttggtaccatcgatcgatcagaattgaataccatcacaattcacaagtactatacgttcttcatcatcttgtcatgcatgtatgactcactttagagttaggatttggccaaccaaaatcttaagtactcgtaatatttaagtcacactaaataattaattattagttggcagcagcaccaaattaagctagcttcagatcagagtgatcgatatgaggcgtacgtgtgagatgagttgccatgtttgactaatcaaattaaaccctcaattaagtccatgtcactagctattacgtgcgtgtttatctcttcacctccaatgcaagctaattaagctagctatttgctggtcgttgctaatcccttctttctataaagttaaggctaaaagcttaaacctcgtgcttccacgtcatcatcaaattataaaccattggatgaatgtattagattgcttctcagacgttggatagaatacagcctagagcctaacccatcagtcaccgggtgagtctcttcgtctcctcagtgccaaatgtagcccacataaacatattggccatctccacacacatctacatgtatccagccgtcaatccgtataaaaaagctttatggctgaacgctcattcaattgacatgtgctacctaaattatctacaaattttgataaagctgctaaaaagaatttctccaagaaagctatttgtttcttctgtttcttcttgagattataccttttatctaataaattgatgttaaccaagtcccgcagcaacacgcgggtcatcttctagtatatataagtagttaacccataagctgcatataccatcatttttagtgaaaaaatatgtatataaccatttagttaaccagtgacggagccaacgacaccgtcaagcccgaatgacgactgaacggtgattcatagtatgatcgaccaattttgatgaatgttaatgatggtcgatcgatagtggaggtggtagtggcggagcctaggcagccatctcagttgctcagaagctgcctccaccactgtatataatattgaaatgttttcatggaaaaaattgatataacatatccattaaatagctcaaattaattaattgtgtacatatgcacacaatatcaataaataattgtgtacatatacacacaatatcaataaacaaggcaattataattgagatggatcgttgaccagctatcatatagatagctaacccttgccctagtacgtacatgtagcatagatgattaattagtagatgatatgtcatgcatgtgtgtcccctgctaagataagttaagcttgcttagctagcaacttgggctagctccccaactacttattatgctgatgacgatcgatatatgtatatatctcttttagggacctatcacggcctgaatatgccaactaattaacatttgcaaacaaaatccacctaaggtcatattagttagttaattaacaaattaatagccggccggagaatatttttaaaataggctgcacagatacataaaaaaagaattaaagaaaggcaccggagacacaggtagctaaagtatacttgtaacatgcatgatcgatgtcatagaatatcacgagtggatctagagaaatcatctatcaccaaactaaaccacatagaaacaatctgccttcacattgtttacccaataacacctaaatagaacctataattgtagaaatataaatgatgtagttttataagagaaaatagataatagtagtagtagtagtaatccaaatgctaaagaataatataaggtgaacctctgacactggaaatatagatgatgtagtttcataagagaaaactaataaaagatcagatccaaatgctaaaaataatttgaggtgattgtggcaaaaaaaaactatatgatatgtatgtgcgcgacttcataagagaagaaaggcaattcacactatagataaatgactaaaatgttaaaaacaattaagatgatgtaaggtaatagtaactacattaagcaatgtggattaactttataattatatagcttaactaacaagagttgatccattcacatccatcgtacccctccgtttcatattacaagttgttttaacctttttctagtataatacctttaagtttgactaattttataaaataattagcaacatctacaataccaaattagttttattaaatataataacattgagtatattttgataatatgtttgttttatgttaaaagcactactatatttttctatacacttgatcaaactttaaaaaggtttgattagaaaacaaagcaaaacgttttataatataaaacatagtgacaagttaagaattcagtcaaagggtatattacaagctgaaagtagaaatcatatcaatcggtagaatcatcgaaattaataaccatatatattaaactatccgcggaaaaaagtctttgaagaaaaaaaaatcatccatgaactagagctgccaataattgtatggtactcatatccatgttcatcgatgaaccctgagctaagtataatattaagccaaccaggtcagtccacatgcgagcttaaatggtggctaattaagcatgcataaatatatccttgtactatatgatatgcacatgcatgtatgttgctagctagctagttttcctccaatcaaggagttggccaggaagctaatttagctttgatcgagtaatactattaattgagttgctagcttcatctagagcgccaaaacatatttgtcttgtatcacagttaattactcttcattaaataagctgtcctaccttaacctcgatcctcttgtactagttgtactccagctagttatgtatctgaatcaaacaagacacgtaggcaaaattaagaaagaaaaaggttaattaatcctataatcgttagagcactataggtgaatggaagagtaggttaattttgagccgtgtcaacgcgcgttaagtttggccgcgccgatcataagcatgaatatacaacaatcaatcatcgaccagaacaacgaactcttaaccagtaattaattaattaattcgcagattaattaagtgggttattttcggtcttcggttagtttgacctgcctagctgctagctagctccacgagtatatgttttttttccttcaagaaaatttagtggatacaaattcattggtaactaccatttatcgccaagtttttaaacattgtaaaagaaaggagagctgctatacgtacgattatttgcgtacgatacttgtacaatgtaacatctgccagtcaaatcccatggtattttctggccgtttctaacgaagcaacacatgacatttaacgtatgttagcaatcgtacgatgatcgtacatataaaatcgtattcatagtattttcgaaaaaaaaacacggtcacaaataaaatactatcagtaaaaatctaaaataaaaggacgtgcgaggagacgcgacaacatgtctataaaagggcactaaaaaatagcccagctgttcttaaaaaaaaagttctaaaaaaaagaaaaaatatcccagccttaatattggtggtgccacctgtccaaaaaatttgggggaaatgggcataggattcctactaccgcaatactccggtttcaattataaaccaaattttcggtggaacatctgtctaataaataattaatctcctttattccttcctgtcccctaaaaaaaccacgagacacttctcccttttaattgcaaccgttccattcacactacttgtactactcctgctttctcttttgctgcccaacccgttgaccgtttatgaaatcaccaaactactccaagctaaaagaaaatagtgtacagaaaccaaataaaaaaggtcaggaaaagctaaaagagcaatttaaattgtacaattacctaaaaaagaaaatgctaataataatcttactgtagtagtatgaatgcaaaataaatgtgggtgtgtaataaagcagttattatcagcagttaatagtttcacggggtacggccgtactcctcctcctcctaccatacgttgagccagtcagtgagtgattggtggtggccccgcgatggcagtgggccagctaccaatggttggagggtattatggtaaatccgcgcgtggagacagcgatggacggacatggctggtcgtcggcgatccaacggcgcatgatggcggtgcggtggtgggctccgccggcgacgacggcgtcgtagcgatgggttgtccgcgtggcggtgggtttggttgacgacgacttgtcctcactgatgacttgaccaaacaacaagcttagctaaaagctgtttagctctagctgtgtccagcttactgcttgcgctgatgtccatttctcatggttaatgcttttgcgttttcttctcctttggaaacagtcaccccagtcaaacgttttccgtcgagatgtgcacgtgcattcattccgaacataccacgaaatttcatacttttactacaaacagaccataattactactcctaggttaattcattttttctttttctaaaaaagaattgaactttggttgcaggactaattttatggattttgcttatcattctatttaccataataagatactcatatgttccaaaattcaagcattcatgattatgtatgtagctagccagagcgatttggaacggaggtagtaagtaaaagttattcaaaactactttttattattattatttttaaaaaggttaaatctttaaatcagatgctatgctaatcaggcaatctcgtgtttgaaatttgcaaaagaaaaaagaacaaaaaaaaaaaagagagagggagggaggaaatgaggaaatgcgcgtggtttgggaggataacggcgtgaggaagcaaagcaagttgccaacttggaacacaagaaggacacaaagctctctctactcctttttccactcctcttcctcctcgcgacgcgtttcctctcctcccctttttttctcctctcctccgcccaatctcccaccaccacgccgttcctctcctcctcctcctgctgctgctgcggccgcgccgccgagcctcggcaaccaaccccctccaccaccaccaccgccggtagaggaggcgaggtcaacagcaacaacccaaacacaatatccatcccttcttgcgcgcggtggtttccgggcagatctgagacacaccaaacaaaagaaggtctcgatcgatggcttcttcctccccttcctcctcctcctcccccccttccgccgccggtgcctcctcctactggtgctacagctgcgaccgcttcgtgcgcgcccccgccccccacgacgactccgccgtcgcctgcccggactgcggcggcggcttcctcgaggagatgagcgcgcccccgccgcgcgccgcctacctccgccgcccgcgcgcgcaccacgccaacgacctgcgcctgcgccgcacgcgccgcgccgcggcggcggcggcggccggcgaccgctcgccgttcaaccccgtcatcgtgtttcgccgctcccccgccgccgccggcgacgacgactccctcgccgccgccaccagcttcgagctcttctacgacgacggcgcgggctccggcctccgcccgctcccggagaccatgtcggacttcctcatgggctccggcttcgagcgcctcctcgaccagctcacccagatcgaggccggcggcctcgcccgcgccaggggaacccaccggcctccaaggcctccgtcgagtccatgcccaccgtcaccatcgccgcctcccacgtcggcgcagactcccactgcgccgtctgcaaggagcccttcgagctcggcgacgaggccagggagatgccctgcagccacatctaccaccaggactgcatcctcccatggctcgcgctccgcaactcctgcccggtctgccgccacgaaatgcccaccgacgcggccggcccgcggccaagcaatgccggcacaaaggagaagacggtcgccctccccatttggaggctgccgggaggcggcttcgccgtcggtaggttcgccgaagggagaaggcccgagaagagggagcttccagttgtgtacaccgagatggatggagggttcaacaacggcggcgcgccgaggaggatctcctggggttcgaggcagagccgatcgacggagaggagtgccattaggcgcatcttccgcaatgtgttctcgtgctttggtcgcagccattcatcgaattctcaggcctcgtcttcgcattcgaggccggagttgaacgatgcgtctgaccggagcgccgtgttcagccatggctcaagaagccggagcacgagctggaggctcgaagatggccatgccgacgccatggtgcaaagataggcctcaactgaagtaaggaaggtcgtcgattgtttccatttcgcgcatatgtatttagaggaaaagaaatttgtagtagaacagaattgagaattggtgttgtacataggagcagcatcacatctactagtagatgataacttgcagggaagaagatgcccacgatggtgattctgaaatgagcatttgttgtttagagtgatgaatttgctcttgctggtagcaaatgtcgcttggaattctatgattcattcaaattcattgtggcgatgattctttgcatctgtgagaacggaatgaatgaaaccattttgatgtttgcagtcttgcaggattcaataaaaatcttgttccagaaaatctcttggcctcttgaatttcgacctattcatcagctttctgttgaaatgcagacgtctcatggcttgatagtttctggaggattgctatcatgctacgttatcacctttataattggtttgatgatcatatttcctggatccagtttttgtcacgtctttgcttcatttgtctgaaccaaagaacttcagtttcacgaaatccaccactgtaatttgtctgtagcctttctcatgtagcagatattttagtagtacttcctttttccttgacttatctgagacaagatttttacacatcattgtcctgatgtcaacatagaaagttgcaggcacatggaattactctcctgtactgcatttgagttcctttcctgcatctgagcacatatctcataagtgttgtgcagtaaaagcttggcttgtacattctccccatggttgactaccttctgcagtaaaatttgccttcctttgaaaccttaccttgtagtagtccttgaatagtactgacagcgttgtacaactatttcatttggtaaaccaaccaagaaatgctcctttcatgcatggcccatatacaggcataatgcagctactaaactgaaacgattccttcttcctttttttttttgtttgtacaacattgcagtgtatgtatgcatgtactggtacgtaggttaggtccaatgattaagccctgcccttaatcctgccactgatgtctgttttggtagttgagctgcaactgcatgcgagcagggttggtccaagttgaggtacgattgctaattttctgttcagttctgtctgcagaatatacaggcaagtattggcacagtatctttgatgccatcatcttgtccctgaacagtttctggctttgttttgtacgactgtgatgttgaaacggaagaaaaagggtctctgctttgctctttttactcgagtggaagtcattgtcctgtgatgagaagaaatcaagcaagtggtggtaggcatctgaatttaccacgtttcagattctttcctggggtgacatggacatgcttgtttgcagttgttacaaaaccacactggtgactcggtggatgtccattgagttgaacaaagggcaaagtttggttccattcactgagcaagcaaaattgttgtgatgacatgtggaaaatactgcaatattactgtggtcttgtgtagatctttagctcaggaattcaggaaacctgaaaacgacccacctttggagcattttcagaaacttgttccggattgttgagagagcttggtctgttgggcatgcttggaatcaatctagatatgttgctttcacgcatgacacatgcattgatgcatagtcctagccttgatcgattgctctggtttttattctctttctttacctcccatttccttaattgcagtttagtgcagctccaagcctccaaatgataagtctctgctcgactcggtaactccaactcctgaaagtctgtagtaatatacatggattttctccctgattccttttacttaggtggctgagttataaccgcaagcaacacggagaaagtcaattttctttccttgcgtgtgttgacatctcctgcgcattgtcagatgtagtaaacatcctactacaccttttttttttacctccatgtaaagcttgaagattggagctcggatgcaatcacactcttcacctctgttatgtctatgaagaaaaccatatgtgttcgatcagctccgatgaattacaggctttgcaacttctattcctagcttaggtccagaaaattcttgatatgtgatgaaccagacaggcagacggacagtatatatatactgctttgatgttgggtgagaaatgttagagagtaaaagaagtgggtgaaacagacacgatcagtttgcagatggtcacaacaacttgccatctccctccttgcacgattcacttggtacggacgcattgctcttgcttcagccttgttaccttgtactgcatctgtactatctcaatgtgaatcatgtgagattgatttcccaattcccatgcggatgacagatcacacacatcttcaagacccacacggccggccatgcatgttgagccgatcgaccacgttgattcttcttcaccgtgctgccattccatcgaacaggctgtgggtgggggtcggagtcttattctccnaacccccctcgggccgtgttggattgggaaaatgagaagccgacggcggaggctgcggtggcgtgctacagcggcaggggaggaagcggcggaggccatggccggagatgaaggtgggcttggacttacgtgcggcccatatattaactaattgggccaaaaactaaacccttaagtttaggggtgtcagtgctgactgtgactggactgtgggacccggtcatcttatccgcatcgcatggaggagaggaatcgcctcccttatcctctcgccatgcatttcctgccttgagtgtgaggatcatattcatattgcagctagcgtactgcactgatcgatttgctctagctagctcgtcgttagccacccatggctgcttctcctgcttccactgccgccgccgtcgtgaatgcgccggcggccaccggcgggctgctgctgccgcgggggaggagtagttggagttggagttgctgcaacaataacaattcttcgatggggaggaggtggcgggcggcggcggtgggggaggtggcggcggaggggaacacgtacctgatcgcgggggcggtggcggtggcgctggtggggacggcgttcccgatactgttctcgcggaaggacacgtgcccggagtgcgacggcgccgggttcgtgcgcaagggcggcgccacgctgcgcgccaacgccgcccggaaggacctcccccagatcgtctgccccaactgcaacggcctcggcaagctcggccagatcgacaagtaatcatccatctctacctacctgcttcatcgacgatccatccatccatccatcatcatccagctgccagcttctgatcatctgatcactatatacatgtgtgtatctcaccatctgtgtgcgtcgtctatataactatatactataatcgttagtttggaacgctggaataattccatatatatggtctaattccagtgttccaagccggctatatatcaatcgctacttaaattcaatgtacttgtgttgctgagctactttgtctctgatatacatattcattgtctctcgctgctcttccgtttaatggaacaatattaacatgttcttactactcaccacttttgtttatatttcttcttttttggatggactggaacgcgtcgttggcacatgtacgcttatcgctttattaaattgagacggttagtataagcgaatgattttgatatatatagctccgagttaaatactgtcctttttggagtatagagagagctagctggctctcaggcttttcctaagttttgcattgtgaatataaaatggacctatatatcagagagtaagttcgatatggaattacggagtatattgcaattatcttttccctctctttgtttggtatgaaactaattagcacacttgaatagctgtgtcatcttcaacttataaactgtacaataacacaaggcaagcaccaactaagtaattaattattaatcttcctgcggatgatgcacgataatcggcaaattgaaggccaagcctgaatagagggcttggtcactttaatgacattttcaatcttaccaaagttgacaaaaaagtggcaacatttagtttcctgccaaattttggtaactatataagaaatcctaccaaaatttggtaaggtttttttttggcatcaaagtaaacaggcctagagatagcatcactacaataaagtttttttgatgaaatccagcgcgttgctgcgagagttttatgtgatattagtaaaaataacatgtaagatagtatattttgtataattttcatctctggttgactattgaaacaaaaatctataaacaatttagattaatctctggctcaatgagagaaggaaaagaaagaaggtaatatatatataaattaatcatccaaatgtaaaactaaagtgctatgacattgcaagagaagaaaaggacgaagataatttaacaatgcatcataagtgccttatgatgaattctctgcattttataaaatgtatctatgtcttgtggcagtttcatatagacatttttttatgtctataagagagtagaagcattttctagagattaaattgtaccacaaccatatccaaccaatgcaaaagaaaaggagaaaaaaaatgctttcccttgttattgacaatccttgagatcatgacttgggtaaatcaatttcatcttccatgcactaatcaacttaatataatgtcatacctgtatatttgtgccttgtgttatttatatgtagttcctaagtatgaattaacattgaaaggtgtgcctctatatagcttaaaatgtcttttacataacatgcaatttttacagtacatgaagaatttctctacaagataaaatagaatcaaacatactaaaaatgtctctaaagtgtctctctatagtaaaagttttctatgcaattttcaaagtgcctctaaaaagtctctaccctataaaactcctaattttagagccaattaaaaaagtgtctctaccaaaagtgcctctatatggggttttttttgttgtagtgatggtactcatgtcaagccgttgtccaccttactaattatatccctcacctccgcaaacatatatacttcctccattcaaaaatgtaagttgtattttgttttcttagaacaagacttggactaacaattgctagatatatcatttatgtgacacaaaagctagcacaatcataaggaagtacttttgaatatgaatctcataacatcaattttgcgtcataaaaaacatattataataaagtaactgctagtcaaaggcttgtccaaaaaaatatgccatatattttcaaatggagggagtaccatatatatgcaggtttaatctagctctagtgtcatcactgtccactatgtatgctcccgccatcgccttaactcgaagtctacttgttaattttgtggtccactatggcactatccataacaataaataaaccataataccagggtgtcctagacatggctctagctgacgtgcgtatatatagtaagctccaaaacattgctctgaccaaccgttctttttatcgctaactatgacttctagttgaaactaaaatccacttgtctgagaggaaaaaacaaaccacgatcgcatccaccagatatatgtgagagtttgatctatcactagcgcgtcatcgctatttctagtacatatgcttctgtcatcaccttaattgtagtctatctaatcttcctccttttccacttgccaaccctaaacgaaatcgaattcactcgttgatcttgtggtcgactatgcatagtaaaattgtatgtagtacatagtaagctacaacaccttggtatagagtaagtggttttttcccatcactagacaacatttggcttcaaaagccacaaccatatccaaccaatgtaaaaaaaagagataaaaagtatgtccccttgctattgacaatcctcatccatcagatatacgtgagtgtttgatctaccactagcgcatcatcgctatctcagctacaaaaccttggtatagagtaagtggttttctcccatcaccggacaacatttggcttcaaaagccacgaccatatccaaccaatgtaaaaaaaaggagataaaaagtattttcccttgctatttacaatccttgagctcataacctgttgggtaaatcaaatttatcttcaatgcactaaccaacacattctcatgtcatacttgtacatttgtgccttatagtatttatatctagttcgttagtatattaacattatagagcttaaaattcctcaaaaaatgcctttacataacacgcatatttttaagtaccaaaagaatgcatctacaagagaaaattaaataaaatatactaaaaatgtctctaaagtgcctctaaaagtgtctctacactataaaactccttgttttagagataattcaaaaagtgtctctacaaaagtgcctctacatgtttttttttgttctagtgatggtactcatgtcaagccattgtccaccttactaattatatccctggcctctgcaaacatatatactccctccatttaaaaatgtaaggcacattttgttatgttagaacaagaattgactaataattttgcgtcacaaaaatcatactagtcaaagccttattctaacaaaacacaatacagcttatattatattttgaaatggagggattaccctatatatgtgggtcactatccactatgtatgcttccgccatcgtcttaacttaaagtctatgtgaactccctccctttttactcgccaccctaaacgaatgttgattttgtaacccactatccataacaataaaaccatgctaccaggcatgttgtcctaggcgcggctctaactaacgtgcatttgtatagtaagctccaaaccattgctctgaccaaccttttttttttcactaactatgaacccgggttgaaactaaaagtcacttgtccgagagcgaaaaaaatgcaccgtcgcatccaccatatatatatgagtttgatctatcactagtgcgtcgttgctatctctagtttagatgcttctgtcatcaccttacttatggtttatctaaacttccttcttttccacttccaccctaaacgaaattgagctttctcattgatcttgtggtccaccacgcatagtaaaattgtatgtatagtacatagtaagctacaaaaacttggtgtagagtaagtgcttttttcccttcactagacggcatttggcttcgaaagccacaagagtatagattaacattatgagaagtgcctctttagagcttaaaatgcctcaagaaaatgtctttacataacacgcagcttttaaagtaccaaaagaatgcatctacaagataaaattaagtaaaaatatactaaaagtgtctctaaagtgtccatagagtaaaagttttctaggcaacttttagagtgccactaaaagtgtctccactctataaaactcctgattttagaggcaactcgaaaagtgtctctataccaaaagtgcatgtatatagggtttttgttgcagtggtggtactcatgtcaagccattctccaccttactaattatatccctcacctctacaaacatatatacttcctccatttaaaaatgcaaggcgtattttgtttttttaaacaagagtttgactaacaattgctatatatatcatttatgtgacacaaaagtacgatcataagaaagtactttcgaatacgaatctcataacatcaattttgcgtcacaaaagccatattgtaaaagagtgattaatagtcaaaaccttattatagtagagtaatacaccttatattatattttgaaatggtgggagtaccctatatatgcgggtttaatctagctctagtatcgtcactatccactatgtatgttttcgccatcatgttaacttgaagtctatgtgaactccctccctttttgatcaccacccccaaacacatgttgattttgtggcccactatccataacaataaaaccatgctaccaggtaagttgtcctaggtgcggctctaattgacatgcgtatgcatagtaagctccaaagtatcgctctgaccaacctttttttttgtcactaactatgaccccgggttgaaaccaaaagtcacttgtctgggtttaaactaatgcgtcatcgctatctctagtttagatgcttctgtcatcaccttgattgtagtctatctaaacttcctcctttttcacttgccatctccaaacgaaatcgaactcggtcgttgatcttgtggtctccactatccatatggtaaagctggtacatagtaagttacaaaacactggtatagggtaagtgaattttccccttcattagatggcatttggcttcgaaagtcactctttcgttcgaaagcgcaaaaactaaggtaaagataaaccataccaaagcatatatagtatcaaacacgcgtcaaatatttaccgtgcgcacgtgtgttctacatgtacgcgaattattcggaccaatcaatcaataaattcctaaaaaccaagctattgatcctaaaaaatgtctatggtaatccttttcctagtgaatttacccatccatgtatacccatgcccctagctagatcaaaagcaatgcatagatctcaaaccaactaccataagtctgagatcgaagagagaacactgtaattaatactcaagcaagttaccaaaaagaaattaagaaagatgtaaggagaacaccatgagaagggaaattaaagatgtatgaggagcgatctaaagggcttattaatcatactccatgtatcggccggccgggaataaactgagtagaggtgatacattgatgagaaattaaaggaaatcgattaagaaaggcgactaatcaataaagagaaacctccaatataatccgacgcaggcaaaggatcgtcgtcgacgatgatcatggatggggtggcgagctagctagtactcgtcgcgccagcagatgagcatttggatgcagcggcgtatgatgtagaagcgcgcccggtgctccttcaccgtcttggtcagccgatgctttatgttctccgcggagtagctccggcacggcatcttcacttgctccggcgacgacgatggcggcggcggcgacttcttcaggcccttcgtcgtcttcatcacctgctccttccgcacggcgacgttgccgcctgcagcatcctccttcgtcttcaggttcttgcaggtcttcttcatcacatgcacttcccttgcgccgcctgctgcagcctccatagtcgtggtggtggtgatggtcgtggtcttcgatggagaaagagatttgaggatcgcgacgacggtgatgaggtaagctatagctatagctagagagagcggtcactcacacctggctgggtgtgccgcgcctggggtctaaaccacgcgcagccactgctgacgtgtggggcccacatcggccgtccgaggatgacgtccggccgagccgaccacacgcacgcacgagcccggtgcgggtcgtagcttgcttgctgcttcagttactctctcatctctcatctcttgctcgcggccacggccacagccactgccagcatatgatcatgtcatgctgtgcgtgcctagctttccagttgattccaagagagagaaagagaggagaaaaattatttttacaagcagtatatgtaatgtaaagtatatataacggatggatggaaattgcaatataatatatatggcaaataatattgttgctagctccatcttttccagctagcacacttttatttctttctgccacaatgaaccttgtgcaccacaggatattagctatggagaaaaaaacgaaacgatttatagttttacactacttgctgtctttattacgacgctctgattaatcattcttacctgatcaatgtcgtatgtacacaaactcaaacgtgcataaatatattcgcttctggccctggttttgatttttgaaatgttgatgtatcggatcatatcggagatcaaaacagaaaatggaataatggtcgatgcaaactaacttctatatattccactcaatcgccaatagccaagacttaattaattacttaaccaacactaccagaaactgaaatacccctgacggccgcaatttttactgacgtgtgtgcatacatgtcaggaaattgaaccctgacggacatatgtcaggcaaatttatttttccccgacaagctagttctgacggtgacatgtccggaactattttcctgacgggattttctttatttctgacgggatttagccgtcagaagtaatacaatttctggtaagatactcaaattcccacgtagatacgcatatatatgcttgcacagtaaacaaagatgagtatttatttaattttacatctctttcaaccgtatatatatatatactccatcttgtatagttcactgtcagaacatacgcatggttacactatagttacattacatttgaaagttaatttctttttagaaaaaaaacttatattacggtagctttttagataatttcaaattaacctagcaccggcagttcccgtgcaaaacagggggctagctagcttgcatgctagccatgcatatatagctttgatttttgttttcttgtgcttttcagggcttccagaagatgcagatgattgtggagtagaatactctatatcctagcttgctgcttttgttcgtttgttataagctttgtatggatgaaaaaaaagttgtttttaattaattacagaatgttaagaatctctcaagactctcagtagtggtatacccaatataatagtgcacctgacatgcatgtgaaagttaacggatggatgatatggatggatggatatgatgctcatgattccttactatttggagaattatctttcataatattcatatataatttacatgttgttaaattatacgatttttaaaaaaaagaattgatggtaaaagattaaaaaatatttgacttataacaaagctataatggcatctaatttaaaacagagagaatatcgggaatgcgtgggccttttttagggagataaatgcatagacttatagaaatagatgacttcattcatcaagatttaaattttagtgttcacgtatattacgcattggtgtgcactttcaatacgatttttggcgaggtcgagagatacccatgtcgtccatctatttaaccatgtgttatatatggacacacacatatgtatgtgggtatgggtgtgatgtgtgtgcacgtattcggtgttatgaaagaaagaatgcatataagttttacttgtcagtttcaagtttctaagtaattaactttgcgtcaacattatttgttgttgcgatttttttaaaaaaagaagcactatatgaatttgtatagaaatagagaacaaaatgaaaggaaagaagtagcgtgagcttatagtgtttcttcttgtagaacctgttgactcgggatttaagttacgactacttatttgttactaggggtgaaaagaaagctcgggttcgtgagcttagctcggccttggctcgagcttggttggcttggctcggctcgtaagccaaacaagccaagcccaagcctcctttttagctcgttgctgaaatgagccgagccgagctagctcgcgagccgcttgttttggctcgcgagcctaggccatcgtgtgtttatattgattattttactttatatagtgttattatttgtcaacttgaaatttatcactaagattttgaagaattgaatataaaaacttatttaaattttacatgttgatgatttgtttttactttttttcaataattacaaaatatatatgaataggtgtttcaacaggaaagcttgcaagccagctcgagctggctcgagccaggaaacgagccgagccgagcttaagttttagcttgtttccctaaccaagctgagccaagccaatcctagttttttgcgagccactgcaagccgagccgagccaggcttggctcggctcgtttccacccctatttgttactgatagtctttcttcggaggttcaggtgcttacagaagatgtgtgtgcgtatgtctggtttcatagcatcgtgcttcgtagaaaaatagagtaaatttcataaaaccccatctattatgatccaagttgtataaaaaccaaaataattttggcacgtgatatataaccttgggtattatgattctatagttttacaaaatcacacctttaaccattttgatttacttttatataaaaatttttaaaaaacggatgtaacatttatatgatgggataaaatccttataatttgagatatgattgtaaaactcaaaaatggtattgcgaaacttaagaaccataatacctgaggttatataacacatgccaaaatacttgtagttttgtgtaacttagactataatattatcggcggagttttatgaaatttagtgaaatgaaaggatggtaaaatggaacgcagggaggtccggcccacagggacatgcggcccagtaatagaagaagtcgattaggagcagcgggaaagcgataaggaaagcgacagccatagccactcgctgcgcctcctcctcatcgcctcgccgtcgccggagaagacaaccatgaccaccatcgccgcgcggatgccgtttgcgggcccacgcctcaggcctccctgcaacctcaccgcctcgaggccgggtcccaggagggccgggctggccgtcgtctccgccgccgccggtggcccgcttcccaccgtgctcgtcaccggcgcaggcggccgaacaggtgcaatgtactccttgcggaaacccctctcatgcccctcctcgccatcttgcccatttggttcctcgtgttcatcgaatcgaatcgaattttcttttttagataatggaatcgattttccttgcaagaagaaagaaatctagtttcgtgcacatctactcttgcaagaatttgactcggttttcccttttgcacgctgcaattggcctctctgtgatgatgatgatctttcaggccagattgtgtacaagaagctcaaggagagggcagaccaatttgtggggagagggctagtcaggactgaagagagcaaagccaagattgggggcgctgccgacgtgttcgtcggggacataagagatcccgcgagcattgctcctgccattgacggcatcgacgcgcttatcatcctcaccagtgcggttccgaaaatgaagcctgggtttgatcccagcaaggggggacgcccagagttctactttgaggatggctcttatcctgagcaggtgattaaatgtattttgtgtcactcacattttctgtatcaacttgtgccttcatttgaaattgatgttttctgctatttgctactctttgaaggtggattggattggccagaggaatcaaatagatgctggtaaaacatctttgtcttgcagatggattctttgaacttgtttcttttcagctatgctgttctttaaaccagtattatcaatgacttgttggtctagctagcatagctcctttttttttcagttaattcattccttgttcatgattcgtttatgttttttcgtcatcttcatgtagccaagagcattggtgtaaaacaggtggttttggttggatccatgggcggcacagatgtcaatcacccactaaataagttaggaaatgcaaatatactggtatataacatgtgcaaagtctttctttcttctaatttattcatctttatgtgtgcgtgttcatatgtatgcatgcatgagcacatcatatgcactgtttacaagctcagaatactttaatgttctttgaattcgcaggtttggaagaggaaggcggagcagtacctagcagactcaggtctaccatatacaattataaggttgtaaagcaagacatctcttgaaaatatagttgtgatttgtgaaatgcacgttgtcttgcagtctacataattttactagcacattagctttctagaacatggtttcacctttcttccctatagctataggtgcctgcagcctgatcataaactcaaaccttatgtatgtctgtcaggaataaagaacaaaccctcagtgcagttgaaatctggaagaattattgtaacttgaatcaggagattgcatcgacatactcttttcattttgtttttaatgcagggctggaggattacaggataaagatggtggtgtgcgggagttgcttgttgggaaggatgatgagatcttgaagacagaaacaaaaactattaccagagcagatgttgcagaagtttgtttacaggtaccttcacaactgtggatgacatgttactgttcataatctctgctcggtgaattttgcatctaccatgtctgatgtctccgagaacaatgttaatctaccaaaacgttatctatctgaaaatgttaatttaccaaacataaaggttgcaacattctctgcttgcacatgccatgtatttttatatcaagtgctgattctgttgcctaatccatctgtgcctgttcctttcctttgcaggccttgctatttgaggaggcaaggtttaaggcatttgatctggcatcaaaacctgaaggtgaaggagtacctacaactgatttcagggctcttttttcgcaagttaatagtcgcttctaagaagtataatctgtcaacgaggcacaatatttgtgatggaataatatgaagtgtgtattgagtgaggttagtttcctagcatatatgcattttttttgttcatccttgtattagtaggcagttgattctgcatatatttttaattatctgtgatctttttgttacctggtactgttttgagaaaaaaaaagttcgctaattgcataccaatataacaaaggcagttacttattactcaatcattcaatatcttcaaatcatttaagagaaatacagatgattgctatagtaatgcattcacagtaagagtatgttaagagcaaatttagttacccacccctaccgagaactccttgttcgtattaattggaaaaatacagagagcaaacataagtcggaaaaccaagccatcttccaagatcatctccaatatccatcaacacaagaaataaattgcaatacttagaacccttatgctgatgattgcataactagcttttgagaatattggagactgattgagatctgctttggtctttctgattaccacatgatcacctaggtttccactttccatgttgacagtgcctgtattatcctccccttccatccctgcagcagccagccactatcttcatcaattacaaagtcttcatgataaaattccttgtaatgtactgatctattcagaatggcttgattaacaggacgttgcttgaacccagccctgaggatcctcatttgccactgtttgtagctttctggcctctcaatcctttctgcaccttcgcatgctacagcattaagtgcatcattcccaaagagatccttctctaccaatatccttgcttcatggttcctaggaacattgttgtcgagcatatcaaaaagtgatgagtaatggaataaaacctctctgaatctagtcagaaagaatggggagctgtacaatccattcacaacaccaagaatgaaaacctgcgggttcatcctcttcatcatgtgtagtaccctatcccttgcactatcaatgttttctgtctcatcacctagctttctcattcgtgacatgcagttgattatgagtacctcatccttgtcaatactgagatcctcgatgcagatagtttcccatcttgaagcaatgccatgatactggaaaggtacgttgaacatatttgcatactctgccaaccgctttccagtctcctcaatcctttcatgagggcgaaaaccaggctggggtacatctacacctgtgatacgaagcttaggggggccaccttctcgctttgcaagtcgctgaattagacatggccactgaaagccgaagaggatgccaaaatcaacgatatgcaatgttgttttcccctccaatgcatcaatgatggttttgttggagaagtagtatgttaccatctcaaaagggcatgctacaaaatatagatgataggcctttagcatgtctctggtgctcgtttgtttcgccatcagtttttcgtacatttgactcccagtcccagccaagcgagccttgaggccatctgcaaagcagtttgctagcctctgagaaccatctccatttggcaaagcgtgatgccttattttcctcagtagctcactagcaaagggatggttgttagatgctatcgcttgtgcacattggatgagaagaacactgagatctattgcctctttctgtttcttcttactactgtgtggcttcctttgcccttttccatatcctttgctttgaaatttctttgggttgtcgcttgcttcttttgccatcattcctctaaggttagcaacttcaccagggagctgcctattgcagagcagaatactatcaaacatttcatcccgtattgtttcactagtggagatggccatatgcttactgttccttgcttccatcaactctatgtgctcaacatgaggatcatgaggatgattccttatttttgtctcatgcttgcccttctgttctgttgtctctgttgtttgtttgcaagcataaagaccattcttctctggatcatccaccaacttttcaatatttggaatgaacctctttgcttcctcaacacctctcctgaattgcaaagccaaacggtcaaattcagaagaccagtcggtggttatcgaatgcgcatcctgtgacccaaggagatcactaacaaagctaccactacatgcctgttcatgataactgctgctaccattatcagggtaatctgcttgactgtcaccgttaattgctgtcttcttaaatgaagatgggtatgccttcccaagaatatcataaaagggcttctctgtcgcctgaagtgcatcctgtcctttttttatgctgatcttttcatcaatatcctcctccatcaatattctgtttatataatcaagagttatgtttgagttggtctgacaatactcagggctgtccattatgctagacctgcattgctttaagcttctgaagcagaaatttgtgatctacaaaagagcaagtcaaccttttaaaagggtttctttaccagccaatgtcttttttttttgcctctcaaaacttgctaaaatatcaaaatagtcatagataggataataggataagttcaagagttcttttatggtcctgagaggtgccacgctaattaacaacaggagttgccaatatgaatgaaaacattaaaattcggaggtactggtacctcccaggactgtaatcagcaaaacatagttttttgcctagataaactgacatgtaaaaccatctctggcacccaattttgaagattgtatgcactacttacctgctatgtaaatcatacttttgacatggataacctccaaactctggaagacaccttttgttgagaaaaaatgttggtgtatcaaaatgtaggagttggtaacttggtataccaactacactgtagaatatatcccaaatatactttttatgatgtatactactattactgctgttacccaatgttaacagcagcaagagagattacatcagtatttacctagcttaatgatgtatctggcctatggtgaggaaggagggaggtgaaaaactggggactttattatgagccattgagagtagtggcattgtccagtccttatgagaggggctgaggctccttagttgtgctgatgggtgagcttttcttgttgatgtgaaaattgtttaatgttcctcttggtctttatttcttgttactttcttgttgacatctggctgattaatattagggttatttcttgtaaccttcttcttgacacttttctgatttataaaacatataactgtgacatgaaggtaacagatcatattccaaatggctttcttgtgatcatttctgttacaaactaggcaccattgtcattcatccaggctgggccttttggttcagtttggacacatagatgcccccaattataaccaaagagaaggatgtgacaactgataaaaggacatcatgtgcccaggaaaatgataagtaaactggaaattctaaagttattgtctaactatttaacgtattgtgctatttactctaatcccacgttaaacagtaaccggccattggaaatttagaatacaatcagtaatctaacttaggagtaaaaaaaatatgagaatatgagaactaaaagttatgaatataatctagaaattgtacttccaagaataatttactggtatacaatgaagtagttgtttccagccaaatagtttgctaatagatggaaagaacaattgcatgtcactggagcacaaacagtctcttgtttaagctgtatgattccagctattcattgcttgcagctttttttgtctccttctcaggtatttaaaattattatttttgcttccccattcacatgcacttagatgttgcactattacaacctattatgcatgaaagaacaagggatagacacattggttttagaaaacaacagtttcactactagagtagttttctattacacatttacactttgttctgaaataaaacaagaagacttttagtatggtccttagggaggaaccttgaactttcaaatagtacatattgttgagatggaaggactggtacctccttcaaaggtataaaaaaagtatgttatacacttcgtttagtttagtttctatatatgctcatgtacaatcaaatcaatacatataaaggatacatatatgttcatttattgtgtttacgactgttcaagtagatacagagattggcagttgcctatacacctttgagcaccatagcatatgtacatgaaaaactgtttgaatcttactgatccaaatatgattcatttggcttccatgtggatatggcataaattactctccctttccatccttgtagtagccaggcaccatcttcatcagctacaaagtcctcatggtaaatccctttcttcatatttattatctctttcaaggtggctggatcgacagggagctgctgaacccagccttgaggcaccgtgcttgccactgcttgtaactttctggcctctcagtcctttctgcaccctctcatgctatgatgttaagtgctttctgcccaaagagtcccccctctatcatattcctcgcctcgttatcccctggaacatttgcatcaatcatgtcaaccaatgaagagtaatggaacagaacctctttgaaacgtgtgatgaagaagggagagctgtatgatccattgacaataccgagaataaaaacccttgggttcatcatcctcattattttcagcaccctatcccttgcgctattcatagataccatctcatcaccaagattcttcatcctgaacatacagttgactatgagcacttcatccttgtcaatgttcaggtcctcaatttgtacggtttcccaccgtgaagcaatgccctgatattgaaaaggcaccttgaacaagtttgcataatcagccaaccgcttccctgtctcctcaattatttcacaggggtggaaacctggctggggcatatctatacctgtgatcctaagcttgggtggaccccctttttcatttgcaagccgctgaatcaatgatggccactgaaagccagtgcaaatgccgaaatgaacaatgtgcacctttcttggttgctgcccctttgatgcatcaagaatagtttggtttgcataggcgaatgacgccctttcgaaagggcaagctgaaaggtagaggctgtaagccttcaacaaactctcagcactggttcggcttgccatgagcttgcgatacacctggctcccgatcccagccaagcgcgcctccagaccatccaccaagtaaaatgccaacctctggttactatctccatctggtgaagaatgctgtcttatcttcttcactagttcactggccgaaatgcggtcgtcagctgctactgcttgtgcacagtggatgaggagattcctgagatcaactacatccttcttgagttgtttcataccccgtaatttccgttgtgcagatcctctggtttgtccattcagtgaattcttgcgtgcttgcttcgtcattatttttcgaagatttgatgcttcggcgaaattctccacaccatagcagagcagaaccctgtcaaacatatcattccggattatttcacagtaagtgatggcatagcgtttgctgttcctcccttccaagatatccaagtctgtggtgtaagggctgtgcctttgatctgtcaactcaaagattgcatatcttttcttgtctcctacttttgccttcgtggtcatttttgaaatggagagcccccggtcagtgtccaaatcgatcaccaacttatcaataattggaacaaatctctttgcctcctcggcacctcttctaatttggaagccagggatgccaaaggtagaagtccaggcagtgcttaccaagtgttggtttggaagaaaaagactcctgccatagctatatggactcaatggggttggcaagggctgtaacatgttgaaactggaatggctactatggtacctattatgataattgtttctgctactgctctcatcaggcgtatctggttcatttgcgctatggagtgctagccggtttagcgatggtggatatacctggccaagaatatcatagaagggtttctctgcagcctgaagagcagcctccccttggtgcaggtcaaccctctcatcgacgtcctccatcagcacccgacttatgtagcaaagggcatcgcttgatctgatcctctggtaccctagactaagcgctgcatcaatctgaaattgttgttgtccaagattacttttgtcattgcaaatcccagggatggtgactgcacctgacaaatacgttcttgatcctgtggttggctgggaaaacagctgcggatcgctggggctgtagttgtacaagctgagttgctgctgggaagaacaggaagacccatcatgtggctgttctgtttctgtggtggtgtattgattgtcaaagggaagctcaatcaccatttgttttttttttttttgccacctgaaaactgaatgacagatatatcctgtcccacagcaaatgaattcagtttgttgtctgtaaaagggaaagtgaagcaagttttgcatgagacagattctgaattcttcttcatgatcacggatactcaaaattatgttcagcctactcatttggtagaattcagaacatttgcatccccaaaccatagaaggttgtttataagagggaaccgcaaccagttagcgcattatttcctcaccctttttttctttggaaattcagcttataattgattcggtgtgaacttctatgaaaacaagcaaaactatggtctccagtaacaaattgaattgtgttgcataaattacacaacagtacacctgaagtactcgtttctaacattctgaatgttgaactgcaggaggctcctgatggaagagctcaagaacattgttgtctgctaattatggaaaacaggcaagtagttaaagtagacaaacacgcaccttacttatcagcagttccaattcagcaacaacatcatatataggttccttgagacacagaagtgaaggaagaggggcatgggccatgttcatttcagattatatagagatcatgttgtccccatgaaatgaaggtggttttccaatttcggtagctaatgtttggtagtgagaccagtgtcgatgtaaactaaaatctttgtatgtatctttctttcagggttcagattgctccaccgttttttggggggatattcttgatgcaatataaaaaaaggcgaatattagggatggcttgatgatctaaggctcccgtacatgttttttgcgagaaagtagctagcgagcccagctagaaacaatccttcttcttaagataatgagctaggaacatccttttatttgtccatctgtagttaactacaatgccttggcatcaagaatctccaatcaagaacacgttcacactataatgtgtctagcagcagctagcatcattatcctaaaaaaatttagctacatacataaacatttaaaagagtaaagtgtattgctggcacttaaatttgttcgtcttatctaggtccttgatattgttaaagtgtattattttgttctcaaattaccatgacatctttgagatcctatatggcactcacgtgtcaaattaccacgacacctttgagatcctatatggcactcacgtgtcatgtcacacgggtgttaactcattttctttatatttttctctttccttttcttctcttcttcgttcctactcgtgtgggaaaaaaatgagaaaaagaaaaagaaaatttaggaccggaatatccgtgtggcatgtcactttagtgtccatgtggcataccttgtaggatcccgaagaggtcttggctagttaggaccggaataacacacttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 37440 - DNA, 14970 bp, Oryza sativa
atagaaatcttgcaatggaaaccaaagatgtcgagggtccaagccatgttggggattatattgaaccatcgggggaaaatgagggaaatgacacggggtgatgcaggccatgggtgtagtggatgaggaggagagaatcagtacaatcgttgatgaaatggagagggaagattcggataacgagcaagcgaagagcgatgcatcatccgacgagaaaggtgatgtaatgcccactgattagacaaacgaggacttctcaggacttgttatctcagaggggcatcatgtaccctgggaatacaaggacaacgaggtaattcagggtgctacatatgctcataaggaggatatgaagaaggcagttgtcaaggttatggataccacatacctaataatagttgactaaatctcggcaggacccaccacataccatgtcttatacggaaacaaccttcggatataggaggagttccggataaggaaagacaactagagttctacatggaaacaacaaggactactcggattgtatccatattggtttccctagttctatttggacagggggacacctatgggtataaatacaaggccccctaggaggagaggggacatggaacaatagatcaagatacaagatcaacatacaagccaacatgcgctaagacaagatgtcggatatggacttcagaggtaagcatggctagtcccctatggtgtctacggatactgataggagagacatagcgttgtctctgatctcaccggacaaggattagaggaggaaggctaccctgttgtcgactacgtgtcagcacttcagaccgccatgtcgacaacagatagataggctaccccaaatattgtactggtgtgattatggtaaataagagcaatgaccggcttcggccaacaggagtagggttattacctgacaattcaagggcccgaacctgtataaaaatcctcatctccatcttttttactacaatctcgcatatatcctagtaccaatgatccccatactatataaataccggaatcgcgacatcaaacgtcgacagcagtgaagcattgggcagtctcattgatgagagagtttagggtggtcaagtcaaccaattatgtgtatgaagtaagttgcgtgaaagaagattgtccgtggcgggttcatgcatataagggtaaatggaaagattattggaaagttagcattgtgaccgagcaccagtgccacttacaaggggtggagaagtatcaccgcaacatcacatcagcttttgttgcaagtgagatgtacaacagtgttgtcggtaactctggctttgaaccaagagcaattattagccacattgaagacaaattcaagtacaccataacctatgccaaggcttggagagcaaaacataaggttttagagatgaggtatggcacttttgaagcatcatatgataatttgcagcgtctgttagccaccattgcctagaggaatagcaatacatactatgatgtgcatacatttccattttactgttgatcctaccaagagtgtgctgcaaagagcatttttctcattgggtgcttgcatcaacgcatttgtgcactgccggccagtattatgcatagatggaacttttttgaccgttaaacacaaaggtcagatattgacagcgattggagttgatgggaacaatcaggtgttaccaatggcttttgcatttgtagagagtgagaacactgaaagctggtactggttcttggatagagtgcgaagggaagtcgtgcatatgaggcccaatgtctgccttatacatgatcatcatgcgggcatgttgcgggctattgactacttgcagaacggttaggatgagaagggaattccagctaagtggcccgaccttcggagtcggtggtgcatgcgtcacatgggtgctaatttctataagcaattcaagaacaagctctagaatggcaggtaaaccccctaggactccccacatggcgggaacgtccagagtgtcgttgtggtgaccgttgtcaggtgataaggtccgtaagataacgaactcgaggacaaagatgcttcgtgtgtcctaacattgacgacgacgatttcgtcgtaagtatcttttttttgggtaccactaatcactactttcatgcacttacctctccttacgcaatttttcaaataggaggaggttaggaaatgtcaattcgtacaatggatcaatacggtcagagttacttccattggtcaaacgataacgcaacctgagacgaccacgcaattcatttaggcatggatggagtacgaacatcaggtacaaattgcaagcttagactggaggaacaatccattaggtttacctaaatggtcggagcgtccaaagtgcggttgtagagatcgctgccaagtggctacctcatttgcagaacaaacaattggcaggagatattttgcctgccccaatgtagacgacaatttcgttgtacgtctaacaaattccaaatttaactagcatctgcttattattactattctatatgactaactatgtttcttagggcaatccaaggaggtgcggattcactttatggatcgacgatgtcaatccaacatatgatggccaaaagatagctgagtctgaaacataggtagagtaccagcgagagaaggaccatcaaaatgcaatacatgttgaacgacgcagaaggggtcggtagataaactcaggctcgatttgacaggaccgacaaatttgtatcttttatccatggcacttcttaactatcttgtcattataatgtttcattattatggtgtgttgttgtatgcgtcacgaattataaattaatgtgattgtatcgttccaatttccaaagtttctttgacgccacgatacgttgtatccttataatttataagtacatgcttatatttttataacttctaccttcaaatgtgtacatgattcaacatacgtgagaattatacataactgacaatttataggtaacaaaccccctcatcaccctccaatctatttgaaaaattagattattcaaattttataaaaatgtacgtactttgttcgtttcaaaacgatattttacctaattttaagtgctaaaaaatcaggtttatgtaaaatacctatttcgtaaaattttaagtgcaaaatagttaggtttatgtactgaataatttggaaccattcctccttcgatttcgaaacgatgatttacgtagtttttaaagtaacaattaaatatttcgatgtaaaaacacccttcgttgggctccaaacagcctaaacaaggtaccattcaattctaataatatttttcttgttttcacaatttttaaagtgacaatttactacattttctaaatgaacggagctaatcgccaggggctgcccttaaagttggcggcccccagcacagtacaaaatcaccctccctaagggcggcaagggggccgcctgcaaaattttaggggccctcgccgcccttttgcagacggcccccgcacagttgaaaatcacccttgccgagggcggcaagggggccgcccgcaaaattccaggagccctcgccactcttttgcaggcagccccctgaacagtgttaaaccgccatccctaagggcggcaaggggccgcctacaaaatgcaggcccctatagccagccgttaggcatgagccaacgaccgtctgccacgtcacgaaaatcaccctcccaaaaggcggcgggcaactagttttgtaaatttttgaaacacaaaattagttttgtaaatattttaataaaaaaataaaaaataaaaaaatttggcttgaaacaagcctaccactcaagaaggcccaacaagaaacttaggacgggatctttaaagcccatgggcccgctagttgggcaaaaagactattgttacccttgtaaatatcctggtaataagaatggttaagtaaattccggagtaaccaaccctagggttgcaaaccaagggttgtaaaactataaatagactccaagagatacgtaataggacattaaattttttaagaaatcgatatatattccactttacatttccacataatagagtgtagtttccctttcaacaacgtatttgtcaatcgacaacaatatgttaaattatagtgtttattaaagttttaagttttatctaaaatagagacaaaataatttatccaaatgttatcaatgtaatcgtggatctaaatccgtggatttatagagctaataatccctatctccaaaaaaatttagattcagaattgtgcaagagtagatgtggttatgatggaaaggataagtaaatgctgatggaaagggataagtatcgataaagtgtccacgcgaacacttgtgaaacaggaaacccatgctagactcatcatatattataactattcacacatactctaaaattagatttggcctaataatattagtatattacagtgtattttaaccaacaaaatgacacaaagcaagattctattgtttaggttcagacatagtaacggtgagccgatacccacccaacagataacggtaaaaaatcgggactcaaaccctaataatttcacctaaagaaatcaggtctcctacaagacattttcctttcaatattctacctcatattcctctttgtgtctacaaaaactttctacaccttttttttttctgaagccacaattctcggtgctatcccaacataagtaagtaaataataataataataataataataataataataataataataataataataatagtggtagtagtagtaataataataatgataataataataatatgcatcttattaaaataaccatacataaatctcacttatcacataaaaatatatgtatgttgtagaaaaataaaagaagcataattgttacatatataccttgtaggtcggtttacttgatcaatagcatattatcaatctcagaaaccatttcatcgctaacctaggtatgtatttcattccatctaatttcacccactttacgtagtagaaaatttatgacacacatgttttattggaatatttacgtattctgcagcaacaacacaacctttattgttatatccttgagataattagtttaatttgcagttgataaaaaaactaaaattattatcaagtaaagtcatgtataaaccaaagattttttccaaagaaatacacataccacaagaattccggttatattgccagatgtaaggaccagttccaaattttccaattagttttgtatataaggatgggaatacgcttctgttgccttaaccactcaatcatctactaaaaccccagcataaatgacaatgatttataaagttgaaatagtgaaagtgattggaaacattacttatttattctaattgttagagataaaacccctggattaaaggacccggtttaaccaatctgccaaaaccataatggaaaaacagccgccaatagcataggtgacaaagggacgtcttggtgatgtgttatcctggagtgtatcatgcattattggatgccgctgctatctaaacgtaaaaaagaaatgactttaacccatttaaccatctttgttcactcggagattaaggttttcttattccttaaacacgagaaagaaacaataaatgattaaatatgtaaattgtttaaaataaggatggaaagacttttgaaataaaaataaatacaaatgtaacaatatcttatttgatatataatagtactacctaatctttaaacttgaatttattagcctttgcatacttataagaatgcaatgcagcacgattttgtattggccaccagttaaactcttaagataagttattagatatataatttgactatcccatcactataggagaaactgtttgttgttgccagcgagacgatttatccttatttgcaatacagtgtttagtgtaagaagaagaaaatttttagacagattgagagagggaggcatagaacatcactatgggagaaactgtttgttgccagcgagaagatttatccttatttgaagtacagagtttagtgtaagaagaagaaaatttttagacagattgagagagggaggtatagatacatgcaaggcaacattattaaaataaagatgataagcagcagtaacaatttcattggcattgacatgaaaaaactaatcaagataggtctgatacaagggcatgtcatcaaatgaatccgcatagtgctcaaaaggaatgagcctgtcccatcctcacatattctccaacgcaattaacataaataaattaaataaagaaagaaaaaaccctcaactggatcatggatagacggattcgagctttaatccataaataaataaaaaaattgaaaaaaaattaccaactgggaatttgatgatggtaagtgacggaggagatttgcatgtccacattttgttaaatccaagaaagcaatttctccaactcgaaatcagtgaacttaacatcaaggtaaggattcccaaatgtagcctggtgttgtcgaattactgctgctcatcctctataacgctgccgtaactgctttgggccttcatctctctatctctatacgtcgaatcactgctgttcatcctccatgacgtcgccgccactgctttggccttcatctctcaatctctatacgacgccatgatgtctcagggtgggatttattttgtgatcgcggcagagatttggagggagccgatgactcgttggaagcaagttactcatgtatgtggcatatgccctgactccgactagaaaacagatatgagatcatctccaccacaaatcaagggaactttatgggaacaactccctctgtccaaaatataggtccatttatttcataccaaaacatgccctgccattttattggcaaagtgaataatatatgtgttagtttggattaaggcttaatatttgcccataaccacctatctgctcatattttagaagtttatataccatatgagtaaattttataaaactacatatactttgcatgatctatcacaaaactacagatttaagaacttgtttcacaaaactttcttaaatctgtaattttgtgatagatcgtgcaaagtaccggtagttttgtgataaacggacatactaaatctgtagttttgctaaacaagctcttaaaatggagttttgtgataaattgtgcgaaatgcctgaagttttatgaaatttactcctaccatatcaatcatcaatatttctcaaataaactgcaagatgatttggtccaaatgatactccagtccaaataaaaagaaaaggagatccttggacttccaaagaactctctatcggaaagatgagaagaagaacgaagttgtaaaatatgaacataaacaaactgatttgtagattgggattaaaaaaaatggaaaaggaacccgacaaactgaccagttgcaagtgcgtcgaaattgacacattgcatgcatgcacgcggtgactaacagctaggggtggaaaaaaagctcgggctcgtgagctcagctcaggcttggctcgagcttggttggcttggctcagctcgtaagccaaacgagccaagcccaagcctccttttcagctcgttggtgaaacgagacgagcccgagctggagcctaggccatcatatgtttatatcgattatttattttttatggagttattatttgtcaacttgaaatttttcattaagattttgaagaattgaatatataaacttgtcagggttacggataaggtataccctctatccttagatgtacgttgtatactgatacggtatacccgcgcgtatgcggatagtttccgtatacattaaggaaatctatcatgtgatagggatggtatttacggatggaaggagttctactcggacaagactgggtctttaccatattgtgaggggtccgatatctccgagtcctacttggagatcaactgacccgtggtataaaagggaccccctgggcaggacctaaggcattgaatctcaccgccaacacacccaccacagcctatggaaccggagcgcgcaagagccaagtcgccgggagatctagtcagatcaactcgactacggtctcgttggtatcatcaagttctgctattccctttgtaatctgtggtttccatcatataatctcataccaactggattaggactattacctaccaagggacctgaaccagtataatccttgtcttttgtttgcttgatgtcgtactacgtagatcctcgtaccaacggaccccaataccccctatatccggtctacgggtatccccctgtcgacaaaacttatttaaattttacaagttgatgatttgttcttgctttttttaataattataaaatatatatgaagaggtgtttcaacaggaaggcttgcaagccagctcgagctggctcgagccgagccgagctcaagttttagcttgtttccctaattgagccgagccaagccaagcctagtttgttgtgagcctggctcggctcagctcgtttccacccctactaacagtagtagcgaccacaagcctgggctctacagattctagagagaatagggagggaggaagaggccgagcaaggctataggacgataaccggctcgagacttcgtcattgcctccgccatcatcttgacatcttcatcctcttcttctcgctatcgctgatgtcggttgccgcttctcttattcgctatatccagtactttagaatgcttttgagggatactagaccatgggatgccattggatgggactgcttaatgaatcagtcctaacctcccacctctcacattgaccgcatctcgagctcccatgccacagaagaaatgaaacaccgcatcttgctatgtatatataatcaaaattatttttcacccatcgcaatgcactggtacttttgctagtaaagtatatatataattatgtcatctaactattttacactttatatgttatctatactatttatcatatagaattcctgcaacaacacacaaggtttcatctacttaagagcatccccagcagctactctatcacgtacgccatcccgaaaatagcggatgagggaagaaaaacgggctccagcaaacacgccatcacatcctctaattttcgcgcatccgccattccggagagaggaatgccaaatttggcgattctctctcctcacgccaaatcacaacctctgcatctgggtcgagctcccgcccccatctggaattcacagcggcagcagaggatgagaaacagggaggatcaggggcatctccggctagattggctatcggagaaggaagaagggaggtagagaggtggcaccaaccagatctgggctggggaggttattggagaagaagcaccgccgcctcccgcaacccgcgccgccgctcctccgcccggcgactgtcagcaaccccgccgccgtgccgccgctcctccgcccgcgccgctcctctgctcgccacctcgccgccgtgtcgccactccatcgcccggcgcctaaccgcgcccgccagccatcacgactgactgcgctacgtcagtcgtcgcccgcgttgacggacagagaagaagagagaaaaaagaaggtttgagaagggtagagaagaatggagaaaaggctgaaaaatagtgcttcaaatataatataaatgtatggtagttaaaaaatattactaaaatataggaatgtgtgatatggagaatgtaatatggatgatccattggagtgggaagggatataaaggagaaattttttttggatggccatccatataggcatctagaggattaaatttggatgagctgctgtgcgttattgattcatttcatttttccagccgcaaagccgaactgcaaacggctactgtttcctgacgatgggcttgtctaattgaccggcaataagatagcacaaatttaaatttaatgaaaattatccacattaagttttacatggtattacttcaaaattatccaaagaagaagaagaaaaaggggtgcgggggcagtaggtccccaaattagacaagaacatgttatattgttaggtggttggctacttccagctagaaaaacaaagaaacaagcaaagaaacataatttttggagaagctcctgctgctgagcatgagctacaagtctacaaggatgcacatgcacgttgttcgttgcatacacgatttccatggtggagggagtggatgatctgggccgtgcagtgcatcgggtgcgtggtggcctgtaaccggcgggcgggtccacgtcggcgttggttggttggaatcctgtggttggtttggctgcctgccgtttcttctcgcctcgccaactttcccttgtccactttggttccttcttcttccattccattgtgttgatgagttgagttggctcatctcatcgtcgccgtccttgaattgccgcctcccatcccacgaattccgcccctcccaccctcctgagatctctctctctcccccacctccgtatttaggtaggcggcgggcgcatcacgttctattgccccctcctgcccgccgccgccgccgcacagccggcgatcgagcggaattcccattcctttccgcccggtttccggcgctgccgcccccctcttaccatcccgggggggcccagaggccaggagctgtcgccggaggtgagattaaatcatcaatcttcattctttatgctcttctttccttcttctgcgccccgcccgcaaaagaaaagatctttcctttctcccttttcttttctggaggcaaaaataaaattaacttaagctcaccctgtgggtagtagtagtaggtagatggtttgtttggatttggaattggaatttcatatgggccctttgctctttatgttcaatattatttttctataataatagattgtatttttttaatgttgggaattgaatctggagctgcctaccttctgcagccgtaagcataattagtgttcaacttgtttgcactcttacatcattgtattacctggcatctcttaggaggagtaatagtaagtaatttattcccataaatagatgcaggcaggtgtcttcacttaacatcaaagaaatttagagttttcatccagctgttctctcttcattctacaggatgccatttcttagagcacttgagtttcacttgcaaattgaggaaaacgccttgtctcttgttttgctagtagtattaaattagacgtcactgtttttagaagcagttgaaaagggttctgtttgatctttactttatcatcatgtcatgcacaagttatgcacataagacaacttcttcaaagacttctgaccctctgaatgcatgcactctaggatttcaatttttcggagccatttgatgctaatgccacaccaccactcctgctaaagctgccctcattatgaactcgctggacaatgagtagcaattgcacattgctgatttccatctcctgcggttacattcgtacacgacagcatgggaaaacttgcagctgttgttcgcaggtttgtatacttctctttttattttgaccccctacaccctcagcaccagaactaatatcatctccttgttcaactgacatgttgatatttgcagtgtacttagattaacaaatgaaagcatgaggattgttatggtaacaattattggagtgctcttgggcttcttcattggaatttcattcccatcagtcagcataacaaaggtaagtataacaatggttttgtcaacagaactgcatcatgtcaattgaccgtaagagaataacttaattatctctgtttgaattatgccagcttcactttccttctagctttgtatcatacatagaagacagaaactctgggctcacaacacaagctttgcttaatcacgcctggacttccgcccgaaatgcaagggaaaacagttctgaaccaagttcaaacactactttgaaggtactttatattacttttctgcactattagtttagctgtagagtaccatgaaccattagaattatgtatattcatttgatagttgtcacaaaatcctctgcttgagtaaatgatggtttgcaagtaatagcttgtattccttgccgctgttcatcccaaaagtataaggtccattgtaacaaagattttgctttcacagatttatgtcccaacgaaccccaagggtgcagagagactagcaccagctattgttgtgccagaaactgacttccatttgcgcaggttatggggagaaccaagtgaggtatattttcttgctcaacatactcgtatcattttattgccaaaaatatttggaattctggaatcttatctttgtttgttatttgttcttacttttatcaagcatatactccttaatcctttttcaaaggttttattttactgtgcctaatatgtcctgctattgagaaattgttgttatatattattaccatgtgtctcttcttgttcatcatgttctgattaagtaaaaactaagaaacgttaaccttatatgtcctggttttcaagtagttcaaaatagaagacctaaactctgtagctttccaagactgtgttggttggcatgctgatattatgattttgcatatgtaggacctgcccttcaaaccaaagtaccttgttactttcactgttggatatgcacagaaagaaaatatcaacagagcagtgaagaaggtaacgttgttgtaactttagtttgcttaacaactaaaatgctgccatccccagtttgtttaatttgcttttcagtctatatcccatttcattaaactcacagggtctgatcattttgttgttccgttctgcagttctctgacaattttgctattctgttgttccattatgatggtcgggtgagtgagtgggacgagtttgagtggtcgaaacgagccatccatataagtgccaggaaacaaactaagtggtctgctactttgctctgatgctattgtcattctctcaggtgctcaattttgaaggatatcttctaaagatttatttatgcacatacatgtaggtggtatgccaaaagattcctgcatcctgatattgtggcagcttatgagtacatattcatctgggatgaggaccttggggtggagcatttcaatgcggaggagtacgcttttgctcttgatgtttcagttgaccacttgttgatatgccatcatgccgcactaacatatgtctgtcgatgtatatgatagatacatcaaacttgtcaagaaataccatctggagatctctcaacctggtttagagcctgatcggggattgacatggcagatgacaaaaagaagaggtgaccgcgaggtccacaagtgagtaaacatgttctgctctgcaatagacatttttcagttagcagaaacccgctattctgttaatactactacctttttggaacctagcaactcaagatgcaatcttttcttgtcatagggttacagaggagaggccgggctggtgttctgaccctcatcttccgccttgtgctgcgtatgtgattatttctctgtcctgagttttgtctacagtacatcccaatatgtatggcgtgaaagtgctatccacttgagttaggctaactaatctatattgctgttgttcagctttgttgaaataatggctccagtcttctctagagatgcatggagatgtgtatggcatatgattcaggtttgtatttcatagtaagctcaattagtatcttcgggccattcattttttttcttcatttatttgattgtgttaatttcctctgcagaatgacttggttcatggatggggccttgattttgctctcaggaaatgcgtggaggtataggttaccttttggctgttaaatttcaccggcctggtagaacttcattatgaatatgctcaccaaatgctttgtgcatttcagcctgctcacgaaaagattggggttgttgattcacagtggattgttcaccaagtggttccatctctcgggaaccaggtaaatgagacatcttcctttttatttatttttccaaccaagtgtttgcataactaaagtatgctcatttgatacgtttttgcatccaaacgattaacagggcaagtcagagaatggaagaccagcatgggaaggggtaagagtctttgaaattttccgcagacatgaacacactagaactgcgagtccccttgtttgtaaccataatgtttgttcgttcaggtgagggcgcggtgcaggaaggaatgggggatgtttcagacgagaatggcggaggcggagaaggcgtactacaagatgatgggcatcacccctccgaactccacactggtgtagatctaagctaggctgattcttcatcttcatcttcactcccatctctgcctctgtctgaatgacgaggattctgatgtgttttacctgctgtacagacagttctgatgaactgatgagtgtgtaggtaggtggtcagatagagtgtggattggatggtgatgattgtagagcatacatttacacatgagggagggagggccatcgatcatgaggagggtgttatacataccatctataaaatcgattattttgtgtttttgtggtggtaatattgtttttgagttctgattgttactgaggaatgaaaggaatgcatgcacgctttaaagagagtgcaatatgatatctggagcataagaactttgagaaacaaacataaaatggtgtaaattacctggaatttgtgatatccattccaaatgaggtggtatcgggcttgtttggtttggagccaatttttgccctaccaaaattttggtagtgcccaaacaatggttaattttgaccctacccaa

SEQ ID NO: 37441 - DNA, 3783 bp, Oryza sativa
tattctgcaaacaatttcggatcttaatcaggggctatcctgcaaaatagattggccgcgtgcgtgtgcgtgtccaccctgatcgccgttggatctcccctcctcgccgtcactcgctgccggataaggaaccaatgcttcgcaccggcggcggagcgcgagccacggcggcggcgcagctgctctcctcctcctcctcgccgccgccgctccgcctcccccgacgcttcctctcgctgacggccaccccctacccgctctactacgacctcttcttataccgcccctcttaccccaatccgcccaaatcctccgccgccgatgaccgccacacccggcccaccgacgaccacttcgaccgcgccaagcgccggtacctccggaagcgccgcagccgcctcttccccgaccccgacgccaccaccgccaagccctcctcctcctcctcgtcggagttcgtggagctgaagccggaggtggtggacttcccgcggctgcacgcgcgggaggaggcgctctacttccacgacgcgttcgcgctaccctgggagaaggacaagcactaccgcatgctctaccgcctcgagaagaagtacttcccggaccaatccctcgacaacgccttcgtccccgccgacgcctcgccgccttcctccgacgccgccgacaagggcctcgtcttcttcgacgacgacgataacaacaaggaggcggaggtgaagaagaagaaggatggcgaggatcgaggggaggtgttggagaggaaggtggaggatttcttcaggtcattgaagaaaggccctggccatggcgaggctaacgtgatgaaggcgaagaagaaggagcctccgcaggtgaggcacgaggcggatgaatggccgcagccgcatctcgcgagcaggagaacggagctgccgccgaggtggaacggcccgaccgggacagtcgtgctcatcgacaagcccaaaggtgatgcctctttatcctctcttgatgaacggtctaatgcacgtttcaagagattgcatcagaatttggttctggtgtaagaaattagaatgttaccactatttacacaattgcgagcttgtgtgcaacattgcagttattcgtgccaaattattagcaaataggtagatatagtacatcgtgtgccaacactaatgcttgccgacagcctttgtttaaaatggtgactggatggatataatacattcgtacatttgaatttgctgtatgtttacaaatatagtttatgtcatggtttcatgatgagaatcttaccttgagaactagagttgttgattttatgtatgttagggtggacatttttgagctgacaattcatttatctgagtatgagcagtacatatgtggacttttagattagttcctactagcagccgtttttgttaatttgtgcacaacaaaggtgattagtaaatgtctaaaagagacttggggatattgctagaaacttataaccttcttgtcttccactccagtttatggagctcaacatatgcctttcttgtaaaccaggctggacttcatttactgtttgtggaaagctgcggcgattagtgaatgtgcaaaaggtaattttgggatttttatggtagaatactgtggttttagatctttgctctacagacatgtttattgaatatatgatgtcaggtcgggcatgctggtactctggatccaatggcaactggactgttgattgtttgtgtgggtaaagcaaccaaagttgttgataggtactctaatattctcagtgaaagctattttgtcagattgcctgggacaatttcctgtggcttatcttatttcaagttcttatttgtgaggatttcaagcgctgctatgttagaatttgacctgcagtaaacctcctgttctagcattcttgaaaactttcctgagtgaatgtccatatgcttttaaagatatcaaggaatggttaaaggctatagtggtgtttttcgacttggagaagctacatcaacctgggatgcagattcaccagtatgtatcttgtattctgataaaatgacctactgcatatatttctattaggaacttcaaatcgggtttacttttaacttgtatgacacgtgagaaattaatacagtaagacaacttattaagtacacaattaatacaattgtgttggtttggccaatcttgattaatagaacttgaagtgtggaagatttttattggggaacaattaagttaaatctggtttttttgctacatttaatccttgttaaactttctacatctatattgactttggttcaaattatgctttttttctgtttacatgatggttatgcctaaccatctatgtatcatcaggttatccagagagaaccatgggaacacattaaagatgaagatattagaaaggtagcagcatcattcaggggcgagatatggcaagttcctccaatgttttctgccattaaggtacactatctcctatattacactaaacctgttattgtttccttgtagataaagagaagttgttgctagaattcttctgtgggatttgctaacctcgcagtatctcctatacagttatgcttgataacacagactacaaaccatttgaattatatgccggttgcactatctcaagttctcaacatctgttgctgtactgtgaatttgtgattgctgttgttattcaacttgttaatggcataggtgcagtcaggtttgactgtccctggttggccatttgtacattagttattatcttatgcaaaatgcagaatttgttaatagttatactttaggtctcacaagaagatgctgcgtagtagttggtagaatggtagttaactgtgtagcttaaagaatacatagtgtctttaatcgttatcaatctattgggaggaaaaaaaaatcctccaacttgtgttgatcaaccacagaactgcaattaactaaatagatatcaggttggtggtgaaaaaatgtatgacaaagcaaggaggggtgaaacagtagagctttcaccaaggcgaatatcaatacaccagtttgatattgagcgcagtttagaagacaggtattcttcctagtttcccccttttttacctttgacttccttgagcacagatctacatacgcttggttcatactgttcgagactccacctgacatgatttttgtttgtgtatttccagacaaaatctgatatttcgagttatttgctcaaaaggaacatatattcgatccctctgtgcagatttggggaaagcgctcggaaggtctgcttattattcggatattcgtgtacacagcctttgttttcattgtttttttttttttggtctttctgcttcaggcggttctgcattgaatgagttgatctatgcatagtagttcaattgtttaaaagtgcagaataacccatctcctttttaggtttctaagattgtgatatcatcatattaggctagaaaatcactttatccactctgaagataatagaatttcatttgctacaagtatttgcatgacattgaaccaggggaagatattttgaatttatctattgcattgtggtcggctagtttctggtgttggttccatcatgatctaataaccaaatgccgcctcttttcttatttttagggcatgtagttaaagatccacttatctttcagttgacgtccgagacttgtcctttctttccatttgagttgctgttgttggacgtttccaactttacatctcctttacatcgtggtgactaaatca

SEQ ID NO: 37442 - DNA, 7062 bp, Oryza sativa
taattttactggaatttgaacgtctcgttcctcaacagtgaattgtatatcaaaattattcatacatatttttaagggacataagttcctttggtccagatcagccatcatattttagttttacttcgcaggcgacttttcagtcaatgatgcttggagttttgctgagctggaggaacaaatcacaaagggatatttatgattactcaccatgccatttggcaaaattgcagccatcgttgggttcagtttgagtttcagcgcttagcgaacaattgctttcttccaatcttccctggtaggcaattggtcgttgagtactgagaagctattaaccaacagtaacgctcaacccagagatcagcacttaatctgacgtttcagaccttgggggaaaggaattcattctggtgtccctggacactacggatgtagcagctttatatattgcaatgatgcatacctgatgtagcatgcatcctaaattttgatgtggaacattgtcaacattacgatgaaatagaatgtggttatacttgattatgaatttatgatgaaatagaatgtagtagtagcatctcttctttgtcgagccagttccagcgtcgtgtatattttttatgcgccaaaatgtttattactggtaaaggtgatgtccaacaaaggtataacttggttgtctctcatcataataactaaggttaaattgataggattacgattgatgattatatagatatccaaacattgtaggtatacatgtgccgaaggtcagcataaattaaatggcacatcattctgcacttgtcccaaatcctgaaaagcctacccaaactgccgaaatgaaccctagagaaacagtcttctaataagcaattgttgtcatcagcatctgcttcacgaactcgattctctgcaacctctcctcaagctcctcctttgatgcatcatccatcacaccctgctctctcctgcaagcatcaaagattgcatttggatcagtcagcattgttcagattcagcacaattgttaccaaatttcaggctgctccaacagcaccaactgcacaattcttaccttttttgatcatctgaggaagatgaaccatggccctcggcatcggcttcgctgcggcgcggcgaatcgaccggaggagcgaggctgcagcagatgaactgggagagaagagggtcaggagaggaatcaggagccggcctgcccatgcagtgtgagggtgcttcaaagtaggagtcctcttcatatgatcccttgtcagctgctgctgagcttggcttgcaagaaaaagaagaagacttcctcctctgtggatcatgatcaaaataccaaatggcaatgagctactaccagtagtagatttaatctacaggagctccaatgtggtttgcaaattgcaatgcctgatcatggcactagtagcagtgaaatcactgtgaaagcaatgagaaattgagtactctaccttgagtagatgtgagtgctgaaccctgaaatgttcatcagtgtccttgtcaaggttgtcggcgcagattggacacacctggaggaaagtcattcgatcagatcatcatcatagaggaactgatcccaacagtatcaccaatctgagaagaatcacaatctacagtaaatctttggagaatattttgcttagtgaactgttcaccaatcaccattagactgaacagaggtgaggactatttacaagttcacaactacagtgaacaacttgtgtgtagtttactactcctactacactgtgcagtctcatcaatggattatggtacagactggcacaaggttaaagtttttccttgtgaatttttactgaagttaacactgaagcttgattcatcaaaattcagagatgcatcgacaggcacatgagaatgcatttgcagcaagaagagaagaaaaggaatagatagcaggtgcggtgcgttcttcttacagcatttttcatgtcaaagcaatgctcctcctggagatggtcacaaaggaaatgaacctccacctcaatgtagcagaaggggcaagggatgtactcccaccactcatcatctcctgaaaaaaaaaaggagaaaacttttaaccggtaaattcacaattgcagttctttctcccacacctgcaatttcagagtacatctgaaacaaacaaaagaaaaggggggcaatatgtttttttaggaaaaaaaaatgaagctcacaatgcatataaattccaagcaacagtgaaggttccttttctgaactttttgtgtgacattgtgtggttatttgacaatggtagtaagttcacactaaacaccaacaatacctctctcacacacactctcatgtgatccgcactgcgaacctttcgatttacattcacaaaagagattaaaccggtaaacaccacatgaaaatgcatataatgatcctgaattaattctccttttctctgaaaggaatcctgaattagttccaatggaacagatgtcaaacaccaggagaaattctcgccacaaaaacctcccaaaaattgctgattcttttgatgataagagatcaaacatatgcaagacaggaggccattgtcaagaaatcagtaaacatggaaaaaaaaagaggaaacacagacaagagaaaacactccgagaactgaactgaactgaatacccaaccataagaaccactcgaggagctcaaaggatccaccaagaaccaaaatttccttggcacagcacaaaacaaagatcacctaacaagacatacaggcaggccaaagaacattcaacaaccaaccaagaagagatcaaagtgaccaacatgtagatacctgaaagttgatagtggggatggccataaaggtgctgcctccctgctgctggtggtaggaagccatggtgagcctccacttccatctctctcccctctcaccactcactattcactagtactactcctctcttcagtcttcactatcctcctcttgtttacctccacaacaacaacacatgcaaagagaggagttggaaaagcctttgttgctcctggctcttcctgtgtatttatatgtggctgtcaggacttcaagaagcctagcccttttagctgcaggaatatttcagtgtgcatctcaaaaggcaaagtggaaataaaaggctggtaaaaaggcaaaataatgagatattactttctacttttcctcagaaattattaaacaagacacaccagacaccactgcacattctcatgagccaacatcacatggaagctgtcttaaatatatgtagagaaatatctccatgtgttaatgaaagtaatataatagtgtaatgcagtaatcatctgcatttgccagcaatttgaagagtcagctagaaattagtactacgtattaagataggttactctcatgcatcttgctcttatccagagtgtccaactttagattacacaaacatgtggggtcaatatagaggcttaatttacttccgtcttattttaaatgcagttatggatttccgtgttcaatattcaccgtcagccttatttaatttttttaaaaaaaaagtcacacataaagcattattcatgttttatcatctaaataaaaaaaatactaatcatagaaatctttcaaataagacggatgactaaatgttagacataaacggtgcaaaactacggtgtttctggacggagttagtactttggattacacaaacatgctgaagcctgatcaaggcactttcatcttttgtcagctatcactaacaaaacacactgcattgtacggaactccatcagaaaacaagaaaaaatggtgtagagatcattgggggcatgtggcatgtagataaactaacattgcaacttgtgctgctaattagtgaaaggaaaaaaggaacagtcaagctagcagagggtcgttgctgattagcctagtgttctttgtgaccagtcttgctcgtgtcttactttaaatgtttcatttttctccttttatggttgccttttatcgcgtttagataaacctttttggaaacttggaagccaagtctaatggaaaagcatcagcaggaggaaagctaaaacagaccccttttatgtatgtccctttcactaataaacacatacatttttcttctactcccttcatctcttttttgtttgatgttgaattaagcaatgtcataccttttattattgaaaagaattcccttccttttgaaaccaaaaaggtagtttttcccattggtcacacagagctctgcatttgtaagtaaatactcctttatagggggatgaattttctgttaattaatgtaataaacaatcacaaaatcctggaatgttgagaacttcagtataggaggattgtttcccattgcaacactcgtcgctcgagacggtttccggtgaacccggaaggccggaaaaagaagttgcagactcgcagttactctttctttctgtatcaaaataaaccaatttcatatgagatgtaacacctcagttcatatcagattcatcgtacgagtttggtttatttttgacggagggagtgcactgaacaccaccaccaccaccccgttctccgtgaagtgtgtgacagtatctttggtggtcagcacagcacagcacagcacggcagcagctagcctggggcaggactgcagcagcaatgaaagctgaaaggcgtcttgtggagttgtggaagccatctcaccattgccattgccatcgccattcctctctctctctctctctctggcctctcttgccacacaccttacatcctcaaaaagcagacagatagagacagccattgtcagggttctctgattctctcactcactctctctctctctctctctctgggaatatgtgtgtgtgtgtgtccactcagcagtcactccctcaatggcagtgaggttgtgatgtgcgtgtgcccagctttgtgtgttagagtagtagagtcttgcagtgttgtgttgcaccgcaatattatggtggtgtttgtttctagcaccaaatatgaagatggaagtttccattatctaaagagaaataaagacggaaattacgtaaacaagaaagctattaatacacatgattagttaagttttaattattatatctgtattttatagcgacttctatatagaaagttttttatgaaacatattgtttagtagcttaaagacatgctaacggaaactaatgtaaaatctgcgtttaattaagaaaaaacattactatgtgaagacctttcgactggagcttaacttggagttagaggccacctttttctctctgtcctggggtttaggggaaaaagagattaaggaaaacaactagagtaaaaaatcatgttttttttctctcatcgtcctttcttgaaggcagatccatctgcttgcttgtctttttccatgttggcttgtgcatgccattgctgaatgctgatcagcctcagctgtgcagtgctgtgctgagctgattgattccctgcagtgctggcctgtcatgctcatgccctctaggattgttgttactggtaggaagagtaccttggtactagttgtactagcaaagagttggcaagatatttccaactttctcagacacgtttcgaccggtggctcttctagttctacacccttaattaatctgcgtcctgatgatcaccttgcaattggccatcaaactgtcgcagataattatagtacttactttgtactgacaaggattaaacttttgtccttagagaattctgccacacatgcatgcttatgaccaaggtctgactcatttcatctctaataatgcaactggggaacaaaaatccatccaagttctgcaagattatgagaacacctcaactgggtagcaggacagtatcatttagaacattaatcaagttataatccaaacaatactctgaatcttgatattaaaaaagcaggtaaacacaaagcaccaaacatttctgaagatccagcacgtttgatttgttaccacttccaaccatagcaatttttttggcatttcggtaatgccaaatgttgctagggttgattttggcaagaaatgaaacatgcccaaagagcacatcataatgtaaaggtaccattaacataggatccaaaaaaaagacgggaaaggaggtatttgttcatgttacatacaaagagtcacacagaaccaaagggttcagaaatgaggaagggggagggtgactccgcacaatttctactactcatcgtttagtcatttatatcacattatcaacacagcagtagcataacaattacataagcatacaaattaaaacagttgctgctgtgatatactctggtagcacatacgattgtattgacacacattgattatgaaacaaacaatgtggtggtacagtacacttcaggcggagccaggtctagcagaagagactaacaaataccaggcaaaccctgacctcgcagttatcaatttattggctgagtagtttggaatcacaggccacaatcttcaccttgccaacttgttctgtagtctcctcgttcttgaatgatgcttcagtcaagatgaatgtccatacattgtcacagaacctgtaagtgtgcaggtggccctgagaaaagaacatgcatcagtaaacagcccagctacaaaaaatttaaaaaacaggctcaaaaagttagtccatcaaccattggaattaagctggaccagagaacttatttttaaataaacaaaaaaaatccatccaaaacaggtttggttgacaatgggtccaaaaagacaaaaggtttaaactcaggtaactagaattgaaaatttttgaaccagaataccaagttagaaaaataaaagagtaatttcacaaaactacatgtattttgcacaatttatcacaaaactacagatttaaaaccttgtttcacaaaactacagatttagtatgcccgtttatcacaaaactacaggtactttgtacaatctatcacaaaactacagatttaagaacttgtttcacaaaactatggg

SEQ ID NO: 37443 - DNA, 15047 bp, Oryza sativa
  unsure (1)..(15047): unsure at all n locations
cctgtcctccctatatataaaggggtcccacgtactgcattatcaatcaatcaatcaatgaatctctaaagctagccctaggcctcagagcctcttagctcagcaggaagaagccctgcctctgctattagagggcgagtgccctatcccccagtctttgcacccttaccctagccaatccataacatttggtatcagagccaactgatgctccaccctcgatggcgtgcagcggggatttcaattggatgtggagatttcgccaccttgaacctctcccaacgttcaatggtgaggatgatccgcaaatttggttggagagtattgagcagttctttgttgagcagcgaatttatggaggaagagaagtggtggattgcatcaagccaccggaccaggtttgccgcaatgtggtatgagttgattgagcgagcctacggaattcaaacttggccagaactcaagaaaaatatcaaacttcgctttgatgatttgccgactgctaccattgaagttctttccaagaagatatctgctagtgctcgaagactatctgtccgcgaggggtgtagtgttatgggcatggaccaggcccatgcagcagtttaggcatcataaattacgaattactcatatataggtaggagattatctaattaggaaagagatgaggtttattagaaagttagagatagagattggactggtttctgtagtactagagattagttccttggatgtcaagcctgtcctccctatatataaagtgaccccatgtactcttatcaatcaatcaatgaatctctaaagttagccctaagcctcatagcctcttttagctcagcagggagaagccctgcctctgctattagagggcgagtgctatatcccccggtcttcggacccttgccctagccaatccataacacctttctagtctccggtagcaatagagatcaattcttgcaaaactatatctaggatagcgttttacatacttatcacatgggtgcatgcatgcaccatagcccagcaggttgtcatggacagatctgttcatcatccaggtggatagctgctatcaggtagtcgaatctacaagacaaacatgatctttccagctataactaattcttaaatgctatagatttagcccaactcttttagcatggagcaaagctcaccgataacaactacatagctacagtaatataatgctcttgatgcacctttcgtgaaaatgagtcatatacaaatgcatcaatagaataacaagaacagtgctgaactatctagtgactaatgggacaagaataaacacgacaaaacgattcacccgaacttggtgagctgcctgttgcgtctacgaatggcccagaggactgattgatactacaagcacagttagaggagcagagcactgaactatgacaagaatggagaacagggaagtgtgattatcgtacgaacccagcgatgagccctagattgcttgtgatcagaagggaaattgagatgttgagtggtcaagtcgcttcttggcacaaaaaaaaaaggtttctagcagagtaccgtcttatgtttggtacggtttctagcatcattactggtttgttattgagctccaacgctgtttgcggcttgtttctcttgcacaatattgcagataaagaagttctaataaacatgtacacaccagggtcacttagttactttatttcttgttttggtttatggggaaaaatcagtgttttaatatgggcaatattgcaatgtgtgagtttttttttctcgaaaccacaggaggactgcgattcatttcattaagaagagaaattgtacaaccgagtgacccaaaggacccctacagaaacacaaaaaaacatcacggaacgcgacgtgcaaccgaaacaccccctaggagaaactagccgtccagggggagcaacccacatagaatttcgaggagtgcctttgctccagcagtacaccaaagagaactctctctagccactgcatgcaaaacagccgagattctcggggaggcaccattgaagacacaatcattgcgatgcttccatatttcccatgccactaggataatcaaagagttcagccctttctttacctctttaggagtatccttaactgttttgaaccaccagctagacaagcgattcattgatggttgcagtgctgcagcgcccatccaaccatttggaagattaaaaaccatacttgccaggaaaaaacacaagtcaccaaaatatgctgtatagtctcctcctgatcgcatagaggaacacacatccgggtgtggcattcctaactcgcacatggttgcgatgtggtagttagggtctgaggctattgtaatgtgcgagttgcctatattttgcatacttttgacttccatttataaaaaaggggcaaggggccaggagtaaagcggattacagtaagatacgtaaacaagtcacccattgttgggcaaaaatatcagtccatttctgtgattacccccaattcacaaacaaaaaagaatctttatcatgccatagaataacaaactacatgggtatcagaaagaatgacactaatctttattcataatttcattttggtgaagattatgctggcaagaaaagatcttacattttttcaggcttgttatccaataaaaggtttttctttcttttctttttttgggggcccaaacaacagatgagcagcttgaatctgaaccactcaaagagtacctgatgtgttgccaaataagattagtggaaataaggttgtacagccgaaaaaataaaagcatatatgtgataagtgcaagatttgtctggttatggccgtgtattatgttgctgataggtcttaattctgttactcgcttactcattactataaagtttgtgcaatatccctcagaactcagagcagcgtacacaggacaggtacgtgtcgaacgtgaatggattcctttatgaataataataataatataatatatgcaagaaacaaattttagacttgattcctttagcaagtgtgtacggaaaagaaaatcgaatggcaacgctgaatccacaaccaagtgtatcaattctagcactggagaaattacatcacaagcgcatatgagttctcaagcataaataatgagtaggctcgaaacagatagagattaaagttatgcacagcacaagtaaggcttggttttttttgggggggtaggaacagcaacatggcaactccgtgataagagcagataccttgatagaaaccttgctcttgacttggttctcccagggctccgtcatagactaatcacatagatgataacaaacaaaatgaggagtcgaatttttcaatagtatagatagtaataggtggaaggagatatggtaaagtaaataccttatcaaactggacaagaacttgaatggcgagctccgggctgagggtgccgctggagaccatctcgtcgagcgtctcagtgaggcacatgccaatggtggacctccggtagagctcgaaggtggccatgggcgatgcgtgcacctaaactttttggggtggggggaacaaacaacaaaactgttgttacttgtagtattaagagaggttaaggctctgaaattaagagcttcttccagatctagaagagaagagaagagaagctagggttaacgaacgaacgcgagcaaattccagacaaaagtagagagtcccggtgggagagagagagatgaattcagagaaagaaagaaagaaagaaagaggatggtcacctgcaggatcccctcccctgctctgctctgctcttcttgcccgatggagatcgcgagtcggcttgttggcgcaaggagaggaggagcggaggagacgacgagacgccagatttctctttattttacgccaaagagaaccattactcgagttattttacagggaatatttgccactcttggaaatgctgctatccgcccaaaaccaattttggaaaatttcaggaaacgaattcagattttctttttctcggaatcggaaatatttagtatttataattgcaattatagataaatatagctctttttctccaagaaaataaattatacacctagttatattattattaattgataaaaattataaatatcgatttattgtttcagagagatattgagctatatctcttcatggattttagaagttcagcttaaggggcttttatattccgataaatatctgttaccgtattcgctccattttcgtattcgataatatttgattccatttttgtatccgtggttttcgatttcgaacaaaatatggaaatggaaacgataaaagagtttttcgtctttttccaaagcgttttcatccctactcgagtactccacctttatctcaatttttttactactttaaaactagctatttctttatgattattgatggacaaatatattgatagtactcagagaaaaaaaatgcaacaaacaaggttggggattgtatcaacggcaaactccttagaccaccaataaccactagttgccgctccacacacaccgccaccaccgctcttttttccattagctaccaccattgttcctcctctccgcctttacatgcatagccacaccctctagtcatcgagatgtcttttcccctcccccgtcatcatgcacactattgttatggtcaccgttgaggttaggggctgtcgggtttgcagggacttggagtggcaggagctggcccgacaaagagcagggaagctagatcggactcctccttgctggatctgacgattccctagctttcaaaaggaaaaaggaaaaggcagaaagagttagtgcgtggaatggttgtagagtcaccggccttgaagatggatagaatggggtagtccaaaatgaaatgtaaagttagatgttgtgtatatgaaaaaaatggttaaacgatgatataatatgaacactttcaagaatatatagtacaaactgcaatttatcttttttttttctctagcacaattaaatatgagttgtccattacccgatagtctcgcgatatgctaagcacactacagtttatcatctgtgcacatccatggagaccttgacatccaggggggacgaagtatacgcgggcatagcgacgactagggaaatactctgtgaaaacgagctaagtgttgaaaactcgtgaaatcatacctaaaagtttagtaaattcatgaaacatttgctagagatatgtgtagatttgaagtacattctcaccaaatgtcaagtccaaactcagcttcatttgagagtaataaaaatgacaaatttcaagtggattttcattcccaaataaagttgagtttatttgtcttttttaccattcacctgaaaatagttactattcacctaaaaaatatttatttttactctcgaataaagctaagtttgaacataagattcggtgagaatgtaatttttttcatgatttttcacgagttttcaatacttaactcgttttcacggcatatgtcctcaaaatttagaatcaacaattaacaacttgttactgctacgggttatcttttggtaccaatataattaggtgtactactttatgtttgatgtactattccgctgcacgtcgtcatgttgacactttcactacagtagatagataatcatatcttcttcctcttctttttttttaaaaaaaaatcattttccttcttaaacaacacagcatgaactgcaggctgtagatgcgtgccgccctgtgcttgatgatatggttgcgtgttcgtatatgtgttacgtgtaattaaggttgcaaaatataaactaaatagagatatagccgaccgacaaggtgtatatacacttgaataattagatggtcactgcaggcaagcaattagatcgcagaggcacatcaggggaggtattaggcaactaaccatgttcaaggattgtagttggaagctccagtaccagccatcgctattgtcatttttgtcatacaataagcacttccaattatgaagcattaattagcggtcagcagtttaagccatcgatttaatatgaattctgcagggttttatagaattctgtgaaattctaatcagaaaggaattgagtgttttcaaggaaaacatacgcctgtaatttgcaggctcatgcatgaaatccaacatacggattttatcaggtgatgagaatttggagaaagataaagctggataaacgaagagggtgattaagaaacgacagacagctaagcattcttttgtttcttcttcagaaaacagatgggcattgtcacactacagtagctgtatgtagcagtctaatttgatacaatgaatgggtagcggtgcaatgttcagctaaaatttgagattaaattcaaccttatttttagcgaggaaattcaaattaaaagaaaaaaaaactaaacctttagatgtcatcttataactcaagaaaacttacaactcaatttgtcaagcattcaactcagatgttccagttctcatttaaaaatagcgtatcccacgattcaagttttttttaacaaatccaaagcgttatagtcgagataggaagctttcacttttgatggaaaaaaaatccaattcggcagttacaaatcggttaattacttatttagtggtaatttcgaacttctattgttttaatttttaagaaatgagaaaacagctagtagcagctatcgagaacttgttttatttcttcttcagaaaacggatgggcattgtcagactacagtataggatggggaaatctaatcccttgtttttcagatgatgggtcctccctggagtgtgggaaagggttgcagtacaaattttaggttaaattcaactatttaaaaaataaaccttgtgatgtcagcttatatctcaaaacagaacttatgactctatcaaatttgtcaaacactcaactcaagagatgagctttcatcgaaaatatagtaccatatgcctcgatttcttacaatgtccaatgcgttatagtcgagacaggaaaataaaacaacttaccattcgacagctacagatgggttaatcaatttgtttcctggtaatttcgcaaataaccgccttatcttctagaaatgcaaagagtttgtcgcggggagaaaagggttggggggcctttcttcctgggttcagttcagtagacttgccgtttaagttcttcagacttgacnnnnnnnnnnnnnnnnnnnnngcagaagctttaataatgcttggagccagcaacagcaaagaaagggaaatccatccattaaaaatgacattgcaaccaaccaaaaccaacaatggactacttccatccagaccctctcaagattcttgtactccctccatttcaaaatgtttgacaccgttgactttttaggacatgtttgaccgttcatcttattaaaaaattttgtgaaatatgtaaaactgtatgtgtacatgaaagtatatttaacaatggatcaaatgatataaaaagaataaataattacttaaattttttgaataggacgaatggtcaaacacgtgctaaaaagtcaatggtgtcaaacattttgaaacggagagagtactgcatcattttcaggagttgtattgtaattctgacaattagaggatagttgtagatttattataataagggtgattagttctctgtagaatataccatttgcagaaatggtctcgaacgactgcaggagccaataggaacttaacaaagaaaattaagaatgaaaataagattcttttttttttgagagagaagttgctagtacaacaatctgcagatttgagaaaaaggaagaaaagttttggatgggtttgcaaaatgcagagagagaagaaggaggaggaggaggaagagtttgtggcgaggaggcttccaaatcagtcgctatcatacatctccctcccttaaatctcatcaacccccccaaaatttgttactttcggagtatatttatttactagcgcgacagtgccaatttcgcggcatctactgcttctgctgctgcatgctcctcctcgtcgccggcgatctatctcgccgccctgcctccgccgagatcgacatccaggtacttacttgaaccctcctcttccctttcccggctataaagattcgtttttttttctctcgatctcctcgcacccctctcaactcgcccaaattcgccggcgtttcgtggaggtggcggcctggttggggcaaactccctccgtttatctttccaattccaattccaattcggtggatgcagcggcgatgatgctttgcggcggcgccttgattccgcgctcgacaatctactgtttttatagataagatcttcagtgagcgagatgccatccctgcagctgctgcagttgacggagcgtggccggggactcttggcctcaaggaggtaacaaaagtgcttcgcccaaaatactttcttcttcttcttcatcatccttttgctccaacctggaattttataagaagaacaaggaaaagaaacacattcttgtttgtgtgggaacaggaaaactcttgcggttgtttctggcgcgctgcttgccggaggagctttggcgtatgcacgctcaagccaaggccaacggagaaggcgttcagagggtgacgatgccaccactgcattggccaggaatggggacaggatgggccaaaatggtgtggatggtagattggccggaacaaagcgaagaaaaggtggcctcagatctcttcatttccttgctgccatcctactgaagaagattggaccaaatggcacccgctaccttcttggcttgacgttaactgcggtaatttctgccattctatgctgctgctgctgcactcatttctctatgtacattcttttttttatagaaaaaaagaagatcatgataagttcttatcagtagttcccacgaaataatttcaagcatcgaacaatttgtagtgcatagagaaaacattctatgatatgtaatagtacctaacactggattttcaaaagctatacataaccttattaactaaacaataatataaaatattattgtcagcattataacaatttcttttgcaggtgttacgtactgctgtgggacatagattagcaagagtccaaggctatttgtttagggcagcatttcttcggcgtgttccaacctttacacgcctaatcatcgaaaacctaatcttatgctttcttcaatccgccgtataccagacctcaaaatacttaacagggtctttgagtctgcgcttcaagaaaattttgacagatcttgtccatgctgattattttcaggtacattttggatcaatgttgattttttattggttgaattatttgttacttcccattgcacacatacctcacttgcattcatcccctgtaatatcctaagagtaccttcctagcttctgtctatcaatggaattattccagctggtatgcctgggaggactgtgtcgtacattgttataatggttgaagaactaaactagtgaccactgcagccaagataatagctgataaaactagagtttttcatgcaaagcatagctttgctatagaacataaatttaaaaaatatcctaaaagtgtagtgaactgggggttcaccatgctatatttatgtgccaacccttatttataagaatgtgtaatttcattcaacaatttcaatcattccgtagttgatagccaagggtgtattattaatactcggcggatatcatcaaccgtgctaatcttggtatggaaataatgtacaaacatgatgctcacaacttcctgatatgtcaaaaagagatgtcttttcctcactgagaaatccaaagaaccggaaaacttttaaatgatcctgttgaatttgacttcatattttaaagtactgactcctgaaactgaaattgttgattcatatgtttctcataccccatcgagaaaattgattttaccagtttctgcctgaggttatcttccctggattggttaagaaataactttctatttgttctagctggtttcggtattgaattatcatatttctcatttgtcagtgattttcctatgctattggattttgcaacaaattatagatatgttactaattacattgtcttgtcataattaagattgcgaggtttcttcatttttatatttatgtagttccagatcagattaatttattttttttgttaattattgtggaattacagtagactaacttgtgtgtgcatcttttaggatagaaattagcccatcttttgataatttacttaacgccttccattatgatatacaaccttaataaggtatatcactgcttcttttttgctgtatggacaattgcagaatatggtttactacaaaatttcacatgtggatcatcgaatatcaaacccagagcaaaggattgctagtgatattccaaagttctgttctgaactaagtgaacttgtacaggatgatctagctgcagttgcagaaggattaatatacacctggcgtctctgttcttatgcaagtccaaaatacatgctctggattgtggtaattttctaattgaaaagcttgattgccatttcatctagtaatgataccctttaacaattaggattagtgatcaaattatgctacattcctcttcttttcactgattctgtaatgtagatggccactgctttctcaccttgttatcttattagaatattagatattattaaaaataaatgcttttcagggatatatactagttgcgggtggagcaattagaaatttctcccctgctttcggaaagctgaaatccacagaacagcaactcgaaggagattatcgtcagcttcattcacgattaagaactcatgctgagagtgtggcattttatggtggtgagaacagagaagcatattatatcatgcagcgtttccaggctcttattgggcacctgaattgtgtactccatgaaaactggtggttcggcatgattcaagatttctttctgaagtattttggtgcaactgtagcagttgtcctcattattgaacctttcttctctggccacctcagacctgattcatccacacttggaagggctgaaatgttaagtaatcttcgataccacacaagcgtaatcatatcactgtttcagtctcttgggatcctatctataagcacaagacgtttaaatattctaaggtaaagccatatcttctgcacactactgataacatataggtccagttttgtcattgcaggcggcattttgcatgcagaaattagtgggtgctgtgtgcggcctaccaatctaattatctgaatctgttttaatgttttctgtaaatgcattttatcaattggcaagtcttatgctgctaactaaatacctatttgttgcaatgatttcagataaacatgttagttccaaacttgataatttgcaactgcacatcaatgcagaaataatgggcttgttcactttgttgccaaaatcaccattaccaaaatctggtaatgccaaattttagcattggatgtgtttggtttgatgcccttttcaaatttgaatgggtgtttttgtaaaaggaagctttcggaactaccaaattttggtaggatgacattggtaagcgcatgtttagttggttcccctaccaaaatttggtaacaccaaaattttgtagggttgaaagtggcgatatagacataaagtgaacaagcccaatcttattacaagctgcatgcacaaatgaactagttgtccagtgaagattctaccaactaaagaggtggtggtgggatgacagagtcaccaccatgactaggttctttaggcaggagagattttgtcacaaaccataaagatcataaaccagtcgccatttctcatgaagagcatttcacttcttggttgctattccaagtataactcatatatttgtctgtgtgtattgtttcggtggaatataagtatacatgtttcctgttcctaatatattttacatatctttgccctttttaatatttcattgttctgttgaaatcacacaatttatgacattgtatgctgttcatggggcaaacttaatggtgacctttaccaccatgggttgcatttgctatctttgaattactcattttcttccaacatgattgtgacgcaaatgaacttccactattttttttcagtggctatgcagaccgcattcgtgagttactggatgtttcacgtgaactgtctggggttcgtgataaatcgttaaatcataattcctctgctggaaattatatcagtgaagcaaaccatatcgaattctcgggtgttaaggtaataactgcataaactgaaggagggtcatagtcgctatctacttccaaagttctcatatcaggtccttgcaggtggtgacgcctgctagcaatgtcttggttgatgatttaactctccgagtagaaaggggttctaatcttttgatcactggtaatcctcccctatcaaatgaatttggtttagcaacttttaacttttgtgatgtaagctgcacttaacattaaattgattgaaatttgaccttctaaacaggagaagattgggaatatatgtaccagtgcatctgtgcatgtatatttcctttatattttgtatatcatcctaaatcatctgctgttatttgattacgtggttatgaaatagtatgtgtcatgagatggtagttgctatatccacgtctactctagcctctgttgataccactatgcaattgtgaactgttcccatgattgcctgtgccttccctcccaacacatcaaatatgtaaagtgattctgttattatttccattcttactttgtatttatctattctattttcaattcactatctgtgctcttagggcataaacaatagtttcaaaatcgtaggttctacagtagtaattgaaaagtcttgttgatgtcagaaattttctaaaagaaaaccaataaaaaaatactggcccaaggttaactacagcatcatattgcaagttctgtgattacattaacaaaaaattgctgctgtctcgaaaggcactcatttgctagtcatattagttaccagaggtgctactaccaagttgaaaccattactgcttttgaatggcatgctccaaatttaccgcttaaaattgttggattatcttattttgcatgttgtgttacagatatttcaagtttgatacatctttgcatgatatgataacaaacttaatcgtccattgacttctcttatttcaggtccgaatggtagcggaaaaagttctctttttcgggtccttggaggcttatggccattagtttctggtcatattgtcaaaccgggtgttggctctgatcttaataaggaaattttctatgtcccgcaaagaccatacacagctgttggtacacttcgtgaacagctaatttatcctcttacagcagatcaggagattgaaccccttagctacgatggcatggtggaccttctaaagaatgtaagtaataggattcatattgatactcaattgccatttatattatgctttattgatctactactgagtacagggacctgctggattgtaaccttgctccttatgcaggttgacttggaatacttgctagaacgctatcctcttgataaggaagttaactggggtgatgaattgtcccttggtgagcaacaaagattaggaatggcaaggttattctaccataaaccaaagttcgccatccttgatgagtgtactagcgctgtgacaattgatatggaagaacgcttttgcaaaaaggttcgagcaatgggaacatcatgcataacgatatctcatcgcccagctttagttgcgtttcatgacattgttttgtctttggatggtgaaggagggtgggatgtccagcacagaaggttgtaaccctgaaataactcactgaatgtttacactctaaagttaattcggtagaaatttaattttgctcatgattttgcagggatgactcatccttttctactgaagagtctgactatacattattggaaactgatcgtaaatctgatgcgcttactgttcaaagggcatttatgggcagggcaaaggtatatgatttctgaacatttcttacttcatattcttttgttaataactaatattgtctgtgccgctgttttatgtgtttttttccatactagagcaatgcttcatcaaggtccaaagaacattgctacactacaaaggttatagcaacttctcccaagttggaaatagaacaaacaatacaaacacatagagtcccgcatttacggtgcttcccaaggcctctgcctgccagagtagctgcaatggtcaaaatattggtatgctatgttctgtttggtacttcgctagttttctctcgttgttattcctcaacaagtcaatattcagataatacggtaccctagttactgcagatattattgctaggtaatacttggttgctcctgtctgcaagttaatgtatatctgcagatgctagaaatttttgtttcttagtatactaatgtaagtatatacttatggaacttgacaattccttaatccttatttgccactggaatttccatgcaatctcttatgtgcccctgatgtctcactgatatctgtccctggacccacatgtcattgaaagaacaaggggcaaataagggaatgggtaaactttcaggggcaaataaggaatttatctgggtaaacctggacatatatctaaccaagcatatggatttatctcatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 37444 - DNA, 592 bp, Oryza sativa
  unsure (1)..(592): unsure at all n locations
ttatgtatctttcgttgagtttcaggtgtatgccactgcattgttttgactaactgaaaaagtcggaactgctactgaattttcaatgttcaaaaattagggtaacttgcatcattcaccgtaataacaggctgttttcgaaatgatgcacagatggaacaaaaagaaaaatatatcaagagccttcctcatttgataaatgatgaacttctatgtgcaaaacgcactcaccaagtcaacgtaacaagcatctgacataagatttagataagctcggcatctctctcttttcataattaaagtacttaaatattggaactctagaaagtgttcctaaaaaaataattttgacggtggtcaatcaactcaagtaaaaccaaaagaatgcacaagtgtgagatatataccacccaaaatggatggaacatgcgaaagaacactgacataatattgcatatttcacacaaaaaggcctagttaccttactaaactttacgtgagattctatataaaatctcgaactattaaaccgggcatcaactcccctnnnnnnnnnnnnnnnnnnnnnnnnnnnnnnnnnnnnnnnnnnnnn

SEQ ID NO: 37445 - DNA, 23897 bp, Oryza sativa
ctcctttcttttcttcagacccacaggattagtagtagccacaatggtgccaataagttatgtcatgttcttcatgaccttaataactgataggcagttgctgctttgactcgcagcaattttttttcttttttatgaggcgtggattgtgcactaaactagtcgaaattgttaattagttttcgagccatgtgatttacaccgatcctctgagtaggtttgatgtttttttaatcatataggttctttaatatatatgtgtgtgtatgaaaattgcttacttaggcttccataatcgccgaactgtcccgtttgtttatggcctctgaactaccgaaatcgcggtgattgagataaacgcgtgaatatgcagcgttcggtgtcatgcaattacggctggaatacgaccataaacgaactcgagctggcatttaatatagtcaattacaaaggggtttgcagttggaaccgatgaatacaggtcacatacgaagggcctttgttcacaatccaagccgaaattcgtacagaatggtgaatgccgctttcaccttttttttaataattattttcagggtttctttgctgatcttttttacatacagggaaaaggtaaggatcacttctttctacgttcaaaagattccgtgtgagaccctgtgccaaaatattagtagaaataatatgcgccatgttgttggcttaatactatatcataaaaaggggttttggaacaagtccatcactacaaaatttatacagagaaggatttctctctatttccactaataaaaattgataaatgtcatataagtaatactctccccatcccatattgatgatcatataatcaaaaatacaaaaaattctaaaatgaccctcatataaccattgtctcttcgttaatattattgcatctacgaatgcaaattgagcatgcatgcatgtatgtctttcaaggcaattaagcgcacatttgttatgcatatggggagttacagtctttaaagtctacctgtttcttgatactccaccacatactcgcactaaataaaatgcatggtagttaagtcttcgtttgtctaggtgaaaaaaagttatagagtaaatttcataaagctataaatttaaagtgttgtatcataaaactacggatttagtgttaaatttatcatgaaattataggtttaattagtactatcaatttaatcacaaaactataatgtttatggctctaacaccatggtagtgttagggatttgaaccctaaaatatgtagttttgtgataatttttatatcaaatatgtagttatgtgatacttgaccttaaatctatagatttctaataaatttgacactaaatatgtagttttgggatataatgttttaaatatgtagttttgtgatagcttggtcaacatatctatagttttgtaaaacttactcatataatgatcaatatagaacgaaaggagtatatcattagtataggagtcaacggccggagagaaaaagggaattaagaagacggttagggtgatgaagctataagagcatccgtaatggtaaagtaaggtgctctctataaaacttgtacaacttagcaatagactagattaatagtaaaccacctcaatagtatgtctacatgggtatctatagctctctaatgcattgcctcgtttttctctatagactatctccaggttagtagatagatttgctctctctcttcatttaatctcttccaagtaggaaaatctgctgacatggatctctggtagagagcctatagataaccattacgggtgtcctaataaaaggagcatgacttgcgttttttaatcaacttgcttacagtatttactatgcgatgtgatcgctaggatgatattgtaagtacttgttattaggggtttcaaattgttatatatatatatatatatatatataatctgaaattaatctgtgactaaagtaaagttggtctgcaatgactttttaatatatgtataaaaaatccccttgtttgaattgagtctaaaacttcatggagaaatctgttgatgtgcttattctcgatctctctcttcacatatcttaacattttatacagggtaatactaatatactataacgattctacagtcactcgtagatgccagcgatatactcaagaatttcctaaagtctgagggattaggccccttttattcatacgaatgaaaaaacgagaaaatagaaaaaaaaatacaaaggattccgatagaaatataagtttaaaacggattactgtaaaagaaaaagaaaaacacatgaataattatttgattggatcgcagaaaaaatatagcaattaaatgagagagatagacttaaaagtaatttctctaggaggtcggccctctggctaattttcctctaaaatctatatgtaatgaaccattttataggaatgtataggatttggaaaaatccaatcatttgaatcaaatgactacatagaaaaaaattctataggatttttatcctatgaaattttttatataaattctttgattcaaaggaacctaagaagatggccccatgatcgactattagcattgttaatcgtcaatgacatagcatacctataaacactgacaaaccaacgagtttggacggctccccatagtcattgagctcaagatccaccactgaatcatgcactctcagctactcgtggtcaaaaaaacgacgcaaagactgatgcaatgttctgattagttgagctacggttgataagtcctaagaaaaagcaaaacaagaaaagaatatttttcagtacaacttttatatttgtattattaacgatttaaaaactaagactgaaaaataagctatactgaaaaaaaaaatactcaataccgtttctaaattatgttacaaaatttaaatttttctttaactgataagtcagcaagaagataataatagcctttgtagttttgtgaattgtctgtaacaagtaggggtgaaaacggtacgaaaactttccggattccgaacctattttcgaaaacggaatctgtcggtcgaaatttttcggaaacgaaaacgaattcaaaaatattttctcggaaacggaatcgaaaatgataagggcagtttccgtcggaacccgaaatcggtcggaaactttccggaaattttctcggaatttccagaaatcacaaaatacccttgattctttttttaagcactgaatagtgaataccatggtgtttggctgttattttcttaaaaatatttgttacgcaaatctaaaattacataagaatattttttcctacattgggatttatcaacagcattactaatttattctatagattgtgtttcatgatgtactatttatacttagcaattggacttatatgattgtgttttacgatgaattgttaaccgttgagacttgagaattggatttatctgtttgaggaggttttttttattccgataaattttcgttaccgtattcgcgccggttcgttttcgctccgttttcggtttcgataatattcgattctgttttcgtatccgggatttccgattccgattctgattttgaaaaaaatataaaaataaaaacgattacgttttcgtaccgttttcacccctagtaacaagcagtacttcgcagtagacaaaactatacactttcaaatggttacagctaaaagtttagttttataaacttttatagagctaccaaaagtttttagtagtagcctctttgacactttcgaaagataaagtgcagttttgtaaaagctatagtactaaattttttttaaaaaacagccctttcggcgatagtagctcggcgcgcctgacgccttgtggcaatagagagaagtgcggccgttttcgtcggtcaacaaaaggacggcacaagtttcctgcttgaacaaaacaagcttcaaagaatcaatcgtgtatattgtacaaatttcctgtaacacgtcttacacaccggactccgtcaccagtgtgaggccgacacgcgggcccggcatgtcagcctcagaccactgactgtcgccacacacaaaccaaccaatcaaactctcctccatcgttttttacttttctttctccctccaacctttcaaactattactgttactgctactactctaacccgttgaatagttcaccggttctaacctgatctaccaaccccctccctcccaaaaagaaaacaaaaaaaatcaactctttcaatcaaagcattgacaaatgaagcgaggaagaggaagaggaagaaggaagaaggagaaaagccaaaggtagaatctttgggcaaaagtttcccgcgtgttgaatggttgaacggttcaatggatggattcagaggaggcggacggagccgcgccgccgctcctcgtaccagcagacgcagctgagcgcgacgagcacctcgacgagcgccgcctcggccttctccttgtccgcccaccggagcgtctgcagcgcgtacacccgcgccccgccgtcgaaccgccgcgtccggtccatgttccgctccgcctgccactgcaccgtgtcgcgcgccatcggccccagccacgccatgatccggtccaccgcgtccttccacccctgcgccagcccggcgtccagcggccccgggtcccgccaccagtcgcgcagcttggaccgcaccgccgccctgagcttcgccggcagcatctcgtacatctcggcgcgctccgcgttcgcttcctcctgccgcccctcggcctccatctgcagcagctgctccgcggacacgatcacgttcgcgtactgctggtccagccccgcgccgcccaccgtgctggccggcgcgtccaggagcttgcgccagtcgatggcggccttctgcccggacggcctcagcccgatgatcgggcacgagctgctgatcaccggcgggtggactcgcgacggcccgtctcgccgcgtgatcggcccggacgacgccttcgccctgaccgcccgcgggttgagcagcttggacagccttgtctggacgctgtcggtggcggccgacggcagcggcggcgggaggccggggacgaacgcgccgaagatggtacagatgcggctgaacacggcgcacgcggcgcgcgccatgaggccgacggccttctcgtagctctggttccagagggactcctccttgaggcgacgcaccttgatcctctgcgccttgagatcctgctggagcgagtcggcgccgggggaatcgccggcggccgacggggccaccggctgcatcgggatcggcccgctcaggcggttccacccgcggaacgcgagcttccgctcgctggcctccagctcgtcgagcgcctccatttcggagcacagcctggccgtggacgcgacgagccgctccatcttcttggccttcaccctgaggcccttggcgacgagcgggtcgagcctcgcgtcgggcgccccggccttgaggctcgcgtacacgccgccgaagtcgatcccgcacctcagcccgagccgcgcgacggcggccgcggcggcgtccagcgacacgacgagctcggcgcaggccagcctgaggaggaacgcctggtcggtggagttgaggtacgcgacgccgggcgaccgcatcgtgtcggaccggagcctggacacctcctgctccgacagcgaccggtgcagcgacagcagcttcgacatcgccgccgcggcctcgaacgcgaggatcccaagcgctgcctgtggccccgacggcagccggagatccacgggcatccacatcttctgcacaaccatcaatacttctctccaaatctcgcaacaacacagagcatggagcgatcgatcgagctaagcttctttttcttctcctctctctctctctctctctcgttaaggcgtcgacctcgttgaatcgatcagatcacctcagcacatcgacgcgacgcggttgcaggtacgggtttcggttgggctggtatggtggcaatctctttatatatagcacgagttattctcacttctcttgccggagggaaggtgatgctaagccagcacaggagaagtaaataaaagagacagtaaaacaatatacaatatactactactcccccgtccactagtagaaggggtttttacattttacttacactgtttcaccattcgtcttattaaaaaaataaattattatttattttatttgtgatttacttcattatctaaaatattttaagcacaacttttcgttttttatatttgcacaattttattaaatataagacgagtggtcaaacgctaaaaaaaaatattccctccgttttaaaatgtaagactttctaacattactcacatatatatatatatatatatatatatatatatatatatatatatatatatatataaaatagaaagttttatactgtgaaacatagaaaagcagtgaatatccggatggaggtagtactactttatttggttggtgatggcgacgcgacggtgttgggtgtgggggagagacacggtcgcctccccgggtgagaatgcgaggccaaaacggtaggcggatgctgcttaccggaagacgtagtaccacgacgcaaccgtcatcgtctgtagagagcgcgtgtgttgattccggtgtgggacacgctctctcgcctcgtttaatctaatctatgcgagaattttggccttgccttggctacttggctccggattagtccgaggatgtggcgagatcagctgcttaatctaactggctttgagagtgattatctgcgcatcccgtcgttgacagagaggattcaggtccggaatttaccaagagctttttagccttttactgtcgggagcttaaacggacgtaattttcgttgaccttagttaaggtgaggcgttttcgctacgtagtcacgggacagaatgcgtgttgatcggtgtttcttcattaatgaagctatagctattagtcctgaaagaaaaatgaagctacgcatatggctgcattttcagatagtattgcccatcctttctgcaaaaatgtctgaaagaactagctagcacatggccggagtcagcattcagtggcttgtgtacaaggcagcggcaacatgcatatgcatgtgttacttcagaattaagaaactgcatatgaactagtaacatgttgtatcttggtttgtatatattgacaattagtacgggtttctggaactgtcgctactttatctcaattcccatactctagcagaactagataattaaactttcaggaattaattacaagtgcatgattaagagatcaaatttatattgaactcaagtactcccctctgtccaaattatgctccaaaggaatatatgtaagccaaaaaaatcgttatcttttgttttcctttctgacacagcttccctttcctttagctaaattatggattataactttgtaaatgttcatcaagttctcgagcgacatatgctaagcagtgttctacgaaggattctttcacaacgaaggtttcttttacgagatttgctaccgtccagtgcttggtacccaagatacctgtatcaccgggcactgaaacaaatccaactatctattgttacaacgtaggattcgtaattagtaaaaggtcacttccaatactaaaacggtcatgcacgccccaatcttgttccttggcgccgctgcattcatattttcgtttgcgtccaatttttcctccctctgccaccactgtccatctgcgtcttcgcatgatcaacagtggtaccggcatgacagcgctacggaacaaggtcgcgcacagcgcaatcttcctcgcgcctgttttttcctccctttcccgccacttttcatccatctttgccggaccgatggtgccaccggcatgacagttaacaaatctacgaacacctcgctgcagcatccgccaacgcccagctgcaaccgccactgccacatcaccaacgccccaactacgacctttcttcgccacatcgcctaattcgaggatgcgacgaccaccgcactatcacatcagtgttgatgaaaaaacacacactgtcctgtaagatctgcttaactcctgtgcaggtccaaaatattgcttttaggtctgtgagcatgccagttaatttgatcctgcaatcaacaagaataaagacaagaaaacagcagttaaatctataaatgatagccaatcggttagttgccgatgacatatcatttatcttcgagccgatgtcatgttggaatcgatcggcaataatgaatgaataatataaaaactaaatctactcgatcggctgtagatattaacaacatataatctttacttcgatacatatttaaactaactgattaggatagatcggtcggcatgccgagacggtataaatcaaggggcagaatcaggcatggggcagctagggcttgagccacatgcctagccccataatccccattataatcttgaaaaatgctatgtaatttatgaaaatatttgagatcccattagctcagccctaggtgtggaaattttctggctccgccactgagtcgaaatatatactaaagtactgattatatagacgtttgtagcatagccgatcagatagatctagtatgtatcggctaatactccgataccactctatactaagatattgaaacaagcaagatatgtcaaacaagaatgcttaatatacttttgatgcaataagatcttaatataaagggcagatttagcataatagacgagcatacgagataatgatagctaaattagataagatcgattgaaactccgatactatctctattgataatcataaaatagggtagacatcataattaaggatattacttaatagatcgaactcaaccgatgcagcattaagcataaagataagtatgagatctaaacaagatgattagaatctctaagagatgatagatacatgatataatctagattaataatgagatctaactctatcggctactttctaacagtaaaaaccagccgatggaaagttatataacgaaactaacaaagattataaagtatatatgataactcgacgaattacataaacaagattagagtcataaggatggaagcactaatcctgagaacgcaaaccgccatgacaagtttacctctagttgaagatcgaatcgatgcagctcaacccgaaagcaagaactcgtcgaaatagaacgaaagtaaaaagggtggcgatgcgccgaaagtgttgttgaactgatgttaatgattacattgggtacgggccatatttatacccgagatacaaaatatgtccttaccggacacgacttttatctctaacaaactttaagataccataagtctttacgacagacttttgcccaaacatatctctaaggaaattacacaaaacatcctaattattagatacaattgcctttctgagagctttatctccatcgtggcaatccttgtgaagcacgttgatcaattctagaaacaacctcggagccatcctcatcggaatcggctataccagctctatcggctgtattagccatcctctgtccgatccatcttagccgatgcatactccaggcgataccttcgcagccgatgcatactctgttcttcgaatctaactttttgccgaatccgcttcgattccaatgccgaacctggttcatatcttaccaaatttggtcgttaacaatcagccgaccaatcgccgccaccacatcatcagactagaacagactgttgatggggttcaagatatggatcggaatgactaagcaacacactcatgcaaaaatacagtattgcccctttcacctctctcacaattgcccgtaccaccacatcagcaaagaaaaaggtactaggaggtgctgtatcttgcaaaccgtccgatcgggtagaatcaagggcccagatatgatattgggcccttgatgaaaatggtccgcgtaaagaaaatctctagcctctgccaaaaatacacacaactaatgagttgtaaaagttaaatatataaaaaggacttgaggttatgggatgaaatctcatcttatgtcatctgatgataagcagttgaaacattgaattaatagaactcacatgaattctacaacctacatcctcaatgtttggacaaaaaattttggccaaaaacgtcacatcaaatatttggacacatgcatagggcattaaatgtgaaaaaaaaaatccaattgcatggtttgcatgtaaattgtgagacgaatcttttgagcctaattacgtcatgatttgacaatgtgatgctacagtaaacatttggtaatgacgaattaattagacttaataaattcgtctcgcagtttacatgtggaatctgtaatttattttattattagtctatgtttaatacttttaatgtacgtctgtatacttcaaaaaagtgatggtagtacttactaagagtaactactaatttatctgttctaaaatataaaaatttaaacacgggtattaagaaagtagataaaattaaatatgtgaagactgtgataattggttgagaagaaaaggtaagtaagaaaattaaaatgtgcaatgttgtgattcgttgagacaaatgttaaagaataggaagttgttatattttgtggcaggagagtactatcttctcacgacaacaatatcgtgtgcccttaatgaacaataacactgccaataatagaggttgaaactcttcacaaagtttacaaacaaaaagaaaatacagaacaattcaccttggaaaagggagagatcgtcgttgaattatgagaggtttcttggttcggtttgttttttcggacggagtctttggcactttggctgccttggtccatgcacttctgttcttggcagagtgttctacgatctacagtatagttagttcagagctcatgtcgggccatgatcctgtgtcgacgagccaaaggggcctatttctatgttatcgcatgtttatcttctactcgctccgtttcaggttacaaacgttttgacttactctaagtttgactattttttaaagaaaaaagtagtactatttttaacccaagataaatatattataaaaatttatttaattataaatttaatgaaactatgtcggtgttgtaaatattactatttttttctacagagttagtcaaacttagagtagtttgattttgactaaagtcaaaacgtcttgtaacatgaaatggagggagtattgttttgcatggctatgtcgcatgtttatcttctattgttttacatggctatagtaagttacttttcactattttttattaccacgatcaacaaatttattacaataaaaacatcgtttcataattgaacttaattttttcatatgaacacgaattttgaaaaaaattatatggaaactatagctctcaacgagatctataattttacatgtgacaactttttatttaaatattttagatactcaaagcatgattcaaatctcagttaggtaggctcaaatgaaaatatatgtatttttgtaatataattgatgcatggataagttagtaaacgcgagcgtgtcttgggtttaaatcctaaccatgacaagatataaaaagaactagttaggatgatagtttaatatttaaacttttaatttggtatttgtataactaatgctgcacatgaagtggtagcaataattatatattacaacgatgtgaagtgttgtaatatgatttttttgtcatatctaatttgtggcaatatcgaaatttgttgccactaaataaaaatcgttgcataacttattaccgctatatttattacatcggctatcaataattttaaaatgacagcaacatttatctatcaccatgattttagcattgatgccacgatttttttatggtaacaaatcattttggtagttgtgattttagaatggagatagtaataaatatatttccctttccaaacaatattgtaatggttgtgtgcaataatttttattctaaaatggttatattcgcaatcaaagggattatttcttcccatctcatagccaccccaatcaaacaacaatacacgcgtgataataaacaatgttggaattgggtaattgaacaacgaaggctgaagcttgaacatcaggggctgtttggatgggactaaagatttttagtccctgttacatcggatatttggacactaattacaagtattaaacgtatactattgacaaaactcattctacaaccttggactaattcgcgagacggatctattgagcctaattagtcaacgattagcctatgtgatgctatagtaaacatgtgctaattatagattaattaggcttaaaaaaatatcatgtgaattagctctcatttatataattagttttataagtagtatatatttaatactccaaattaatgtcaaacatgtccctatatccaaatcaatgaatagtctatccatacgacaaatgacaagtgtcgcatccaaaaatcgtcgaaaatttcctcggatccccactgcagggtccatgcttcattgatttgacccgacttttatactcggaaccattgcgtggaggctctcgagagaagggaaagagaaagactggttactgatgacaactttggaagctgccggtactgagcttgacgcgcatcgcatggccggccgctggctttggctcgaccggtcgtacggcctgggtcactctcactcactgtcaaacccgaatacgtgtggggccctttcggccgggtcgtatccggatatggctttcactttgcactttccatctactgcggccagtcaggccagatacccaaatcggttactgctagttgtttacatctatcgacgtagatgacacttcatgagtcctataatcaactcctcccgtacaaaatttgaccggcgttccagtgctcgagttacctggacatttcagcgaatcgatcgacacatggtaatgcaatactctctaccagcactaaccgaggcaaaaaccgaattaaatttaaaaatatattctcacttttacacaagcattacacgaaaatgatgtggacatgacaacgcggacggtctcacacgacaacggcacgagatcgtgtggtgttgcacgataaaacggtgaccgcgtggcctcgcacgacgaaataggtgagaccgaatggatgtggccgattcaaattgtttaattatcatgatcacttactgtgataattaatcactaattaagcggcagctcaaaagctgttcgctctcgctcattccttgtgcaagacagttcggtctcgctgtttggttgcacgagactgcgcggtctcacattgtcgttccacaacactgcggggtctcgcaccgtcgccgcgcgagaccgcccacatcattttcgtaataattatgcaagacctacggtatatttctgttaaaaaaaattacttcctaaatatttttgagaaaaaacaaatcaacagtatatttttaaatttaattcggcaaaaacctgcgtttccgcaagtccacggcccacatgatacaatggccaccatgatactaatgatcaggtcgtcgtgattgacttaaagtacatcatgacacgacaagacgaacgtacatatgcatgcatgacatgacaaacatttgcgcgtaccgtgcaaggacccccaacaacaacagcgacggaccctctagtaaacggagtcgcgatcaaccacgggacagatgcacgcactcgttttctcgtacgttgatcatcagacagagaggcgacgtccacagtttctcctcctctcggcgcgtctacgggatttttttgttttcttttacagcttctggggacacgcaaaaacgagtgatgatttgtgtcagatcgatccttccgtggcaatttcaggtcagagacgcgagtccgcccatgttcagacggtgagagggacgtcgccgcacgtaagtactccctccgtcttaaaaaaaaaaaaaccatagattcccgtggtaacgtttaaccgtctgtcttatatgaaattttttataattagtatttttattgttgtttaataataaaacatgattaatactttatgcgtgacttatctttttaatttttttcataactttttcaaataaaacgaacggtcaaatattgaacacgaaaatcagggtctgtcttttatttggagggagagggtaggcgcacatcacgggatctggggaggagtgggtaccaaatccacaagtcaccgaacgggaaagcgggctcccctccaaatcggttaaaattacggaaaggcgagtcaagaggctgcaggtagagacagaatacaggcgagaatttccggcagattcgccgcgccaagcttacgaccccgtatggtggcttcgttttcgcgctgggtttactggtagctatagctgcttgtgtggctcccgttcagtccgcttttgaggtttgatcaacgtagacccgagctgggactgtgaacgccgtaaaacttattgtttctgtttctgaaccgtagactgatggcagaggccagtgtagactctcgacctgtacgccgacggcagaggactaattctcaggtaagtaacagttgggccaacgtatcgaaaaatgatactaggttttagtaaaaatgaattctttcgatgatttggaagcagtttcgctaagcagaatcgaatcgtatgcgataccacttgatagcaatgtgagaccagttcgtttcgtttgacccgtaccggcccagtttaaagcccataactacccctcatgggcgtaagttgggataaagtccgacttgcctcctcaactccaatgtgattcgcatacctcaaaagtcaaaaccacaaaaccacaaaaccagatcaattaacctcactcggttgtttaggctgtgattccgtcctacgtgacattacagtagttctgtctaacctgacacgttgacttggtccacccatactaatattgctcttaaatggcaattatagccacatgaaaaaaaaagagaatagtggatcagccagtgagttctacctcgagacggccatcgctggcgagctccaagatatcgcccacatgaaactcgagcttagtgaaggtgggcatcgggatgtgccgacaacggcacacatggaacgggccttcctcacgcaggggaagcatgtaggtggccataattcctttctcgcatcagcaaggttaacgaaggagggggcggtggagccagaggtgggggcaatatgatagcggcagtggtatcccctcaaatcctcatatttgcttccaaggcgattagcaaagaagccttggcgtcgaacaaagacaaggagagagatgaggcactgagttgcagagaaggcgacaacctcggattcagctgccgattggctacggtgacaacccacggtgcagatctagctcatcgcctggaggggaactgtcgggtctcaaaactaatgattcggtaaccgacatgtttagactgtatcaagccctggatcagtagattgatacaggttcaacaatctgaatcttcattgcatacatttgaacaaggttccaaaggagatattattataaaatacatgggtatttacaaacttgtagctatctaatacaacagaagctatagaataaatcaactctaatgttttgctatagagttaaaccatctaacaatactagacttcaagactaggtttaaagtgaactaacttatgtgattgaactcccggcttcgataagaactccaaatggactctgaaaaaggtgaggttgaagcaagggtgagtacaacgtactcagcaagctattatattcaatatgaatgtatgaaatagcagtatttgagtagggctagatttacttgcagaaagcagagaatgtagaagaagaaagcttgtaatgactttaatgcaacaatatttagtaaaatctcgaattaggtttctaaccaaataccatatgaatctcggtactcaattccgtgagcacggctattcgaatagtttgatgaatatcctactgcagtagatgtacgctttacccgcagtccacgacttgccaatattcattagcttagtcatggcccagtattaggttattaacaattgtggtacctgttccatgaacttatatcctcatgcgctctgaacgtgacgttaactgcagcgagaggagttctggcgttaccggggtctttagagaggactgattgtatgacaccatgtcatcgcaatcagggttcacaaacgtgatcacaatatatctcaaatacatatttacctgtgcctcggtaaatatcacaattgccctactcggcgtaaatttgcctcctacacgaggactttaaaatagaaccactgtacagaggtaccacattgctaattaacataatagctaggtttgtccctattctagaagctgcggtcgtactcgttcgtttgacataagtatttggtataaacttatatcgactgagacagtactagccacccggaaatcaaccatttctaccgtactgtcccaatctaagttcattaaattttatgcataatctaactaggcagggctaagcaaaagctagcatatctggtttgctatatgttcaggttatgcattgaaaatcatgaatggctaatgcatgagatatcagagatatagaatacagggcatttatgctcaaaggagatgaataataacttgccttgctccaacgcaaataaatccgagataggcaacctgattatccgattctcgaaataccaaaggttgccatccaaaataaaatagactctactaagaaagacgaagaaccaatttcaataaaatccatagaatagcaagaaagagataaacagttaggagggctagggtttagggtatagtctatctcttttatagggtatatggattactgtgctaatatcttatgcggaggttctagagagttggaggctagaggggattaagcaactactatcgcttatatttcatatgtgggtttgattagtaggaggatgggaagtaactagtttggataatggtattggttaaaagggtatgtggttggtattcattggcggtagctaggtttaggtcgtatggaaactaaggtctagttgtcctcgagtcgatactgaaataggatagcatatcagctcggctctataattttatgtgtaggttctggtaggtggagagtaggtggtggagagtatggtggataggcgatactggtgggtgtggaatttggatgacaactggaatttgactgggaaggtattagttagggtttggttatatgctagtcaatgctagagcataacgactagatttggtaccttctctagccggtgtcaaccgacaacatattggctagaggaataggaggttggtgtaggtttggtggggcggaagtgttactccgacaaccgtgggtggcggcggagcggctaggattacacagagctcgagagctaactgtgcggcgtgctgtggaggtcgagggaatagtgaagctccgactgttatacgcgtcgaggcgtagggtgccaggagcagcactttgaccttgggtttgggttctgccgggctttacaaccaacggttcaacgtcggggccagtagatcgcgcgaacgtccccatgaaaggcgtaaatttttaaccgggcggcttttaagtggctatagggtattttggagtaaaaaggaaatatttgaaagtcaaatataaattcaaatggcatgaaggaatttcaaataaaatagtaaaatagcaaatttgatatcaaaatgtagcttttgaatttagatgaatttaggtccatgtttcattggaatcggatctacggtttaggagatatgggcttctaaagattagatttgaaatcaaatctagaaaatgtgaaataatactgtaggggcccacctgtcagttcccttttctttttttcttctctctttcttcttccttcttcttcctcccgttctcttcttcttttctgttgccgagtgagttgagaggagggagagaaggggcgccggctctccggtggatggaagactgtgactccggcggcaaaacgcgttcccgagcaacgcgcacttagggagggtggttgccgatagagaaggttagggaggagaccggaacggcgacggcaagagcttgctccggcaacaaaggaggtggctatgatggttggtttcggaagggaaaaggaagggtaaactaggaaaatgagttcgcctcgtcgaggcaaacccgatggcgcaagggcttggccagaaacactccagtgagggagatcgacgatggccggtggtggtttgacatgagaagagagagagagagagactgagctcacggctcggttgtggaagaagagagggggcttcaccggctatttataggtgtcgagaggcggtagagtaggtcggttcggatggagaacaacgaaggatgcacggcaatggcgacgtggggaagagacgacggcgccggcttcgttctccaattggctgttagtggcggcgcgtacacgcggcgaccgcgggaggagttgggcagctgggaagggaggacacggcacggcgtcggcgcgacttggcggcgaaggaagggcagcggcgacggttgcttggcggaggaggagggcaaggcaccgcagcggcggcgcaagttggcggctcggctgggtgttgggccggcttggactgaggaaaggaaaagaaggaaagggagaattcggcccaaacgtagaaggaagaaagtctaatttttcctggggctgaataatttgatttagaggagaatttttatttggaaggaatttgaatagaagattttgaaaggaaaatatatttggagataatttgaatagggaaggttgaaaggaaattatatttggatctaatttccaaaagagatatttctaatttgagtgcaatatttttggaagtggaatatggtggaatttaatgcactcaaatgagaggggaattaacaatataattcctcaatatatatatatgtttggaggagaatggttggaggtaaaataaataggatttgaatcctaaatttgatagtagaagtatttgaagaattatttgtggctaatagggaaagttgagtgaagaatataaattggtattttcttagcacaagagcaattattcacaatatttgcaataatactattcttgtgccgaagaggaaatcaagccacaggaattaaatcagtggctagatcaaaaggaagaatttggatcaagaatcaaaggatgggtttaagatcaaaggatgggttaataattaattccaataaaattggaattactttggttaatttaggttcaagggaaaattgggaaggtttcttagaccataatccataaaaaaaatagaaagggttttcaaactaattttgaataaagaaattttagtcaaaggaaggttttaaattaaaaccaaatcaagaaacaccttaatttaaccaactatatttttaaatgaaaaacacaaaagagattaaataccagagaggttttgtgtgagttagttttaggagaccccactaattatattgtttaggaagttattaagaacataagactcagcatgatgcagaattagaaaatggttagttttcggtatgttacaggaacggtggggatcggaaccaatcttcgtctatggtgtcctgtatctagcacaaaagcgtcgttttaaactttcgatgtcacttacatataggcttactagttatttaattatttttatttgctgactataaatgtcacataatcaccacataaataccacgcgtgatgaatatcatgtcaatgtaccatctagttggcatgtaggatgaaaacaaccatctaaagcaccaagggaagtaattgactcgattttgacagttggaaggcctatatatgtgattttgtggttgagggatgtgaattagacgatgaaatagttgaggagaacagatggacatcgttccataatttggtgctattatataaaggagcaaatggcttgcgtgaagtccgttgcaattggtgagatgcataatgatggggaatttttttcggttttagattttttttaatatttacagaaataatctatcgaccaaaaaaattgcaaaaatagcccctgccgcccacctctggggtggcaagctgacgtggcaaacatgggaggaacgggcggtgatggagggagggttttttgcaggaaaacccttgccgccctctggtggggcggcaaggggcccgaatgcaaaaaagtcagtcggggccggctattttgcaggcggccccttgccgccctctggccgggcggcaggcctcgctgcctataaaaggcctgctgcccagcccccagccctcattcttctctcctcaattccagtgaaaaaaaaagaagagaggggaggagaagagaagaaggggcgaagccctgccggattcagacgccgatttcaggtaatattcatagatcctatatgtgactattgagttaaatagtgtgtattctttaaaaatttgtttgaataaatgcattatatttttagggttttagttgtactaatctagaagtgcgtattgtagatatcggtaactacgtagatctgctagtttggaattaatacattaccgttgcattggcttacacaagaagatattacgttgtagatgtttattgcatgaaagagtaatatgatctagttatttcgttgacagatatgtcgaacaaggaatattccaagttattaccatggaccaggaaacgtccgttacggggccaactggggtagatctgttagattttagtgtatcagaaaggggaattgatagaccggctgagaggagtgtaccttctataaaaggatggttaatgaggggcttgagagttgatccacagacaagtgacataacaatcaatgttatagtaagtcgggcaactgagggtttttattgggaactaatgccagttcaaaactcttgagtgtggagatggtatttggaaaatgcattgcaacgcgggtggcctctagctttggttccgtttgttcacccaaaggatccaggtgtgcagacgaacatggatgatggcgagggaccaagtgctaaagtaaacgagacttctgtggaggaggtcaacgcacgagaggacgggggcgtagtagctccagtgggcattcaaccaggtggagtagccgacgagggggagactgtcggtgccattgtggatgaaatggagagggacgattctgacaacgagcgtgtagaggaaggtgattcgtcagatgatgagacagatattaatccagcagaatgggctagtgaggatttttctgggctgatcgtctctgaagaggatagtgtgagatgggagtacaaagaaaatgaggttattcagggagcgatttatagtagagcagaagatatgaaggaggcggtaaaacattttgcaatgtcacttcatagagagttttgggttgccaagtcgaaccggtcgcaatatgaagttcggtgtgttaaggaaaaagatggttgtccctggagagtgcacgcgtataaggggaaatggaaggattattggacagtgtcagttgttaccaagcatacatgttttctacctggtgttcagaaataccacaggaacattacatgtgcatttgttgcatctgagatgtatgcgcatgtcatcgataatctcacatatgaaccaaggtcaataatccgacacattgaagagacatacaagtatactattagctatgccaaggcctggagggccaaacagaaaataatagagatgagatttggaacttacgaagcctcgtatgacaatttgccacgcctgcttggtgttatcgaggaaagaaaccctgggagctcttacgaagtgaagaaattcccctcaattgaacatcctggcaagagtgtgctgcaaagggcgttcttagctctacatgcatgcaagatggcattcgtgaactgtcgtcctgttctctgcattgatgggacattcttgacaggaaagtatcggtgccagatactaacagcaataggggtagatgggaacaatcaggtattgcccttggcatttgcttttgttgagagtgagaataccgacagctggtactggttcatgaaattggttaaaacaaaagttgttggtatgaggccaaatgtatgcctgatacatgataggcacgctggcattctgcgagcgataggagagttgcagtttgggagtatggaatgaggataccccggtgtttgggaagatgtacagagtaggtggtgcatgcgtcatatgggagctaatttcttcaagcaattcaagaacaaggagctcatgaacatgttcaagaggctgtgcaatcagaaccaggagaaaaaaattcaatgagctttggaagagattagatgagttgacagccaaatgcagtgatcagcgtgcagcggctccatcgaccgccgttgctgaccctcctcaagctcttggacctctcccaacggatagtccaacattggttagaagaactggattggagattcggaaattttctcagtggattctgcatgaaccaaaagagaaatgggccaaggcgtatgacacaggtggtgctagatatggaataatgacaacaaatttggcagaagtttacaactgggtgatgcgcggtgtccgtggactgccactagttggcatagtggagttcattttacatgggacatgcaggtattttagggatcggttccaggcagttcttccctctatgccgaacaacaacattttgtttggagctttcatgcagaaaaagctagaggagttgcgtaaaaaggccatgaaacatcgagctctagtgcaaggtacccaacagcacaggtttgagatactatgtcaagataaggcaggcaggggtatctaccgcaagagagtgaagcaggagtgtgttctcaaagccgacggcacatgtcattgctcttgtgcaaagccgaagctgctctacaggccatgcacccatgtcattgctgccgcagcggagtgtggcataccagatgcagtatatgtgtcacagtactttagtaagcaagcaatatatcatacatggagcggcgagatttatgggttcggcatagctggggagttcacagagactaacgatgaagtactcaatattcctgacccatcgaagctccgaggcaaggctggaaggaggaggactcgtcgcatccgcaacgatatggacgagtcggaggctggcagggtgaagcgttgcagcaaatgcgatgaacatgggcacacctacaagcattgtcctaaagacaaggagaaaccaagtgcggcggaggcaggactatcaggatcagcagcagatggagctcgccctacgggtgaaggcactacctccactcgaccacgtcctaggcgtcgtcgtgccacgtctggctacgtggtgtagttcttatgttctatgtcggcatgtggatttgcttgtaattcgtttcgaacttatcgatgtgtttatgtttcgtcatgtaatgtcagacttcggcatgtcatgtctttaggtctcgtgatataacgtcggactaaggtgcctaacgtctttaggtatgctgatgtatgtcggacttcgacacgtaatgttatgttatattattgaactctacatatatgttaaattgcacgtcatcgttatgtaccattagtaacgtttgctatatttaaatagcctgtactcttgttgtacataattaatctcatgatttatta

SEQ ID NO: 37446 - DNA, 4255 bp, Oryza sativa
tcggcgcatgcacgactactttctgccgcaccgatacagtctcctttattcgcgtatgatacgagtatttgcccgccatttggcgcatacgaccaatgtaactttcggcgccgatcatgcatgtatctttcggcgccaatcaggcgtacccaccataccccaccacgttcacatgtcaggggtatcactcgattttttgcgcctatataagtcgccttaacgagtgaggcctcacaatctttcaaaactcagtcacattcagtactctcttctccacttgcttcattacaaatccgaccggctttcgtcaatggctagacgccgaggtgttgaggatccaaactggcgtagcgatccttgtgtatacctactaccaccttggtgccagcgtcctctctgcctatgcggtgatcgatgccaactaatggcttcgaggaatcctgatattcgaggaaggcgcttttttaggtgccctaactatgaccgtgaggtattttattatctgcatatgcttattcattccgtatgggcaatcgctttattcttcgtaacactactctattcggcagacgcgcactacggcttgcgcatacatcgagtgggtcgatacagaaaatcccgttctcgacctaaccacttgtttacaagaaggtcgctggtatttcgcatccgaaagtactgagcaatacttacagagaaaagcggcttatgaacaacaatgtcgtgaacaacagagcgactggcgggtgttaactatggcactccctccatgggaagcccgtccaagatgcaggtgtggtgatcgttgtcaggttcttcgttccataaatcctacaacattgggtcgaaggttctttgtttgtccaaatattcttgacgacgatttcatggtaagaatattttgattacatgaatccttattttctcacaacatttactaactttgcttgctttacatctattctttcctcccaggaaccaccaaggagatgtcaatacacagaatggatagacaccagaagggttctaactccacctagccgtgttgtgcagcttgaactaccagagaaatacagggttactaaagcgcggtttgagagaggagagggatcctcacgtaggggttagctattatcggacaacttggcatattgaaatttctactgtcatgcttccttgtcccattactacatcgtcgttgtgttcaactattgcactacctccctcctagttcgaatctaatatcatctatgtcacgcccggaaattcactagtaatttccgaacttatttgtgcataaaatcctcgtccaggaatcagccgaggtacacaaactgacaatttaatatacaaatccatcataataataacgttacacacttacaaaagaaaagaaaacagcagcggaattaacggtctagcgatggcttcagctccactcccacaggcagctcaactggggtataagccaaacgtcttctccttctggatcctttttcttcaactgaggttgattgattattgcaagaatgagcatatgacatactcaacaagccacacagcaaatatgcaagtgcacaaggataccaaaggatggcataatataggctcatttgcgaaagcagcatttagcaaagagttaagagtagtaaaacagtagagtaattaattaaaaattttaatcaacactgaacagcacacccatgctgtacaggcccaaccatcctgaacaaccatacccggctgtacagatctaactccaaaccaggagctaggcaaattattatcaggtattaacatccataattattgtgagaggtgtgagactaatcacgaaaaacattgctcaacccgcccataaccgcgggcacggctattcgaatagttttactctggccagaggtgtaccactgtacccacaagacacaaccccacatcatgtcaccatgtgcctcaataccaccacggtacctcggaaaggagttgtgacaataccccttgcacaacataatccattacagcgcacctttcctggatcataatcaccccctcaaaaaccagaggcatggactctccagcgacccccgtggacttctcgccacttctcagtctggcgcactataatgaatcacgctatacaaaagataaagccgttgcccacgctggcttgtggttggcacggtaaatgtctcacaacagtagctcgcgaaccggtccttaattgtcatgagcacgactctcaaaaccatgtgctcacaacccaccattatcaagttttagttggcaagtaattaattaaccaatcacgattaaccatcgtgaactatcattaagccatccttaaataatagtgagtcataagttatcccaatagtgtgctaatgtttctaagcatggctaagcaatcataactaatatctagctgaaccaatatataaagcccaactagtcaagttataataacccaaggtatcaaggaataaagtaatcaatgcaaattggccataacaaaggaataagttcacaccactcggtgacattcgaaaataaatgcacagttgaaataaatagagaatttaaatataggatcaacatgctcaaaggattgtgtttaggatctgtgtgacttgccttgcaataatcggccttcaagtaatcttcttgatcacttccgacgcactcacgaaccttcgcaacgacggaaacgacaagctaacacgcaaaacgaagaaaaagactaataaaaaccaaataaacagtacatataaagtaaacaaacatgtagatcatgattttagatgaatttagcaacttgaaccactcaaaaccgagttacgatgatttagttatgaatttccgaagatttaatctattagaaaaaactggaaaaggagaagatgatgacgtcatgatgacatcatcaatggccggaccaagatggcgacctcgccggagatagagcgaccggctgcggatttggaggacatgaacacgtagaggacgacgagacgaacccaacgatactcaccctcgtgccaaacgacgaccgacgacggccggcgacgaggaggcgacggcggcggctcgggttgcacggggcggcggagctccgatgaccggcgacggaaaaggaagggtggccgagcttcccctcaccacggcgcacccaacggtggtgacggcgaccggcgacgacgatggagacggcggcgcggcggcaccggagatggccggcggcggcggtttgcttggcggcggtggcgacggagctacggagcacggcagaggacgggagagggggcaaacgaaagaggaggactagggggtcctatttatagccttggattgaagagatcggactcctcccgcaagaaatcgatccgggaaatcaaaaactcggttttggagataaactcgaaaacgagtttgattcggataagatactcaacgatttgctccgatttttgggggtaaagatagaggaggataagaggaatatttcccctcaacaaaattggagaaaaagagcaacggggaggcgagaattggaaggaagaggcggcggcactgtgcacggcacggctggctcgggctctgcctgagttggaagatgaacagtagcgcagggagggaaagtagacttttccggctgagctgagaggagaggaggcggctcaggttgggccggcggaagagagaggaaggaaaggaaggaatgggccgaaaatggcccaagctgaggaggaggattttattactttcccaattaaaataatcacttaaatgatctttgaattattaaaaatacttccaatgctcaaataatttcaagaaaaatcctgaaaatacttggacactcaaagtacttaaaaaaattacaattagaccatttaatgattaatttaatatgtgggtaattactgaaatgctctttgtatgattaaaaattaggaattgagctccgaaaaatccgagaaaattccagagagtataattaaccatggagaatttaataaaaattaaatccatccatgctttatatttaggaaattttatttcccacatttaacttcacttgtaaattaatgaacatttaatataaattctattattaatttattaaacaatttataaatcctgaaacgaaaatcaggatgtgacaatctatgtaaccgcaatgcaaatagttgtatcatgttcaaattgtactactatttcttcatgttacataattctcctagtttaagtccatata

SEQ ID NO: 37447 - DNA, 429 bp, Oryza sativa
caaaattgcaattagcccctagccgccctctgtacgggcggcaagggcctaatcgcaattttggccgacggcagcagacggcgcggtcgacccaccgtctgccacgtcagcttgccgcccaccattagggcggtaggggctatttctgcaatttttttggtcgatagattatttctgtaaatattaaaaaaaaatctaaaaacgaaaaaaattctaatcatgggctgctcagtctaaaagtacaaaataatgggctatcgaataatgatgggctgctcagtctaccgccccttgcattcttcattgaaacaagttcacttaacgttaacgttccttatctttgtcatcaagttttaaaatcgtctctgaactggaatatcagataaaatacagctctaattttacattcgacccgcatttcagtaaaac

SEQ ID NO: 37448 - DNA, 931 bp, Oryza sativa
gaatttatgcaatacactcatatttctagacatgatacatcataacaaaaatctgcagcttagttggtttctagaaatgaaaagaatttgtagtttagctttgcatttactttacttcacgtggaagaatgcctcaggcttgccatggatttaatctggagatccatgcatattaaacattttgcattaatttttttcttcaaattactgtgtatacataaccatatgaatcactccagatatcgtaaaatttgacatatgtcattccagaccataataggaggttgattcaaacttcaaagcatatgaaacataatgctgatacacaacacaataaacaaggaaagaacggcaatgcatgaatgaggaataaaagagcagctgtcataaatctaaaaatgcaaacgacaagaacaaatatgaattcgtcatgtgggaaaataccaacagaataaatgaaagactagtgtgtttcccccacaatggaacaaaaattactaggggtacataggaaataatgcatacctttccatgcttcttgctgagcctcttcatgcttataaacaggctgtgctgcccaagcaaaataaccgccggctctgagcattctattaacctccagaagcaggattccatctttaaagtggcaaatcatggcaacaaaagttaagcaaattggaagtcagggtgctacaaaaaacagttatctttgtgttgatattttgttgaaaacaatcattggatgaaaaagcgtcttcacgtgctaaaaataacacactatctttgcaatgtttgagtgccttgagcatgtctatttttctaataaaggaacttccagtcattatttgaataaaatatttttcttatgccgtaggaatgaattcagactagctccttaaatactccttaaatatgttgcctttgctcaaac

SEQ ID NO: 37449 - DNA, 21937 bp, Oryza sativa
cgcacctgcttcctgccgccgccagacgacaacgacgggttcgacgaggaagaggatgtgcaccacttcttcctctttcatgtctcctccatcttcatgccactgtcctctcgccacatctgtcgctaccgtatcatgcgggcccctcctcttctcctcactcccgccgcacgccaagctcctcaccctcccctccccccttccaaccgccacacccctcccggcgcggcctctgccacttcgtcgacctcgactccttctcgggagcgttgctcgtcgcgtcgtccccgcccttcttggcgccctccaacctgcttgctgtcctctgcaccccgtctccgccgtcctccgcaccgccctctgacctcacggcgtcctcaccaagggcagcggctcgccgcgctatcccctgccatgggcagaggaaatgggacccactacccgcgcccagctgctcccccactacttgtgaccgccggcccccactcacacgcagctgctcccttccctccctccccccaaccgcccgtggagagaagaggagagaggaagagaggtggagaggagaggggaagaagaggctaacatgcggggcccacgctgggtgagctgccacatcggacaaaacctgagtcaaaaccacagagggatctagtttgcactggtttcgtaagttaggggacacgttgtatctggttttacggtttaaggatgattttgtaacttgatggcaagttgtgagaccttgggtgtactttttcccaagaattttgtgttcctttgatcatactggacctgagtaaagctaagcctgcatggacgtttttatgtttgggctgtccttgaggttgggtttggcccgttaaaagagcggtataatgggcttccagctatgcagtgaccacaatgcgagttctgaattctggattgctccgtgaactgaagtactgctgaactgtgacttgtccttgtgagttgtgagagatgcctcccaccgattccgattatgtacattgctaacttaacaatcccttggtttgaagcgaagaatatggacaacaccgctgatttgccaattgtcatatactatattttgctggtggcaaacaacagttttacgtgttccctttgttacaacgcatcttactgaaaagagtgaacgcagtcttattttatggcggtcctaatatcttccattttcttgccaaacatgcttctaaaggaaggcctttttcctatgttattgcagtattgctacctgaaggatggacacgtttccacggtacatgaagcaccaccccatgtagcattctaaagggaaaagttgcgatttctacgagcagtctatcggaaattaaacaatctcatgtagcaagagtgcatgacgcatgtggatggttacaagaaatcaataatgcgtcgtcgcatcccgggtctcgctatcgcgcgatgaatgagaaaatcacaggtggttggttggttggtcgagaagcacgatactaacaaacacagcaactcgaccacggtgcgccgtacgctcaccacaggagaggcatcacacgaacgatttcattcagacaccgtgcgtgcacaacggctcatgatggttaggctcccatatggcgggtgcgggaggcgagtcaagtcaagtgctcgagcgaaagcaaacgcgaacggaggaggcagtacactggcagtggcagcagaagaacatcgtacgccggtcgctttcccctcctcccccacccgtcgccgtcgcaggagaggacaagtgtgaccaactggtgacacccacaggcacgtttacctgttaccgcaagagagacgttttttcctcgcacggcacgcgtgcgcgtgacgtttttctcccacaactgctcgactcgatcaagatgacggggctgcttgctgctacagtgttgttgacgcggccccctttttttcgctgctgattgatgcttgcgcggggcgggaaactgaggcttcgtgaagcttcgagacgttggccacaaagcgtcgcatcgcacgcaacctggcccccgccacgaagtgggccgatggcgtcttggcgcatcggctggctggcggccgccgctcgtgagtctcgtggcccctcgagcggtcaagccacggagggagataagaaactcatgatgcgtagacgaggttcgtcaccggagcgttcagggccgaataataaacgagcgcgcaccaaagccggtgcacggctgcacgctggtcacacgttctcaccgcgagcctgtgtgtttaccattcgatcgggtcatgtgtggagccaaaaaatggtttcgatatttagaatattattttaaggattagttttacataagcagctatcttttacattctaaccctttcgaaaaacatatttcagaaatggacgcaaaactctacactagatattgttgacgccgaagttaaaccgcccacgagacaacccaccctagtctgattggcatgggtgaaaaatgttgtgcgcataacgaactacagtatcgtgtggatttctattaaaaatatcatgaaatttatgtattccagacatataaatcgcacattagtgcatatgcctttcagataaaacatggtgttatcaatcggtgaatctactgcacgccacaattacgctactaaaagtactcttttatgtattcattttttttttttgcaactggatatagttgaactatttaagttttttttatgacaaaacctactttctccgtttcatattataagactttatagtatttttcacattcatatatatatgttaataaacctagacatatatgtgtgtttagattcattaatatctatataaatatggacaatgctaaaaagtcttataacctgaaacagaggtagtactaactagatctaaattttaggcttagcacgaatgctcatgtatacatcagtagagagacaggtatggtaacttcttcagccttaagatatcccaaccgtcttcctcgtacgggtaaggtaaggtgtacgtacgtgcgtctatagggatgagaggtaactctgttaatttcaatcattttttaaatatgttggtccaatttttagagatgctcatatgcgtagaacgtgtgtgcatgtttatagagatgagtgtgtacatgtgtgtccgtatataggcctggtttagttctcaattttttcttcaaactttcaacttttctaccacatcaaaactttcatacacacacaaatttccaaattttccatcatatcatttcaatttcaatcaaacttccaattttagcgtgtactaaacacgccctctcccttatgccttttgtttttttttcgtacggtgtttaaaatcacgatggtccaatggtccaggatgttcgagctaccaacatattacatataagcatttactccattcaataaccagctttagatgatattgcattcttaaaaactgcgaaataaaactccctactaaaactatccttataattattttcaacatttattctatcatatactcaaccaatcacaataattttgtatttgatttatgtatataacttttaacctcaaattaatcactattatttattatttataattttttacctcaaacaatcacaactactcgtatgtttttcttattttattttttttgaaaattgataaaagtagctagtataatatactcccaccgtttcacagtgtaagtcattctagcatttcccacattcatattgatggaagtagacatacagttgtactccatcatataggaaaacaaattgccattccatcgggaaaaggcggtttagagcatgtacaatagtcggctataagccagctataaacatatttaaaagagacaaaggaagagagagaagagcagcgggctgcagtacggactccaaatcgtacaatgtgtatgacaggtaggaccatgtattaatagtgtagtaagcaactattgtatgaattggctataaatgatatggagctagttgttggctatactattaaacttgctcttagagcaggtacaatagcaggctataagctagctataaacatattttaaagagataaaggaagagacagaaaagtagcgggctacagatctgtagctggctgtagcacggactccaagacgtaatgtgtgtatgacacaggtgggaccagatattaatattatagtaagcaactattatatgaattggctattacattggctatatatgatttgaagatagtagtggcctgtactattaaacttgagcaattctacggttcttaagaaggtaccatgaggtatcatttttttctattgtaaatttagtacctcttggtacctagatactatgagataccaaaaatttagtataaaatctgatatctcatattacctcctcaaaaactgtagaattgctcattaaacttactcttaggaaggctaccagcaaatttaattggtggatgcggcgccggggagtcaaattgcagccggccacgttttccctggccgcgtctcctggctccgacccgcacgacgtggcctctcccacgggccgacacgtagcccctccaagccctgggcctcaaacctttccagaagcttccggccgtttcctggccaggaattcgccgtcccgatccagcggcccgccgagcgccacgtgtctggggcccagccacgtcggcatccgacgtggcgcccccggccccggagaaactgatacgcccaaatctcgcagctcacagcctcacgctcggaaagcaagtggccgccgcttccccaccccaaccaaaccaacgccttctcctcctcctcccccccgtggccgccgcgaggcgagagcgatcgagacggaggcggcgacgacggcgacggagaaggtagcggaggaatcggcggcggatacggggaggacgggtgctcccgaggagatgaacggccgcggcggcggcggtggcgaacgcgtgggggtggtggaaccgggaggcgagaaccagatggaaatgaggagggacggcgccgggcttcgcgcgcgggttttctgcgggaaggaaggagcgggtggtgcttatgtgggggtacctcccaggcgtctcgccgcagcgctccccgctgctcgggcccgtacccgtgaggctaccggccgcggcgggcggcgatgggtggagggacgtatgcggaggcggctgcggcttcgccatggccatctcaggtgacgtcccgtgactctccttctcattgctgttccgctcgtgctccgttgctctcgattcgttgggtttttcggggtgggctgtggtagatctactggagttgtcgactcttacaattaccgtggtggattgatgatagtaataggtagtgaatttggcgaaaatttgcgaacagatagtataggacgggtttacggggcattaatactcgtgacgatttttttttacagcttgcatttattgggcacatttgaattagttgattgtgatgtacttacatttcaagtggaggtccagttttgcacgacttggtgcggcaagtttgagctcggacttgtcctcttgttccgattgtgctttagttacaaccatttcatagctgtgggtgaatgtgtgaaatggggatttgtttgtcgagagctatatagtgaaagaagatgaatacacagctgaaatttgttaaattaagtgtatttctgaattttctgagaccttattcgtgtgatacccagaaacaacgataaaaaatcgtgtgatcgaggagaggtgaaagaagaacgtcatatcatgttcttagttgcctctaacatgatcacacgagtgaccttttaattcattttgttcggttgaccgtgatggggaatttgcattcttgttggccggccccacgaattaatttgatgtaccaaatcagagtgttcgaattaaaactattagttcaggagattgtatgtgttcagactcaacaatatgccaatagaaacgagctttctctgaaaatttctgtaatcggttgctcaccatgttcaagataaatttgatactaaactggggtttttatttggatcagagtctggtaaactcctcacttggggttctgctgatgatatgggccaaagctatgtgactgccgggaagcatgaggtaaaaatgctacccgtatctgtattgatgctttatgctctcatcactcggagatatttctaaggacaattttgtacttctcaggaaactccagaagcttttccacttcctagtgacgtggcaatagtgagagctgatgctggatgggctcattgtgttgcaataactggtatactactagttgaacacacatagcgtactttaggacagcaagagctcataatttttgtgttactagtaatttcgtaaatgtcatactggaccagatgaaggggatgtctatacatggggttggaaagaatgtgttccaacaggaagggtcatttctgaccaatcttctggtggaactttggaaaaagatgaaagacagagtgcgattgccgctgaccaaggtggtgatgattactgcctaccttgtttcatttgtgcctaaaaagtataagcttctctacatcaattgttttcagatataacaaaggcaactccattacagtgagccccaggtcgcaggtgtctaggacaagtagcggagcagcatctggtccttctgaaagtagaggtactgatgatagcacgaagagacgaaggttgtcttcaaccaaacatgcacccgaaagttcaacgtccagtgatgaaaacctttcagcacccccttgtgtagtgacatttaatacaggagttaaaataatggcagtagctgctggtggtcgtcatacattagcactatcaggtagcctacattttgcactaacactatggcactacatttgctgggctagggaactttgctgattaaaactaaatgttttctcgaaagcttcagatttaggccaagtatggggttggggctatggaggagaagggcaactaggcctgggttctagaatccggactgtttcctctccacatcctatcccgtgcattgaatcagcattgtacagcaaagatcggccagcagctatgaaaggaaacaaaagtgctgaagtgcagattagcaaagtcatgggaaattgcgtgaaggccattgcatgtgggggtcgccacagtgctgtagtaacaggtaagccctttctttcaagctcactctgggaaccttttatcctacttatttaaagttgatgtcgatcatatatgatcttaaggtggtatgtgtgaatacctcagttgggtcggtttttttcttgtggatgacaatacatactttcaaattggtagttcagtttgctttggtacagtataaagtaatgttttgtgatgtagtattacgaatttacaagaatggacaacatgctttttttcatgtttgttttcacatagaaaatagttggtgattagaggcaacaaggtgcattgcttgattggaccatatattgtagttaacttttaagtaactacgatattatgtatatgagattttctgtgtaaaatcaccaaagaacatgttccaaagaagttactttaaatccaaggatgtgcacaaaagtctaataatcaaaactgcagatctagacgagttacatctaggaggaatttcaattcaaaccaaaatattagcaactgttcagctctgttcatatcttctagtgaattccaacctgcttttacaacacatggaaccctaaattctagtaaaaattttggccctgcacttttaacagctagttcttttgcagattcaggagcactacttacatttggatggggactgtacggacaggttagtgcttctaccatagcatatcagttggaccaagcttgtgtgagatttcaaagcatcatttgcatgactaaacacatccaagtagctaggaaaagaaatatgtattcaagggatggagaagtgtatgatttgttttgggtaatccatctatgtattcaacaagattaggcattgaagagttgtttgtacttgctttccgactgaacaagtacacagcaaacttatgctacaatttaatttggtttacatgtgatatgtagtttcattgaaagtctctctctctctctctctctctctctctctgttttcaactttgacatcttccataacaatggtgatgacagttcttgctcactcacttgacactattttggcatggtatatattagatttttcccccattttgaaacctatgagtaggagcaacaaaagttctgttgcactagtgctcttaattattgtataatttattcttcagtgtggacaaggaaacacagatgatgttttaagtccaacgtgtgtatcgtctatcctgggagtcaagatgcaagacattggtgcagggctgtggcacactgtatgcacatctgtagatggcgatgtctattccttcggaggaaaccagtttgggcagctgggcactggttctgatcaagctgaggtacaaattctattgagtaaagtgcattggtggtccttaaacttgtagggttggtcatataggtccctaaactctcgaaatgcatatctagatcccagaacttgtcaaagtgtcccaaatcgacacatcccctctaagatctacgtggcgctgatgtggcatgccatatggacgtgacgtatccttttctttttttctttttttctttttcttttttgttttcttctcattcttcttttttttccctttcttctactcgggtcacagagaaaggagaagaaagggaaaaaagagaagaaaaaataaaaaggaaaaattttaaatgggtctcatttgtaaatcaaaatgatgccatgtcatgtccgtgtggcatgtcacatcaacgccacgtaggatactgaagagtttgtggcgatttgggacttagataacacactatgacaagttttgggacttagatatgcattttgagagtttaggaacctagatgacatacccctacaagtttaaggaccgcccgtacactttactcaattctattcttttcgatgttaatggaggttaattacataaagtaagtttagggaaaataactacagttaacataatgattgcctcccaaaatggagttagctgtatgtgaggtgcatgtttactcagtaagtgataaccataagtatattgcttttttttttatgcagactgtaccaaaactggtagatgcctcaagcttggagaataagaatgcacgagctgtttcttgtggagctcgtcatagtgcaataataactggtacctttgactgtactagtatttttcccctagaaggaatttgctatcctatctgtctaatataactgcatattaataaaatgctcttctcatgctcatttaaatcaaggaaatatttctggcaagggtttgttgaataaacccaattatccaaacaagacctttacggtttgttgaaaaggtaaagaattatactcgatcccttaaaaagccatgagtattttagtttaatctgtctgccaaccgaacgtactgagcctaatccccatataagcaagccctattgaatcttcctagatattctgatgtgtaatcatattatgagtcactgtagttattagcgtattatcagtaacttgtgcttggaaagttggaattctacaataagctgttccatgtgtgattgaagtacttaaattcttgttaatctttggcctccctgacaatttgtttaaacatgcccgtagaaagtgctgttcctggtctaacatctactgacaaaatgtggtgacatttatgcagatgaaggcgaggtcttctgctggggatggaacaagtacggacaggtgcgtatttcagctctgcacttggagaagaaaaacattcaccgttgcagttctttttataacttttgagttgcgcgtgcagctcggtctcggcgattccatggacagaaacgtgccttgcagtgttcctgtcgacgcataccacccactgaatgtgtcgtgcggttggtggcacaccttggtgctcgcggagtcccctacttaaaacctgacggcgaacaaacttccctagttgacaattttgttaggagtttggtaggctttcatcaaggtgcggccgtgttgcatttcgtgtatatacatggcagtgcatgcagatatggtgtattcattctttccggtgcgctcttcaacgggcaacgtacacaagcttgtatcgcaccgcgtatacagttgggtaggaatggctgtaaggcctgtgcttgaaagtgcatgcggtgatgactgtgtccatgcttcgtcttgcattttccagttgctatatgcagacgaaattaaccggttgctatatgcagacgaaattaaccggaacgctgattacgctagaacagggacgatcatgtatggggctgatgagctatacatttctgctcccgcctctgaaatccttcagaatttgacggtcacttcgtgttaattttccctcaatccagactttatataaggcagctactactgacgcaaagacttttcatttgaatcacctcaataaatacaatatacaatgtacacatttaagattagagaccctcatttagatcatccttataaacaatgtacacaccagaattagagatcttcaggatgacggatttaaaaaaacgagcgcaatggtacagtttaagaccgcaaaggctgaattgtattgtgatcggagacatgcaagacgcccaatgacacgatataatgacatttttttctgatcttttagatcaacttatgagttgtagcaaatacacgataccataatatgggttctacatctatataggaacaacaagaacgaaaagggctgccccgttcgcaaaaaaacatttatgtacaacgagaggggtcagctacagcgatcaacgaatacttctaataaggttacacaagagctcctggatgaggctgtcgcgaacaatctgtcagtcagcaacttctttcctttaaagaacacaagcatcccacttttgcccgtagatgctcatacatttattgtgcttccatttgctagcaatcctcaagttagatactaattaataccaagctgtatgtgaaatgtcctagaacctgtactgaaaacttcagatgattagaacgaggatgtattgtggtatgaaagagtgaaagatgagagcaaccatattttgtttcaaagttccatttatatgggaggcgagtatgtaatagctgataatgattataatggaaaaatggcttcaccatggacgggcaaagcctgatagctcgagtgcccgtaaataatgcccagtttacataatcactgtcagctgactgaagggtataccagaaagttgactaaggtctatgcattgttaataaacatcccaaggcaattgtgcaaaactattattatgtttattactaaaagacatgcaaattccaactgtagtatcatcacaattctgatgaagcaatgttaaagtaagaaaaggaatgattctatctgctgaacagacttacatgtaatttcccttttcccttgcactgatgaggaggcatgatgcttagaaacggggcacttttgacagaggccccattgtgggcattggtgaaggctcagtaaccggaggtcttgtttgatggttggcaactgaattgttaattaccaatttatttcctgtgcttctaataccagcagcatcacattctggttgttgagggtccactgatacctttacctgttgcagtttattgttttaaataatccaatcaaacttttgtttgagcttattgctgaatagcacagcagcagtacatgcaatgcaagatgcccagatgatgagaataaaggcaatggcaaaaatataagtgctagttctatttcaaaataacaaacagacaacattgcattctaaacttttataaccaaacaaacaaaggaaacagggaaaattgctgaattaatgttccctttactaagtaaattctactagaaagcactagactatggtactttgatagcgattacccccatacattcaaagtcataaaacctaaaacccaaaaacaacaaaatggctacaatagccaggtcaattccctcagaagttgggtccagatgtccagttggcatattgcataacatgagtgcacatgaacgaagattaagaaaaacagtttcacaaaatataataagtaatagaatggcatttcttagtcttacaggatgtctttgcggattcttgtcctcccttaagaaaccaggaacagataagtgccaatttttttctgcatgaaaatatattcagatttaataagcaaataaagttgattctatcacatcagagaggagggttatcaacctaggtgcagcaatacatccttggcttccaggactgatgatttcctatgcttcgcaagggtacacgcaaatgcagtcacctagtaacaaataaaaaaggtcagttgatacaagttttgtccatcagataaaagaagcaaaatcagaagctcaaggtactcagattctgaatcacacggaatcacatttttcaaccaaatagaaattcactaagagcaagtgtgctgtaaaagcatgatttacaaacaacaaacacattaccgaatcaatgaagtcatcagcaatctccaaaagcaaatcttccacttctggatcaaccttgcccaggggatctacctgtaaataggagttcacaattcaaagacaaagcaaagtattattcaaccaaaagagtaaagtattattcgaccaaaagagcaaaatattattattcaaccaacaaagagaatatgcttctgaaaaatgggaatgcgattctaatatttcaagaaaaatctcaaagatcatgatacgatcacatcataccagtgatacagaagctcataagaatgaacccagaaggttatttgttacctgtgaaaccaaatcttgtatttttctcttcccaagaagttgattagttacttctgctccttgacttgcacttccaccagtcatagttccacctgataaaggagtgcccggttgtgatcctgtcaggttcatggacttctgggaaccagatgctgatatccttggagattgttgttgttgctgaagttgctgtagaatgtgttgctgctgtaaaagctgggtattgagatgaggatgctgttgttgggtttgtgcgatttggtgttgattcaatcctgactgctgttgaagttgatgtattaatagcatcctttgttgatgctgaaattgttgtggagaaacaggtgatcccagcgatgattgcatttgttttaaccatgctgcctgctgctgtttctgaggaagggacatttgtgccatcggcccatttgtcgacgatccaggtagctgtggatttaatgcagcaatcgatgctgttcttgtcaagccttgacccacaaccttctgataaataaaccaagatagaagttatccgcataaacatgagaggtgctagaaaaattgatgcacgcaactgtcacaagttaaaaatagaatatccatggtgcaaagttaataagcatagttctgattaatcctaaaagaaaaagggaaaaggacacacaaatgcttaactctcatgcagttttagtgggtaaaagcataattttagtaactgtgtgtaaagatacatcagaaagctgccaagagattaatattagcttctttgatcagtacctgttaatatatgttctttaaaaaggaccttggctatttgctgcggcatgcattcacatataataacaataaggccatgaaagatacatatggtaaggtaaggactaaggaggtgggtgcttgataaccaaagataattcttttgcttacggaagtcaagtacctgtggagacagtgtgccttgctgtgatgtctgctgcggcctcaattgtgcttgtgcatgggcaaaacgttgctgattatatggaatagttccatttcctctcataccacccatgactcccatggactgcataccttgtaatgcttgagctgcattggcagtattaaattgtgcaccttgcaccatacccttctgccttggctgcagcaacaagaaaaaccaattatgctagtaatacaatcagatggtgatagttactagttaccttcaactgaattattttccccaataataataatttcttaacataggcaaaactagtacgaatcactcctcttaatgtggtttccaataaaaaaaagcagagggtgtttcattaagcaattctaaatataatacagatattcgaacaattgtggttgcgcctgcaaagattccaacaacagaaggcttcttatcagagcttatatttgattctaaaagaaatcacaaatattttaccaatggaacatagtacgagaaatgtagatttctagtttttctttcttgtggtatgcaccatcacacccaaggagttatctccactacttaaataccatgatgctacaagaaaaaaaagtcaaaactgtttaagaaatttcaagattctggatccacgattcatttccttttgattcacaatcaactggtaaatgcaaagtttcagccggacctggcattctgatcaaattgatctaattttgtgtgcgtaccctcctaaaaatattcagcatagatatttgagtcaccaattcactaagccatgttacaaaactgttaccatatacgatacgctaccctgttaagctgatagaaaaactctaaccacaagtaaacaagtctacaattaaaagagtctgtgtttcccacttccgttaaaagtggaattcatgatgattagatgcaaaattcagctaactcaaagcgtgcctgagaccccaaatttacctgcgccatcatctgtgactggagaccatagtgcgccgcagatgctgcgttcccctgcccttgcagcatcccaatctggccttgactaagcatggccgcgcgagcagccagctgctgctgctgctgctgctgttgtcccacctgtcctccacctcccgagaagttcacctgactgccgtacatcctggccgcagcagcagcgtactgtggaagctggccgacagcggcgaggcgggagcccgagcccgagcggtggatctggccgaagcctccagccccggccgccgcctggccgggcgaaggagcctgcatctgcggcggccgcggggggtagtccatggccccgccgcccgccgcggacgggtcgagctgcggggacagatggcggacaggtcggagacgtgggcgacggtgggatttggggggagaggagggggttagggttggggttttgcggggtggagactgcggcggcggcgagctgatcgggctgcggcgaggcggtggcggccgcggacggcggatccgccatggcgggctgggggcggcggggctccggcggcggtgggcggcggccggagacgacgcggggtggacgattgcgtcggggggtgcgggggcaggtacgggtcctgtggggtagtttgacgtgtgcgcgtagtcttttcgtggttgagtcaggaggggggtggttgctgtctttagggtcactgccaggttggccccacgggatcatttagcggataagaagaatccgctcagagtttgcttctcgttgccatcactatgcttgcttgtactctcctgggttgatctaggaacatgttcgaggcatttgaggtgtaacaatcatattcaggttccctgcaaaaaaaaaaaaaacaatcatattcaggtgcagtgaccgtcgaaaaaataagcccagacgcaggagaaaccaatgctgtctgggcgattggagactaaattaacaagagacggtaatcactcgccgttacacgtgcctgctggccgctgccaacgagcaaagcacggcacgctcgcatggccgtgtctcagcagcttacctcctggagaccggcagtctcgccttcgatttctctttgatcctttccgtgacccgaccggctccgagtcgacgcgctccgcccagctagcgcttgccgtctttcttgctctttgccgaggcagcgacgcccgctcgccgaaactctcgcggctcgcgctgacatcaacagcagcggggggcaacgcgcatgcgcgattgcgcgtggccgtgggagacaagccaaacaccgcccggctccgactcgacggggcaaccgtctcgctcgcgcgcgcgcgcgtcttggcgttcgcagtcgccgcgcgcttatcctatgggtcgcgaggagccgaaatatttcgcgttccagtggctgcgagtctgcaacctgcgactacgcctttctccattccactcccgctggccaaactcgtccgcacatacgccaacagagaacacccttctgcctacgaattacccgcgcccgcacgcgggatatctctctatgctttccgcggtcagttcttgctgctatacacctatattcctacgctgctgtcaagttcaaaagcacatgatcagtttcagactttcagttccagtggacgaatggcacctaggcacgcagacgcagagaagaaacgtccattcctgtgctgatcaacagggttaggctgcgggagtgtgtggggtatctacatagcgctgatcgatcaggttgattgctttatattttccagtggattagtgcaataatactacagtgaacgaagctgaaagtttcaacgggacaacggcgtaccggcattgtcaagatcaaggtttaaaaacgctgtcttatttctcctcccgtagcaggtacgctagattatagcatcatcaacttcaagagctgaaaaggtcatccacaggtttgcatcctgatatgattgccgtccaatcgggaacgcgccttgtaagactggctaacccctcattccctccaagtcttcatggattacactggattaattatccaaaaattaatccgttggctgaagagaaaaaccacggggctagctgccggtatatgatacatccacgtcagagtaaagccgatcaagattgccatttcaacctaatacagttaactagtagtatttgggattccgatcgatcttgtttcaacgtcattttgctgcgtctgttacagtagctcgtgtcactttctcggcaactttacctgctctttttatagcccccatcagttcaagcctcactcatcctaatccagcatcagtcccagctcgatctccctacaactcgcaaggaaaatcctctgaatctctcccatggaaggcatcatcccgttcatcttcaaggcggtagcgcagtacaaggagggagggcacgtatccctcagcgacatgatctccgacaggccgtcgccggcgtcgtacgtgctcctgccgggggactctgacggccgacacgccgatgacaagacccagccacttcgtcttcaggcttccaccggctccgaggaggaggtcaccacctgcaccgcccgggcgtcgcacctccggtgctccacgctgcgccggcgagcttaggatgccgtgaactgctacgccgatcaaactgcaggtgccagtcgttcagacaatttgaggtttgtggtgctgtgcttgtgcagtgcagacagtgagagatgtaaggagcctagtactttagctagtttgggcttttcagcctatagcatctataagcgacctttactttttttttttagctgtttatgctctgtaacgaggtgcaggtctccaaagggaagatttgtgcgtcgaagggcgaaacgctttgtatcttgagaaaaacgaatttgtaaaacaatactgtgcgtgtaactgtataaatttggtgataggttctgtatgcagagaggtacgcatatgcaagtgctatctcggtcactgtgattgatttgcctctgaagaaaaaattctcctgttacctgatgcaggactgccgtttgtttgggttgggctttgctgggcgtaattagacagtggaaaaagtacactaaaagtcctttgtcttgtcgttgaattacaaaatcgtcgctcaaccgaaaaaccaaactatgtaatatctctcaacttaaaaaaggaattactttagatccttagatggttttgaccccgattttatccaacgtagcagttgaatcaacatgggactcacatgggccccacatgtcagcgactatttcccctcctctctttctcttcatatttccctctctactctttctcctcgacacgaagcatttgactaagatggaggagatgacccctccgccgaggagtatcttcaggagcacgtcaactatgaagatttttagggttccgagcctagttccaaaaccgtgcctatgaaataagttagtcgcttaggcgcttagcctagcgcttagtcgttaagtcgccttccgccgttagctcccgctatgttgttttcgcgttatgttgctgtcttttgtgttccaaagttgtctatatgggatctgtccacgatggcaacctatgtaaggactaccctagtgatgtaataatattagactgttttggatcaccgatgttccgtgtgtatcagcttgtgtatcctgggactggtacatgttacacaagtacagtatcgtggcctccggacttgcgaggttcggggcactatagttgccagtgttgcagagacggtgcgcggcagctgttggcaagtgccactgccacctttccactgcccacccgccattgcagcctttccgctaatgagctggcatgggcggctgtggcgtcaccgatgcggcgggaaggagggccagcgcgacatgggaggaatgcggcggagaggagggccagcgcgacagacggcggccggcaaacgagagcagggcggtggcgtcaacgatgtagcaggaaggaggggctgatagagagaagttgggcattggcagcggtggtgtcactgacacggcagggaggagggccggcgagcaggcgcagctggtggctggcgggggaagagcgcggtggtggctcccagccgaccgactctcgagctcctgattcacgggctcagcgacgccgccgccgcagagctcatctacgccggcagccactcttccccaatgccgcgctgtcgccgcacagccttcgagcttcctccactctctctctctctctccactgtcaccgccgccagcattcttgggagccacccgccgccgaccgcactcgaatctccagtgccaccgcatcttgggccacctccgtcgccgtcgaggtcgcccatagccattggagtcgtgcgccctcctctggccttcctccctgtgcgcaggaaagagaggaagaagagagaaagagggatctaacatgcgggtcctaccttttattattttattatttccccagaaactgccacgtaagccccacgtcaatctcacgtgggatgaagaactagtaaaagaagctacgtaggtgtcacgtcaatcaaaactggggacaataccaccggaggacctcatttgcactgtttttgtaagttgatggatgagttgtaactgggtttttttttagggacgatttataattcggttacaagacgagggatctccggtgtactttttccttagacagccagtagcttttccaagattctgttttttcaggcccagttcatctggccacagagaggcccatcatcacgtaacgaaatgtaacccgactaggccttatggcccaaaaagtcgtaagaacggctaagccttatccaaaattccgaagcttatcacgaaacggacaataaggtatacaccctaatcccaaaaaccattgaactcaaaaggggaataaaatatcgactgggaggttttttctgacggttgtatcacaggatcacacagtattactagtgtattactgcagcgttttcagatcataaacagattctggcggcaccatacacgagaatacgagattaagtaatcacaagatcagcttggaagcaaggaagaaaaagaaaagagcaccgacacggcatttctctcgcatgcgcgtttgcgtatcagtgagtgcgcatttgggtcccgtcactcgcaaccaaagaaagattagtcgaagcaaggtgcagatatcttggataccggagagccggttgaccctagaaagaggagccaagatcatcagatctgccgggtttccggacgcatcaggattagcacatggaatatcctatgttatgcgtgattacaatgggcagcgcaatgcctcgccttggttggttgcctgcatctacagtctggacagatgacagtccgaagcggcttcattgtgacaaaaaagaagaagcaatctttggtttcttggatcagggaaagtggaaagcataaactggaacagaaggccaggcggaaataaactggacaagaagaaaaggcgtatgtaacgtactaacgtgcatgtttttttcctcattcaaagatttcccctcgacttctcattcaaacaaagcaaacatagcgttttctaaaatttatttattttaataatattctcccatgattagaaggggattaaaagaaaatctcttccgttgacagaaaccacatctctactgtagttatctgaattctgaaagcctgaacctctcgtcgtgtctcgtactctcgttcccctcccctcgcgtcgcctctccacttcgtctctataaagtcccacccaattctcgattcccaatccagcgcagcacaaagccctcctccttccaccgcagctgcgctacctacctccaagagggctggtccgctggtcgtggagaaggaagagagatcttccaggctgatccctcctattggtacggaagccctaaactcatcggagctttgccgcggccgcgagcgatcaaatcgaaatctttctttctttgttctttgatgctccaacctagtgtcggatttgattttgactgttgcaatggcagctttctccttcccgagcccgcttgaggatccccgccggagtagggattagggaggggagaacaggaggcggcgattcaccatgaaggcgctcattcttgttggaggcttcggcactcgccttcggcctttgacgctcagtttcccaaagcctcttgttgatttcgcgaacaagcccatgattctgcatcaggtaataagtggtttcgctagtactctgatggagtaataagagtacttatttgcagtgccaatggatgaattgggcacaagttaattatagtacagtattctttaccaacagtccaacaatggcactggcctctccatgaaaggagggagagggtgctaaactggtcagagaacattaatactatttgatttgtttattactcccacataaacatggtgtaacaactaaaaatccatggtaggttgcacttggatgtgattgaatgcacctttttactattcaattgtttctttccttagttatcaatttggttacatgattttggaaaactcttttggtatcacaccaaattttctctgtcctcgaaaattccaatcggttatcaagagtacttgatttatatccaaaatgttggctccagcaaacatgagcatgaggattgaggagagtaatgagctctgaattaaaagttttccgatttatgcagattgaggccttgaaagaagttggagtaacagaagttgttttagccatcaactaccgaccggaggtaaaaaggagataatcttttactgttgtctcatggtataagtataactaacttcacattctaattggtttgctctgatccgtcttttaggtaatgctcaatttcctgaaggactttgaggataagcttggcatcacaatcacgtgttcccaagagactgagcccttgggaactgctggccctcttgctctagcaagggacaag

SEQ ID NO: 37450 - DNA, 683 bp, Oryza sativa
taatttataagtaaaacttttatagatttgttcgtagcgacttaaaagccaatattaacaaaaaaaatacgttaaaagcattttaaaatcaacttcaaaatcaagttcaaaaatttaaattttggcttattttttgcttgtctaggccaaacgatggggctactagtgtttccggcccgatctgctctgactttctggagcgagccatcgtgcttgtgatcacgtcgtctccggcgagtcacctcactcgtggttagtactgccactatctgaggtaaccaccagcacagtacatccactgatcgagagaacggaaagggcctattcattcatccccagcggtcggcgccgcggaagtccgtgccaaattctcccccacgctgatcgagatctgaacggtggtgacgactcacgcctcgtcagtcgtcagtgcccgcctcggcgcctcggctgcccgcagtttcggcgcgtgcgtacgccggcgcagacgccagatgcaattcacctctccgggtccgggcggcaacgcagcgtgcgcgggcgtgacgagcccgagggggggcggcggcggccgatctcgtctcggcatggtgccacggcgccacgcaccctcgtctttccgcatagcttttctccaggttcacctccccttgctgcccccaccaacgtggtccacgccagcg

SEQ ID NO: 37451 - DNA, 12397 bp, Oryza sativa
caataaataacctgtctgaaggcgggctggcgccacgtgttggcagcacggggttaggcgataacaccggcgtcgtgatcgccgttaacatcaaccgcctggtggaccctaccgcgggtgggccccggcgcacggataccttccacgtgttgcgggccgggccggggcgtggccacgcgtcgagatcaggtggagatggacggctcagattccccggaacgggagcacgtcacaacaactggacctgtcgggcgctgcccgtgacggcgacgggcacctgccctccttcccctcctcctcctctcctcccccctaccttctcttctactccccccaccacccccgccttcgtgcttgcgtgtcgtcgcctcacctcgcgcctccgctactactgcttgtctgctgctgcatctgctgttattaccataccgcgggagaaggggggccgaacccgaaggcgtgctagagggaggtgaggtgaggtggatccgtggaggctcttgtttcgcgtgcgagacggtgcttcgtttcgcctcacgttttccgagggctacggcgacttggtgggagcgcggagaaaatctagcgagccgtcggagttgggtggcgcgcggccggctgtgcttctgaaggaggagtaattggagtagttgcttgccatggccgagatctgctgcgaggaggccatgtcgccgccggccactgccacggctgctgtcgcggcagcggctccgcctcggccgccgcagccgctcctcggcgatagacaggcggcgccgcagatggagatgaggcgcatccgcatcgcaagtgatctcgagctgcaggccggagaggatgggcgccctggaaagcggcagaggctggcgcgcacggcgtctggcgccccgcgtcctgacgaggattcggcgtctgagcggccgagttgtggccgtacggaggagttcccgaggtatggggtcaccgctgtgtgcggccgccgtcgcgagatggaagacgccgtgtccatcagaccggacttcttgccggcatccggcaagttccatttttacggcgtcttcgacggccatggctgctcccatgtaagtgtttgctgatgtctaaatgtgcgaaccggatagtgatctgtgcacatgtaattcagcgtgctaattcgagttctatgaatattaggttgcgacgacgtgccaggacaggatgcacgagattgtcgccgaggagcacaacaagggggcctccggcgaagtggcgccttggagggatgtgatggagaagagcttcgcgcggatggatggggaggtcggtaaccgggcgtccacccgcagcgacgacgagcccgcctgcccgtgcgagcagcagacgccttcgcgtcgcgaccacgcgggttccaccgccgtcgtcgccgtcgttagcccaacacaggtcgtcgtcgccaacgccggcgactcccgcgccgtcatctcccgtgccggcgtccccgtcgcactatccgttgaccacaaagtacgtatatgctcgcatcacagggccggctgagcctttcccgtccatctgcaaaaaatcgttagtttcttgtccatgagcgtgtgcctgacatggttgctacttgctacctcggaacggttcagcccgatcggcccgacgagctggaacgaatcgaggcggcgggcggccgcgtcatttactgggacggcgcccgggtgctcggcgtcctcgccatgtctcgagccatcggtgagctgatctagttttaccttcttctctcgtcgtctcaagaattttgatttggcacccggatccgaaactcacctgcgtatgggcgcgcaggggatgggtaccttaagccgtacgtgacgtcggagccggaggtgaccgtgacggagcgcaccgacgacgatgagtgcctgatcctggccagcgacgggctatgggacgtcgtgaccaacgagatggcgtgtgaggtcgtgagggcgtgcttccacaacaacggtccgccggcaccggccgcgcggccgagcggcgtgccctcctcggccgaggcggcggaaaccgagaacggaggagccgcatcggtgaaggggataagcaaggcggagtcctccgacaaggcgtgctccgacgcggccatgctgctgacgaagttggcgctggcgcggcggagcgcggacaatgtcagcgtcgtcgtcgtagatctccgccggggattgtgattcttggcgcaatattctatgctccatgattgctttctttcttcttcttttttttattctaagttaatttttcccttcaaatttcttccttatttctctgtttagttttagttttactactagctcctaccaagataaatgaatataatagccttttttttcgcacaaacacgaaccagacagatataacaggagagtgatcgtaggcgtaagatttcggaatcaagaatcaatgcgcacatctttaatcctgccgtagttaatcgttattcgatcctaatgtctctgcaagtctgcatccatatgggtaaaattggatccatgggatgctaggttccgttgacactaccaaaattagagcatcttcatgaaggaagcatgaaaaagctcaccactcgtgtgagtgctagcaacacgtccatcgtgcatcctagaaaaggagaaaaaggagaggaaaaaaatagggaaacccaaaaaaaaaaacgtcccatcgtgtgaggctatttcggtggccatcctaggatgaggacagacagcagagcatagaaattgatgctgatccatgcgtgggggccgcccccatggtggtgagctgaactcggacgagattctcctgctccaccgctttctgtgtggaaatgtatggtgtttcttgtgataaagttttgagccccaatgatgcgacccacgagcaaatagctggggtccgcgtgtccagcctcgtcccccttttccctttctccccgtcctcgatgcccctttgcgttggcgacggagcaccgagccaccgagaggcgggagagcactcccttcgccgcgagttaggcgccgcaacattattgggggctgcacgctctcgacgcaccccggggcgtttccgcaacagaacatgacacgacgcgaccgggagcaaaagggaaccagctgtcgcgatacagcaggtgggaggagtagcgaccaccaaattttaaggcagcgtcgtggtggtgactccgtgctgactcgaccgtgcgtgccgaatcgttcgactggattcccggccaacccctcctaaaaataggcgtcggggggcaacgtggcgcaacgcgcgccgagaggtggggtgtgtgtcactcacgccgcgcgctggggacgacgggacgatgaggcgtgtgcgtgtttcccccgatgtgcccggcacgacacctcgccccgcgtagagttgacacacgggagggcgcgtcgccgtcgcggatccagcaaaggaagatatggcgcgatccatcggcggcaagggcgggggaggcaacagacgaaaggcgtgccgcgatcgcgatgggacgccatgcgtttttttgtgcgatgggagatgaggacgacgggacaggttacggagcacgggagcagcggcgaatcgtgatccggctgcaatccaacgtcggtggcatactgacatcagaggaagggcggggaagcaacggccagtccagctccagggctccaatcgtgcatgatctgattgacgataggcgtatccgcataggatgcttgctgtttctgtgttctgccgactgacgtcgcatgcgtgaaatagccaaacagggaactatacttgcaacagaaagagaggtgcatgtagctgcgccacatctacctatttggaactcatcccttattactactcactactacaaaatctatttttcatggcatcactttatttttttttctttggcggttatacgcagaaaccgccagaaaaaaattaggggggggggctatgggccaccagcgaaaatgaatcttcgctagcagctcacttagataaccaccagcaattttcgccagcgggtgcttaggagcaccatctgagaaaataaattcgagatataaatcctatccacctctctccgcgctttcgtggcctctcccacccaacccaactttctccgcctctctcccacctttctcgatacctctggcctcccccctctctctccacctttctcgatcttcctccagcctccctcctctctccaccgccgtcggctgccgtcgctttcaccgccgccgcatccgtcctggggaaggcgagagcgaggaggacgaatccgctgcctctcgtggcctctccacccaacccaactttctccgctctcttccacctttctcgatacctccggcatccctcctctctccgcctccgggcctccctcctctctgcaccgccgtcggctgccgtcacttccaccgccgccggttgccttcacttccatcgtcgccacggcatccatcctcgggaacgcgagggcgaggaggagggatccgccgcggcctggctgtggggagcgtgcatccgccgccgtcaggccgcggggaggatggatccgctgccgccagcacgcggggagcacagagctgtcggcggtagctgcggggcctcgtcgtgtcgcggatctcatcgtcacggtcgccgccatcgggccgtggggagcgcggttccgccgcctccggccgtggggcctcgttgtcggttgcgtcgcagatctcgtcgtcatgaccgtcgccgccgggcgcggggagcgcggagctgacactgctgggccgcgggtagggatggcaatcgggcacgacgggcacaggtagtgcctacccatacccgtgcccatgagattatttgtgcccgtgggtatacccattactacatgacgggtaaggatggttgcccatgcccattgcccacgggcgccttgtgcccgcgggtgtgtgcccgtttacccgctacaacaaaagcagtggaacaaaaagtctacaagcttctaagttcgaatcgaactttaaacatcaaatattcttcgccttggtgtggtgtctctcctctggcggcgatagagtaaggggaagagaaataataagggaaataaaagggaaaccgtagaaaacaaagaacgtggctaatgtattctagtggacttgctcctcgcctacatgtaagttagactttgcgggtaaatgggcaaagtgggcatgggtagtgattacccatacccatacccatttacccatcgggcatagcttttgacccaataagatacccatgggtataaaatggagaacaaacccaaccctaatagagtttttacccacggataaacgggcaaacgggcacaattgccatccctagccgcgggcggtggtgctcggccggtgatcgttcgacgacggcgacaacaagcggtagcggcttaaagtttctttggatttgtgcaacgatccgatccggttaatgtgtttggagatgggaatggaaattggtgtgattctgaatgaaaatttttttaccgtaaattattgatgcaaattgctgtggatttgtggatcgaggagtggatttgggaataatttgaactggtgttgacgaaggtggacagagcgatgttgctccgtcattttttttagccttggacagtattaacactggcggctggtatagtgtaccgcctatgaaaaatggatcgtgtggtattcaagtttcgcaggcggttagcttacgaaaaccgtcagagaaaatggatctacgctggcggtcagctaccgccggcaaaaatactgtattaccattggcctttagtcactggcggtgctgtcagccaccagcaaaatttcattttggcaaaaaaataatgatttttctagccgtgactgtatttaatttgttccaaaatggtacggcggtgattccaaatttatgatgtgtttagttcacgctaaaattgaaagtttgattgaaattggaacgatgtgacggaaaagttggaagtttatgtgtgtagaaaagttttgatttgatgaaaaagttaaaagtttaaagaaaaagttgggaactaaaccaggccttatagtctatagctatattttgagatgggtagctacgttaatagcttgtcaacaatatatgttagtgtagaatgtcagttagcacttggaagatttgtttataatcttcccagtttaacactatcaatcttccgcgcacagttgttgtgatgatggtcgaaacaagtcggtcgaacaaacgcattccacgtatgatgtaatatagtaactgtgctataaaatacagtcttttattctctctggagaaggtagcataaaattaagtttttctggagggtaacataaattccagttgtttgtggcgctcgctagtcgctatcacagaaataggcaatggctcgtcgagtcgttttccgtcttccatcctgtcttgtcctagaaaggccttcagtccttcacccttcaagccctgcttttgtttccaccaaagtctctaactgggccttcaccaaatactttcgcgaacattgtactacgatggggctatttttctgggtccaccaaagaggaaaatctattgtgtggcctgcgcactacaaaaagggcttgggacacccatgatctgactgggccgggagatctgccttggatctgactgtttgagagtctcttctttctttcgctaaaaaaaggtctcacctttcttagtctcccctgcaagagatgtcatgaccaatatgcaatgaacatactcgagagtaacgcatagtctaatatgattgcaatcaacgatgcactgtattattagagcaagttttatggaggggtgcttgctagcctttagttttgttcacatcatcaactaattaattaagcgatagtatataaaatagattacctctaatacactagctccagtataatataattttttatttgcatccaatttacactggtctctcgagtctcaattttctcccttagagtttgttaagaggttaccttttgtatgaggagtggccttttctcttttttctttgtcctctccttcaattcacctcataatttagtcttagtatatggcatcatgggatctggcttaggtgtccttaatacttaggtggtgtttagtccctcccacccaaacaccaccttactcttatactggcataatgctcgccaggttctgaatgtggtctccaatagatatcttttataataaagtagaataacaccaaagttgaatgtaccttttttggagcgtgtatgtgataagcatatgctcttgtattgtgtttctcaaattattaactaaactaaagcagagtgacgtacattagattggtaaaaccaaacaaacaagtctaacgcgatcgcaattggtttcgtttgctcatgtcaatctatgggtttatgattacgggcatgtttagactattgccaaaacaactttttcataatttagcatacccaaattttttataagagacaacatcgccatgttttgatagggtaaagttaatttggatatgtttagtttggtgcccccatataggataccaaatgttggcaatattcaaaggataccggattttggtatgttactatggtattgccaaattcctgtagtcattgctatttgctaatgtttcttaacaaaccgacctatgttttgtattccactttaaaaaaaatagcatggtttaaattgttagaatcaatccgaataggtcttatgtccacttcacgaaattcctgctgctcgggcgactggccggggccggggggaggggagagagagagaattgggcgctctccatgtgctacccctggggccccatcatgtgcccctgttacctgccacgtgtctccaccgcatactccattgcaaaaaatcacccacatattttggaaaccctctattaagagaattcgttttatttttttccacaaaaaatgtttcacctagtatactcacgatgtttcactatgtatagatctaatgttgcagtgaattgaaacattcttttgcaacaaattatccacatattatagaaaccctctattaagggaattcgtttcattttttgttccacaaaaaatgttttacttagtgtacttataatgtttcactatgtatggatcaaatgttgcagtgaactgaaacattatttcgctatttgctgaaacattgttttttatataaggtgaaacaacacccgatttaaacgattgaaacattttcgatctacttagtgaaacaattccaaaatacttggtggaacatcgtgcaacatttaaaaataattcaataataagctaaaaaagtttcgccggaatatatctatgtgtgatcttgttttaaagatttaattataacgaatttaatggtgcaatcggattatgatttggacaaataatttaagagaaaaaaatagtttaaagtggttttgcacgtatgcgtcatgctgacgtcaacgtccgatttcccccctccctgtcgggagcccgacgcggagtcgtcttctccacttcatttatcaaatggagctgattttggataggcatgggatatgccggtccaaattttaggtgttagggtgtgcttttagagcaattttaataataatattgccaatcactagttttaaaaattgaaacattatttataaccaatctaatagctcatttatataatagttaattatagatatatactgcatcattaatacctaatatattaatgattaatactgtgtgtaacaagaactctcttccttttaatatattgacgtacaatctttttacgtgccttttatctctcccttcacataagcacaaatataatgtggtacttcctccgttccacagtataaaaccttctaacattatccaaattcatataaatgttaatgaatctagacacatatataaaatatatatattgatcaatggatgaatctagataagtccaaaaagtcttacgatataaaatggagggagtgacttggacaatctgtttacgtcatcttattatactcactcttatatggataagtatataaatgtgtatatgcgtaaatatgtttattgtgtttctaataaaattactaccacattgtttcgattttgaaggggtgggtaggagagaggggaaaaagtttcctcctaaaaaaactagaaagaggaggttgagtcgagggaccgatcgaatatgtttagttccacgctacaattaaaagtttgactaaaattgaaaatttgaagaaaaaaattataagtttatgtgtgtagaaaattttgatgtgataaaaaagttagaagtttgaaaaaaaagttaaaaagggtaccgcatagtgccagatagtacagtagccaccaaaaagcccacatatccgactaggagtacgtttttacttgcttcccccatcggtctccctctggcgcgccgctttggcttttccgaaaggaagccagtcatccatctcccccgatttaacccgacgccgtgccgctagtctgatccgccaccgccacggtctcctcctcgcccccgtgcctccgcctcctcctcctcccgtccagcccgtatcgacgagaccagcaaggcgccgccgcgcgcggagctctcgacgcccgccgacgacccgcccgccgtcagatccgcctgctgcatgcttcctccaggtttagatcgtttccaaaaatcctctgcttctcttcagtaattccacccgcgtacggggtttctcgatcagagcgggggttccgtttatgatcgggtcagggtttacctattccttgtgatttgggcggcatgcgatttttggattataggtgacgtttggaggatatgtaatattatgggttttcaggaaatcgtttggatgctgtagttaccaaccaccgcagcatgcctagcaatttgtgcaattactcgttactcttaacagcactcacgctgtcacgcgcggtgtggcacactgtcaaaatttgagatacgttgacacttcatcattggtggaatctcgtgaaggaattatttcagcggatgtgcatatgctatagtatgagaacatctatggtattatgtagatacaacaatcactaaccagtcacgagaagaaggtttttagttgtgattctataatatatttgagaatcaaaactaactttacaagcttatgtgggtttgacccttcaaaatttcttggagttttttatagttcaacaagcgtcaatgattgcgattcatatatatacattgtttactagtaatggtttgtgtgagttcttgagacaaaaatatgtggttgaccacgcaccaaatgcattgttccaccactgcttttggttgtgatcattttcgcatagatagcgtcatgtcatgctgcattttgatggtgatgttgtgattcgtgaatgcaagcaaaataaacgcaatggaaacattttttttgcaagtcatattttttgtttgtttctagttctcatcgttatcttcttttaataaatgtgtccctttgttctcttagagcattttcccctctcagaaaattggaaacatttaataagcatcagagtgatcaatcttagtgaatacttaatagagaacataattccatcaatgttctgttcagagcaaatttgtagaaaagaaaaccaggcaagcattgaccttctgacttgtggttagaaaaattatctggttgaatctccattctctttgtttttaacagtatttttatttgtacccatgtaacatcttgtttttcctttttggtccattatatttcgttgttgaactgcaggatttcagtatgactgaacatataaattatgatgtggtggagcagtgtgttaaaaacatcctctctctaatcaaaccagtggaggatgacagacgcaaacgactatctgcaattcaggagttatcaaattccattcctaaagttgcagccttaagaggtgagttatctcatatttgataatttttaagtttgtaacaatgtaatttttgataagctaaatatgaaatgcaatggccactgtggacagttatggtcagttatccttttggcacctacagctgaggcccttggtcacttctcttgtgatttgttgctagaatggtgggaacgggcaacaagtagaatatctaagaaacaatgtcttccagtgatagcagataggcctgcaggctgcagaaggtggtcacaagttgtcggcgaatacagatctaggcgacttaagtttagtctcacgcattgcattcttttcagtagctgtcagtttcgtattagggagaatcctccagttgtttgttgccttttttttcctttttgcttctaattatctgcatcatttgatctctcaagcctttttgcatgctgctaaaaagaaaataaaggcaatggtgaccagtgttcagtttattttttcactacagtcctaatgctgcataatgtggaactattaggtgtttgttttgctataatggggtcatgatctcttcaaatggtatagattgttcaataacttattttccttcatatacttgcttagtcaatgcacaggttctctaataagtttccatgatggcaaaatgaaatgtcaaaggatttaatgatgatatgatggtggtgatttagtgttgccttatctgaacttttaaatttctttaacaggtgctgttttcaaaccttttggatcctttgtatcaaatctttactcaaattcaggtgatttggatatatcggttcacctccctaataactcaatcataagcaagaagaaaaagcaatatgtcttgagggaattaatgagagtgctacaaaatagaggtaaaccttttttaccatattacataataaaggagcatgcagacttcttctcattgcatgatcattgtacccatgaaataataaccatggcttttgcggtaaaaccataaaaggattccatattatgcaaccacacatttacgcacataggatagcaaaatcatgtaggagtactaaatatgatgaaccgtgtatctttatttcaaaggagaattggacttgaaattcacaaccttgtgctactatattgggcaattctttttagtcatacaggtagctcttatttatattatgatttcgttggttgaattgtgtcaggtgttgccggatatgtgcaatttgttccttttgcaagagttccagttcttcagtatgtgagcaacaccttcggaatttcctgcgatatatctgtgaacaactaccctggtcgaattaaatccaaaatcttctgctggatcagttctttagatgtgcgtcttggtgatatggttttactggtaagactaggtaactagtagagagtttctt

SEQ ID NO: 37452 - DNA, 4010 bp, Oryza sativa
tccttccacctcttaaggagatttatgaagggaacattgaagaaggtattgctggtaaaatgaactaatattttctttgatgatgattgtctagcatatctgtatctgaattcattgcatttacatacagaaatgacggtgtatgatgaggaacatcttgatgaggtttgctctgaaaatttagcaaaatttcaaagcaagaacaaggaacgaaggaatgaaagctctctttgccatctgcttgcaacctttttccacaaagtaattaaacagtatgctccgtttcattggtaaagttagtatgcttcttgtaaggacatatttgctgttcatgtcttggcgaagcatgtcttcatgtttctaggaatatttcctatgccatattttagtaagttatatcgaggttgctggtgctcatgtagtttaataagttgagttatttcaaaagtctttggcccttgcttttgttcagcatcgtggcatcttgttaaactcaaacataccttttctctttgtgttttgtattttttaaactaattaacacttgacagactcttccttttagagaagtaagacgatttttgttataactcaactcatcttccatgctagcctttgttttgctcattttgttataagtccaataagatgatttgtgttcaaatctaagctaagtgaaatagctacttatcttcctttcattaaacataattaaacaaatgagctaatccctcctttttgtggggctacttaattactttgctccattaaactatattttatccccattaaaataatgctactgtcactgaaagcatatttaagatttagatgccatgcacatttttcattcgttactttttgtaactcatgagatacgagctttaccagtaatcttacattgattgcagttttcctctatcggcaccctttcgggtgatgtgatatccacttacacgggccagttcaaacgaatagaggagaacccaagttggatggccagatcatacagcttatttgtaaggatttccttttatggttgcattcagcagtcttattgaaatttggactatttactaacacactctcgttcgttcattatctccttttcaggtcaaagatccaattgagagacctgataatgccgctagagcggttgatttgaaaggccttgagcggattgctggggccttcaccgctgctaatcgtaagtttgcatctctccaacacgccaaacgaaatgacttactggagatgctgtgtacgcctgctgttggctcaaagcttggcataagagttagccaagaagttatggctaactcttgcacaaatactccacggaggaaccgtcatcatggtagaccaacggaacaagtctcagcgaggccatctgataatcaaaatcaccgcggggccagacattaacagtggggaaacaagtccataatcccccacgggcgccgccaatcaactggagcgtaccatgctcttaacagtcaccatgtaattcctgcttggacccaaccagcaggaatttatcaaacagttggcccataccaaagtaatggtcatccacaggggtatactaaaaatgtccaaacagtagggcaccaaaattatgggcatccaatgggacacaacacacagctccaaacagtggagccatatcagagtaataatagtcaaccacaggttcatgctaccagcatccaagcaccaagacaataccagaattatactcgataacgcccggccagaaactacaatcaccaagtgttacatgctacagcgaccgagacaacggccagaaactacaatcaccaattgttacatgctgcagcaaccgagacaacggccagaaactataatcaccaatcgttacatgctacagcaaccgagacagaaggatcataccggaatcagcagcagagacaacacacatctggccgtcaaacaaataggaacgctgtgaacacaaggtacgtgcctgttgttggaaggccacaaaatgtagcatgtgaatcacgagctcaagactcctcaggcaggggaacatggcaacaaagggagccgcgagcaggatcaacctaccaaaatagatagcaacggattatcttcagcttttgcatcgcagtgtgtatgagtttttggtagtttgtgatagctttcgtcagccagcagtttgatctcagtgccgctgcaatgcagcgaactgtattgggtaaaatgcagttacaagattttcttttgtgcagatgttgtcatgttgctacacgcgtggctacgattgattgcgctgtagctgagaactgtttaaaaaaatgaagaaaaaacagtttatttttatatgtatgataaactaataaacgaggtaatctgcagtatcagccgtttaaaagattaaggcttttgtagtagttgggaactcatccttatttacgaaaaagaagcaacaaattaatatataattaattaagtattagctatttttttaaaaaaagttaatatgatttttaaagtaactttcctatatttttttttcaaaaaatgtactgtagcgtgcgaacccagcctaaggccgagaaaagaaaccaaaaacttacatttaaagtaacttttaatacttacgttttggttgtggctgataacccaacaagcagacaattttactgaatatttttgcatctggctattttaattgtctagttgtgaaggaataggtaaatatagggtagaaactaagtcaaaactcatgtcacccaatcccccgaaaaaaaacataaaatcatatataagttccatataaattcatataaaaaatctcacgcgtagatgatatgatggtgggcaacgtttaggttcgactttctttgtgagatgtgatttttcataacttataaacaaagttcaatttggacaatatatctcggtgtccaccatcatctcatatatggccttgtttggcataggtttggatccaagattttatgaaattgggtatccctagcttcacaaatttatagaattggatctaaaaatttatggaattgggtttcctaacttgcttaaacactctcatctttttgggggtttcacgattttagaaaaggttggaatcccaaataaattccttttaatttcttgctcccttaccctcttttttttttctcacaaaatctatatgttgcatttggaacactgccgtttcaaaaaaaaaaatcaaaactcataagggaaaaaaaaaccacgtttcaaacggcttcctctgtggtttccccaaaaactggataagcgttcccctcgggccggctccgacgtgctacggattgggccttcgcgccccgtcccgtccccgctcccgaagcgaaaccaacgcaacgcacgactccctcccactctaccctcgtctcgtgcgcgtggacgactccctttgcctagcttgactcgtgcgccgcctactttcgccaatcgccatggtgcaagccgcctcaacctcctcgcgctttctccgcacaacccgtctccacggctcctccacctccaccacgccagcggagcccgcagcctccgcgtagccggcggcggctcctcctcctctcatcgcgctatctctctctctcggtaaacccctggcctcggttagtatctgaagtggatttctcgcttggtctactggcggggttcgctcgatactcctcctcgagttagggtttggcgaatacgaccaaccccgcggatcgcggttggatggcgactagagcggccgcgctgctctgagaatgcaatgtacctttcaagggttcggtattttagttccttgcttgataattgctactactgcgacaatctcgcggttcgtttgcgaagaaatataaagagggtgccttgctgtggctgtgcacttctctctccttctttgttttcacccgaaagttgtgattttggtgtggggttttgatgtagagaaattgatgagtaccacgggtattgccagccaaatattaattgcg

SEQ ID NO: 37453 - DNA, 2227 bp, Oryza sativa
tttggttgatgtggcatgcaggtgaacgtgggggcatgatgatttagggaaagaaaattatgtgggcctttttctctttcctagatggggtgtggtatgggtgggagtactgccatgtgttaaagaaattgatgatgtggtagccacatgacccaatggccaacacctctagtaacctctttgggtgtattctgcgctggaaactggtggagggatgaaaatatattaaattgcagggtgtacattaaactagagcaaagttaagaaacaattgtagggtgtacgtaggtcgttgcactgttggtttggacttatggagcaaatattttacaatttacattagaaaaccaggacaaccattattcttgtaactgtaatgggtttgaatgcggttatatctggttatggtgcttagcgacgccactgtgtacccatataatctcttttgatcatacgtctatatcatttgttgcccaggatttcaggatgtcgatttggcgtgtccctaattatgatgtgttggagaagtgtacagaagatatcctctctctaatcaaaccagtggagggtgaccgaaacaaacgaatatatgcaattcaggagctggcagatacaatctattcagctggggccttgagaggtaactcacacctaaagttaccacataacccctgtattatttgaaaatcttccgttgggttccttgtatttattgacggtatggtgttgtgatgtttctacatcaagcttggttagacttatctatgatcttgaagagaaaatgtgttttccactttattgctgtgaatgctagcttgggcatggatttctgatagatctctgaaagaaaagacccagtcttataggtgtaaggtgcctctgcggtgcctatcgtatttcttgttatattcataaggaaccttaagttttaaagttatcatcacactttgtctgggcatagtttaaaaatacaatgagtgacatatttatgcaatccatagtacttaaaagtgatgtgtttgttttgtgatcgatgctagaaaatggtcttcatgctgcgattgctgtatggcaatgggaactctacggcagacccatgaggttgctagcaggcaactgttgacctatgacagttcacagtacacagtaaccgttaaccaacaatttgtcatatcatgcctgacaaatgacaatcacgataagcttgtgttgctagaattaagggtgggcataattacctgaaaccaaagaaccaatccaaactaactgagaccaaatacttatgtcagagtttctaactaaccgaatttaatttggttataggccttggttaaccgaattgaccgaaatatagttaataagcgcaaaatcaacctgttaagcctattaagtatcatgtttgaacagttgaattttgatgttaagttgcaagggcctatctttgtgttctatatcatttgttgtttattttggaactttttactgtcaaacatgtcctgaaactggggaattgctgccaaattttttactaccgaaacatgtcctgaaattgatcaatcagttcggtcatgacctaggaccgaaccaaaatgaccaaaaccaaatagcttggcctttatgattttgcattgaatttcggtcttgattttcggatggccaaaattcgagaaaaccaaagaatcaatccgaattaattgttcaaaccgaatggttacccatagccagaatggagctgctcaaatgtcacataatgtttttactggattttttttttggttacattctcttgttatacaatggatagtgtcttcctcaatgcatatattatttatgaagtttgcatgttggaaaagggtaactgttagagaagtcagcagtgcaattattttagtgtttctttttctgagttcttaactttcctttataggtgcttctgtaaaaccttttggatccttcgtatcacaactttatgcaaaatcaggtgatttggatgtgtcagttgagctgttcaatgccttgaatctccctataagtaagagaaagaagcaagataccctgagagaagtaaggagagctttgcaaaagcgaggtaaactttcttttcgattaatgaaaacagctttaaccgaaatgatagaagttttggttgtgtgttctttgggatcaaacaaatagtcacttatatgcatatacatgcaccaaggaaagcaattagtgggctttgcgc

SEQ ID NO: 37454 - DNA, 4976 bp, Oryza sativa
tcccttatttaggtatgctagacatatggagttcattcctaatgcaagagttccagtccttcagtatgtgagcaaccaatatggtatttcctgtgatatatccattagcaattaccctggtcgaattaaatcgaaaatcttctactggatcaatactttggatgatcgctttggtgatatggttttattggtaagctctgtgtaaccaagagaattctctttttgctacaatcttcctttttgttaagccatgttttttggcaggtcaaggaatgggccaaagctcaaaacattaatgatccaaaaaatggaaccctgaattcctattcactttgtctacttgttctctttcattttcaggtgttatttcttactttacaagttacctctatttcttatttattgttccattaaagttatctatatgcgttctttattctgagccttccagacatgtgaacctgcaatattaccaccgctgaaggagatttatgaagggaacatcatggaggacatttcagataagatttcattatgggaatatggcttacctgtgatggatagtgactatctatttgtcagtgccttgctgtttaactgctgcattcacatacagggagggcgtactataatgagaaacatcttgatgaggtttgctccataaatatagaaagattccggcgccaaaatatggggcaaagaaatcagagctctctttctcatctacttgcatcattctttcacaaggtaattgaacttatggccactatattggctagtcaaccttgtctaagagagtatgacttccttctaagtactgtagttctgttgttcaaatacaggtgtatgttttattcttgtctttaggcatgtatctccacattttgttcttaactatgttaatgaatcaacactggcatttttaggccatatatggtctctcttgagcttgttcaaacatatttggtctgcttaatctaactcactgggggtgtaaatccaatgacgacgactcatatgtaacctttttagtaactagtagctatcaaattgtcagtacatgagctaatctcatcagtgatttcatgttgcttaactcaagatagtcagtaaaatacatttaaaagttatctgcaattcagcatttgtagtatgtctacgcaatgaaatttggcctgaaacttccccaataccaaggttcaagggctagtgtcaaaattgtagcctttagttttcttgctttgtatctgggattattgcatctttctttagttttttaacctgaagagctagatgggcttaaccagcaatttatattgcctgcagtttttccgcatcgatgccctttcggataaggttatatcgacttacactggtcggttggagagaatccaggacaatccaagatggatggacaagtcatacagcttgtttgtaaggctttcctttttgatgcttttggtggttatgatgattgatgttgctaaaagttttagcccaagtgctgatattctatctacttgctatttattatgtaggttgaagatccatttgagaaacctgataatgctgctagagcagtcggttcctttgagttccaagatattgtcaatgccttcagcaacgcgagcaataagtttgtttctgatgcgcatgcgcttactgaccgaaatggattattgtcactgctttgcacacctgatgttggatcaaaacttggtggaagagccagtgccagccgttatacaaataccttagtgagtcctcatgacagatttttatgatatcttgactatgtggcacctaacccatacgatgatcatcatcaccagccagccagaggaggaagcaggtcaggtcagagtccacatgggtatactaccaaccgggaaactgcagtgcattaccagaacaataatcatccacaggcatataacacgcagcggcaaacaacagttcatcaccagaaccagaacaatcaacaggtgtatgctgcagggaggcaaacaggaggtcagtaccagaatacccagcgtagcaaggagaacacatcatatcgtcattcaaattggcgagcagcaactacattggcacgaggccagtttgtggatgattctacaatggagaatggcagtaacgctctcagaccggcctcaccatcagcatcagttgatcataactgatggtcctaggatagcaacagattatctttagctcttgcctgacaatatgtcaatatgcatcacatttcgattcccttaggtctcgacaaacaatatgtatgagctcatgaaatttagcgcaagttattgccagccagctcgtatggttgagcgagcctggggcttatgtgcattttgagatctagaagatgtattgctgaacatgcagctctatcacttctgatgttcaatatataactttaggccatcttccttctccatctatctcccatgagaaagattgcaatggaatgtgtatttctggagctctcttgatagaatgcatggtcatgtatgtaccagttgtgcttcgcgtctatgcatgcatgcctccatggccgcagacggaaacaagaaattgaatcaagcaggaacatcaacaatgcgctcaactttagctgcaaatttgaccatcacagaacatcggaacatgcatgtaacacgtcgacgaaaccgtgcgctctgaatgttgagcacaaacagatcagatagaaaccggaactatatgacttgcaacttatatatgacttatatgacttgcaacttacaaaccgttctttctcattgcactgaattatatgacttgcaacttacggaacttgcattttccactttccaaatttgcaatagagctgtgccaaatgttcgcagtgatcagagaaaacattagagacacaacaacgctgatcatggacgattgatctatctcattacacacctgctctgcaaggtatgcccacacgagtacagaacataagagcagatgttgggcattgcatgccgtgccgaactgccgatgcaaggtgacatgctatgtactcgtcgcccagtcgcccccacgcatatcgatcaatctatcatgcaacgcatgtgtaaaacttgtaaaacttggtttttagaaatttcactataattagtgcaaacccgagttgaaacttgtaaaacttgttagaaattagaaggggccgcgcgaacgcataccaccctactctctcacttgtggggagatggtaggttaacactccctcccatgtgtaatggaggccgttaaactaggccatgagctttcttgatcgctcatcgacctcgtccaggtaagaatttctcaacgttgtacccagcctttgttttataccttctctctggccccttcaactcaaaaggagtgatgtggtactaaactgaatcgttaggattcagttcggttcacctgttgggctctcagggggccgttccgtgtaaattcaacccaaataagtagctggctcctatcatagacaagtacaaaatgatcttacccatctggcatactgaattataatgtttacaagctcatcgtattcgttccttttactacaaggacgtttgagtctttgaggtctacaatttgacgtggatggtacatgatagctgaacataaaagaaacgatgcacatactagtacaagtcaaataaattgaatttagtaaagccctttggttaaaaaaaaacctgaattagtgtatcaataaaatcataagtatttctttgagtatggggaatgtctatctatttgtcgggtgatttctaaaaaaaattcacccagatttgttctacccttaaatttacatccaccggaccacaaaagaaaataaaaatgcatatttagttacacaatacttttatcaaaattacaatgcacttacatgccatatcaactgaatttacaaatgtaattttagttaaataggattgtaattttatatattaaaaaaataccaaataaatatttacttacacaacattgttatcaaaattacagtgcacttacatgtcatatcaactgaatttacaaatgtaattttagttatataggactgtaattttgtattttatttttattttagtttcaattgagagagaacgagagagaacagcgtgcatatcaattttttaggggtgtagctatatttatggcgccatatttttcatcaaaaagtagttggcatgtatttacattgtaagtccctaaattacatatgtaattttagtgtatttacaatgtaagtctcaaaattacatatgtaagtactaaaattacatatgtaaattcgaaaattacatactaattatatatgtaagtggggtgtaaatgaagtgtaactactgtgcaagtggctaaaaaaaatcaactgtagcatatggcgccatatttctagcaactccattttttagagcacaaaaaaagaaattagcgcctctaaccgtccgactaaatcctatgcggattcccagcgctatatgtgcacgaatcttggtacttatcgaactgcctaaaaaacgacaaatccgagagaaaaaatcacacgacaaatctatagcaaaattgttgctttaagtaatctagttttcctcctattgtaccaagttcgttcatcctatacatttctacaatcaaacaggggttatcagttggacaatacaagcgacataattcagaatacaaaatcaatttttctatcaaagtttaaaaaacgttttaaaattttaaatattggtaggggccgcgcgaacgcgtaccccctctgccacaaattatgacgtccactcccacttggggagatggtagacgagcgttcctcctaagtgcaatggaggccactaatctaggccatgagccttcttgatcgcccattaaccccgtccaggtaagtatgttcaaacgtagcacccaaccttcgtggttataccctaaaaaccaggtagggggatccg

SEQ ID NO: 37455 - DNA, 1696 bp, Oryza sativa
aaacaaaaccagggctcgcatcattgctctggaccagcctgatcggctaacgcaccatcggcttgtcgcacatcaaaaccttcctgctagcatacgggccttctgcggtgtcacgcatgatggatcgccatcccatggcggttgttatctctttgacatcctgtacaacttgttttaggtcacgaatgtaagccctaccgcctggtctgagtattcgatccatctccagcaagatacttgagatgttacatctggtaacaacagagatactacagttagacgcactgtttatccagaactcagtggtatctttagcagcatagtcaagaacgtagaaaggaatgagcatgaatactatttttgtatcttgcaatgtatcgataaagcatgagatcacctgttcagctatttttatagtcacattgttggggcacataagtgtggatatttctttaggcacacaggtgtttgggagaaaaataaacaggaacataactcgaatttaattatcaaaagaactgctaccttttctgttccttcgagaataggctaaacgcatggagcagatcatatgtccttggatatgtatcaaatggttcacacctgtcgataaggaaggcacaaaaatggcagcatgagcaatatttaaaggtaaaattttgtagatttagtttaataacaccaaatatctaatcaccactgcttagaaacaaacattgatatctaaataaacaagaaacacgtcaatgagaagcattataatcaaactgttgaccactggagttcaagttcgacaagaacacggggcaaggagaaagaagatgcaagtgaccactattcactagtatgctctattaagaacattacgggttgcagtacaatataattcaggaggaacatttataaattataaatagaaccaaaaccctaataagagagccacagaatataaaaatgcataccagtcatgagccactccaagaagtccccggtcatagattacaggcagtgtgtttggctcactaacaggaacaacattcatcacccagcaatcaagtttacgattaatcaatgcagctgcaaacctgcataaaaaattagcaagcaaaatgagatattgcgcaaaacagaatatatcacgcaccaaacagaaaataagtccaatttattttgtctttgtgagaacctctgtaacctagtatagtagtgtcagagcagaaggttactacggttgaaataactaagtggcatagaatctatgtacaataagtgtccaaagaaaacagatgacatattactaatatcaacttatcaacgacataagcagatttgtgatccactagacctccaagtcattgtatatattttatcaacatctgtacttaaaggcatggaaatcggatactaatcaatgtctgaggtaatttgaaatggaaagagaatggacagagtgaagaaaaggccttaaagaaagataaaataccctccaaatccagccctcatgtccaatacattccggagtttgaactttctccacttaaaaacacgaatataaccttcaacaatgtcatcccaaaatttggtttctgctttgaaaagctccttctttgatgagtgtgcatccatttcaacaccttcaagcctttttgagtggctccattaaacgtgcaggccatggaaagggagtcagcccatc

SEQ ID NO: 37456 - DNA, 1055 bp, Oryza sativa
aacccagaggtctttgaaaaattaaaccaaatcagttggttatactccctccatttcataatataaggcacaactacttttttcagatatttcataatatgaggtgtgcatgcatgcatgcaattaaatagcacctcctctctattcaattattatatttaaatcctccacactcaagatctctaattctattgggtgcatgcattgcatttgttacggtgatccaaactaggaggtgatcgtaattgtttcttggtctttgggttaagggtggttatgccttatattttggaattttggaatggagggagtatttaattttgcattaaataaaatgctgtacttcaaatgctgcttcatcatgctctagttaatttgaattcatacttcatactgatggcagaatcagaagacatctcctctacttagcaaacagaaaacccagtatgagcttgctacaatgctagtaataacccacaaaatcaaacactaccccatgttccacgttcggaaaatccaaaggcaatccatcaatttttgaataccttgcatgttatactcgatgcctagtactatagggcatagagttatacactgaagaattgtatgcatcacactatcaaaacttttgtttacagcacactgtcaaaatgtgaaagagagaacaccaatgcgcacctcatctctgctccgaggccaaggaatgggtgccttataccccttgggtgccggcacgaggcagctcagacccttgtccttggcagggcagtgccgctcgaaccgctcgccacgctccgtcgagggcagcctcctgatctcttcctcgttgtcgaggcagggtatgtactccctcatgctctcaggacaaaccgggaacctcccaatccgaaccctgctcccgacggcggggcccgcgtcggtcggctcctgcggcagggcctcgtcggtggcggccagatcggtgtcgttggcgccgccgactacgacgtcgaattcgtcgcgcatcgcgccgtcctcgccgacgatgccgaggcgggcgggagggggaggggggc

SEQ ID NO: 37457 - DNA, 244 bp, Oryza sativa
aatcttttgtggacgaggggttggctaatcttaccagtgttgctgctagatatatctaagcctaaggagacctgcatggattgcttttgggaactaagctgagcgaaaacaacagatgttgtgactgatattatgtctagtattttatcagtagggatcctgcacgtgattgtaataagtgtctgttatatagcagcaggttgtgtatagctgggtgtgtatgcatggaacagcatgtaggcat

SEQ ID NO: 37458 - DNA, 5630 bp, Oryza sativa
tttttggtaacacttggttgactacagccgctgcatatataagaaacagtaggaaatgtgtttttccggcacaaacataagaagactttgggaaacagtgtgcagcgaatagatatagcaccaattataagagtataagttctggcgatatttgattagaacgtgcatatcgtacagacaccacatactatttatacgaattcatttatcgttctgctagccactagggctcgcaagcctgtaagacgtagaagtaatgtcatttggtctaatggcttgcacaaaagaacacatcccctatttatattcccactgcaaaatacattgggcaaaatatgtgagcattagtcttgcttgatcagggacaggagtatacgccttggcatgccaggtgcaaaagaccgctttggtggggtgatattatatggagccctcaagtcctaaagggcaaaatgtaatgtacagtcagtttttctataacaaatgagcacacaggtaatatatagttggctaacaacgtttacttacattttgggggctgcgggggcagtttgtctacgaacagcgcacgcacaactgatgctttctgacaatcatgttcacgaggagatgaactacagatgcaatttgtttgagccatgagaaaactcaaagaaaaaaaataaggaacgtaaatatgaaactgtgcattgtcacttacccttcctgagcaagatcctcatcaattacagaagatttatgttttttgtctggttgtgccatagccaggacctgataaagcattagtggtcagttaggtttgataagggacagacatacatatttgctctaagtacagaatatagtgctagcctctgaagtaggcggtgttgtcccatgctgatcatcacggttatcagttgtggcctatgcataagcaatatttatataagaatttccaattgtttatatgcaagagagtacacattgctggagaatgaagctattagattatacctttggttctgaaagcaccagtggtgtagaaggtgttcatagattgaagagaagagccaattatcgtgtgcggttcaaattgcatcaagttggtgatgagcccatgttgagaagattgccccagaagcatcatggctgggcagagtacttgtgtgggctgcatctagtgaggcaagcataagagaatccacttggtaagatatccaatttctttgcaatgagccacgtgacacactagttctaatgacatattgttttccaaaaactgctttgatttctgatggaactatatctcgtgctccttggacagatgcaaccaggttaagaaaagggatgccaatcaactggtagccaatttctccaaagaaggtaaactcagctgttttggcgtcatggttcgtctaatgggtcgacacctatgatagccactctgtacctattatagaaggtagcagaagtaggtcttatgttctatagctcaaattgtagcatactgaatggtttattatgtaaaataattgagaagagctgaacgtgtgtaggtggtaagagtaccttgtttcaattgcattagtgatgcacctcgagcatttatatgtgttcccttctctacctgctcctctcttactggtgttgcatgctatgtaccaccaggcttcagcagggactaaatccttgatggctatcttgacaatatagctgttgccctagttcacatgcgagaaacagaagaagtaaaggatggcactgataacacatggatggaaattatgcaatgtaatcattaaatgtggggaggtacactatattaccaaggcttcgtggggattaaggtcacaaatatcaaaaacttttacatgcacagcttctttctgaccaaagttcggctctattgcccttaccacctgtgggttaccatggaggcttcaaatatgaaacaaattaatgttttggtttgtaggctagggaaatatggttgatccatataacagataaactaaggaagatataagttgaacaaagaagaagcatgtttatgtgaatggaaagagtgcagaaacagatacctgcttatgagagaaattgtttcctagattggtgcattgggataccacctacaaacagtgctaccttgtagggctagctggtctggcaagcatgaaagagtacattatttaagcaagaacaggcaaatatgtaaatgggagaggtgataatagggtaagaatttatttcttaccgtctcggaatttaacagttaatccaacaaacaatataacaacaggtccatggtctggttgctgctgtaagttttcagcgtggaactgtgtagcatgggcaccccacaatgcaacgacagcagtttcgctgtaggcacatagaagaatgaagaggtggaaaataatgtgcatgaattaagctagtattcacatttgcaaataagagagttgtgaaacaatgttgatattataaacaaaaaagaaggattgtacatgtgtaaaaagaaactgacaatgcatgtgcggacaattaagtcattttgtatctaatacaaaagcagctggaacaattagcggattaacgcatacataccttccattggttatgtggacattaagcaccgctttcataacacctccacaagaaacagtttgcactggtccaatggctgtcattatacctatagcatctacaggagtagtataagggataaaatttgcacatgagtaagtgagagcagtaagcagggaatggacaaagctaataaggaatgagatagattgatctggaccaaacagagtcacctgaaagaatatctttcctgtaagcacgacctctgagttcatcaaaagaaagaaccttgtaagcatgagatgggaatgtggatggtgcctcagtgtcttctctaacggttgtgtgggcagtgaattttgccatgaccatccgatcaataggcctgtactgggggcgcgcctcagcaacttcgaagtacttgatgtaatacacagcatcctccttcagcaaaggcttgaattgagaaacatgacgtcctgggatctgcgcatccatcatgtacccttgttgatgtttggatgtgtaagagacaaatagcatggaggtaaaataaggcatgaccatgtgcttattgctatacctgctcatcaagcaggactaaatcaagtcgcagaatcttgtcaggttcatttgctgtagtgaactgcgagaagcgcgtgacccgcactcggacttgccaatggtgtgattcctgtgtcacattccttagcatagtgtaatccatctgcaacacataaagaaggcattacataggttagagggaaactataataataataatactttgcatgatatgaagatataaagtcctaattgttgaaggaactgtggtgcaggatatatctttttctttttcgaggtgggaaatgtttcccaactgacagtgtttcaagcaggcatgtttaaaagcaactgattgcatccaagagaagaatttgcaaaaataagaaagaacaattaataagcagatatggaagacactgcaacaatcaactggtcaaataggaagaacacaagtatgaacaacaactcattgaagggtaaaaagaaagcagtaacaaatagcgaaaaccaaaaatatggatagtcattgtggatagaacactgtatgaccatgagttcttgcttaagttacacaagcaaacagtaacacggagaaatgggatcatagaagaaacaggtgaacaaaaggagcaaagtttcctagccgcagtcacagtgacaaactgacaataagattaatctatagcaacgataatatttcagtgtagacgatgttcctggtagtggaacaaggcttgccatcatcatcctctatcaacaacttgaggccttgcttcgatgtagcgcgcgaaacagcgacatatagctgaccatgtgtgaagacagggtttctgaggtatacaccaacattccccaaagtttgcccttggcatttgtttattgtcattgcataacatagcctaattgggaactgccttcgctggagcgtgaaaggccactttggactgttcccacttaggacaatccatggaatacagaccagctggccaatatttgtgccagtcatgattttggactcgaaaacataatcactgagtcggatgaccatcaatcttgtctcattgcaaaggccgagtgattggttaatgttgcgaagcaggactacagctgaaccaattttgagggatatgcgatgttcctggaaattgtttatggatattgagtttagaaattctatggggtacaatagatcaaaatctacaggcttttcaagtgtatttgaaatagtgtcgctgctaagatagtcctttgcatccccaggcactttagcaagcatattatcattaatctcatcaacaactgtattgacaggacagacaattgcacgctgagaaaggtaaggaatgcagtcatagttcgattcaaaatctgggtacacagcatcaattatagctgtaatctgtcaccgcagggagtaagcagcaactccttaggtatctctatccatgtcctctcaacctcaccttgtcttttgttcatgggagcacgaccctcaccaatgtcaagaacccatttagcaaactctgccaattcacccctggcttgctgcgacagggatggattatgtagcctcatgttagtggtaaggtgtaagacttcaacatgcttccatagtgcagacctaaccagcgaagcatctaccacatcagctcttgtacctttctcaatcaccggtaagacttgcctaaaatcaccaccaagtaaaatgggtttacctccaaaaggcttatattcattagctggttcatcagcggattgaatatctcgtagagttctatccaatgcctcaaagcacagcttgtgtgtcataggcgcctcatcccatataatcaatgatgctttcctaataagatctcctaggattgtccctctacgaatagcacacatcgaccgatcatgtatatctataggtatccgaaaccatgaatgagcaatccttccaccaggcatgagtagagctgcaaccccagaagaggcaactgcaagaacaatttcacctcttgatctcaggtttgccataatagcattccacaagaatgtcttccccgttccaccatgtccagatataaaaaaaaatacacttttcgtgatggtctatcctgtcaaaaatcttgtcatatatcatcttctggtcattgttcaagctggcatacatggacaaagattcttgatggaggctatgttggttaaagctaagatcttctaagataagcctgtttgctgcactggatcctgaacaatcaactggtgttggcaaattgtatgatgagattgataagccattatttgagaacatggcatccaactctttgagcaaggtatcctgcaacataacttctggaatagctgtgcgctgtactccaagagctttggttaacttgtaagcaaaatcatctaccatgtatctccagtacttatcaaacaaaaccctaacatcacctacatcacagtgtgctagtacagtcatgaaaaggttcctgagctggtatgaagta

SEQ ID NO: 37459 - DNA, 2741 bp, Oryza sativa
cccttatttatatacttaaaaaggtacttgataaggtatgttttattgcaccattccacattgatatgagcttggaatttcttcagaagagctggattataagggacaacccaccggttatctagtgaaacaccattcttcaccacatagcagccatcattgcgtcatcgataaataggatatccatcatcatctatggtagtaacatcacagaactgttttggatagccctttgaacaccgaccatccttcatgcaagggctgcttggattgtgctcaccacatgggccatgtatcatgaattcatcaacaagaccaacccacacctatcagctgttatatctggtatctcagcacagattaggttgtcaatgaatgcaggtgaaggatcttcagattgagctgtgagccatgttaatgtgtgggaatgcggcaatcctcttttttggaactcaacagtgtacacaactgaaaagcaaagcaacaagaaaagaacagataatgtgttaggggaagcaatagatgtgttaggaaggagatgtacgtaaagataggacagctatcatgaataagacaagtaacacaccagcttttatgggaccgaaggcttctccattcttaatagatgtgatgtactcatctagcttcatatggtaaacacgtgtgaccatatcacttctatcacttggtttttgccctgcctcaaaacgaatagcttcaataatctctggccatttagaattgcaggtgaaagttgagaatatttgaggaggagccgtaagaacggcagattgccattgaatcatggtagttttgaaccatgtatcgccttcctcctatgaaacttgatggcaaaattacttggtgccaacatcctttccatcactgtctcccctagcaacagcatcagatataccttgatgtgtctcagagcgaagttttttctggttgagggcatggtatatgagtcgagatgtctctatacatgagaaagcattcacagcgagctgatcagaaagcctaccacaacaggtgaatggattgggctcatcctttcgatagtgggactcgtaccgataaaattcaagcatcgatgcttcgtcgtgactaccgggtggctgatcatctacctctctaagcttgataccagtatgaaaacccacatcaccatatgggaatagaagcgggtactgcaatgacataagggctggatgaataggtgacaactgacataactcacctgaatgcttctgcacaatgacatcaaactttgatacctcacaagatgcactaggtataatcagtgctgccaactcagaggtggtgggaaggctgtaacggtcactctgagaatggcctgacccaatgagcttgatagcaatctcaggagcacttgaagaaagcagcttgtttcgagcaagacggaactgctgcacaagaggattgaactgatcaagcatcgagataagctcttgcacaataacaggatcagggacatccccaggattatcagtgtgatcaaaaatattaagcctattctggagctcattggcggtgtcatatatgtacagctgggcgaattccggacgttgtccaggagcaggaaccagagaaccaattctgtgatggacaacaccattgatatgaaaacataaggccccggaccagtgtttatgctcctatcaatgttagccccaagcgatgtgaatgcaaataatgaatcatattgcctgatgagtcgcatgaaagagctggaatgggcaccgccatcaaaacgaatcaagtcttgtaagataggaggaaaaggctggggcgggtaaggagatctttccaccacgacaacacagatgtatgcaatcctcttggctctgtgcgagctctggctaacaaccctttcttggtaccaaaataatgcaccacaatgattgcattcatagtcagggccaccataataggagcgatctgggtacgtagctataagagcggaaaggaaacctataagtagagaagcatgcatatgtttgtccagaaatagatagagaggcaaaaaaaagggacaaaggcgaagcaaagcaaggttggtactaagatattacctttaagaatttgcatgtgctcctttggtatggaatatgtgaatctcatcgacagtgaacgcggcacatgttctgtgcaaatagaagaagaacggaagaagagaaatagcaaataagaaataaaggtaaacaaaagcaagaaagaacatcgccataagcgacaagaaaggatcatgtacataagcaggtcaagaaccttgtcgcaaaataagacgcattttcctagcggcctgtcttttttcccggttcactcgagcaacacgtgctggcactattgggcaaaaatgatctcctatgaaaaatttaaacaggaaaaacaatcaatcggaagaagggaaaatgccttagcaagctaagcaacacaacaaatagtagtccagagctaactgttgggtcgagaagactgaatgtggccagctccacaactccctgtggaagtgatgcgaggagatagaatgagggatcggagagaaaacaaagctaagctagaaagaaccaatgagcaaatagatgaacttatcaatatgaacatacattttgagtatatcatatcacagcaagtggacaactgtacaaaaatatgagaaaatggatgtgcaagggataagagatgacactaaacattgagacagcagcgactacagc

SEQ ID NO: 37460 - DNA, 2303 bp, Oryza sativa
cactcccgtggacccggtccgcgcgccccctcccctcggctgacgcaataaaccctttttaaattaaaatttaaatgaagaaattcgcaaatattcatttaaagagcatataaacttcaaatggccataacttggccatttgaactcggaattggaccgttcaagtctcttttttttccttaagaagtcaagaacccatttttgtgctttgttcctacttgttatatggagtttattagagtaaaagcccttttatttttccgttggtcatgtagacgttgcagcttcggaagatccgctcttcgtggaggttgaagccgacgtttgggaaagtgagcaaggcaaatcacatcatccttgaacatattgaatcccagtttataaaattattttgatttaaattattgcactatcgctttatttaaattctcgcgttatcactgttttatctagccatgcctatttacctttgttatgaccttattattgttattgttattatttccttgttcaccctagaataaacaaaaccccaactagtggacactctactcatggtaccactagtatgattttaggtagatgcttcgctggttaattaggcaacattaggtgggtttacaactctagactttgggaatactcttatcacctggacactatggaatggttggattattgtggaattggattcacacctccccctctattcaaaaccctcaaaatgattttaggctgggcttggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctagggcaaatgaaggctacacgagctgcggcccggtagtcgagatgtcatggcacagggccggtgtcctgctgctaggggctcagtcctgcctacctatcccgggggttccggccgtaggtggggttgggtcggtactcttgtttatggctaggatgggttggaaactatgtcatgtcttccgtccgtataccatggtggtatgtggcacgtggttacacgtgaggaagatgtgtcttgtgggtaaagatgtacacctctgatcagagtataacctattcgaatagccgcgccctcggttatgggcaagccgagcaatgtacccaagttagtgttttaattcttaaaacctgcctaacagctaaaatgtggaatggttggcctgggttggcttgggacaagctgggacccagggtcgggttgccagttcggtctgaatcatcgtaggccttgggttaaggcaggttcgtgtgggttcacggccttagttaataatattgtatagctctaggaccgtgtttacaaagtagctttaagcaactaagtgacttttaatgctgtttactgcaaaccctaaccccctatattatggctcccttgtactcccttgcatttattctgcacttgtgggtgtgtcttgttgagtacggtggttgtactcagtcttgctcaatttttcccaaacccagaagaggagcccctggataatgaaggctttggtgtctagctcgtgcctgccgtcaagcgcttgtggtcgtcgccctagtcttccgctgtttttcgtttgtcttcttgtgtgctgggtcttcgtcgcccatgtaataaattaattaattacgcttccgcttgttaaactctgaattgtatcaacttttggtgtaccttgcctcctgggacaaggaataatgcacgcacgtaaggaacgcccgttaggttatttctggtcgtgacaccatagaagcgctatcctggcttggcagctgatcaactgtaacaaaacaacgtgtcatgattgtattggataacggctggctcaatcgcccggaaggcagctaatccagcacctttaagatatttaatattagggaagcgttatatctgttttgtaattttgtaatattagggaagcgttatatctagaattgcagtttagtgatgattttaaaattcgaggacaagaaaaagggatgtcaagtgaactttttttttttttcataaaatttaggatttctacataggccgatttattttttgaaaactcaacaatttataagaagggtttttagggcaaaatcactaaataatttgctcgtggcccataaataaatctacatctatatacctaattaaaaatatgtaaggcttcgagaaggattttcg

SEQ ID NO: 37461 - DNA, 1641 bp, Oryza sativa
  unsure (1)..(1641): unsure at all n locations
ccagtcatgttcaccaccagagctcgccattgtcatttctctttctatcgtaccacattgttgctagccgcatgcatgtttattgattttcttcttagccaacccccaccatctatggaccactcatataatattgaaaccataggaatatgaataaaacatgaaaattcgaatttatgttaataaaacaagacctattcagaactaatagatcggattttcatctatatgttaaaataagctnttttaaaaaaaattctagttaatttcagttgtttttccatttccatttttaattgtagcactatttgatccactaaaaattgttgtaacttataatattgaattgtttgtagctaaattaaaaagtaatttattgatatatttttttgatattaaattatcgttccggccaaagttatttgtagtttcatgttgatatttctatgattatattgttcttcagtccaattgtgatatatggtttaagattttagtttaatcatatttctttcattccaattgtgttatatggtttgtaattttagttatgtcagtgttatttagcaattcgttgcaacgcatgagtattatgctagttaattagtaatgagtaaatttcattagcggtacataaacttgtcaggtgggtgcaatttagtgtataaacttgtaaattactcgttttggtgtatgaacttgtctggtatgtgcaaactaatactaaaatggcacgacaagaccgatttttctatgatgaacataataaattatatattagtagatgtcgtgcttatacatagtagaaatgttatatttataaacttaggttccaatttatctttctttgtttctgtgccatgcatcattgctcggatgtttattttttttatgcaatcattataccttattatatatttatccttcttagacacatgtttacatagagtttaatcttgccgtgcgattttgaccttgttcacactcaccaaataagtttgtgtactaaaacgagcgttttacaagttcatgtattagattgcacccacctaataagtttgtgtaccgctgatgtaatttacttattagtcatttataagagaggaattaactaatatatttccacgtgggtgatttgactatacggaagcaaaggccaactaattaaacattttcttgtataagaatgatttctctcgtattccaggaatgcgaatcggtgaatttgaagactaataaagagagaagacgacttatgcatggcttctaaattttgctaaccgtgactttgtggactaataatttcgtcacatggttattctttaaatatatcgtctctgtgccccagctggttaactttattttgttggagtccatccgtggaaataactgtggcttgaagttatagtaaacctttaccctcgtgcatggttcatgattgaagtctcacccaacgttttgtcacaacgttataaaaatctaccccacaacggttcaacatgaaagaggcccgttcaaatgcgcacgaccgagacaaaaacaccatattttttgccccgaacccaaacagtgcgtttgtgcgtgcaccgacaccactgttgccaccctatgcggaatcgcatttcctgtaccgtggaaatc

SEQ ID NO: 37462 - DNA, 592 bp, Oryza sativa
  unsure (1)..(592): unsure at all n locations
ctaatcggctgccttctattgacggatgttggccgattgtaggttagatatcgatattgccaaggattatgtaggatatatgataactcgacgaaatacataaacaagattagagtgtcataaagatggaagcactaatcctgagaacgcaagccgccataacaagttttacctcttgttgaagatcgaaaccgatgcagctcaacccgaaagcaagaactcgtcgaaataaaactaaagcaaaaaggtagcgatgcgccgggattgtattgaacgtgtatgttaaaagtaacataggactcgggtctatttatacccaaaaatcacaagatatgtccataacggatacaactactatctctaacaaactctaagataccataagtctttgcggcagacttttgcccaagcatatctccaaggagattacataaatcatcctaattaatagatacaattggcttctcaagactctatccatgtgcggcaatcaccttaaagcgccttaatttaacccgatatcatacatcagtatgcattggccgaatcggctgcatttgcttacctagctcgactaagacccagncgatct

SEQ ID NO: 37463 - DNA, 1494 bp, Oryza sativa
acgtggttcacgtaaggaaatgtgtcttgtgggtaagatgtacacttctgatcagagtatatctattcgaatagccgcgccctcggtatgggcaagccgagcaatgtacccaagttagtgttttattcttaaaacctgctcaacaactaaaatgtggaatggttggcctgggttggcttgggacgagctgggacccagggtcgggttgccagttcggtctgaatcatcgtaggccttgggttaaggcaggttcgtgtgggttcacggccttgattaataatattgtgtagctctaggaccgtagttacaaaatagctttgagcaactaagtgtcttttaatgctgtttactgcaaaccctaactctctatattatggctcccttgtactcccttgcatttattctgcacttgtgggtgtgtcttgttgagtacggtggttgtactcaatcttgctcaattttttcccaaacccagaagaggagttcctggaagatgaaggctttggtgtctagctcgtgcctgccgtcaagcgcctgtggtcgtcgccctagtcttccgctgtttttcgtttgtcttcttgtgtgctgggccttcgccgcccatgtaataaattaattaattacgcttccgcctgttaaactctgaattgtatcaacttttgtgtaccttgcctcctgggacaaggaataaggaataatgcacgcacgtaaggaacgcccgttgggttatttccggtcgtgacaagttggtatcagagcccccttgaccctaggacgagccttagatcccaagcctttgcaatattttcaaaataaaaatgatagcgaaaagaaacataaaaacacgcacaagctccatcgggcaaaagcacatatgtgttatacaaaggagcaaaaaattacatcatccgtttcagaacatttttgccccgcccctactaagtcccgcgaacacggttcgtcatctatactgtacacgactctaaggggggaaggaagtgaaatacacaccgacgtcaagcgataacaacttgacgattagtcatttcgaagtctaaccaaagtgtggcaatgtcatcgcggcgctggatgtggcaccggccgtaatcctctaaggttcgaccgggatgtcttcgcctccaattcgccattttgacaaccacagctacataaaaggcgaatgcttgatcgacgaaaacgccaggggggcaaaacgaatcggccgaagcatcgctcgccgaacattgaaaccgcaacagcttgtttcggaataaagataccgaacgccgttacattcaacttacgcaaaacacaagcgtttttcccaacgcaaaatgctacgagtcgaaaacggaagtcgaaagctaaaaagtcaacaaatcttttcgccaatccccaaaagggggccgaacgcatgactttgggcaaaatccccgctaaaacaatagggaaaaggggaaagaaaaaaatacaagtcaagaatcgcgcaaagca

SEQ ID NO: 37464 - DNA, 1051 bp, Oryza sativa
caagtatgttgttgggaaggaagacaatttgccatggaaattctaaaatatttgttgcatattgatgtttgcacaagctatagggaggatctctattttggcaatgttatttcgtaggccagaaacttccccaaagagctccaggagaacttttaggttttcaatctccgtggagtctggctttacaaagaatgctacatcatccgcaaatagggagattctgaatctcaaatttccaattccaaggggagagattacccttgattgttcagctagtttcatgatattattgagtggctccattgcaatgatgaagagaaaaggggagagagggtcaccccgtcttaggcctcttgcatgtttaatgggctgcccaggaatgccaattacgagcacttttgaactagacttttggaagagtgtcgaaatcccatttctccttctagtgccaaaacctaattgtgtcagaacttcaatgtgatattgctagcttacagaatcaaaagcctttgaaatatctaatttgagaatgagtgttttgaattttttcctatgaagccttttgaccaagttctggacatacatgaaattgtcatggattgatcttttccttatgaaggctctttgattgatgttaatcatctcatgcattgtcggagtgagtccattggccagaatcttagagacaatctttgcaaagctgtgtactaacttattggcctgtaatggttaggtgaagtagcatcttcttttttcgggataaagcaaatatgagcataattcagatcatccaattggtttaggttatgattgatgaaagattggactgcctttaggaggtcaagcttgatgcagtttcaaagaatttaccaataaaaccatcaggtccaggagctttctgtgcctggatagatttgaacgcctgctctaactctgctagagtgatatcttcttcctggtcattaaggtcaaactattgcaagctgatttgggtccaatttaaagttgattgacttatgtgggtttgcccaactctttgatgaaagaaatg

SEQ ID NO: 37465 - DNA, 7720 bp, Oryza sativa
tagtctagatctctgtcgaattttgattttattgagcccaagaattttgtgcttcaagctactgtgcagaatttgttcttcgatagaaaaggttcatgatttctggacaacacctagttggaagataacctcgtttgtgatggccagttgaagtattatgtctcctacctgtttcgctacccatcttcttatatctcgtgccaaacgtttcagtttcatgttaggaattgctaaagggtttgtggagttgattggtctttcccaggagcttgtgaccatttcttgaaaggaatggtagcttaacctaaagctctcgaaacagaaatggcttggcctaggggatccatcactgccctacaaaaggaggggagcatggtctgaacaggagctggataggggcaatagtcaagcaaactcgtagggcaaatctcaatccatgaaatagaaagctctgtcaaattttatatctcaatccatgaaatagaaagctctgtcaaattttatttgagttgggttgcttgaggtccctgcccaagtgaacattcttccctggagagtaagcacttttatttgcaaatgaccaatggcccatataaacctttgcatcatcctcaaatcaattctcgagttgtttttgtcataggttttgtagattggattaaaatctccaattattaaccaagaaggtaaaacgatgctcatgttgtgctcaagctcttgtagaaaagcgagtttctctgcatcactttgtgggccataaacagctatgattggccaaaatgtttgttcttctctcattgtgatggtagcagtgagggagaaaactcccaatgtgacagccgttaaccgaaagaaattctcatcaactgcaaggattatgcctcctcttattccttgggctggaaggaaaacaaaagtattccgaaatctacttcccatagattgaacaatgcagggtgtgttcacctcctgaattttagtttcctacaaacagacaatcgaggcacaatgttggttgatcaggagtctcagagcttccttcttggtcggtgcatttaatcccctaacattctaattaaatattttgcagtgtcgttaagccattaggaaacaaaataaggccactaagagcatccaagcatagcacaagggagaacaaacagacaaggaaaggtttcaagagcaagagcagcttaggtttcttctagcagtattcacagttggagatagcgcgggagaagaaaactgtactcatgtgaagatacagaagtgaaacatgcttagaacaagaataacagctttaaggtctttgcaacaacatccatagatagtgcacttcttaacatagcggggaaggccttatagccttgttggtgcatcaaaactacataacacatcatacaccaaaaacattccaggttcctagaggtttgcatcacacctcctgacttgatcactgggggtttgccgtccattatttatctaggtgcctactaggttggttgcagagtagcttcatgctggcagatcaattgtctacgtcttggcaactttgaccttgatctgtttgcagccatccatctgcgcaacgtgagtgacttcttgaaacattgtaaataaagttttttttgacattctcatcaaaagagtcactctcattcatgataacaaatttcttagaaaggatttcttgagctatggtttcaattttacatccattctttcttttcttttcaaccctttcgctgtgcctttgagtagaattaagggtcacctttgggcgatgggctcggatgcgtccaagcgacagacttgggagtagtgggacctagactggcgtcaagagggatgccaccatatccccaactatatccttttcaatcgtgctggctctcaggatggattcctgccttggttcataggttggcgatgcctcgtcatcagcattcccatccacggagaagttcagttggggtaggtttgcctcaaccagcatcgaatcatcatgaaccaactagttcgctggaacttcctaatggagaaaaaagaactcagttgggggcaaggagactggaataagaagagctagtgacccgtcattgggactcttgctgcggcgtgaagaacgaggcttgtaggggggagccagcagatgggagagagaaggcagagctagtgttttagagctgcgtcatggtgaggtaggataaagagaaggtctcacctctccgtgctctttggatcggcgattgtgacccatggagatcgatggctcccttgctctctgcctgccatgatttttcctggttgtagtagctgtgctcatcacccctatgcactctgccgctcgagcagccagtgatatagccctagagagagcacgagcgtctcctgtggcatggtcttggtcgcccaccgccaccatctgggtcatcctccaggcccctcaccgcgctcagctccggcttgcatggaataggaagtggacacgagtgcgtgcgagaggcatcgtcctagaccacgtaggtccattcataggtcttgtagagcatgggttggaggtcttctagggtgtctaggtggaggatgaccgggtaggtccatcccccttcagtctcggcaatggtgggttgcatagcgggtcgatgtccaggaatggcatgtcaatggggatcagctcttcatctacattggagacgcccagccaagcttcttcttgcatccgcttcagtctcaatgaagttgatggagcacttgggctcgacaagcttcgccgtcaccccctcagtgtgaccatgcatcgggatcccctcaatgcataggcgcacacggtagtgacagctagaaggtctgatgaccctcatggtgtgagtcccaagctcggagatggtaggaacagctagaagagcggtcaagccgtagagtgcacggaataaagtccctatcagcaggcctagccaatgtgaggaaggtagcctcatcaacgcagtcactgtggttgtccaagcaccacgcaatgaaggagcagcacgagaacttttgccgaagcctctcgacctcgtcagttgcagccactgtcaccgtggctgccactagccttctttccaatagttcatccatcgcaaccggggttccacgaggggcggccactcgagaatccggcagggccttcttggtgaccgaaggttggtgggggagaggtgggaactgagagggatttgggagaagaggggggagcaagcaaggtggcaggtgaactttgtcccctactcttcgcttggagcaattaaggacttcatgtccaatccctctacaaaaccagcgtttgaagggctctctgcaatctttaattttgtgatctggagcaaggcatctgaaacactttccttccatatgtttaaagaaacgagctcttccttgcttgtgttggtcctgtggatctgcttgagcactaagggattgctgtcttctccactagtgttttgctttgacttctttccactagggatctgagataatttgggaggatcttttaatctactgagatggaggatgtgacgaggtagagattacacttccgctcttgagtactctaggcgtatcactagcgagaggcaatttgcttcgcctggtagataacctcttgctcacaagcaaactttggggggcagcagctaaaggaagagagtcactggctgcaattgaaacctaactgactggggtcagtggagcattgatgctttcagcaggagtaatcaagacttctttgaacgttttgtagaaccgctgctagggatggttctggatttgctcatcacgtggaggaggcgctaggctttccaggtgtgaaaccagatctagatctgaggggaagagtggcttaccttgtggtggaagacgacattcaagacctgagagaaggtttgagatgttacggggtggagagaagttgggcaggagagaggtctggaggtactggctggccggaggtgggggtggaggtggtggcgacagctagttgctggtgtcgagggtgggtgtctgggctaggggacgacatatttattgctactccctccgtctcagaatataacaacctagcaccggatgggatgtattctagtactatgaatctggacagccccctgtccagattcgtattactatgatgcgtcccatccgatcctagattgctatattctaggacggagggagtaatcacttatcatgtcattagtttggtgggctagggcctctagctatagctcaccacaaatggaatccattttttttcttaggccaagtgctcccttagaaactgttcaagccagtctcctactcaagtatagcaaaccaaacaagtctggatcaaccaaaatccaacaaaccaaactcatcccatatcgaagaagaaaacaaaaagaaaaaggtagcacaagatctgcaactaggaatcacgtgtacaccttgtcgtcatctgcctgctagcactagtagccacaagatagcacattgtatggaaaattaattcaaccgggtaggttaggaggccgatgttttggtgcgtacgtacaaggatgtcaagcttgccgccgaacatggcggcgaccctgccggcgatcgcctccgggtcagcgcgcacctacgcgtcggacggagacggtgacggcgagcttcttggctctccactcctccagacacctgttcagggtagcctcgttccgggcgcacgtgtgcaccgtggcgccgaagctcgccagttcctccacgatggcgcgcctggatgatgcatttatacatgcttaatcagttaatctgctgccatcgatttaactagcatctactaatacgccgaagcaacgattcgatgacttggtgaacttattcatagtataattagatgttaaaagttaattagaatcaataacaatttaacactggctgaagagctagataattaagagcacaatctgaagagatagatctgtttcactcttcaattctgaaaacagatcgatgggaaagcttggattcggcgaaggaagacgaattaattacccgattcctttgctgccaccggtgacgagagctgtggcgccggcaaggctccaccgcccgacctccggcctgctgcttgtggacatatcggcgtgcctccggtttgtgcgtcagacttgtgtgttagtgagacagcttgcagttgcagcacagggtcgagtacttctaaaggcgtaaagcattagccgtctgcactaggtgcttgtctagtccgctggccctgtccgcctccttgtgtccatctcatgaatatctttgacgtgtatttgttcagatttttctttaaaaaatactattttttatgggaaaagagagtatagcatatatcggcttgtcctgagttatccattgactttagacttgtttagttctctgagacaactccgcatccgctgtccactaaagaaacgggatcggttatctgtaatgggtttaaagcatcatctctttcggacagggcacccgtcactaagcaaagatcagtaatgtgagaaaatatcttaatcgggcatccggccatcacgaacgaatgactctcatctctaatgggcctaagctatagcctgtcacggatgactctcatctctaagcacccggaaagaatttttccggtcggtcacccattccgaaattgctctaggccaagcacgcttaatctcatagtttttttttaagattggattccgaaaaagaaattgtaacttgttggcatgagtattctattaatcctattaagccctgggcaaggatgtcacaccctagcattccctattcatatacatttattcatatacctaactatcaatatatttaatacaaccacattcatataacatccattttgatcatatatttcaccagcaaaaccgagttaattgcatcaaatatatatttagcaagtattatcacgagtagggtaaatcagacttctaggcaaaaatgaatttcaaattgaattttatggtactagatgaactcatctgaaaaagttgtaaaaaacaaagttgtagaactaattgagatctaccaattttatttagggcaattgcatatttgactctgttttgaaagccaactactaaattgaccctgttttttttaacttagcttattttaccctgcttttcaaaaacaaacatcaggcctgaccctattctgtcaatccaacgtaacagtgttaacttatggctaaaaagacatttatgcccttgcgtatttgaccgtgatttgttttctattcggtctaatttcatacacttagttgtttaaaaataacattttaacatatttgtgacacaaaaatttgacgaagaatcgataaaactacaactgaagtttaactaaattttggcagcatatattatccatcacaaattacatatactgaagaaaaaactaagagctagctagcctgcggccctggagtgcgtcgcaccaccgccggccgatgcccggagaggtggaagccactggccatagaggcgcaggggtgccgacaccgttcctgtcaccacctcctcaaatctcatcgtcactggctcgccgctgatgcaccgtcgccaatgcgaggaagagaggccaccgtcggcaccagcacagtcgccgcatggatggagagcaggtggaggagcttggcttgcatggtcgccggtgtcgggacattactccgtcgcctggaacagctaagccgccgtggccatcgactgcatgaagcagctgcttcgcgcgtgtgccgccgccgccgccacaaatccctccgcgccccggcactgccgccgctcagctggtgcggatcccctccctccccgccggcgcagatcccatcccgtcgccgctgctgctccctcccaccacgtcgtgctgccgccgctccctccctccagcgtcggcgctgctatttcctcatacgccgccattaccactcgcatttatgatacgagacatccagatagggtttattttggatagggttcctggagggtattttggataataattatattttttatttgttttttaatgaaagcttaacggagtagcgaaaaaagggtcagaccaagtgatcagttttaaaaaatagggtcaaataagaaaaccacaaaaaatagggtcaaattggtagttagcctttcaaacggggccaaataagcaattgtcccattttattttggtcatttttctatccgagtttgattaaactatataaaatttgaattctaaaatataagaaatttaaatatttttttgggtagtaaatgatttcaaatgaaaaaattatcaacaacaaagttgtatatctcctcaagatctataacttttacttttgtctttctcccatataatattttttgaatagtttcaatttgaatttgaaaatatgacaacttcaaacaatattttcaaatactaaatgatttcaactgaaaaagtcatcaacaaaaaagttgtataattcatcaagatctataacttttatttttgtcatttttctatataacatttttttgaacagtttgaatttgaatttgaaaatatgacaacttcaaacaatattttcaaatactaaatgatttcaactgaaaaagtcatcaacaacaaagttgtataactcatcaagatctataacttttatttttgtcatttttatatataacattttttg

SEQ ID NO: 37466 - DNA, 2956 bp, Oryza sativa
aagttgtcatattttcaaattcaaactcaaactgttcataagaaatgttatatagaaaaatgatcaaaataaaagttgtaaatcttgataagttatacaactttgttgttgataatttttctatttgaaatcatttagtatttgaaaatattgattgaagttgtcatattttcaaattcaaattaaaactattcaaaaaaagttatatataaaaatgaccgaaataaaagttgtaaatcttgataagttatatagctttgttgttgacaatgtttccatttgaaatcacttactacaaaaaatttgttttgactaataaaatgaattattatactacagttaattattttgcacaggtcaactcacaaatataaacatttcatatgaaaaatggaaaaaaaactaagtcatctcaattgggcataagtacagagcccgtcacgaatgagtcatctgtgacgggcctaattgttaccgattgagatataggcatacatatatgttagatgggtagtaaagtcaggcccgtcacggatgacacctatcagtgacgggccgtagtttaggcccgattgagataacattacatttctcaatcgggccctaagttggcgcccgtcatggatgacctaaactaaggcccatcagtgataggtgtcatccatgacggggttgacttttatgcccatctaacatgtctgtgcgacaatatctcaatcgggcgctttttcggcctcatctgtgacggcctgctaattctagtcatgttagctaattctaggcatgtcaggcgctaaggttctgtactagtgatctaatagatcatggaaaatcgggcgctctcctgtagctgccttatatgtgcatgttggctctctctcactctgatgcatgcatacatatgtaccgcctccccatatatgattgaccaccatacattcatacagttcttgctccacaagttctttctcctctctccgtacacaatttaaaccaaaatcatagtttcttttaaattaattattgatctttaatctaattacgtagttgtatttgatgaaattaaaacgttacaatcaaatctcacaacactatatttcaaataaaaatataattatattcttaattgaaacattgtttcatcatacatacaacatgatttatagcaggtgaaacatcacaacatttttttaaaacatccaaagaatacaacgtgcaacatttgtaaatgagctagtgaaacatcagataatatttattgcaatatctaaataacaccacgaaaaccacgtgcaacatttataaatgacatagtgcgacatccgaaattcttattgcaacatccaaataacaccatgtgcaacaaacaaaaatacatttaaaaccttaaagtgtgtgtaacacactgaaaattttgaatttcaaatatggaaaacaaaaattttgaataattaaacacctttctcaaaatttcttcatgcaggttgttgtcaattgacaactgcatcacgtcgaaggacatggttcagttaacaatagttggaaagtaaaagcagccaggcccacctgtcaatggttgttggaggcgtatcacgaggacctttggccgggcctaccgaaaccagaggtgatcaaaagtgcgagtaggaagaaagcggcgaagatcggagaaactgcatgggcaaaggtgatatggcgaaagcagtaacatggagcctacaagctttgccaaagacagacctcgccatggggagacacggtcgaaggttcgaggcaaaagccttgccacggagagcacgagtttcgccaggcatcaggtctcaccacaaggaggcccaacaggccgacacacccttcgaagctttcgccaaaggccgggctgaaacactcaacccattaagggcccatataagcaaaagacacaggatacccatggagatgtccctatcataaggctaaccatgtaaattcccctgtaaacccaagaccttaaaacggagagtctgtaatagggctataagtagccccctaggacaatgtaacaggggatccaaaaaaattttactatgcaatataattgtctttacttccaactacagttgagagatccacgcctttcgacgtgatgcagttgtccattcgacaacagctggcgccgtgtcacaccctgaagttcttttcccaagcctaaattgaatttataaatgacctcaagaaaataccgatgtaaaagcaagagcgaaaccctaataaattaatgcaaataataatcggaattggcatgtggaatttatcttgagttctacatgtcgaaatgtgctaacaagatttttagtggaatttttagagctctagaaataattttaatcaattaaaaatgagcacaagcaatatttaatccctggaaattcatttcctcctttttctttttattttccctccttttccttttcgaataggccgctggcccattctcttcccctccccgctgggccggctgaaggccaaggcccagcagccggccgccttcttccttcttcctttgggtcgccgacaggtggggcccacctgtcgggcccgtctcccagcttcagctcccacaaccgccggcccgctcgctcccgcacctcccgggccacgttggccacgtcgccgccttgccccggcttccccgcgcccactccctctctttcccgcccgcgcccgcgctcgagacggccgggattcgaaattcgaatcccgtctctctcttctccccacctctccccactccgccggcgaaatcgcggccatcccggccataatcgacccccgcgggtctatataaagcgcccccgtctccccctctctctttttcgttttgaaccatccactcccgtgccctccacagccctagtgccgttgcccttcttttcgccgccaccgccaccgctccggccaccgctagccgccgtta

SEQ ID NO: 37467 - DNA, 8540 bp, Oryza sativa
tatcatgttcgctaggtggtttcggagctcgtgccactgccgtcattgtcctcttttgctcgccgacgtcaatcggcgggggtgaggcacctcctccccttcctccctctctcccacgcagcttagccgccggccgccgcctagccgcttagccgccgctagcgccgtccgcgtcgccgcgacgtcgccgccctccgcccccagccggtcgccgccggtcgccgacttgcgccgccacggcatcgagccgtgccgccgtgcaccatggccgccgggccggcttgagccgcccgagcgcgccggccgcgtggttccgccgctgagggtagatcggggccgtcggttcagctgcccgcgtggctgccaggtggccgccacgtgtgcgccacgtcggcgccacatcagcgccacgtggtgcgctgccccttccccggtccatggacccagtccaccgcggaccgccacccgagtcactgacatgtgggcccgcatgtcggcgccgccccctctctctccctgggattttaattattgcgcaataaatcaattaaggattttaattattgctccgtttaagcccattcaagtcttagtaaatcaagaaaaatgcatagaatccattaaaaatggttttgttctctgtttcaatagtcttatggcctgtttgtattgtttgttttgtatgtcgcttagattccggttctcccgacgctccggtgtactttgaaatagtcgccgaggttcctccagcagcaaagcaaggcaagtcatgcattacgattgatcatattgtacccaatttacaaatgtcccgtatttctattaaatgttgcattgttttacaatgtcatgtgggatgggtcctactactcggccatatattgtttaccttttgccattgataacttaggtattaaaatgattagatgttggtttagggaatgcttagccatgcttagttcaaccagtacacaaagggggatcactttaatgcctagactttgattattggcatagctttggattagtaccaccgcaatggtgttgattaattaaaatatattaaatggttggctgtgggtgcatgattttgatggtcgcgcccatggcacttaaggaccggttcgcgggatgccctggaagaacttatcgtacttaccacaagccagcgtgggtaacggctgggcttgtagtgtagctttgctctagctgacacatccaggcaagggtgggcgtgatggagcgggacaggccctgcgacggcctctgtcgcttccggatttacgtaggcacgagaggggactgcccgttgcccgctggggacgggggtgaaacctgaggtgtggtgtgcttggctagagggggttatgcgaagggtcctgtcacggcctctttccggtatgttgtggtggcatgtcggcgcacagtaacgtgtcgtggggctctgtcttgtgggtacagttgtacacctctgatcagagtaaaactattcgaatagccgtgcccgcggttacgggtggtccaccagattcactgtgattagtctcaccctagattagcctaatggaattgattagttcaggaggatggttgggccagttgcaacgtggtgtagcgttggacagtggatgattaatattgattaattactacaactgttttactgctttcaactactgtttataaatgctcgctttatgcaaatgacccgctctagctatcctttggttatatcatgcatcatactcctattctggtatgacttgctgagtacggtggtggtacttagtcttgctctattcccctccctaaaccccagagtttgagtacgtgtcagatgatggcttctccgaggtgtaggcttcgtccgtgccatcgaggatgcctgtggagtggtgttcccgctgcagtccaagtcaaggcttagctccagttatcctttaattttccgttgcatttatgtaaaacttttatgatgtttgtaagacgtggatctgtatgtcaactttgtcgtttgtgtaccccggccggtcctggacgggggttttaatgcacattctgcttggaattctattcggaaatttctgggcgtgacacgccgtccgtggggacgtccgagcgaaaccactgagagtgagcgaaaccactgatgccaccaaaggaaatcgttaaggagagagttgccaagtgaaaggaaggcaacagcgaaggggagatggctggcgaagagggagtagagccttcgacttttgaagccgaagttggagctgcgccacccccagcagcggcgccatctcttccaccttcagcactgacgaccttgacagatgcggatacgttgaaagcggcggccacgctccagttcagggacgtgatcctttcgcctcaagtaccgggggcacctcaagctgccgccttcacctagctagccacgacgtcaacagcaatcatcaccttgcaagctgacgccaatctcaaagctcaagccaatgcagacatgggggctatacgtcagaacatggctaaactgcgagacacacttcgccagatgcaagagcagcagcaagcatacggagcagcaagacaagccaggccaacacgcaggagtttccgacgctctacgctcagccccaagtttttcccccacatgctgcaccagccccggcgtactacgccaagcccgtcccggccgtcgctgtacgaccgccataacatgtgatttcggcgccggttcgtccagcggcacaccaagcccagtacccgaagcccactcacactccacaagcaatgatggaggcagcttcgaccttacaagcacagtttcaagccttcttgcaacaactcaatcaaccccacaacaatataccaagagcttcgcctctggcccaggacgagcggagcccaagtcaggggtgcgctagccgggcagccgttgggctagttcatcatgccaagttgttgacgtaaaaacacaaggcctgggagatctgcttaactccagtgcaggtccaaaacttgcctttgggtgtatgagcgtgccagttgatttgatcctgcaatcaacaggaaacaaagacaaagaaaccgcggttaaatccataaacgatagccaatcggctaggtgccgatgacatatcatttacctttgagccgatgtcatatgtgcatcgatcggcaattattaataagtaagaaagaacaaaatctactcgatcggctgtagatgttaacgatatataatccttaggtcgatatatacttaaatcaagtgattgggatagatcggtcgccatgtcgagacagtataaatcacttagatcgaaatatatattaacaacaagaccatatatgttcgtagcatagccgatcagatagatctagcatgtagcggctaatgctccgatacgactctatattaagatattaaagtaagtaaaatataccaaacgaaagcctaatatacttaaatgctacaagatcttagcataaaaggtagaattaacatgtcaatcaagcacataagataaaagtagttaaattaggtaagatcggctgaaactccgatgctaccctaatcggcaaccaaaagcaggctagagattgagattctaatcacgattcataagatcaaactcaactgatgcagctataagtatgaaaagaaggacaatatctagacaatcaagccgttggatgtttcatagagtggtagatatcctatataatctaagtcaacatcggtatttaacctagtcggctgccttctattaacagacgttagccgattgtaggttagatggcgatattgccggagattatataagatatatgataactcgacgaattatagcaacaagattagagtatcatgaagatggaagcactaatcccgagaacgcaagccaccataacaagttttacctcttgttgaagatcgaaatcgatgcagctcaacccaaaagcaagaactcatcgaaacaaaatgaaagtaaaagggtggcgatgccccgagattgtattgaacgtgtgttagtttgattacatggggctcgaggtctatttatacccgagatttacaaaatatgtccacattggacacgactcttatctctaacaaactctaatataccataagtctttacggcagacttttgcccaaacatatctctaaggaaattacataaaatatcctaattaatagatataattgccttctcaggactacccatgcgtggcagtcatcatgaagcttattaactcaacccgacaatgtattcttcgtcatattgtcggattcggctcaataggctaaccctgtccaactcggactttgctgatcctgatcacagctgattcggacttcagccgattcttactctatttccgaaacaatcttggatttagattccgcttcaatctgatctctatctttgatactcagattaccaaatttggtcgttaacacatgcccaccaagtccagaatattggataatgtttcgaatttgccatacgtcgactccgagagaaatccgcacttgccgttttccgaccgttacacagtgctttaaatactaaccgttgtccccgagatatctcacacagtttcctccattttcaccgccgaagccaattccgtcctctctctctccggcaatcccctcggtgcgcaaggcgatttcctctccggccaactttccgcccacggcgatgtcgacctctcccagcccgtccgccgcatcatcagccgagtacgcagaggtaagttctcatcggctagatcctcttctttcgtatcggattggttttccctttccatatcttgttttcttcttctctgttcttttggatccgtagcatctctccaacctgatcgcagttccgagcctatctgacgagaaccattactttctcggcccagtcggcaaccttgatcctactgagttcatcattggcgaaaccaatagaattcctttcagattagccaacctagatctaggtcactggaagaataccttcaaatcatggccatctctcgagaaaacttcacccgagaagagctggattacatggtacaagcgcatgtcgtctaacaagaaagttcactgggacgaaattggaatcggccaagcgcttacccttaccatagccaattcagctaaagatgaacctttaatggccgccgccacctatttctggtccaataccatcaacgcttttctgttcaaccaagggccgatgactccaactttgattgacatcaccatgattaccggattagacgtaacttcattgcctaaccctgtgagtatgaacaccaagaaccaatttgatttcaggaccaaaagcataggtggttggtctggctatgtagcggcatacatgggcaaagggcctgtcactcctcgaaaacatgtggctttcttgttgatgtggctagaaaagttccttttctgtggatccagttgatgtcctacaaccaactggcattttgtagccgaagccctagaatcaaagaaacaatttcccttagacaaaattcttcttggctacctgtaccaagtgttaaataatgcatgggccaaaatagctatcggcttagtggtaggagcaggtggcccatggtggctgctgcagacttggctgaatctgatggtcatgaaagttgtcaatcggccatctgtgatagaagctgaattcctaagattagagccgatcatagaagacgatggagaggaacgcacccatcgcaaatgcacatcctatcgagggtatgcttccacactagccgacacaggggcaaagctatcagctgaactgcttaaggattggttctgcagtttttatgaaggctttcagaaagatgctccaatttggttcccttatgaggactcagcacttctagagctcccatcggactttagatttgaagacatcaaccacgagagatacgaaaagtccagagaagtcttctcggctgcaataagcccatgcatccttcctgtcggcattcatcaagggaggaatattcaagtctcttatgaattttatcatccgatgagttctgctagacagcttgggatgggtcagctaccaatcggcttgttctttgccgataaaattcaatgtcgaggggaaatttcatcaaccttaatgatggatcggttactcaatctcgaaggacctcctttgggcagtattgaaaatatagagctggcaaggttcaggagtaagaactttgacagatggtgggggtgaatggaaacaacatatcttccatcaaccagcttctatgtaaatgacagatctgttccccgatgttgttcctcaggtatatctttgctcttgtcaattctgtttgaacaattattagccgacttgaaacttgactaatttctcttctcgtcttgcagacaacagaatcctctccccctcgcaagagcaatagtggcatagatatcgaatacgctccaggtctcattcccaatggaggtgggtcatctccccctgtcatcaattgtcatgcccccaaaacttcaagtatgctccaagggctcattagagaactagctgatgccggtaaaaagagaaaaaccagagcatcggctatagacccattggctccggctccaaataagaaagccaagtcaaataagaccaagccaaccgatgatctgtctgccgtagatccatccattgaacaagctctggatgaagaggatattggagaagatgttgatcaagctgaagctgggataagcggtactgaaaaaacaccatgggcttcacttaaacaaactcctccgactccttctgctccagttcatttttccagggtaaacaactctccttgatttctttttgcaaccatttcatttatagccgattgcttatagattttataattgcagaaaaagaaaaatactatgagaaagaaatcggtagcaacaactctcaaactggctccaccagtaagatgttcttaaatctttcactagttgatcatcgccgatcttgtctaacaattgtctcttttcagcctcctcctccttctccccatgtacagctatcatcaagtgaccaaactccatcggctatcatcagctagaagcatcatctctagacagtttggtagtagactgtggatcaattaggactcggctacataaagttcaagctttgatcccggaagaacatgcagacgtcctcactccagctgcttatcttgaacaatatcaattcaaactggagaaggccaagctgagattagccgaacgtgggaagcgcagggatattaaagccacaatccagccaatcggcaactcgtgcatgaagagaagtccaagcttgatcagctatctgagggcccgatcaagtctaatattgatcagcttgaagctggtaagattgagctgttggcacaactccaagaatccaatgctgatatgaccaagtccctaaaagtcatctctggaaccgatgctcaagatacccaagctattgaagaagtagaacacattaggcaaagagctatatcggcgatctagcgctacttgtctcagtgatattctataataggatgtagtaaatttttgtaatcggctaagatactctggcacttgtagttaacttgtcttgatttatgccgattaatataactccatgtttttgctcaagaatttgctcaaaaattttgcaacttttgcatatatatgtgcccccctaattttacaatgtcgaaggcattgatgaaattatatcttgaactaagggcaatataacaatatcggccatttgtacatcggcaaaccacaaccgattacaataggaaaataactaagggcgatataaccatatcggccatcccaaggcaatgcaaacacatcggctattatgtatcagtagtaccagccgatcatgcattaacccaaacacttgggtaatatttcttcaagtattttccattgagcgctcgtccataaacttctccatcgagtccttgcaacatataacctcctttagacacaactttatagatttgaaacggtccttcccaattcggcgactacttgccgaatttgctatcccgagtgccaatcggcaaaatcaatttccatacaagttctacctccgaaaaagacttggctaccactttcttgttgtaatgtcgagcaacccgttccttatccttagcaacttttgcaagggctctgaatctagattgaaccaagtcttccctctcatcggccataagattataatactcatcggctgtcaaatcattttgcaactccgttcttcttgagccgattctaacttctcatggcaaaacaacttcatgtccataaacaagtttataaggagggacttgaatcgatccatgacaagccatccaataggaccataatgcttcggccaatcgagtatgccactgccgaggataatcggaaatctctctcttaatcaatttgatcaaactcttgttagacgcctcggcttgcccattagcttgtgcataataaggtgagaattcaacatttt

SEQ ID NO: 37468 - DNA, 1129 bp, Oryza sativa
aaaatacaagcacaaacacaacttctccacaggggaatatctcgtctctgcatccaagagccgacgacttaaataaaatacaactctttctttcccttcaagctcctgaatcaagactgagccgattgacttctcaccagctgatagatataatctaaaaggtaatcccttttgtggaggaatcaaaactggaggagagctaagatattccttaatactatccaaagccttctgttgcactgcctcccaagtaaacttttggtcggctttcaatcttaacaatggtgtaaaaggctctaaccttccagacaaattagaaataaaccttctaacaaaatttatcttgccgatcatctcctgcaattccgtctattttctggagactgaattttcttgatcgcattaacactcctttgagttatctcaatccccctctcatgaacaagaaatcccaaaaactggccagccgatacaccgaaagcacactttgttgggttcatcttcaagccatatttcctagtcctctcaaaaaccttccttaaatcggctatgtggtcctctatctctttagacttaacaaccacatcatcaatgtagacctcaaccaaccagccgatcggatcatggtatatgtaattcatggcccattgatatgtagctccagcacttttcaagccgaaagtcatcgtaacccattcaaacaagtcgattgcaccaggacacctaaaagctgtcttatgtatatcttcttcagccatgaagatctgattgtatcctgcatttccatccataaaactcaatatcttgtgccctgaagcagcatcaaccagctgatcggctactgcattggatactcgtcctttggggtagctttgttaaatccctgaaatcaacacacaccctgactttgccgtttttcttgataactggaattatactagaaacccacttggcatatcgacaaggacgaatgaaaccagcatcatataaacgtttaatcttagccttgacaggttcgagcatgtcggctttgcatcttctcggaggttgttggtgcggcctaaaccccggtttgataggtagccgatgttcaacaatcgatcggctgagccctgacatctcataatac

SEQ ID NO: 37469 - DNA, 2037 bp, Oryza sativa
  unsure (1)..(2037): unsure at all n locations
tgtgaaaaccatgttaaccgatgcagttacaacactattccctttagccaatctttttgcttcatcggctgtggcttcatcggctgtaggaacttgattcttaacgcgccactcctgctgcggcttcgttttcttcagccgatggttgatttcttgctcaacctcttccctgttcctcaacctttgaacccttctcttctgattctttgtaaaaataccagaaggacaccattaagtcttcctaccttcattgtcctcttggtcacgatcttgatttactgggcccaacctttgatgaacaggaacccttgcttgccttagccaattgcctttattatatgatcggcttgaacttcctgcaatattgctgtacctaggacaatcctcattggatggcagcctcataccttcattccaacagaatctaaagaactcacaaccccaatgaggatcaagaccgctatcatcttcctcataatacttttcctgatgctaatcatatttcctctgatacttattgataatcataggcgagttcatttgaaaacctcgagcttttccttcatcggctgttcgaccagctgtatgtactatattgacacgaaaaggattgncatcaaccttcatcggcttattggaatcatcaaacttgattntgccttcctcaatagccgcctggatctgctgtctaaagactttacaatcattggtagaatgagatccagaattatgccacttgctatatctcctcttgcctaactcctcagccgatggaattgtatgaccagcaggaagttgaatatgtttttcccgaagtaacaaatcaaagatcttatcagccttggtgatgtcaaagtcatacctctcttcttttcagaactcttcacccattggcatggtataaccttcttgctcctaacccacttggctgctgctacctcggaatcatcatcatcatcatcagatccatatatgtaggtttccttttgtgcaagatgtgacaaactatcaaagtcctgggatgagaatttctccctgattggagctatcataccctaaaaagccaaatctgctaacatcagtcaagcttaagttgtagcacttattcctcatctctctaaacctctgaatgtagtcttgcacaggctcatcatgcctttgcctaatcgctgttaaatcagacaatttcatctcatgaaccccactataaaaatagctatgaaaattcttctccaaatcggtcaactgttgattgatccatatggcaaagaagaaaaccaagtaaaagccgatccagacaaagactagggagacaacctaacccttaaggcgtcgacagtcgatgctttaccacactgagctaagaatcggctagcatgttcataggttgagacactgtctgcctgagaattttgaaaaatcccgaaccttgaacgggttaggcaatggaaccctctcaaaccactcaggatatcgatgccgatacaagtttccagtgtcttttggcttgatcccaaattgctctctcatcacatctgcaatcatatcggcccatggttcctattgaggcaccccctgcacttgctgtggcacaggctcgaacgagttgtactgataagcgaattgaggctgagtcgatcctccttgttgatactgaacttgcggcgatggaggctgatactggtaattcaaattgcccccgtgataattctgaaagtttggctgtatattgcgcaccaaatgttcgggaataacttgaggtatcaccgattgatctggttgcacattatgaaccaaatgctctgggacaacttgatttgcagcgtgctgcctcggctgattgtcgggcgtcctgaacccagccgatgcatttaggaaaccttgctgctgaatcggctgagcaacttgctgcctcggtggcgtctgctgaatcggctgctgttgaactgggtcagcagtaggctgagttggtaaaaacatagctgcaacttgctcttgagttagccgattcacattttgtccactatgctgagactg

SEQ ID NO: 37470 - DNA, 2982 bp, Oryza sativa
acaagatccgtgtgaattgcatcgcgcggggcatcatcgatacaccccttggtgatgatgtacgtttaattctccacacatatgacaccaatttattgcgaaggctggtgcttttgttaaattacatatatttgttccccggttttagattttattttcacatcaaagttctgagttattaattgaccctctacttttattatggatatatatttatttgtttcactcaagaacaattgttgatgctctcaaccacaggtcaagagcggcaataatcctcaccttcagggtgttagcgggacggacttcatacaagacgacatcgcacgaacgccgatgcggcgtgtaggcaagccggaggaggtctcatcgctggtggcgttcctctgcatgccagcggcggcatacatcaccggccaaatcatttgcgtcgacggtggccgcaccctatcttagcagagtatgtttaattgccctaaagccctaaaccatataaagaattagttcctacctcacgcgttgctacggaacaatcgtgttaattgaaggatataatttcagagctagcattgtgtatactctggctaaaacaaaattaaagagcatcatatatattgacgtgtcctttacaatttacgttattattatatactaaaagtctattaaattaagcttcctataaacgctcacgtggcactcctagaaacactcctaggccatcacaaggcattatctaatcttaccatcaattttcacttaaattagtggactcgttattttacatcattggattaaatctattattaaaaaataataactttctccttttatacgatacaagcgctattactgttgttatgtacgtacaagtttatacggtacaaactatgtccttctcccgtacgtatttacgtacatgaaaacaaaacaatagctttacataaaacgccggaataaaaagaaaaaaccatacgcatatacataaaaaagagagcaaaaaaaattacatccaaaaaaattgacaatctttaaaatatgacaataccttactttctgttcgccggaaagaaaagaagaaaccatacgaatgtacataaaaaagatagccacaaaattacatccataaaaatcgacgatctttaaaatatgattttctaaaatatatttcttttttatatataaatatatataggcaaacggagagctataataataatattaagagatcccatcaatgttctttgaaccatcttttaataatttttaaattatatatctaatttgtgattccatggtattcctttaattaaattataaaaattgtgttgcgatcctaaatatatcacaacacatgagggcgtcatataatagttagctggttaatattttttaaaaaagtcagatcatattttggggtgtgaaatatcacttcacaaatatacaacaccattttaaatctacatatataaaaaaataaaaaaaagacaatttagttgtgttttttcaagtagatctgatttaattgtaatttgtttgagattaagattctcaaacttttttttgacattttcagaattattttattggtatttgagaagtgagcagcatacatagtacatagatatgaaaagaaatatcaaaaatagttccactcaatgatctttgctatgattcaaccccttaaatcatcatgtgatttatggtcatattttttctttgccaaatagttttgacacaaatgaacaatgaagtaacatgcacaataaactactcatgatatattttcttgtacttaaggaatttcaatatattagacataattgatggatatttatcataaactccactgacatgactgtaagtgtactccaataaattatttattgtaaataagtttagaaaaataaatatagtcttcaaattagtaaaagtgcctcgtgattatgaacaataggtgttgaaacaaactacgcgctaaactatagatatttgtcaaaatattaaaaataatattgtgctgcggaaattatcgtggtagtatgtctctttagcaataattcttttaaataatgttgaatgattaacctctctcattttcaaaagcgagttttctgtctttatcataaaattttgagtagtattgatcaacgccataaacaaactatgtctaaaaaaactattttgatcacttccatcttctctttgttcttccctaaagggcaacaaactgaaaactccaaaaatatgatattctaaatatttaaaacaaaacacacatagtataaatggaagatttttcactgcaacaaactccatagttatgacacaatattttgcacgattccaattttcagtttagaaattatgtgttgcaataattggaagaaaatcataaccaactttcgaagcaatcctaaacaagtttagaatatcgctacagaaaattgggaaagtcactcacacacaaagtttcataatagaaattcaaccattgttaaataatggtttgtttgggagatttatggagtatcaaccgaattattcgtaacacgcttcaaaattataatttgtgtaaaatactttcttaatcggtattgcttaagtaaccttttttaagctatttgttagtcgtatgctatactatgtaatgcacttcataatcaattatctatgttccacttcatcatctaaaagaaaagtagacatactttgttttgaaaatagataattgtaaattaaaagtaggttctttcgctttttaatggaatggccagggtctctagatctccttttcaaataatctcaaactatattattgataatttatgttttacatcaagttagagcgctctctaattggttcggattgacataacttcaaacatactagcatgtgaaattaaaaatacataggagcgacaaatatatatcgaccctactttatatgatgtgttggacccatattatttttttaagaaaaaa

SEQ ID NO: 37471 - DNA, 1465 bp, Oryza sativa
  unsure (1)..(1465): unsure at all n locations
ttttcaattcagtttattaaaaaatctaattatttttatattattagttaattctcctatacaaagaaatacccttgggattgttttgatttatcatttttttattaattctaattaaccaggaatgatatttttaattattgttctttttatgcagtacgtagcaaataacatctgcattggatactgcatcacatgatgcaacaattatatttgctctgacagaaaagcgtcaaaggatttttaatgatcaatataaacagtagacaatatatttgcatttaatctaagacaggtctgtagacaataacacataaataaaatagtctcagaaggtaagttgatcaaactgattaatctagcaactataataggtctgataacatgatcctagattcctaatctctaaatgcttgcaattcgacattagcacatcctagaaacgccagaggtcatcattctcacaagttcttccacaatgaccagcttgtggcgcttcttcagtagtgttcatcccattctgaaataaaattacaaaataagctacaaagttactgaaaaactataagggtaggtctaagtttgaacttatgaatgatacatagcagtccatttctaaattgaactcactaactggtatcgcaactaaagccataccattggcagaacatttttaaattgatctattgttgtccaagaaccaaatttttcataatgtttgttcaagagaataaataataaggatgtacagtagtaaaaagattgaagtcagtatataccatgagaagtgcatgaaggaactcagggacaacagaagaagatggtccatttgcatcctgtgatttgaaaaataataccagttagtatgttctttctaggaaacaaaaatagctttaatttatacttacatgggaatgagtttctgccttatccttatccactgtctgctctagcctttctatccntgatgctagttcttgatgagcattgttcacagcattagtgactgcctgctgaacaatgtcttgcacttgctgctgtgtgtatagtggctgtgtctccatgctaccagatggtgcacttgctgaattaccaacatggtttctatctataattcctgaaagaccataatacattccacgttttctacctttagtgagctgcacccaaacatgttgtttgttgacttgattgttttctccttccttgacacgatcattatacaccacctaattaagatatgtagtggcaccattgcatggttttagatgatttcactttttttgattgccaaacttgaaactagaaactagaataagcagaacacataccgctaactattcagctttcttgttggcatactgtcccttgccctttgcatgtcgatgtgtgcgttcaaagacatcaatatcatcaacatccgtccctgcattctcaattatctatccaaaagtacatatcatag

SEQ ID NO: 37472 - DNA, 4010 bp, Oryza sativa
cagtcgcacgcatattttcgatatgcttctccaaagaacgttttgcttcagatttctcatgtgacaaagcttggctaaaacgttcaacagctttgcgataaaataatctagcacaatccttttctctaccatcagcaaacttaaaacacaactgtaaaagataaggtaggacgtcaatccattaaaagaacctaaatattctatgtgaatgctaacactgtaactcaccaaaaattccttcagaatagttatccttgtatgagcagaaaagttgtgataatgagcaatgacaactgcttcatcctcaggcacctgtttgccatgtttatccaaaggtctatatgtgccagggtagtgagcttttataagacatgtgatggtagatgaaacattcttcttcataggattcgtaatccaagcactagaaacaacatgccatttaccaagttaggtaatattagtgtaaaccaatgaaagtgataaaaaaatatgttcagccatcataatattggatttataggaactatgcatctgtatttcttaaaatttaacatggagtttacaacaagattttcaattattaacaacaatgatatacatattatatggagtgtgtgtttgtgtgtgtgatagacagtgtgtgttttaatataagcagaaatttagagtgtcaacttactctttattgagtggagttatcactgccctatctttctctggaactggtgccatcaaaacatttggaccacgaccacccttactttcttttgttgaagtaaccaaagaatttgaaggttcatcttgtgttgaatcctcaaaatggtcttcaacttcaggatccggataatgtcgatggcgtcttgacatagtacttaactagtaaaaacaagggttattttgcaagcaaatgtagtcattgaagaatagataacatagtaaatttgtaataatgccactgctcatgagaaaatgaaataataatatcacacacacacacacacacacatatatatatcaattgtttagtcactagaatcactatcattgtctgagtcattatctgattctattggcccttcatcttcactgctgcaatcactgtccatggcaacataactctctatgttctcatggctatttggtctatttaaaaaatccatatcttctggatcaacttgctcaacaatatttgattcatgaagcaagctttcatcaccaagctcctgtgaaatgtcagctccaagctgctctccctcttgataatattcagaaactacaggaggaagcgaatcatcaacttcatcgtccactgcaggaacgggtaaagtaccaattggatttgtcttgaatgcaacccaccaatcttttctttcacgtggtggcgatggatatggtgtataatatacttggtccacttggtatgcaagcacaaaaggctcatattgttccaatcttgatgtatggttaacttcaactaggcctagtgctttgtcatacttcactcctttcttaggatcaaaccagacacacttaaatagagccacctttagatcactatcactgacatattccaactctattatctcctgaatagtgccatagtagtcaggcccttggttatcaaaccaatttgctgacacacaaactccactatttgtcattgtcctcgatgatttcttttgttcatatggttgggtacgaaaacgaaacccctgaacatcacatcccttataacacttaaccatgtatcggggcccaatggaaagagcccttacttgttcttcaactgtttcatcttttccagcctgtagaatcaattttcatgaatcatgcattaaaataaataataatccatcagatattacatcatgtattcttaccaactcacgaacccaggttggaaaatctttctcatgcatctcttgtaattgagttgtagtgatgttcctgttttgttgtttcatccccctatcaaatttcctgacatttattgcaataacataaatgtaatatgtcatattcacaaaaatagagcccaagtaataaaataggaaaacagaataatatatacttacaagacatatttgtcaacttctgcacaattgagtaatgcatataccctagcagcctgccattcttctcttgataagttacatgatgtgctctttccaagagtgcgatatgggatagagaatatagatagccagtcagtaggtgctctgaaaccaccatcatcatgtctagggacgcgagtgtgctttgttcgcacatgatcagcaaagtacatagaaataaaattagagacctcctgtactctatacccctctacaattgaaccttcgacacgtgctttgtttcgaaccttcttgcgagcctcatgtaactccctatgaattgagcagaaaacataattatgaaattaatatacaaattcacactttagtacttaaccaaagaaacatacctttcaaatacatacatccagcggtaagctacaggccctccaattaaagcttcataagctagatgcaccaccaagtgttccatacaatcaaaaaatccaggaggaaaaatctgttcaagtttacacacaatgactggcacttccttttgtaggtgcttcatttgttctatatccacctcttttgcacatagttgcctaaagaagtagctcagttctgctaaacacttccagatgtgcttggggaggaaatcacgaaatgccacaggtagcaacctttccatgaagacatggcaatcatgactcttcattcctatgatcttgcctcgattaatatcaacaccctgtgctaaatttgatgcataaccatcagggaatttaagattcttaacccattgcagtaccaatttcttctgtgccttatctagactataacaagcttttggtttcacccatcgacctatagatttttgttgcatatgaagttctttgcgattgcatatattggctaaatcaaattgagccttgacattatctttagtcttctttgggatatccatcaaagtattccatatattgtcaaacacattcttttcaatgtgcatcacatcaaggttgtgccgtactaacaactcacgccagtaaggcaactcccaaaagatagatctttttacccaattatgctcctttccaaaaccctcaatctcttgatttcctgccttggtaccaaatgtaatttgagggagagatttaacacaatcatacacttctgaagatgatcgatgaataggtgggccatctttctcctccttattctggatgaacttgtcttttgcatgtctaaaagggtgtccctttggtaggaaacgcctatgacaatcaaaccaacatggcttgcctccaacttttagccaaaatgactttgtgtcttccatgcaaattggacaagctaattaaccgtgtgtgctccagccgcacaacatcccatatgcaggaaagtcacttactgtccccataagggcagctcgcatgacaaagttctggttttttgagcgatcatatgtcacaacttcttcctctccaaagttgcaaaagttcatcaatagtggatggaagaatacatctatgtctttccagggtgcgtaggccctggtatacccatggtaaggaaaatattatgtgccttcatgcatatgctgggggcaagttatatgggacaacaaaaacaggccaccaggagtaaggggttgcagtttgattaaatggcgtgaatccttctgttgacacccttaaccgcacatttcaggcctcctttgcaaaattaggggtactttgaatcaatatgcttccatgcttcactctctgctgggtgagttaactttttctttctgctttcattgttgcccctctctgattcaagcccatccttgtggtatgtcatgtgtgttccagtgcctcgtgacatgtagagcctctgtaggcgtggaatgattgggaggtagcgaagcaccttctgtggagtgcccttcttattctcagggagttctaa

SEQ ID NO: 37473 - DNA, 16304 bp, Oryza sativa
  unsure (1)..(16304): unsure at all n locations
tgtctactccacacatggtaattttcagtaaatcctttattgcaaaggtgcatttgaactattcttttgtcatgcagctgcccattcttgcacttcgtacaagggcatctaacccttttcttgcctgaccttgaactttgatacagcgtgtgacataaacctcttaactcctttcaaatactcatctgaaatgtatccattcactacccttttatacatccaactacggtcctcagccattaatctcacactaaacaagctattctgacatgcaaataatggctagccctacacttgaaattatatggtaaggatgcatattttgaaagattatgtaaaggaagtttatcaaaataagaagaggaaagattagatgtagactaatagcaaatcttcttttaaatacaaaaaataattgctcccagataaatcattattagtgataacttgaacatattaagtagtacatatttctctataatttgtttactctgtctacacttcaatacaccaaaagaataaacaacatgtgtcttagcttgtttaatttactgaatttttgcacacatgccaatggtttgctatcagattgcacaattattaacactcaaattccatcgtactttcagaagacctgaattttctaaccacttaaagcaatcctgagattgcacaattattaacattcaaattccaccgtactttcaggagacctgaattttctaaccacttaaaacaatcctgagatcagtaccaatcataaattaaactatgttaataattcctacctgtatattctaatccgaagaactgatgatagaatatatatctactagagatactcgtaatttttgggcaataaaaatatctagtagcgagcaactaaagaattagaaacacaagcatcgtcaggaacttgagtcatacatgtgcaagttagagagcaaattttagtgtgtattacttaaaccataaacaaattaatccaatatccaacatcctggagcaaggagagtagaagaaaccaaaaggatgatgaacattctttcaaaatcattagttgagatgctcatgggatacaatcacaaaagatgaaaatcacaggacatgacaaaattcttacaggggaattccatcgagcagctggtaggcacacattaatcaagatgttacctgaggaggaaggatcggggcacggcagagcggcacactccgacgaggtaggagtgctgggcctgggtgtcaggcaccgggctacaggaggtgccgcacctgatggctcggagtgcgacgggggtgccaacctgcgtcgaggcaagcgcgcggcaggggattgttagcgatcatgcgaggaagaaaacaaatgaagaaaattgggtgctacaaactcacggaggggcaaataaatctctccaatcagatgaggaaatcacaattagaccggcaaacatggggagtgggagagatgggataatgggggtcgatgattttggggggaatgccagaaaatcgcgggaaggaaaaagatggattgggacttgggggtttttttcatgagagctagagagcccttctttttctttttttttttgagttgacggggtttttctagagggctggcaggttttttttttaagtacgggaaaacatcctttttttcagggagtgggatgtggctgggtcaaaacaaactccagatattccctcattaaaaaactaactcaggataaaaaattgcatcaaaaatttatacatggtaatattatttataaaatatatgaaatctcgtgttttctattatacaaaaattatgtaattattttcaaagttacatgagcataagagtaaaatataccgtctttaaatatagattttgcatcctttatttctagataatcaatctagaatttttttaattttttcaatttttataacgatcgttgctacgggagtagagccaccagtaataacataagtgtggtaggcgtgtacaataataccttcgattaagtggcggtcatggagcttgacgacgaagatagaacagtggcaacgctactcaacctgtcaaccatggagacagtgtatataagacctcggcaacgacaacagtggttataataatgtattaattagagggttggcgtgatggcgacaacaagtagtagctactagagtgttaggtagtagtgacaagcatgctagcatgggaaaatatccctttagagtagaggtgccaatgtactgataaatttttatacggcagatacaacggtgggcgccttctctcgtttgcatgacacttgttacatatggctaaaaaaatatatcatggcgttacaccattttattaatgtaatatttaaataaaacctatactaaaatataaccttagatgtgactcggtatctctactattaaaatattcgtgttattaaaagatcatgataattaatttatgtttttctattaatggaagacaaacagttatgcatgtcacacgcacatgccctgtttttatcatttgcaggcccttccgaatagttcatttatatttttttttatagtactggtaatgaggtcgcgtggtcgacattttatattaacacgtttcatacaatttttatcggttagctatactttaattagcaaactaaaacttagtaaatgtaaaagaagtttttgacagtacaggcacaatttcatttgcaattctttaattttgttttttatttagctatttatagagtttttttcacagaaatcaattaaatatatttttatttttagataatgtttaatctatttataaataaaaacaagctcacaagatccatgcatggctagcgtaatactagcaattaactaactgtataatttatattatgtaatttatattacaaagagatgctttatttcatacaatcccaaggaccatcgcatatgccttggggatgacgacattctacaagggtacgttcatgacccttgcaaataaacattattagcaaggaactagagtgatggtagcagataaggatcttctgcaaggctatactattgcaaggggaaatagtcttgacaataattacatttcttatagtggtagtggatatttttagtgtatcaatgatgtattaggcttattttattggtacatatgcaattcactcaacttttaaaacgtaataagtaatagtgagaatagtataatttatatgttactcgttcaaagtgttttttttaattttagagatattcttatcatttaatatcatttgaatagaaatggtgagatacgacttttttatcattgtttttataaaacaatcaataagacgcccgtgcatctgcgcaggctttgttcctagttgatatcaataattcaatattttatgccaacaaagaaaaagaagaaaattacacatcaaattattggtcgaataaaaggggatccacttgggtaatctggtccaacacgcaggacactatttacatgattaaaagggctataagatgtgattgttctaaatgtgatatcttttaacaacaaagataaaatgtggatacatagctgctaattgtatatgctgataacaatgaccatagtcttaaaaagtaactgtgaaaacatgaagcaggtaactattattcagaaaacgtgttcacattaatcacattatgtgtgaaatggaagaattatacagacaacattctgtgatctgcagtctaaataccatggagattttggcatgcacctttttgagaagctggtgatggtcaaatccgagagtaactgatccctcaatcctgttgatagtttgatatggtacgcaaacagagcaacagtagaagctgttacatttatatgctttggcatttatatgaaacttggtcataaacaaactcaaatcaaactatgatcaatgatgctacctagaacatgatagaattacaaaattgttttaggatcaagatatccatattattggtaaagaacatggacctgccgcctgtgttgtcctgcagaaatcaatggcaagagaataagaggtagatatgccagttcggttaaaaataaaaaagagagagatagatatgccatggcaaatgcagatcgagcgagagagtgagagagatactgtgccaacaaatttttggggccatgcatgtatgatgtatggcagcagcaaggcacgtgcatttacccttgatcgctggagtttgttcatagacggtcccacatttgtgcaacaaatcgcatcgggactgtgaaattcaaggcggtacatatactggaaaagatgaacagctacaggagttccatagagaaaataaagtaaaagaactaaaaagacaacacaaaaaggttacttcgtaccactgttatttgacatcgccataacagtgaagcattctctaaatagccaagggcatccacaatataagctactcctaaagtgtcctcactaactaaggacacacgtaggaaaactcaactcgcaatggaggacacccctgaatgggctcctcaaaatcccaacctataaagccacaagtattgttttcctcttctacccctctcttcaaactaaggaatttgaagacatgaagcattcagaatacacgaatatattcaacacagtaattttcaatcaagagtaacctatatattataatctaattaagcaatagaatactagtattttctatcacactctcaagtactacttcaccacatcatctgtactactctatcttatcctcttcgttcatagccattcaccgcatcatctgtactactctatctcatctttttccccaatcttccatcgagagcagcaaaccgatgccaagatcggtggatggcatagcgagctcgcatacgcggccgagctgggtaccgggcggagcaagcaaggcggcagtcggctgacgagctcactcgcgcggccgagctgggtaccgggcgaagcaagcgaggcggagcaatcgaagcggacgcacggcaggagcgagctgccaccatggtcagcacaagctcaagctgcgtggtttgcgactttgccccaccgcgccgccgtttactccgccacacagcgccgcccgtgagctcccttcagctcgagctcgaggggaacgggagagagaggggagaggggtggaaggagaatatggaggtggagcacccgttgcccgaggcacccgtcgccgcagcgcgtgcctcgagcccatcccctggccgaaaaggaggagccgcatcgcccagacgggagtcgcgtggcgtcgttgggggacggtgcgaacgaaaaagtaaacggagatggacggaaggagctagggacacgcccctgaggctacccattgctgatggcctaaacatccataattttttaaaaagtaaaaaattcacgccagcagaatgccaaaacatagagaaggaagttaacttttcaggaaacaaatatcaggcgatgtccaacgtggaagagggaagacctccacgtacgattggatataactactggaaactaatctttgctcggtcgccccaaaaccacaatagtcccggttacaaaaagaaccgggactaaagatgatctttagtcctggtttaaaaccccacagccattctacgatctttagtccctaaagatcatctttagtcccagttcatccctatcagtcccttgtcagaggggcggggatctttagtccctgttggtgtcacaaaccgggcttaaagatcacctagatcaccactttagtccagactaaagatctcctctttactccctataacaaacggaactaacatcacgcgtagtatataatccctattccctatcctctccaccacaaccggcctcaatctcctcaacaaccggcctctcctctcctcagatccatctccctctcctcccatcctagccctctcctcccctcctcccttcctatccgatgcccagcgagggccgcctcctccccctcctgccttcccgtgcccagcgcctcctccccctcctcccttaccgtgccaagtggggccgcacgcggcaggtggccggcgaggccgcatgcagcaggcggctgagcacaggccgagtagcgagcgggcggcgctaccggcatccattctttattttttttacaatttgtgattcactgagatgtataattttgtgatttgttgtatagatttgagatgtataatatgtgatgtatttggtttgtgtgtaatttttttaggatttgtgatgtatttgatttgtgtgtacaagtaacttaagatttgtgatgtgaatgttttggaatattactttgatttcggaatatgcatccaactcgatttgggagaaaatacaggattaaactctggctaaaaaacaatgaaaaaaaaagaaaaagagacctaattggactgccactaccctctctttagtctcagttgatatcacaccaaccgggactaaaatccatctttagttcgggttatttcaatcgggactaaagatgcgccggattgctagtcccggttgaaaaacgccggattgctagtcccggttggaaaaccgccggttgaaaaaccgggactaaatgggttaccaaccgggagtataaatggtttctggttgctgagccgccatcaaacctaggcgagatgaaccatatatatataatatccgatggagttgatgaatcggccggcaaatcacatgatgcattgatacattaatgcatttatatttaatgaagatgaaaataaattaggacattggcagtttatattaagaagatgaatagctatggcgtttcaagcagcagctttcaagttttgctttattgttggactgcaaacatgaatagtcaaggatcctagggggcaccgcccacatcgagctgagccatccaatgggcttgtctaagattttctgcaaatttgagcttcacatgaatgaaagcaaattcatctcagtgccgcggccgcacccgcgctgtccaccacgcctaagccgaggccggggccgcgccgtgcgcacgcacgatgcgccgttccgcgcatccgccgcactgcgtcgtgccaccacggagatgatgccctgccgcgccgcgtgcttgtcaccgggccgaccaccacgcacgaagaacaaagaaaggaagaagaacaagaaaagaaaaatgaaaaaaaaaagagggtgcgccatcggccgtcgccccggcgccgacagcattggcgcccgaccgccgaccgcgcctgcagcaccgccgccgcacggccacgcctgtggcgtccggccgttccccgttacccggcatccgcatatggcaaggaacaatcgggggagaaaaatgaaagaacgaaaaaaaaggggaaaaggcgacgaacagcaccagatggccgagccgccgtcgccggccgcccaccacaaatagcacgccatgccacgccacccttcggctcgccgcgccgcccccctggccgctgcaaccacgcatgaacgaggtcgacgccgctgccgtgcccgcgccggcctaatccggccgcgtcgccttgcccggccacgaccgccgcgacgggcgtgctcgcggcgccggtcgcccgcccgcacccgcgccgccgcttacgtatggccgcgctgtcgccgacctagccgcgccgcgccacgctgcatccgcatggccgctccaccgttccccggccgccgccccgcgccgcccccgccggtcgccgaccgagtcacgccatcggccgcccccacatggaaaggaaccatcggtggaaaggaaaagaaggaaagaagaagaaagggaaagagaagtggaaaggaccgatgctcatgtgattttgcaaatggacccttgcattttttggaaattaagtgcatattcctctgcaaaggaaatttaccttttaaatcctaatgttttaagaaaacacacaaataacctctgcatttgggatatttgtttgaaaagcatttgaaatttgcaaatatcactaaaatcatattcacgcataaaaagggtccatcggacattgcatttcgaccttgactttgtatttaaggtatcttttattgctgatgtttatgattatgaaatttatttatcgcatatatgattattgattatttatgatgcttttattacttttaattgatatcattgcagtaaatatatagaatagcatataatatattgaaattatttgcggcaattttgtgtaccatcgcattgcaacatttgtgtatttgttaacgaccaaatttggtaatatcagcatcggaaaaggagattagatcaaggtggagttgaaggcggagattgatcctagaacagagcaagaatcggctgaagtccagatcggctacgattaggatcggctgggtctgagtcggactaggtgagccgattcagccgattctgatagtataatttggtgtatgacattgggttgaatcgaggtgcttcaagatgattgccgcacattgatagagtcctgagaaggcaattgtatctattaattacgatgttttatgtaactttcttagagatatgtttgggcaaaagtctgccgcaaagacttatggtatcttagagcttgttagagatagtggtcgtgtccggtatggacatatcttgtaattctcgggtataaatagacctcgagccctatgtaattggtaacacacacgttcaatacaatttcggcgcatcgccacttttttgctttagttttgtttcgacgagttcttgctttcgggttgagctgcattggtttcgatcttcaacaagaggtaaaacttgttatgacgacttgcgttctcgagattagtgcttccatctttatgacactctaatcttgtctatataattcgtcaagttatcatatatcctacataatctttggcaatatcgtcatctaacctacaatcggctaatatctgttaatagaaggcagccgattaggttaaatagcgacgttgtcctagattatataagatatctaccactttatgaaacacccagcggcttgattgtctagatattgttcttcttttcatacttaatgctgcatcagttgagtttgatctattaagtcgtgcttagaatatcaatctctagcctgtcctctggttgccgattagggtagcatcggagtttcagccgatattatctgatttaaccatattcaatctatatgcttcaatgacatgttaaatctgccatttatgtcaggatcttattgcatttaagtatattaagcttttgtttggtatattatatttgttttgatatctttatataaagtagtatcggagtattagcggatacatgctagatctatctgattggctatgctataaacatatataatcctgttattaatatatatttcgatcgaagtgatttattctgtctcggcatggtggccgatctaccccaatcacttgatttaagtatatattaatataagaactatatatcgttaatatatacagccgatcgaatagatttagtttcttactatctatttataaccgccgatcgattcacatatgacatcggctcaaagataaatgatgtcatcggcacctagccaatcggctatcatttatagatttaaccacgaattctttgtctctatttcttgttgattacaggatcaaatcaactggcacgctcatacattcgaaggcgagctttggacctgcactggagttaagcagatctcccaggcctcatgttttctatcaacacgcttttggcacgcccggtgggacaaattagaagtcagcaagcaattcttcctcatggccgagaagccaccgctatcgccatcctcggctagcccaagcactgttaaataaaagatccagaagttggggttgactcgtgcccatcgatccagagaaattcacacctgagcagaagaaggattttgaagcaatgttgcagcaagcccaggatcaggtcttgaactcattcatgcagccccgcaagggaacattggttcagaagtataaagtaaaggtagttgcggatgaccctgggaccagttcttccaaaggtgaagacgggaaataagctccaaatggctcggctcaactgagtgacaaaggtgctaccgacggttctctaggaagtcaaggtgacaactctcaaggggtgcatggagttcaaggtgatggtgctcaggggttacaagagggaaatcttaatcagaatagtgatgcggcacaagatttttttaataatttccaagaccgggtcgactatgttgtgcaccatgctttgatcaatcagtctggggtgttagtcaataccttatcaaacatgacgaagtcaatagcagatggatcaatagctgagcatcaggctgcaagcaattcttcctcatggccgagagccaccgcagtcgccatcctcggctagcccaagcactgttaaataaaagatccagaagttggggttgactgatgtcaatgaaggaaacgtcgtgcccatcaatccagagaaattcacacctgagcagaaggattttgaagcagtgttgtagcaagcccgggatcaggtcttgaactcattcatgcagacccgcaagggaacattggttcagaagtataaagtaaaggtagttgccgatgaccctgggaccagttcttccaaaggtgaagacgggaaacaagctccaaatggcttggctcaactgagtgacaaagctgctaccgacggttctctaggaagtcaagctgacaactctcaaggggtgcatggagttcaaggtgatggtgctcaggggttgcaacgtggaaatcttaatcagaatagtgatgcggcacaagattttttcaataatttccaagaccgggtcgactatgttgtgcaccatgctttgatcaatcagtctggggtgttagtcaataccttatcaaacatgacgaagtcaatagccgatggatcaatagctgagcatcaggctgcaggcccagtttatttgcaaggaggtgtctttccaaattatcggcctttgattactgatgcccaaccatctatttaggcagttccccccgtcgcaccatcagctcagccgacggcgacggcatcgactcccttacctgctccgtcagcattggcaccaggccagctggtgaaccctcagttgttaatgagagagcagccacaacatagtgggcaggttgtgaatcggccgacgcaagatcaggttgctgccatgtttctgccgcctcaacctgctgttgatccaatacagcattagccgattcaacagacactcccgagtcagcaggttgtacaaccaatccagcaacaagttgtgtaaccagtccagcaaacgccaccaaggcaacagcctccgcggccgattcagcgaacgccattaagatagcaaatcattcagccgattcagcaccaaggctcaatgagcgcatcggccaggtttgtgacgcctggtggacaacctgtacaacaatttttaaatcaagtcgtcccagaacacttgtttcaccccgtgcagccggatggcacagtaatgcctcaagttgttcccgagcatttggcacgtaatattcagccgaaccttcataattaccagggggcagcttgaattatcaatatcagcctccttccccgcaagcccaatatcagtcagggggactggctcaacctcagtttgcgtctcaatacggtcagttcgagcccatgcaacaatagtcacagggagcagctcagcaacgaccgtgggccgatgtgattgctgatgtaatgagggaacagtttgggcttaaaccaaaagagactggaagcttgtatcggctgccttaccctgagtggtttgagagagttcctctcaacattcagttcaaagttccggacttctccaaatttttgggacaagatggtgtgtcaacttatgagcacattagccgatttttagctcagtgcggtaaagcatcggttgtggacgctctgagggttaggttgttccagttatctttgtttggatcggcttttacttggttttcttctttgccatatgggttcatcaatagttgggccgatttggagaagcaattccacagctatttctacagtggggttcatgagatgaagttatccgacttaacggcgattaagcagcggcatgatgactctgagatagctgcagccgaatgggtgaggagtaaaaaggtcataccgtgccaatgggtgaatagttctagaaaggaagagaagtatgattttgatattactaaagctgacaagatttttgatctgctactccgagagaagcaaattcaactccctgctggtcaaacgattccatcggttgaggaattaagtaaaaagagatatggcaaatggtataattctgggtctcattctactatcgattgcaaggtgtttaggcaacagattcaggtgcccattgaaggaggcaagattaagtttgatgattccaaaaagccgatgagggtcgatggtaacccatttcccgttaacatggtacacacagctagcggaccanttgatacggggcgcatgaggggttatcaagtaagttcggtagaattataaacaaatatcaaaggaaatacgacaagcaacaggaaaagcttcatgaagaagataatggtagctctgatcctcattggggctgtgagttcttcaggttctgttggaatgaaggtatgaggttaccatctatcgaggattgtcctggatgcagtgatgttgcagggggttcaagcccgattgtacgatggaggcaattggccaaaacagacaagagtacttgttcatcatagattgggcccagtaaccaacgtggtgattcgaaagatgatgaaaataagaagactgaatggtgtcctcttagtatttttacgaagaatcagaaaagaagggttcaaagattgaggagtagggaatgcttccagcaggtcgaacaagaaattaatcatcggctgaagaaagcaaaatcgaggcaggagtggtgtgttaagaatcaggctcctgtagccgatgatgttgcagctgatgaggcaaagaggttggcaaaaggaaagagtgttgtgacggcaccagttaacatggtttttaccttgccagccgaattcgggatcgatcaagccgatgtcgacgaggtggaagaggaatcggctaagttggttctatcaccagaacaggcggtgttcgagaagcctgaggggacagagaatcgacatcttaaaccattgtatataaatggctatgtcaatgggaagccgatgtcgaaaatttgatgccttatgctacgttcaggaagttgggtagaaatgccgaggatcttatcaagacaaatatagtgctcaaggactttggtggcaatccatcggaaaccaaaggtgttctaaatgtggagctgacagtcggcagtaagactattcctacaacgtttttttgtcatcgatgggaagggttcttacagcttgttgcttggaagggattggattcacgccaattgttgtattccttcaactatgcatcaatgcttgattcaatggcaagtcgacaaaatagagatcgtactagccgacaggtcagttaatgttgccagtgccgatttagctctttgggagatggatggccttgattgtttatctggaaaagtttggaatggagattttctaaaagtgtccgattctgatatacagccagttgaagttggagaacccaagctattattttgagggcgttgtggagggttcaagtgtctacactaaggatacggtagatgatctcgatgacaagcaaggtgaaggttttatgtcagccgatgatttggaagaaatagatataggtccaggtgatcggccaaggccgacatttattagtaagaatttgtctctagaatttagaaccaagctgatagagctcttaaaagagtttagagattgcttcgcttgggagtattatgagatgcctggactcagccaatcaattgtagaacatcggctacctatcaaaccaggggttaggccgcaccagcagcctccgaggagatgtaaagccaatatgcttgaacctatcaaagctgagattaagagtttatatgatgctggttttattcgtccttgccaatatgctgagtgggtttctagcatagttcctgtcatcaagaagaacggcaaggtgagggtatgcattgattttagagatctgaataaagctacaccgaaagatgaatatccaatgccagtagccgatcagctggttgatgccgtgttagggaacaaaattttgagttttatggatggaaacgcagggtataatcaaatttttatggctgaagaagatatccataagacagcttttagatgttctggtgcaatcggcttatttgaatgggttgttttgactttcggcttgaagagtgctggagctacatatcaacgggccatgaattatatttatcatgatctaatcgactggctggttgaggtctatattgatgatgtggttgttaaatctaaggaaataaaagagcacatagccgatttaagaaaagttttcgagaggcccaggaaatatggcttgaagatgaatccgacaaagtgtgcttttggtgtatcggatgggcagttcttgggatttcttgtccacgagaggggaattgagataactcagagaagtatcaatgcgatcaaaaagattaagcccccggaaaacaagaccgaattggaagaaatgatcggcaagattaattttgttcgaaggtttatttctaatttgtccggaaaattaaaaccttttacaccattgttaagattgaaggccgatcagcattttacttgggggcagagcagcaaaaggctttggataatattaaaggatacctgagttcccctcctattttgattcctccacagaaagggataacttttagattgtatctgtcggtcggtgagaactcaatcggctcaatcttgattcaggagttggatggaaaagaacgagttgtattttatcgcagtcgtcggttcttagatgcagagactagatgttctcctgtggagaagttatgcttatgtttatatttttcaagcacaaggttaaggcattatttactgtccaatgaatgtactattatatgcaaggccaacattgttagatatatgttatcggctccaatattgaaaggaagggttggaaagtggatattttccttaactgagtttgatcttcggtatgagtcaccgaaggcgattaagggacaagctatagccgattttattgtggaacatcgtgatgattcaatcggctcggttgaaatggtgccatggagtttattctttgatggatcggtgtgtaatcatggttgtggtatcggcctagttataatttcccctaggggcatattttgagtttgcttatactattaaaccttatgcgactaataatcaagctgagtgtgaagcagtgcttaaagggttgcaattgctcaaagaagttgaagccgatgctactgaaatcatgggggattctttactggtaatcaatcaattggcaggggagtatgaatgcaggaatgatacgttaatagtttataatgagaagtgccaagaactgatgaaggaactttggctggttactttaaagcatgtatctcgagaacaaaatattgaagctaatgatctggcccaaggggcatcagggtataagccgatgatcaaagatgttaaggttgaaattgcagcaataacagccgatgattggaggtatgatgtgcatcaatatttacataatccatctcaatcggcttctaggaaattaagatataaggcgttgaagtacacactattggatgatgagctttattatcatacgattgatggagtgttactaagtgtttgagtgccgatcaggctaaagttgctatcggcgaggttcatgaaggaatttgtggcactcaccaatcggcccataagatgaagtggttacttcggcgtgcagggtatttttggcccacaatgttggaggattgcttcagatattataaggggtgttaagattgtcagaagtttggggcaattcaacgagcgccgacgtcggctatgaatcctataattaaccgtggccatttagaggttcgggaattgatatgatcggtatgataaacccaccatcaagtaaagggtataaggttatattggtggcgacttgatatttcaccaaggtggtggaggccatttctttgaagaaagtagattctggggatacaacccaatttgttcaagaac

SEQ ID NO: 37474 - DNA, 394 bp, Oryza sativa
  unsure (1)..(394): unsure at all n locations
actccttgatccttaagaaacgtgtggctctgaatctatttgacctcaaacttaagtagtgttagtttttatagccacttgacgatgacacgtctgacgacgcctctgccagagtacaaccacgaggtctttcaagtttcatggtcaagacgacgaatgcctgacgctcaccgttcgcagcgccgcgcgccgccgccgccgccaccgncgtagaaaggatggaatcgatgagagggtggggtggttgagacgggcggtctccgggatggggagtggtcgtagccgagcgagaatccgagattccgagcatgggttgacgctggaaaacggctctacggaagcaggaaaagtcactcaaggaaggaacgtacacaaacacaagcttgggggtgtc

SEQ ID NO: 37475 - DNA, 5481 bp, Oryza sativa
  unsure (1)..(5481): unsure at all n locations
gacttcctggtgtactgtgacgcttcgcgccaaggattggggtgcgtattaatgcagnaaggtcatgtggtagcntatgccacacgcaagcttcggcctcatgaaggcaactaccctacccatgatttggagttagccgctgtggttcatgctctaaagatctggcggcactatctcattgggaattgctgcgaaatatataccgatcataagagtttgaaatacatcttcactcagtcggatctgaatcttcggcagagaagatggttagaactcatcaaggattatgatgtgggaatccactatcatcctggtaaggccaacgtggtcgccgacactctaagtcgaaaaagccattgcaacactcttggcgtccgtggcattccaccggaacttaatcaacagatggatgccctgaacctaagcatagttggtcgtggattcttggctacgctggaagccaagcctaccttgctcgatcgaatccgtgaggctcagaagaatgatccagatatgcatgggatcctcaaaaatatgaaacaatgtaaagccgctggtttcatagaagatgaacatggaaccctatggaacggaaatcgtgtatgcgttccggacgacaaggaacttaaacacctgatacttcaggaagctcacgaaagtccttattccatccaccctagcagtacgaagatgtacttagacttgaaagggaaatactggtgggttagtatgaagcgggaaattgcagagttcatggccctttgtgatgtgtgccagtgtgtcaaggcagagcaccagcgaccggccggacttctccaacctctccaagtaccagaatggaaatgggatgaaattgggatggatttcatcaccggacttccaaaaacccaaggaggatatgattctatatgggtagtcgtggaccgactaaccaaggtagctcggtttattcctgtgaagaccacctatggagggaacaaactagccgaactctacttcgctaggatcgtgagtctccatggcgttcctaagaaaattgtatctgatcggggaaaccagttcacctctcacttttggaagaaactccaagaagagttgggtacccgattaaatttcagcaccgcgtatcacccgcagacagatggacagaccgagcgtctaaataagatcctagaagatatgctccgtgcttgtgttctagatttcgggaagacctgggataagagtctcccctatgccgagttctcctacaataacagctaccaagccagcatacaaatggcaccctatgaagcgttgtatggacgcaaatgctggacaccgctattgtgggaccaagttggggaaagccaagtgttcgggactgataacttgagagaagctgaagcgaaagtcagaaccattcgggagaatctaaagttggcccagtctcggtagaagagttatgcagacaaccgacgccgtgacctggaattcgcagtggatgactttgtctatcttcgggtcacgccgttgcgaggcgtacgtcggtttcagacgaaagggaagctcgcacctcggttcgtgggtcctttccgtatcattgctcgacgcggagaagtcgcttaccagttggagctgcccgcatcattgggcaacgtgcatgatgtgttccatgtgtcgcaactcaagaaatgtcttcgagtgccatccgagcaggccgactcagagcaaattgaagttcgcgaagacttgacctacgtggagagaccagtgaaaatcttggacaccatggagcgcaggaccaagaaccgggtaatccgtttttgcaaggtccaatggagcaaccacgccaaggaagaagctacttgggaacgtgaagacgagctaaagtcagcccatcccgatctcttcgccagttcttccgaatctcggggtcgagattccgtttaacgggggtaggtttgtcacgtcccaaaacgtgtaaataaatttcctaaaagtcaattaaggcttagaggatttttgtatatttcctaaaagcctaaaatgtgtaaataaattttagtggaattctcagagcacaaataataattattaagaaataaacaaagttaaaatgattttataaaaagaaaaaccctaatgggccgaattcggcccatctccctccccctctctctcctctccccgcggcccactcggcctctccctgcgcgcgcgccgctgacgggcaggcccgcccgccaccctcgctgacgggtggggcccacccgtcatcccctttctcccaccgctcccgccgcctcccccgcaccctagcgccgccgccgccgcgaatcccgccgcctcccgccgtccccgcgtgcaataaagtggggggaatcactccccgtgatcccctctcccattccacccaattttgcatccctctctcccttggattcgtttggaaaccctcccctaatcccgccggcgccattgatggagcccgagagcgccacgccggtttccttcccctccggccactctctccctcttccaaccctatttaaaccctccccgcacctccttcgtccgtttctgcctctcgccggccttcctcctcgccggatttgagctcgcgacgtcactctctctctccgccgtcgccgccgagcttcggtccgccgccgtcgtcgccccggaccgcctcccacctcggcgccgcctccttcgggttcaccgcatcctcgccaacctcgtccacctctccgtttcggtcgccaaccaccggagcgccgccgacgccatcgacccgagccgcgccgccgcctccctccactccggccgcctcctccgtcgccgccgtcgacctagggtgagccgtggaccgtcgcctcctttcccccttccctcccctctctcggccgccgctccgccgtgccggtggtcgccggcggcgaccatcggggcgcgggcgcgccgcctcccgccgaccgcgccagcgtggccgccctcgtgcgcgccgagtggctgccgcgtggggcccggccgtcagccgcccgcgcccttgggtgcggctgacacgtgggacccacggcgccggctggtgcgagcccaggtgcgcccggtccactgtgggccgtgaggctgccgcgtgggccccactcccgtggacccggtccgcgcgtcccctcccccttggctgacgcaataaacccctttttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgttcctgcttgttatatggagtttattagagtaaaagccttttctttttcgttggtcgtgtagatgctgcagcttcggaagatccgctcttcgtggaggttgaagccgacgtttgggaaagcgagcaaggcaagtcacatcatccttgagcatattgaatcctagtttataaaattattttgatttaaattattgcattatcgctttacttaaattcacgcgttatcactgttttatctagccatgcctatttacctttgttatgaccttattattgttattgttattattaccttgttcaccctagattaaaccaaaccccaactagtggacactctactcatggtaccactagtatgcttttaggtagatgcttcgctggttaattaggcaacattaggtggttttacaactctagactttgggagtattctcatcacctggacactatggaattgttggatcattgtggaattggattcacacctccccctctattcaaaatcctcaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctagggcaaatgaaggctacacgagctgcggcccggtagtcgagatgtcatggcacagggctggtgtcctgctgctaggggctcagtcctgcctacctgtcccgggggttccgcccgtaggtggggttgggtcggtactcttgtctatggctaggatgggttggaaactatgtcacgtcttccgtccgtataccatggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatattgtatagctctaggaccgtgtttacaaaatagctttgagcaactaagtgtcttttagtgtagtttactgcaaaccctaaccccctatattatggctcccttgtactcccttgcatttattctgcacttgtggttttgtcttgttgagtacggtggttgtactcagtcttgctcaatttttcccaaacccagaagaggagcccctggaagataaaggcttttgtgtctagctcgtgcctgccgtcaagcgcctgtggtcgtcgccctagtcttccgctgtttttcgtttgtcttcttgtgtgctgggccttcgctgcccatgtaataaattaactatgtacgcttccgcttgtcaaactctgaattgtatcaacttttggtgtaccttgcctcctgggacaaggaataatgcacacacataaggaacgcccgttgggttatttccggtcgtgacatttgccgatgtacaatagccgatattgttatatcacccttagttgttttataattttatcaatgtttttgtcattgtaaaattaggggggcacatatatatcaaaagcatgttgacagaaaacacgaggcctgggagatctgcttaaatccagtgctggtccaaagctcgccttcgaatgtatgagcgtgccagttgatttgatcctgtaatcaacaagaaatagaagcaaagaaaccgcagttaaatctataaatgatagccgatcggctaggtgccgatgacatatcatttatctttgagccgatgtcatatatgcatcgatcggcagtcattaataaataagaagggactaaatctactcgattggctgtagatattaacaatatataatcattatatcgatatatacttaaatcaagtgattgggatagatcggtcgccatgccgagacagaataaatcacttagatcggggctgc

SEQ ID NO: 37476 - DNA, 6731 bp, Oryza sativa
cgacttcaccatgtttgacaaggtattgactagtaccccagactgattcttggaagttgttaaattgtatatgtgcagtgttaccatctgggctgagatcctcatctttcactccctgagaacaatcacccttatcacctgagccatctgcagcacttttatcacctaattgagctgtagcatctgaaacctgttctacctccccatccttggaagaacttgtcctaggaacatcagcaactaatttcatcttatacctctaaacaattgttccttggcgggtctccatgaatgagttcaagaattggttctgtgtttgctgcatcatcgcctcgagattattcttttgttcaagtgtcaatttgtctatagtgacgggcacgatgttgctttcatgaacttcggacccaccaagcttcgggatcctagatttgggaggaccctcttttgccagccgaagatggcgatgctggtggtttcttagcgatgagagaatgctattgcggttctgacttctaatctctcccactgggcgtgccaaaagcgtgttgacataaaaacatgaggcctgggagatctgcttaactccagttataaggttatgtctaagggagcatatatgttgcaagggcttgatggtgaagtctatgggcaagcgctcaatggcaagtatttgaagaaatattacccaagtgtttgagttaacgcatgatcggctagtattgccgatgcatgacagccgatgtgtttgcatcgccttgagatggccgatatggttatatcgcccttagttgtttttcatggtgtaatcggttgtggtttgccgatgtacaatggccgatatggttatattgcccatagttgtttttcatggtgtaatcggttgtggtttgccgatgtacaatggccgatattgttatatcgcccttcgttgttttataattttatcaatgcttttgtcattgtaaaattaggggggcacatatatatcaaaagcgtgttgacagaaaacacgaggcctgggagatctgcttaactctagtgcaggtccaaatctcgccttcgaatgtatgagcgtgccagttgatttgatcctgtaatcaacaagaaatagaagcaaagaaaccgcagttaaatctataaatgtagccgattggctaggtgccgatgatatatcatttatctttgagccgatgtcatatatgcatcgatcggtagtcattaataaataagaagggactaaatctactcgattggctgtagatattaacaatatataatcattatttcgatatatacttaaatcaagtgattgggatagatcgatcgccatgccgagacaatataaatcacttagatcgaaatatatattaataatgagtctatatacgttcatagcataaccgatcagatagatctagcatgtatcggctaatactccgataccactctatattaagatattaaagcaagtagaatatactaaacaaaagcctaatatacttaaatgcagcaagatcttaacgtaaagggcagatttaacatgtcaatcaagcatataggataaaaagtagttaaatcaggtaagatcggctgaaactccgatactaccctaatcagcaaccaagaagcgggctagagattgagattataatcacgactcataagatcaaacttaactgatgcagctataagtatgaaaagaaggacaatatctagacaatcaagccattggatgtgtcatagagtggtagatatcctatataatctaagtcaacattggtatttaacctaatcggctgccttctattgacggatgttggccgattgtaggttagatatcgatattgccaaggattatgtaggatatatgataactcgacgaaatacataaacaagattagagtgtcataaagatggaagcactaatcccaagaacgcaagccgccataacaagttttacctcttgttgaagatcgaaaccgatgcagctcaacccgaaagcaagaactcgtcgaaataaaactaaagcaaaaaggtagcgttgcgccgggattgtattgaacgtgtgtgttaaaagtaacataggactcgggtctatttatacccaaaaatcacaagatatgtccataacggacacgactactatctctaagaaactctaagataccataagtctgtacggcagacttttgcccaagcatatctccaaggagattacataaaacatcctaattaatagatacaattgccttctcaggactctatccatgtgcggcaatcacctcgaagcgccttaattcaacccgatatcatacatcagtatgcattgtcaaaatcggctgcatcggcttacctagcccgactcagacccagccgatcctaatcgtagccgatctggactccagccgattcctgttctatttctgaactcgatctccgcctccaactatgcttcgatctaatcttctttcccaatgccgatattacaaaatttggttgttaacacatgccccccaagtccggaatatttgataatttttcggatttgctgtaaatcgactctgagcaagtttcgcactttgccgttttccgaccattactgccgtgctttaaatactaaccattaccctcgagaaatctcacaccgtcctcctccgttttcaccgctgaaaccaactttgccctctttcgctccggcgatctccccaatgcacaaggcgatccctaggcgatttcgttcccgactagatctccgctcggggcgatgtcgtcttccaccagcccttctaatgcaccatcgggcaagtacgctgaggtaagtcctcaccagctagatcccttttcctctcatgaaattgatttctccttttcttctcatgttttccgcatcccgattcctttggatttgcagcacctttccaacctagtcgcgattcctagcctttcacacaaaaaccactattttcttggcccattcggcaatctcgaccccactgatttcatcatcggtgaaaccaatcggatcccctttagactagccaaccctaacctgggtcactggaagaatacattcaagtcttggccatctctcgaaaaacctactcctgataagagctagaccacctggtaccaacgcgtatcggctagtaagaaagttcactgggatgaaattggaatcggccaagcactcgctttcaccatagccaattctgctaaggatgaacctctgatggctgccgccacctacttctggtccaacaccatcaatgctttcttattcaaccaagggccgatgactccaactttaatcgacatcaccatgattactggattagatgtaacttcatcggctaaccctatgagtatgaacaccaagaaccaatttgacttgaagaccaaaagcataggtggctggtctggctatgtggcggcatatatgggccaagggtctgttacccctcgagagcatgtagctttcttgctgatgtggctggaaaagttcctcttttgtggatccagttgtggccctacaaccaactggcactctgtagctgaagccttagaatcaaagaaagaatttcctttgggcaaaatccttctcggctatctgtaccagatattgaacaatgcatctgctaaaatagccgtcggctcaatagttggagcaggtggaccatggtggctactgccaaacttggttaaacctgatagtcatgaaggttgtcaatcggccctctgtgacaaaagctgaattcccattgccagagccgattgtggaagatgacggagaagagcgcacccatcgcagatgcatgtcatatggagaatatgcatccacaccaaccgatgctggagcgaagctatcggctgagctactcaaggactggttctgcagcttctacgaaggttttaagaaagatgcacgaatctggtttccttatgaagactcagcagaccttgaacttccatcagactttagatttgaagacattaatcatgaaaaattccaaaaatccagagaaattcttatagctgcaatcagcccatgcatcttctctgtcggcattcaccatgggagaaacatccaagtctcctacgagttttatcacccacttggattgggccaactcccaatcggcttattctttgccgacaagattcagtgccgaggacaaatcacatccactctaatgatggatcggctacttaacctaccaggaccccctctgggcagtattgataatattgagttggcaggatttagaagcaaaaactttgacagatggtggggtaaatggaagatgcatctattttatcaatcggcttcaatgtatatgacagatctattccctgacgtcataccccaggtaaactttgtcattaccaaattgcataactagttagccgattcattacttgactaatctcttgctcctgttttgcagacaacagagtcctcccctcctcatcaaagtaatagttgcaggaacattgaatatgcttcaggtttaattctgaatggaggtggactatctcccccttttatcggctaccatgcccccaagacttcaactttccttcacggcctaactagggaaccagccgatgcaggcaagaaaaggaaaaccagatcatcagccatgagtaccttagccttggctccaaagaaaaagaccaaattcaagaaaactcaaccacaaccaactgatatgtcgactgatgatctgcccgccttggatccatctattaaacaagctttagatgaagaagaaattggtgaagatgttgaccaagctgtagccaaaatgagtgacacagaaagaacactatcggctttacccaagcaaacgcctccaactccttctgcccccgtttattttacataagtaagtacctctctctttggctaattacccatagactttgtggttgcagaagaagaaaactactgtgaagaaaaaaccagcagcaacaattgttaaatcggctccaccagtaagatgtccttaattcctttacttaatcaatctcaaccgattctatataacacttgtctatttcgcagcctcctcctccttctcctcctgtacagcaatcgtcaagtaatcagactccatcggctgtggggagtcatcacgtcgaagaggaagaacaaccagctgcttctgctatcccagtaagtttccctttgtctcaacaattagatcagctataatttacccagctcttattctttccgaaattgcctctgcaggctctagccgatctcttctcttttgacatcagagattaccttgatgaggcagaagaagacacttcaagcaaagccctagctcccctatccgatgatgtgagaaaaacacttgaagacatctctcatcggctagaagcctcttctttagacaatttggtagttgactttgggtcaattaggacgcggctgcatgaagttcaagctctgattcccgaagatctggccgatgtcctaactccagccgtttatctcgagcaacatcagttcaagctggaaaaagccaagctaagactagccgaacgccatgagcgcaaagagattaaggccataatccaagcgaattggcagcttgtgcatgaaaaaaaaaccaaacttgatcagctatctggaggtccaatcaaatccaatattgatcggctcgaagctcgcaagattgagctcttggcgcaacttgaagaatgcaatgccgagctagatatggaacacagaaatctagccgatctcccaaaatcaattgaagaacaaaaagcaaggctcaaatcggctatcaaaaatgttgctgacctaaccaagtccctgaaagtcatctctggaactgatgctcaagatgcccaagctattgtagaagtagaacaaattaggcaaaggcctattttggctatccagcgatacttgtctcaataacttttgtgtaataggactcagaaattttttgtaatcagctaagatgctctagtactttactgtcctgaaaatcctttgtgccgattaatatgactttgaaattcgctaaaaaaatttgcctcaaaaaatttgcattgcattttgatatatatgtgcccccctaattttacaatgacaaaagcatggataaaattataaaacaactaagggcgatataacaatatcggaaattatacatcggcaaaccacaaccgattacactatgaaaaacaactaagggcgatataaccatatcggccatctcaaggtgatgcaaacacatcggctgtcatgcatcggcaatactagccgatcatgcgttaacccaaacacttgggtaatatttcttcaaatacttgccattgagcgctcgcccataaacttcaccatcaaacccatgcaacatatatgctcccttagacacaaccttataaatttggaacagtccttcccaattcggcgaccacttgccgaatttactatcacgagtaccaatcggcaaaatcaatttccatataagttctccttccgaaaaatctttaggtaccactttcttattaaaatgccgagcaatacgttccttatccttggtaacctttgcaagggctcgcaatcgtcactgaaccagatcctccctctcatcggccataaggttgtaatactcataagctgttaaatcattttgtaattccgttcttcgagagccgattctaacctcccatggcaaaacagcctcatgcgcataaagaag

SEQ ID NO: 37477 - DNA, 1643 bp, Oryza sativa
atgcatcggctaaaaagccgttggctcaatagttgaagcaggtggaccatggtggctcctgcaactttggttaaacctgatagtcatgaacattgtcaatcgcccctctgtgacagaagctgaattcccattgccagagccgattgtgaaagatgacgaagaagagcgcacccatcgcagatgcatgtcatatggagaatatgcatccacatcaaccgatgctggagcgaagctatcggctgagctacaaaaggactggttctgcagcttctacgaaggttttaagaaagatgcacgaatctggtttccttatgaagactcagcagaccttgaacttccatcagactttagatttgaagacattaatcatcgaaaattccaaaaatccagagaaattcctatagctgcaatcagcccatgcatcctcccagtcggcattcaccaagggagaaacatccaagtctcctacgagttttatcacccaatgagcttggccagacgacttggattgggtcaactcccaatcggcttattctttgccgacaatattcagtgccgaggacaaatcgcatccactctaatgatggatcggctacttaacctaccaggaccccctctgggcagtattgataatattgagttggcaggatttagaagcaaaaattttgacagatggtggggtgaatggaagctgcatctatttcatcaatcggctgcaatgtatatgatagatctattcaataacgtcataccccaggtaaactttgtcattactaaattgcataaccagttagccgattcattacttgactaatctcttgctcctgttttgcaaacaacagagtcctcccctccacatcaaagtaatagtagcaagaacattgaatatgcttcaggtttaatctgaatggaggtggactatctcccactctccttcacggcctaactagggaaccagccgatgcaggcaagaaaaggaaaactagatcatcagccatgagtaacttagccttggctccaaagaaaaagaccaaattcaagaaaactcaaccacaaccaactgatatgtcgactgatgatctgcccgccttggatccatctattaaacaagctttagatgaagaagaaattggtgaagatgttgaccaagctgtagccaaaatgagtgacacagaaagaacaccatcggcttcacccaagcaaacgcctccaactccttctgcccccgttcattttacatgagtaagtacctctctttgacttcttctgaaattacctccctctttggctaattacccatagactttgtggttgcagaagaagaaaactgctgtgaagaaaaaaccagcagcaacaattgttaaatcggctccaccagtaagatgtccttaattcttttacttaaacaatctcaaccgattctatataacacttgtctatttcgcagcttcctcctccttctcctcctgtacagcaatcgtcaagtaatcagactccatcggctgtggggagtcatcacgtcgaagaggaagaacaaccagctgcttctgctatcccagtaagtttccctttgtctcaacaattagatcaaaaataatttacccagctcttattctttccaaaattgcctctgcaggctctag

SEQ ID NO: 37478 - DNA, 15594 bp, Oryza sativa
  unsure (1)..(15594): unsure at all n locations
ttgggaaaataaacaaatttttgaaattagtaaatttgtcttgaacaataagtgttaaaaacaaaccaggggttaatcttggagattattagtgcggtatttctctttagctatattttccagcaatatccaattattaacctcgctcattttcgaaaaagaatattgtatctatactattaaaatttgagtaatattaattaacaatataaacaaactatgtctacactataccctaaaacaactcagaatataaaaaacaatttattttcatcaccttcatcttctctttgtccttttttgaagggcatcatgcatgataatagagcatgctatgcaatcataagtatagctgggacatacatatagtgggctgagatagtctcaatgagaggatacctttggcaatagagctcaacttcctacccaggagacaattctctatgagggcacctataattaattaggcattaaaattatgctccacgctggtctagagaggcacggctatgagaaacccatatctcacggcagcagggaagaaagccttggcgcccgcggtcaacttcacccactacacgaatattcttatctaatttaacgttgttatcctattaattgatagaagaggtattgttagaatatttatacatagatttggaaagaagtgagacatggacactcatctaaataacatagatgattttttagttaactaataatgtattaatcttattgtaatggtatgatgtagtttgatctattaaatatactctcaactttcaaaatcaatgataatgataataagtatccactaaaacaatacaattgtcatgagaagaggtgacaatagaaaagtgatttttattttaaaattaggagacactcttatgatctagtatttttgagacggtatagatgtttttttattataagataatatataatactctacaatgaatatggcaagttgatttattttattattcttttcatcaataaaaaataagatgccaacctttttcctagctagaaagaaagattacaaatgatttcttataggcatgaattaaatactaaataatttcaagttaccaaatagtttggaaaaaaattaccgagcgatgctaatgaagaaattttttgaagaaattgtacttttgaagcatggcaggtatcatctggttatattccacttatataggtttccaaaacacaacatgctatacatgcccgcgcattgcgcgggctaccttcctacttattttggaattacacttaaaggcatttatgaatggcaacctatcctattcagacaaatttcaaatgctaatcgccgtggccaccaactttacaaaaagtaacaaaataataataataataattgcacactatcaagcacctacgtataaaagtttcaaccctaaatttgtgttggtacgcagagtgaatatactcagtgatcttttattctttaattaccttttgcagttgagaagacacagatggggagagttgggaatccggtaacagtcgatatgccagagatattgacgatgttgcccttgccggaggccttgaggagagggtgcaccagctggcttaggtggaagcatgactccaggttgcccgccatcacactggagagctccttcggtgtcacgttcaccgctggttttaggaagaagaagccgacattgttcacctgtaggtaatttaaattaagtcatatctaatagcgatcgattgcctgcatttctagcagatttaatccatacttgcatgcctaaattatttacccttcttttgggagtgtttggtcgcttgatagtggtaagaccgggtcaaaagaagaaatgcccaggctagcatcaaccagatgtgagaatacaattgtgacttgtttggttgtttagctatggtaagtctgtatatgtttaaagaaattttatagccgtgaaaggtataaaaaaatttagtgtaaatttagtacctcctaataccgagaggtccaaattttacagtagaaaatatgatatttttcggtaccttctcatagactataaactcactcatatgtttaggatgttgtttgattaattgcaccggagatgttgaataagtagtataagaaaaaactattagaactagtttagctgtctaagaacaatttaatatattttttttgaacgaattgcaccggacgatgcaagttttatattaacaagattaccaatttgggaggcaataatcaggaaaagggaaaaaacaccaaagcaataccaacacatgccaactgcacctgcacacactccccggaaaggatctagcatcaagccggcctccgctatgcatgattggatgccgctagccccacgaaggggtcacaaacgacctttctaagccaactccaaccaaaagatccccccataggctctgagccatcgccacgtagaagggttgccaaaagagagggcgagagagaagaagatccactcctcccacgagcaaaccggatggcaacatccaagaatgttgtcgaagactgaaagatcgaatgttggataggcaacagagccgcccatccagaagaggacttggttttcacccgaggtcctgctagagggagaggtaggcctctcaacaacgcccttaggagggattgaaacgttgaagacattgtcgttgtttgcccagacaaggtgtcaagcaaggctttcgcctatagccgatctcctcctcctgttatgacaccgacgtcctgccaccgtcagacctctgctagcatgtgctctctaccacactgatgcccctccgtcgactggccatcgtcgcaccgggagcaccactgcaccgacgaccctcatcggctcctccgcacgccgaccgtcccaattctacaacatgaagcaacgagggaggcgagtagaacacctccagtgctaggcaccaccaccatctctacgctagagctctccacgaccgtatctggagacagaacggctaaaggagggggagcactaggggaagaaggggcatgccaggcaaagaggggagacccatcgtcgttgccaattttgtgccgccaccatagggtccagctcaccgtcacccccggcctcccactgatacccacgcgcgcggcctcacgcacactgccgtccactgcagctagctgctccgtcctcccgccggcctctccctcctggtggctatacgcatggcccgcaccgctactgcccgcccgctaccgccatccgtgcccagcctctccctcccagcagctaccatcgtgcctctcattgccttcgccccccgctgctcgaccccagctagatccgacgcggaggcactagatccagccgtaggagcatcagatttggtcgcggaagtgccggatctgccacctccctcgccggggaggatgtgccgctgccacctccaggtctccggttcacaactcgtcacgctgcctctcccacgctcgagacagggcgcctctacgataaggcccctccaccgccatcctggctcatcgcccggttctccgacgacacgctccggcggcagcgaggtggggggatggggaaggtgcggcagtgggggctagggttttgtccctgagtcgcctaggcgtgggtgacgcgagagcctagaacaatttaacacatactacctctatcccaaattaattgtgattctaggttgtttagtgttggaggcatgccatgaagcccttcgaccggacctgccgaaactatagtaccagcaaggattcaagccaaagatgtcaaggccattcaggcgaagccctatggcgaaagccataagcgaagatggcgaaggctggaaagccgcgtcggtattctgaaagtaaaggcatctcgggtgaaggcatcttcggcgaactacaaagacttcgccatgacgagttcggcatcaaggaggcccaacaggccgcccctggccttttaagcccgtttgccatagaccaggcccagcctatcagcccattaaaggcctatatgtgcaaatgacactgcatacccatgtaaatgtccctttcataagggcaaccatgtaaaatcccctgtaacactaaaccctagaaagtgcaagcttgtgctaaggctataaataaacctctagggccatgtaatggggggatccccaaaaaatatttcacgaatcaatacaattgcttttacattccaactactgttgagagaaccacgcctttcgacatggcatagttgtacattcgacaacagctggcgccgtccgtggggaacccagaccgaaaaggcgaaatgggacccctttcaccacaccctttgccacagtacccgcgtggtacggcgacaagggctgggggcgaaagtgagttaagtccaagttggggggctacgaagccgcccaagcctctggacacctttcgccacatgccacgcccttcgccatagtaccaataaggcacggcgtcaagggctgctggcgaacaggtttcgccaacccacgcccttcgccatagtgccaatatagcacggcgtcaagggctgcgggcgaacaggtttcgccacacgccacacccttcgccatagtaccaataatgtatggcgtcaagggttgggggcgaatataagttgcttccaagctggggggctacgaggccaccctagcctctggagcctttcgccacacccacacccttcgccacagtacccgcgcggtacggcgacaagggctgggggcgaaagtgggttaagtccaagctggagggctacgaagccgcccaagcctctgtcgcgaccgagaaaaatacattttcccaaatgctagtgtattaatccccgtcccaggaaaagccgaggtacaccacacaaacatgatacaaaaggcacatctttattatatcgataatatttacattattacaaaggcacttaaggcctgacaatcaaaaataaacagcagcggactagcgggcctacggctccatcttcacaggtgctcaactggggtataatccaggactccacctaagacttcttctccaaagcttctcttactgaagggggggaaagattgagcaagaatgagtacaaccacagtactcagcaagccacaccggcggatgcatgattaatacaagggggtacaaggggtaataatataggggttaagttttgcagaaaacagcatttaaaagtcacttagttgcccaaagccattttataaagacgatcctagagttacacagtgttattaatcaaggccgtgaaccctcacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctaggcttgcccataaccgagggcgcggctattcgaataggttttactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacccccgggacaggcaggcaggattgaacccctagcagcaggacaccagccctgtgccatgacatctcgactaccgagccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcctgagcttaatccttatagtacccgaggtacgactaacaaaacccaaccacgcacctcgagcccagcctaaaaccattttgggggttttgaatagagggggaggtgtgtgtccaattccatcataagccaaccattccatagtgtccaaatgatatgagaattcccaaagtctaaagttataaaaccacctaatgttgcctaattaatcagcgaagcatctacctaaattcatactagtggaaccatgaatagagtacccactagttggggttttgtttatcctagggtgaacaaggtaataataacaatagcaataataataaggtcataacaaagataaataggcatgactaaataaaacaatgataacgcgggaatttaaataaagcgataatgcattaatttaaatcaaaataattttataaactgggattcaatatgttcaaggatgatgtgacttgccttgctcagagagaacggccttccgaaccttcggcgacgaccacaaagcacgcttcgggaacctccggaacgacagaagctacgcgaagcacacaagcaaagctacaagcctataaagaagcaataacaatatataaaaagaaagcacacggttctttaggttataacaaacattaagagacttgaacgggtcgattcggagctcgtatgaccaagatatgatcatccgaagtttaatgctgttatatggagatttgcggattattataattaagctttgcaactataaaacatatggaagcgctagcctggaaaagacaggaaggctgcgctgttgacatgcggaccccacatgtcaacctaaaggaccgcggtagaccgagtacacagagacggtccacgggtcgacggaagcggaccccgtgtgtcaaccgaggcgagtggccgacaaacggactccactagacaccacacgggctgcacacatggaaaccacgcggctactgagcggacacactaacacggacactacacggtcaccacccgcacacgtgaacgactaccgacaccggtacacaggtaccggggtcgacaaccgcacaacgggtacggggcgacaccgaaaggacgaggacggggcagcgagaggagagatccttaccaccacgcgacaaggcgtgggaaagacaacgacgaacgggtgcggcggagacggacggcgagggaacgacttcggcggcgatccttgaacgaaggcgagacacggccggcacgaggcttgacgacgcggaggcgaggacgaagacgatgatggggctgcggcacttgacgaagcgaggacgacgaacgagaacggctggacggagggacgaacgccacgacgaccaggaacgacgagagggcgacgacgacgacgaccggggccggcgagaaagcgacgagggcagccggcagcggctgcacggagacgaggacggcgcggaacacgccgctgcgatgccgacgacggaggcggcgccgcgagacgacgagccggcgaggaggaacgatgacgacgacgacgaacaccggcggggttcggtcgaaggggagacgaggccgagggtgaccttgccgctgcgatgccggaggtggtggtggcgcagcgagccgatgagccggggaggagggaggggcggccgaagggacgccggcgacgaagaggatggagaggccggcgcgggcgacggcggtctccgaacgaatcatagggtaggccggggtggaggtcgacgcggcgacgccgagggaggagacggcgcggccggcccgcacttgagcggtgcggcaggggcggctggaggcagtgggtggcggcaatgccacccgttgccggtggggacgcgcctccggcggtcaccgcgcgaaacggagggcaggccggggagaggaggcggctgcgacgccggggaaggcggcggcacggccggccggcgcacgggtgaggagggagaggcggctggaggcggttgacgtgggggaaagagaagggcgacgacggggaggggtgatacgaccacggggaggctcgggatgaggctaaaacgagagaacggagcgagggggttccgttttataggcgtggggagggagctggccacgggaggagcggggaacggtggcagaaaaggcgcccggcggccatggaaggcggccatgaatggcgcagccgttccggtcaaaatagtgcacgattaaaggggagattagggggaaaagggagaggaaggaaaggggattaattccccccaattaattttggaatccaatgcttaaatcgtgcggtttcgagggaggaacgaactagggttttcacgggagagagaggaggccgtgcgggaggaggaagacgaccggcgcgtgggccccacgcggtcagcgcgcgcagtcagcgcacgcgcggcgcgcgtgcacgcggctggcttggctcggcctggcttgggccgggctgctgggccgaggcaggccgagaggaaggaggaggagggagtgagctgcccgggaggaaagagagaaaaacaaagagaggggagagggatttggactgtgggccgagggggagagagggagactttgggccagacttggcccaaagggaggagggggattatttttagctttttctttttaataaactttgttaattgttgttgtttaataaatattttcggtgctctgaaaattcaagtaaaatttgagggctccttttagaccaaggagaatttaacaaaaattctccggaccacattcgaatttttctagcaggtattttagtgtttgtcaatttctttttgaattttaattaattctattattccttttagaaaataatttttatttcgggatgaatttatcagggcgtgacagcctctgcacacctttcgccacacgccacgcccttccccatagtaccaataaggcacggcatcaagggctgcgggcgaacaggtttcgccaacccacgcccttcgccatagtgccaatatggcacggcgtcaagggctgcgggcgaagaggtttcgccacacgccatacccttcgccatagtaccaatgaggtacggcctcaagggttgcgggcgaggaggtttcgcccacccacgcccttcaccatcaaaccaatgaggtacagcgtcaagggttgcgggtaaagaggtttcgtccacccacgcccttcgccatagcgccaataaggcacggcgtcaagggctgcgggcgaacgggtatcgccaacccatgccctgcgccatagtaccaataaggtatggcgcatggccttgcaggcgaagaggttacgtccacccacgcccttcgacatagtgccaataaggcacggcgtcaagggctgcggacgaacaggtttcgccaacccacgcccttcgccatagtgccaatatggcacggcgtcaggggcagcgggcgaagaggtttcgccacatgccatacccttcgccatagtgccaatatggcacggcgtcaagggctgcgagcgaagaggtttcgccacacgccatacccttcgccatagtaccaatgaggtacggcatcaagggttgcgggcgaacaggtttcacccacccacgcccttcgccatcgaaccaatgaggtacggcgtcaagggttgcgggcgaagaggtttcgtccacccacgcccttcgccatagcgccaataaggcacggcgtcaagggctgcgggcgaacaagtttcaccaacccacgccctgcgccatagtaccaataaggtacggcgtcatgggcttgcgagcgaagaggtttcgtccacccacgcccttcgccatagtgccaataaggcacggcgtcaagggctgcgggcgaataggtttcgctaacccacgcccttcgccatagtgccaatgtggcacggcgtcaagggctacgggcgaagatgtttcgccacatgccatacccttcgccatagtaccaatgaggtacggcgtcaagggttgcaggcgaagaggtttcgtctacccacgccctttgccttagtgccaataaggcatggcgtcaagggctgcgggtgaacaggtttcgccaacccacgcccttcgccacagtgccaatatggcacggcgtcaagggctgcgggcgaagaggtttcaccacacgccatgcccttcgccatagtgccaatgaggtacggcgtcaagggttgcgggcgaacaggtttcgcccacccacgccctttgccatagtaccaataaggtatggcgtcaagtgctgggggcgaaaataagttgcttccaagctggggggctacgaggacaccctagcctctggagcctttcgccacacccacacccttcaccacagtacccgcaaggtacggcgataagagctgggaacgaaaatgagttgcttccaagcttgtcacgaccggaaataacccaacgggcgttccttacgtgcgtgtattattccttgtcctaggaggcaaggtacaccaaaagttgatacaatatagagtttaacaagcgggagcgtaactagataatttattacatgggcagcgaaggcccagcacacatgaagacaaacgaaaaacagcggaagactagggcgacgaccacaggcgcttgatggcaggcacgagctagacaccaaagccttcatcttccaggaactcctcttctgggtttgggaaaaattgagcaagactgagtacaactaccgtactcaacaagacacacccataagtgcagaataaatgcaagggagtacaagggagccataatatagggggttagggtttgcagtaaacagcattaaaagtcacttagttgctcaaagctactttgtaaacacgatcctagagctatgcaatattattaatcaaggccgtgaacccacacgaacctgccttaacccaaggcctacgatgattcagatcgaactggcaacccaaccctgggtcccagctcgtcccaagccaacccaggccaaccattccacattttagttgttaagcaggttttatgaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacccccgggacaggtaggcaggactgagcccctagcagcaggacaccagccctgtgccatgacatctcgactaccgggccgcagctcatgtagccttcatttgccctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttgaggattttgaatagagggggaggtgtgaatccaattccacaataatccaaccattccatagtgtccaggtgataagaatattcccaaagtttagagttgtaaaaccacctaatgttgcctaattaagcagcgaagcatctacctaaattcatactagtggtaccatggatagagtatccactagttggggttttatttattctagggtgaacaaggtaataataacaataacaaaaataataaggtcataacaaaggtaaaaaggcatggctaaataaaacagtgataacgcgggaatataaataaagcgataatgcaataatttaaatcaaaataattttataaactgggattcaatatgttcaaggatgatgtgacttgccttgctcgctttcccaaacgtcggcttcaacctccacgtagagcggatcttccgaagctgtagcgtctgcacgatcaacggaaagaaaaaaggcttttactctaataaactccatataacaagcaggaacaaagcacaaaaatgggttcttaacttcttaaggaaaaattagagacttgaacggtccaattccgagttcaaatggccaagttatggccatttgaagttcatatgctctttaaatgaatatttacgaatttcttcatttaaattttaatttaaaaatggtttattgcgtcagccgaggggagagggcgcgcggaccgggtccatgggagtggggcccacgcggcagcctcacggtccacggtccacggtggcccactcggcgcgcccgagtgcggctaaaccggcgcggtcggcggaaggcggcgcccccgtgccccgttggtcgccgccggcgaccaccagcgcggcggagcggcggccgagagaggggagggaagggggaaaggaggcgacggtccacggctcaccccggggcgacggcggcgatgagggaggcggccggagcggagggaggcggtggcgcggctcgggttgatggggtcggcggcgctccggcggtcggcgaccgaaacggagaggtggacgaggtcggcgaggatgcggcgaagccaaaggaggcggcgccgaggtgggaggcggtccggggcgacgatggcggcgtacaagagctcggcggcgacggcggagagagaaagcgacgtcgcgagctcgaatccggcgaggaggaagggcgccgagaggtgtaaacggacgaagaaggtgcgggaagggtttaaatagggttgcaaggggaagagagtggccggggaggtagaaaaccggcgcgggaggtccggccgccatcaatggcgccggcgagatttgcgggggcaaatccgtccgtttgaaaccgagagagagagggaaaaatggggggaaaggaagagggaatcacggggagtatttccccccactttattgcacgcggggacggcgggatgcggtggattcgcggcggcggcggcgctagggcgcgggcgaagcggcggaaacggcgggagcggcgggaggtcagggatgacgggtgggccccacccgtcagcgagggtggcgggcaggctcgcccgtcagcggcgcgcgcgtggggagaggccgagtgggccgcggggagagaagagagagagagggggaaggagagatgggccgggccggcccaagggagggaagggggacttttagggtttttctttttataaaaccttttcaactttgtttatttcttaataattattatttgtgctctgaaaattccactaaaatttatttacacattttaggcttttagggaatatacaaaaatcctctaagccttatttgacttttaactttgcacattttaattgttggaggctttcacaaggattttaattattctagccataatttaaaggatatatttttgggtcattttgggacgtgacattgagcatcacttccagaaatgatcttttgggacttggttaggtcagcgacattcttgatagccgatttaagccttgctttttgctcttcgacagattttgggagatcggctagctttttgtgctccatatccaattcagcattgcattcttcaagctgtgccaagagatcgttcttgcgggcttcaagccaatcgatattggatttgattggaccttcggatagctgatcgagtttgactttgtcttcatgcacaagctgccgattgacttggattgtggcttcaatctctttgcgctcacggcgttcggctaatcttagcttggctttttctagtttaaattgatgctgctcaagataagcggctgcagttaggacatcggccagttcttcaggaattagagcttgtacttcgtgcaatcgtgtcctaatcgatccacagtcgaccactaagctatccagagaagaggcctctagctgacacgagatatcttcaagtgttttctttgcatcgtcagataagggagctagagctttgcttgaagtatcttcttctgcctcatcaagataatctttgatatcaaaagagaagagatcggctagaacctgcaggtataagtttagaaagtttgagagctaagtcaatatagtcgatctaaattcttgcatcaaaggaaaacttactgggatagcaggagcagccgattgttcttcttccacaatatgatgactccccacggccgatggagctcggtcactcgatgattgttgtacaggagaaaaagaaggagcaggctgtaaaaagacaagtgttagaaaaaatcggctgaaatcaactagtaaaattgagagtgtcttactggtagagctggtttgagaattggagctgccgatttcttttttatagcagttttcttcttctgtaactacaaaacctatgagtagttggttgaagaataatgattataaaagggtttgcaaggaaagatgttttactctgaagaagtgagtgggggcagaaggagttgaaggtatctgcttaggcgaagccgatggtgttttttcagtatcacttacttcggctgcagcctgatcaacatcatcctcaatatctttttcatccacagcttgttcaatggatggatccaaagcaggcatgtcgtcggttggcttggttttcttagacttggcctttttctttggagctagagtcaaggtgctcacaaccgatgatctagttttccttttcttggttacatcggttggttctctgatggcgccttggaggagggttgagaccttgggggcatgatagccgatgacagggggagacaattcgcctccattaggaatcagacctggggcatattcattgttcctaccaatattgctctgatgtggacgggaggactctgttgtctgcaaaacagggacaaaagattagtcaagtaatgaatcgactaaccgttatgaaatttagtgatgacaaagtttacctggggtatgatgtcagggaatagatctgtcatgtacattgtggccaattaataaaatagatgcaatttccattcaccccaccatctgtcaaagttcctgctcctgaatcttgctaactcaatattatagggtaatagaattcgtaggagacttggatatttcctccttggtgaataccgacaggtaggatgcatgggctgattgcagctgtaaagacttccctggacgtttgatatctttcatgattgatgtcttcaaatctgaagtctaataggagctcaaggtctgctgagtcttcataaagaaaccaaacctgggcatctttctggaagccttcaaaaaagctgcagaaccaatctttgagcagctcagccgatagttttgcaccagcatcggttggtgtggatgcatattctccatatgacatggatctgcgatgggtgcgttcttctccattgtcttctacaattgggtccaaccttgggaattcagcttctgttacagatggccgattgacaactttcatgactacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 37479 - DNA, 1078 bp, Oryza sativa
gtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttgaggattttgaatagagggggaggtgtgaatctaattccacaataatccaaccattccatagtgtccaggtgatataaatatcccaaagtctagagttgtaaaaccacctaatgttggctaattaaccagcgaagcatctacctaaaatcatactagtggtaccatgagtagagtgtccactagttggggttttgtttaatctagggtgaacaaggtaataataacaataataataataaggtcataacaaaagtaaataggcatggctagataaaacagtgataacgcgggaatttaagtaaagcgataatgcaataatttaaatcaaaataattttataaactgggattcaatatgctcaaggatgatgtgtcttgccttgctcgctttcccaaatgtcggcttcaacctccacgaagagcggaaaagagaaggcttttactctaataaactccatataacaagcaggaataaagcacaaaaattggttcttgacttcttaaggaaaaattagagacttgaacggtccaattccgagttcaaatggccaagttatggccatttgaagtttatatgctctttaaatgaatatttgcgaatttcttcatttaaattttaatttaaaaaaggggtttattgcgtcagctgagggggagggggcgcgcggaccgggtccacgggagtggggcccacgcggcagcctcacggtccacggtggaccggttgcacccaggctcacactggccggcgccgtgggccccacacgtcagccgcacctgagggcgcgggcggctgacggccgggccccacgcggcagccactcggcgcgcccgagggcgccacgccggcgtggtcagcaggaggcggcgtgcccgcttcccgatggtcgccggcggcgaccaccggcgcggcgga
